United States Patent 9,328,346 (POLYCOMB-ASSOCIATED NON-CODING RNAS) - sequence listing, part 155

SEQ ID NO: 192733 - RNA, 181375 nt, Homo sapiens
agagcggcgcgcgcggcagccccgaggcagcagagcgcggagccgggagcgcggggagcgcgggccggcggcggcgagggaggacgggggcgcagacggccggcgcgcggcgcggcuaccaugggcgugcggugagcagccgcucgggacgacuuccucggcugcgcggcgcucgcgcggagcuccccggccggcggugcguccccacggucaccaugaaagguagggcggcggcagcuccgcggggcucugggcggggggaacgggcuucggggcgcgcgggaggccacggaggugccucccgcgcgaaccuucccuugggcugcgggcccggggagucggggcugccagggcgccggguucgugcgcggacacugggggcgcacccggcucccgggucaggcgcggcuggagaccucgagguugggguuuugaagcgcgcaaguauuccccuccccaucgcgucuuugcaaguaguuugaagcccuaagucguuguuuacggauucccguuuccaacuuuuuaauugaaaaaaccugccgaggagaguggaggcaucgccaucccucccggucgcuuuuccacgccgcagcgcuccccacgcucgcccaguccucucuccucccgccucuagccguuucccggcccgagcgguccccgcgcuggcggccggguguuuucuccgggacuggggauguucuccgugcgcccucgccacaucuggcaaugauuaggugcccgaggaguucagcuggcucgggaagugcauuuggcaucuuucuccaucagauucaccgacuggaaaauaguugcccucgguuccgcgucccuuccacgugcccgccuuggggugugcccacugguguuuuggggugacacaccucagcugguuagucgcccccugcgcgguguccucugcaggccgguuuauggaagugucagauguuaucguacuuuagaaagaagcacgagaaggacugcagggcagccuucuguuuaguggaaacacggagauuugucagcggaauccugauuuauguaugagauaaguaaccgcagcggaggcaucaaagagucguucaggaaugggcccgcgugguguuuacacaaggcuucgugugagaguugcugguucugugcuaggauaacacagcccugcgugggugcgaaaugccaucugaccgcggucaccccgcuuccagccgccacagaccuggcgaugcaaucgcuuugacuucuaggguugccguccgagggaggcgcccgggaagccccaaggcgcuuggaaaguaacuuuuggcucuggaaaguuuuuuuucugaagggcagcucccgcggaacuaaccggagcgaugauauccuaccaauucacucccuuuccaagggcguuagguguccacgucgggagaccucgggaagggaggugacugauggccaggugaaaaguggucugccccagggaaaaagaaacaaaagacacgauacaacugccuaccuagagaauuucaaaaugcaguggcuugcuuuccuucugucuccaucucaguuucucuucccucauuuacauucuaggaaauacacacauuccuuagcuggcucugauugaggagacucccuagaaaggaaagaauuucacauggcuaaaaguuaucuggggcucaguuaucauuuuagccagaagugaaucuucucugcuggucauuaagaccagugguuuuuaaaacuugggaagauuaaccaccuacccacuccaucagcucccacguggguucuuaaacccugaaacuuuuguuaugcuuuuuacuggguaaaggaccgcuauugcacuugagacacuuuuccacuuuacauuugcacuggaaaacauacccagaaguccuaaacacauuuuuggagagauuuaugcugcauucuggaccagaugguggccuacccgcuguggucuagcgcugcccagaagccccauacacuuuccgccccagucggggagguugauggagggacggacuggugaauccccggguagacuaaucauuuugaagcccucuuuuaaaaacgaaaauauuccagcggggcgcgguggcucacaccuguaaucccagcacuuugggaggccgaggugggcaagaucacucgaagucaggaguucgagaccagccuggccaacauugugaaauccugucuuuacuaaaaauacaaaaaauuagcugggcgugguggcaggcaccuguaaucccagcuacuugagaggcugaggcaggagaaucacuugaacccaggagauggagguugcagugagccgagaucgagccauugcacuccagccugggugacaagagcgagacuccgucuaaaaaaaaaaaaaagaaaaaaaauauuccaugagaguuuugccuaccaauuauuaccacguaaucuguauuuauuacauuugucugaguggugggguggggacgggaggggcaguaauaauuuuuuaguaccuacuaagugccagccacuguacuauauacacuacaaacacauugcaauuaauccucucaacagcccugagaguagacauuucaauccuaacaguauagguaugaaaacugagucuagaagaaauaggaacuggcaacuaggaggauagaguaggcaucuaaagacaagccuugucaguuaccccguguggcuuggaaggcccuaagacaccaaauagauaaccucuggugaagaugacuggaaaaaaaagugaaucugagacaacuaacuagccaaguaacccacaauuggugcuguauccaggaagagguggagccaaccaguugcaugugaggcuuuggaagccuagacaaaaacggaaagcugcuuuuaccaaguggaauuguuuugaccauuugccauagggaaccaacuaaagauuuuccccggguuccugauuacaucaaauaguuguuaacuccccgugcuucagaaagccaacaugauagaaagcaacgacaagccuuguaaauucuuagaauaaacguguuaaucuaaaacauucuuggccaggugcaguggcucaugccuguaaucccagcacuuugggaggcugaggcaggcggaucaccauauagugaaaccagccuggccaacauguaaugaaacccugucucuacuaaaaaauacaaaaauuaucugggccugguggcgcaugccuguagucccagcuacuugggaagcugaggcaggagaauagcuugaacccgggagguggagguugcaaugagccgagaucgugccacugcacuucagcgcaggugacagaagcaagacucucucaaacacacacacacacacacacacacacacacacacacaccccauucuuuagccaaauugaaaaucaguggacaccauagaaguuaaagaaguucauuugcaaaagcaaauauuccugugcaagucagaugccuuuuuaggguaccaacgugacuuucuaauucugauauuuaaaccuggauauggccuuuguagugaccaggcucuuggaguguaauccugcaucugccagucagucacagcgccaccuaucuguugcauucagcaaacauccauuuccuccaucccuggagucacaaguaccaaaauaaugacaucauuauauauuacccagaagaaaaugacuuuccccguugcugcaguacuugaagucuuccaaacugauuaaaacaugaaguuuguuuuaauuuauuuccaauuucauuuucaauuagcuguacuacaccaucaaucucauggcuuuuuggauacauauucacauucuugacgaaggaaucugacuccucuagaguuacgugugucguuaacuaaaucacauucuugguucuuaaaguuggggauauugguuaguuucagugcagcagcacuuguugccuaagagacaaccaaaaacagcugccaccacccgggaccacagagguccaaaccaguguuauaauuuaacacagagaggaggcuggugccaugaaaacacaguguucagcugcuuauuuuuguacuuuugugcauaaauauuucugaaauacaguuuggcaauaauauauuuaaaaugcacuaguaagcaguauacuucucccaaaguuuuuugggacucacagucuuuuugcuuuuucagugucucucugagauuucuuguucuuaacugggauaagcaaacaagccuauaaaggcaauugcauuuaacauugaaagagucauauuuucuaaaggaaaauggaaacaaaaugaggccuuuuucccuucacugauugguaauaggggcugcccuucucugggaggcaaauuuacaaucuaauuauacuuuugacuuuucauuaguuugggaaugcuugacauucuuaaucugagguuuaauuauugcuaaguauacaucuucucuguggucuccuaugcaauuucccacgguuguuccaauggcuccaacccuuugccauguggcucauccacugauaauggggugaauagaaaaagcuagccgaugauggcuuucaggcuaugucauaacagaguaucucauuuuccuacuaaaugccuauucucauuauaauauuauuucaaaacaacucuugcaaccgcugccaaauaaaguuaaauggaccuugaaguauuagcuuucaaaugggaaaauggacauuuaaauuuugugauagaaaauauguuucacccuggguaaaaccagcauguggguaaucucucagggaggccagccuaacacagacuucccuuuaauaauagcuaacauuuauugagcaccugccaugccaggcauuaucauuuccuccauuuuaugauaggaaaacuuagguucagagagguuguguuacuugucuaaggguacccagcuaguugguggcgggggggaucaguauucaggcucagacugucugauuccagaaucacauguguaaucucuagcccaggcucccuccuagcuaugcccuaauaaugcauucaaguccuacaucuuugugaaguccuacugugugcugucacgcuccacuagauacugagugagcaacguagacaaggcgcuaucauccggacuuagaacuguaaugaccuagcaucaaaggucugaaggauugauguguucuucagucagccaguggaggagacgcucuaaacuggagcuguugcaaagauaaagcagauuucaggauugcuucccuguguagcuuaucuucugggagguuuugcuuaccgcugauugaaugaauguggauggcccacuguagccaccaacucugaaaacggccccuacacucgucuugcuaacagguuugcauugagaaaaugaaauauugucagaagugccauuuucaugaacagacuguaaccaccggugagugaucaguaaaaauaaugauacuacuaaguauuuuaaaccaggaacagggaaguauagacauuuuucauagaagguucauucuuuacugcugacaacagaguuucuaaccacaccaaccauccaaaccuuaagggaaguaacuucuuagucaagcagugauuugauuucuuuuucagugcaugacauuugaagaaccaaaaccagcaucauaccucaaaaagguccugcugauugcuuaaggguguuuuguaauuauacagcagugaaagccaauauaaacauaaauuaguaaucccaaauuaagauuccaaagagauccuaggagcucucuuaacuucugaauuugucaugaauauuccaucaauacucuuaaaaauagaaaagaaaugcauuuuucagcauggggguuuuaaaaugaaauacacuuauuggacuuggauauauuaaacaugacuccuuuaugcuuccugaaugaugggauaucauaccucaguaucacgugagguauuauucacuagccugugacguuggauguuuuacauuuggugugaaaaacucacuugucucuggcucuguggaagaagccacauuucuuuugccccagucauuuucuuaugacagagaaauguuaggaaacuagcugauguuuauaaaacaauuuauuauucaaaggcaaaacaguccuacuuuaaaguagauaauauaugcuuuaaaauauaaccaucucauaaaauacaauuauguuuagugaucccagguguugaauccaaucauuucugugugcugggcgaggagugugggcucugaaaccaagagagccuggggaccucaggcaagucacuuaacccccuggggccccaguuucuuuaucaaugugaugagggacaacaauggcaucuacuugauguuguuuaaggauuaaauaguuguuuagaaugguggcuaguauguaauaggaacucaaguuguuuuaguaauuguaauauuguauuauaaccugcugcuuccucccagcaauaaguuaauugccaauuaugagccaucuauguucauuuaaucagugauguaguuuagaccaugaaggcaaauguucaguucugaaaugaaaguaauuuucaaauugcaaauguguuaaaacagaccucagggauagaaggagugaguugugcuccacguggggaaguauuaguauugguugcauuccagcugccgucacugcuaucaucauaaaaaaugcagggauaauucccaaagugaaguuuguaauuguaguaaugaaacaguuuuucuauuuguuauaguagugguagaaaauugauaaauauguguaaguauauuuagauuaccuaggagcacuguuuuuuuuuuaguacuauugcucacgugccuacugaugacaugauauuuuuaaagaucuguguuucaaauccaguguccgguuuuauccaguaaggauaugacaucaaggaaucacaacauuaaacaaguuugucucuaaauaaguauucggacagauguauguauaaguauguuuuuaaaccauaugaugucaugucuauuucaucaguaguauuaguuuuccauuaagcugucauauuucuguuuuauuauuuauaauugggccaccaaguucuaacuagccuucauuuauucuuuaaacaaauauuugguauuaacuuucugugugcaaggcccucuagaaaugccaaauaaaaugaauaaaauauagcuucugugcucauggagcuugcagucugguagacaagacaagacuuaugcguaaacaacuggaauccaaaguagagaguagaacaugcccuguuugagguucagauaaucuggcugaagacagggacauuuucauuugcaggagagauuugaauuauaguucauauuucagauuacauuauauuucauaucuugaauuauauuucauauuacauuaauagggcaagcaacauuaaagaaaaaugucuuaaaagagaggagggcugagccugaugacucgugcuuauaauuucagugcuuugggaggccaagaugggaggguugcuugaggccaggaguuugagaucagccagaucaacacagcaagauccugucuccacagaaaauuuaaugggugcgguggugaguggcuauagucccagcuacuugggagacugaggugggaggaucccuugagcaguggcacagucuuggcucacuguaaccucugucucuuggguucgagcgauucuccugccucagccucccaaguagcugggacugaguacaggugcgugccaccauggccaacuaauuuuuguauguuuuguagagacaggguuuugcuauguugcucaggcucgucucaaacuccuagccucaagugaucugcccgccucagccuccaaagugcugggauuacaggcaugagccaccgugccugaccugaaaucucuuaagugugacauuucagugugggaggugagaggaaaccaaauucagagucuucuugaauugugucucuuaaacucaaaacguugguccaacauuuguaaauaauuauaguauauugcuuuggcauaauuguuuagauaaucuaaacaacguuaauggauuucaaaacaaaaagacguaucgguguuauuuuuaaaccaaagaccucuuuuuuuuuuugucuccagagaaauggacagcauuaguuuuucuugccaaaucacccauguauuugaggcccugccaaggcccuuauucaauuuaaggcagagauucaaggccucauucugacucucuuauuaacaugauuaaaaugacuggaugagaauuuuccucauagaagaaagggaagugcaucaccuccaccauaaucaccuaugaaugaugaaugcagaugucaagguuuuggaugucguacuuacugauuacuucuaaguucuugcaguugguggcuguggggaaaucugauuuagcccccacugccaacuuagggguaaaaguaacaaaaacacccuuucucaguuuuguuagacuguaaaggaaggaauaggguacccaugccucuuuauucuaaaagcaaguaucugccauuuuuacaagcaucagaauugcaaguugugccagaaauuggagucauuuuaugucuauaauuuugacuuuugacuugaaaaaacugugcaauugaaucaaaagugaucccauuguugcaaaacaaauucaguaagcagcugaguaaucaaaaugaaucuccugugauacuuuaaaauaaucuacaaguauuuaaacugcuacagauuccuucauccauuuggagugaaacaguugaauggaaggccgaucuaauuaccccccuacaaaauauccugaaccucagauacuuuguuacgcugcauugaguucauucaccaggagaauacauaauaacuguguuccagaaaugccaagacuggaaaaaggaaaccaugcggggagccagguuuacauuuguaaagcuauaaaaccagggcaaauauuaccgauacugugcuuagggacauaucaagauaaaaggacaccuuucuucaguuuuuacagcccaaaauacguuaagauaaauuuucaucaauaucaaccagguacuucagugccaauuugcugaagcccaaauagaaccugcagcacgcauuacucuuuugcucaucaagcuuuccuguugguccuucccccaaauagucaccucagaauggaguuuugugucuuuugaagccagaugauuaaaguucuaggauauuuauuuuggaccuuaaggcauaguagcuuuuaccacugccucuguccucuuacuucaaagaaaauucauauuuauuaagcagaugguauguguuggauguuuuccaugugucaguucacauuucccuccccaaaaugugugagauaggaaucauugguuccagcuuauaggagacugagaggcagacaugagcuuauugcuauuacaagguggagccagucuucaaacccaggucuuugaauuucaaagcccacacauuaccauuaauucuaucagccucugguguuaggaaagaagucuuccagauaucacagcaacaucaaggggacauuccaaauauuuagcaacccaggugacacacuguggaagccaccauucccauaugaaagcaacuccuuggagcacuggucaguggagagugacuguagacucagggguccugauggccccagggauacaggggcaaggaccugcuacagugggugguggugacaguagaaacagggacagcuugcagaaaugcucagagcagaggccauuguucuucaaccagcugguuuggaagcacuuaaauauuuuaacaaccagugauaccauaccauuuuguucuaagaguaaugacaaauguacaagagcugggaauggacccuggucuaaacacgauagagcaaccaauggguacucauauguagacagcgccagugggccagcauggaagagaagucuaacuucagccuagucccuguccacgguccuucaggcuggcuccuaaaaaugucugcauuugcuaugauguuugguuuggcauuuguuggaaaccugcuuugugucaaguauugaaggcuccagcuucaaacugcgucuucugugguuucagguugaacuccacacucuggcucuuugggggcauuuucugguuaucugguuaucagugcugguuaucuguuggaccugaaugcuuuuauuuuugucugucugacuuuuccauucauauaaucuuauuuugcuuguuuuacauuauuucuuaucaaaguuagagauguacauaguuuaaagagucagauaaugucguagguuuccugaaauuccugaaauucugaaaaacagcaguuuccuacccaggccaccuucauuucauuuuccauuccccagagguaaccucuugauaacuuuuuuuaccauuuucuuguggcauuuacaccucuuucaguuaccugcuaaugccuaaaaaaccaucccgaaacccuguagcuuagaacagcagcugguuuuuugcucacaauucugcaauucagccuggacuggacacguggcugcccucaggagccuggagaauuacuggggguggccggaauggcugagggcucccuggcuggucucacguuuucccugcucucauccuccagugauucucucucuccagguggccucuaguucagcaggggaggugaacuuuucacagagccacuggcuaccaagaguguagucagaagcugaaaggccucuaaggccagggcccuggagccacccacucccacuuccgccacauuccaugggacagagcaggucauggggccugcccagauuccaggggaaggaaguggacuugcgcauggagggcuggaaggaauugcuggugguccuuuaugacgaugaucugccauggcccccguaucucuccgugacaugcuuacagugcucuugcuucacuuuuuuuucaucuuaaguauuauauacagacuuccuuuuauagcagaagaggguuuuguucucuuucaccuuuuaccuuccccuaacaacccuugcagguaucuccuguuccuguccaccuuucuaauacaguuacagcguaaucucagauccacauucaguguugauauuauugugacaaugucagugcgacucacagcugagucauguuucuugcauagcuuuuuguuucccccccacgaaguuaauaauccucuugcuauuuuagcuccucauauauacaucauuauucaucucccaagucccuucuacuuucccaaaucucuccucuguguguucaaacauauuaggaauucuuucauuucuaucuucucgaagaaaucuuuucuggagcauucugaccagcugagaguuagaguuagguuaggauauauacacacagacacacccagacaugcacacacucagacacaugcacacacacuggguuuguugcuuauuuuagugcagugcauucuccaguaacuuccugagacaagugugugugggauguacauuuuuggggauucugcuggucugcaaaggucuuuauguuacccccucauugaacugagagcauucuauauuggaaauaauuuauccuuagaauuucgaaagcacugcuguauuuacuuuagcuuccaacuuugcugcuaaaugugaagcugaucuuuuuuucuuuguaaaauucuuauaaaugaucuguuuuuuuccucugucuggaagcuuuuaggcuuuuauuuuugucuucaguguucugaaauuuuaugaugaugagccuuggaguggcugucuuuccuuucuuuguucuagguagugaugggcccauucauccuggaaacucauguccuucaaugcugggaaaugugguucacuuacuccuccagugcuucccucccucuguucuuuuuccgggaaacaccuguuauaugaacauuggacccucuaaauugauuuucuuuucuuuuuuuuuucuuuuuuuugaaacagagucuugcucugucgccuaggcuggagugcagugacacaaucucagcucauugcaaccucugccucccagguucaagcaauucuccugccucagccucccgaguagcugguauuacaggugcacaccagcacgcccagcgaauuuuuguauuuuuaguagagacgggguuucaccauguuggccaggcuggucuugaacuccugaccucaggugauccgccugccuugaccucccaaagugcugggauuaugggcugcaaagugaucccagugagccacugcaccuagccucuaaauugauuuucuaauuuuuccuuauuuuuacuuuuuucuauuuauaugccuuuauucuacuuucuguaauauuuugacuccaucuuccagcccuuccauugagauuuauuucugugaucauauuuuuuaauuuccaaaaguucuuucuuuuucucuuuuuugagauggagucacgcucugucacccagucuggagagcaguggugcuaucucagaucacugcaacuuccgccucccggguucaagugauucuccugccucagccucccuaguaauugggauuacagguauguaucacuaugcccggcuaauuuuuguauuuuuaguagagacgagguuucaccauguuggccaggcuggucucaaacucaugaccucaagugauccaccugccucagccucccaaagugcugggauuacaggugucagccaccgugcccagcccuuuuucucuggugguugcuuuuuuauagcauccuguuuuccagauauauuauuuucucuuaucucuguaaguguauuaaugguauuuguuuuuuucugagguauuaauuuuccugcauaauguagauuuccucucaauugcuuuaucugguuucuuuauuuucaucuuugucuuuucauguuagagguuguaucaguugucugaugacccucaacugucuuauuuaagagcagaacauuacacaggucaauuggaaacuuuugugcugguggauuuugugaauugugaccaucacucuaaguuuaccugguugggcuguuccacugggaaccuccuggaauuagaaccauuaguuuauuuuuuuauuaguuggucaaauuccccagagaagaaccuucuaaucuuuaccauggaggggacuuucuggcuaagugggagaagaggacucagggucugagcauucaguugguaaacuuuugccuuuccccugauuucauuacaguuccucucauuuccuguucccgguguccacuagacaagagaacuuuuguuuuaauguuuccaaguaguaaaccuugaaucuucugcugugguuagggaggggcagucacacagcucuuugggugggcagcuccaacuccuucucuuuuuuucacauacuauacaaaucauccacuuaacguguacaauucaauguuuuuuuguuauauucacauauuuuuuauucaucauuauaaucaauuucagaaguuucaccacccuaaaaagaaaccucuacccacuaacagucacuccucaguuccccucaaaaccaccagcccuaggcaaacauuaauugcuuucugaaucuagacuuugcuaauguaaacauuucauauaaauugaaucacacaauguguguguguuuuuuuugugacuggccucuuuuacuuagcauaauguuuuugagauuuaucuguauuguaguaugcaucagugcuucauuuuuuauugcugaauaauauuccacuguauagacauaccacaguuuauccauuuaucagucagugaaccuuuggcuugucucccccccuuuuuuugcuguuaugaauaaugcugcuacaaacauucaggugcagauuuuuguauggacauauguuuuuauuucucguagguauaaaccuaggagcagaauugcuggauuguaugguaacuuuauguuuaacuuuuugagaaacagccagacuguuuuccaugguggcugcaccauuuuacauucccaccaacagcauaugaggguucugauuucucccuaucuuugccaacacuuguugucuaucuuuuugguuauagccaacugcuucuuaaacuuauguuccaacaguccuccuauuuuagccucaccuuuauucccaaauuccuaaaccuguucaggauucugcaauaucaaucauugccucuuagcuuucccggcugcuagcacaggcuucaguuucaugaguguacgggucagucaccaucaugguguggaaccccugagucccacagaccugugucuuccucuugaucuggccacucauaagcugugagaccuugggucaaauuaauguaauuucucugacccuugguuuucucaucuguaaaacagaaacauaauaaaaugcagccaggugugguggcucacaccuguaaucccagcacuuugggaggcugaggcaggcagaucacucgagaccaggaguuugaggccagccugaccaacauggcaaaacuccaucucuacuaaacauacagaaauuaggcaggcauaauggcgcaggccuguaaucccagcuacucugaggcugaggugggaggauugcuugaaccugggaggcagagguugcagugagcugagaugguuccacugcacuccagccuggaugacagagcaagauucugucucaaaaagaaaagaaaaagagaaagaaagaaagaaacauaguaaaaugugaaauagcuggcauacagcagguacuaaguauauuagucuccucucuucugcaaacauggugaguaugcaaaaagggaaagacuuuaucuuuuuccuuuaggaauucaugaacuagugggaaagagagugacauguauaacucuaauuuccuuaauuuucaacaacuacuguucagugccuaucaugcaucauaaauguguuaguuguugaggguacaaugugaugaguuuccugucuuuaaauggcuuuccauauggaggaguccgaaccagaacuggauauaaggcagauagaguuaagugcugucacacugauacaagggagcauacaagaaugagagguaaauucugacuguagugcuagugcccaacuugguccacagauugacuggaacauguuaauguggaugacucucagcucuaagccaacagaaccaaacuucacuugaacucaugguucucugaaauagcaaggugcaaagaauaaaucagcagccaaauucuguucaacauucucugucauaaaaucucuggccccaauguggcucugugccaguuacugaggaaaguagaaaaagauaaauaaaaaucacauuucaaaauagguaagcaaaauauaacauagccuguaggauuaaaaugaaaaugcaaaaguucagcugugggagccaagaaaauaugagcuuaagacagaauaaaucuuaaacacuuucugucauuuaauauguuaagguugcuucuuccccgcagacagauggcugucagaaacagggaucaaguuaugaccacugcaggacuuagaggucuuaaaucuuaaccaaguccuuauucauguaggaguguggcaguuguguggcuaugacugucagagauagacauugggaaguauuaaguugcuaaagagacugaccucagaagaaucuccuuaucugaguacaucacuuuugcaggccccgauacuguaaagacaaucugggauacaacacauugagcuugggucuauauggugugaggaaaagguuuugaggacagaauguagcauugcacauuguaucaggcuauuugucuucaugaaaaccugccugucagcccuugugggcccuagcauagccuucugcccucuagcauguuuuagucaauggggacacugacuacucauucucuuucccguggcuaugguugcaugauguaaaucaucuccacaaccacaagccccaccagcuuuacccucuuccucuuccucaagucccuaaacacccaacuguucuaucagccugaaucagcuguuugcuaacugagcagcugggaacaucugggagugggccugggggaacaccuaagcgaguaaacugugcaccaagcuuuuucugcccugaauccacccaacucuuaaggguagcaaaagaggauucuaaagucaacuuuugaaaacauugacuaaaacaaaguuaaccauuuuuuuucuucucuuugcauaucucacagucucuggugguuccaaaaccauuaugaauuuccaagaaagggauguaauaugcaguguuuuccaaucucuauccucgcccccaaaaaacaaaaacauugagagagacugauuuaaggcacuucuguauaauugcagucagaaguaaugugugguaacuuaaacuuguaccccucaugucucuugugauuuucucucuaauuuuagaguuggaugagauagagacuauuuuauucuuuuaguggcuguuacaagaaucccuaauccuuuucggaugaggguuaagaugagaagcagggaacccacccugugcuuuaugauggguggccugugaggccuuuguuuucuugaacuccucauggguuuggacauguuaauuuggagguagaagcaggacacagcuaaauugcuuuaauaacaaaaauaugugaaauuugaaguucccagggaaauuucaggaaggagagagaagucagucagacuaaaugcugcaugggaaaaagauuagagagggaaacgaaaacaaacaaacaaacaagcuaaugguagcccugcugaaaugaagcuuuugggggagaauagacaugucuaaugggaaauuugaagcuguuugcuaucaagggugcagcaugaaccucccuucuuguuuccacugugacaucuucaaugauguuucuguggcccacagugccuaagugugaguggauucugcugcagagguggcacagugguggaaaggauagagcuggccaagggcacggaugucuggguaccacugaugcugauauucaugucucaucaacuccgcuaggcuguaagcauguguuuauugaaugaaugaaaaaacaaacgaauggauaucuaagcagacgcagcaggucagcguuucucuuaaauggagaauagacgaggcugcagccauuaacacgacagauuaccacaucaagcauuaauaggacagauuaguaaguaaagcaggaacagagcauggacuugauguguguuuguggagguagccaaucacugaaucagagaaaaagaugcuguucucuugguuguaggcaaguucuuccauucagaaagaauuaaagcuuaaaucccugccauaagaaaaccacuuugaguauaaauaccuggccuucuagauuccaaaccaagaucucuucccuuucugcagaauaaggagacaauggugaaauacaaagauaucacaccucucuguuuucuguuagaaauaaccacugucucacaugugauuuuuuuuuuuuuuuuuugagacggagucccacacucugucgcucaggcuggaguguaguuggcgugaucuuggcucacugcaaacuccaccuccuggauucaagugauucugccucagccucccaaguagcggggauuacaggcaccugccaccacgcccggcuaauuuuuauauuuuuaguagagaugggguuucgccauguuggccaggcuggccucaaacuccugaccucaggugauccacccgccucaaccuccuaaagugcugggauuacaggcaugagccaccacgcuacagcaucacaugugauuuuauaaauacauuguaacaaacaaguauucugagcuucaccacauuguguuuauagauagcauacaucuuggguucuccauaacauuucaagguucagauauagcuagaucaugucucuuuuggggauugaaaaagacuaucacagaggcuucauuuccccuauaugccucucuuucuugaaagccaagauugggugggcacgguagcucacaucuguagucccagcacuuugggaggccgaggcgggcggaucaccugaggucaggaguucgagaccagccugcccaacauggugaaaccccaucucuacuaaaaauacaaagaauuagcugggcgugguagugggcgccugcaaucccaguuacuugggaggcugaggcaggagaaucgcuugaacccaggaggcggagguugcagugagccaagaucacaccacugcacuccagccugggcgacaagaacaaaauucuaucucaaaaaacaaaagaaagucaagauaaaggaccaugacuuacucaccucugaagccacagccuggcagucucugucauggugagugcuaacaacaugccuuugagcugaguugccugugagagaaaguugugugcuggggcaguaauggacccagucagacaggguccccuagaaaggccuggcuuuggcaccucuuacuugucaucaaaaaguguuggccgggcacgguggcucaugccuguaaucccagcacuuugggaggcugagguggguggaucaccuaaggucaggaguuugagaccagccugaccaauauggugaaaccucaucucuacugaaauuacaaaaauuagcggaggguaguggcgggugccuguaaucccagccucagaaggcugaggcaggagaaucacuugaacccaggagguggagguugcagugagccgagaucgcgccacugcacuucagccugagcaacagagcgauauuccaucucaaaaaaaaaaaaaaaguguuccuccuggacaguagccacuggggccuacuuguggaugaagggugagaggaggaugggaauugaaaaacuacgugucgggugcuaugcucacuacgugggugaugaaagaaucuguccaccaaacccccacaacccacaauuuacccauguagcagacaugcacauguacccccggaaccuaaaauaaaauuuggaaagaaaaaaaaaaguguccuuuaguugugcaauuaauaugaaauugugucugcacagugcuugcccuuccuggaccuuuaccuggcagaacuguaaaugagcaguucuuuagagauguaauaaggaaucucaugucuacuuuaggaaugagauuuuaggucuuuugguagaaagguugggugauaaaacaucucucccucucuuuuuuuuuuggagguguaguuucauucuuguugcccaggcuggaguucaauggcacgaucuuagcucacugcaaccucagccucccagguucaagcgauucuccuaccucagccuuucaaguagcugggauuacaggcacgugccaccacaucuggcuaauuuuguauuuuuaguagagaugggguuucaccauguuggccaggcugggcucgaacuccugaccucaggugaucugcccaccuuggccucccaaaguccugggauuacagccaugagccacugcgcccggccgacaucucucuucuuuccaugguggguaugcauuuaggaauuuccacaguaaggcugccuuuugaaacacauuuacugcgaaaccaucgguuggucccaguuacccaucggaaggagggugggaaggguuugguugucacugcaggaguuaugucggcuccugagaggcaacaguuagugaaggagaugaccccagagcccagacauuuaaaaacaggggcuuuagggugaguugccuaaagauaacuuaaccccuuuggcggucgauuauuucugugagcagaaaaaguuucuguucacaggaagcaugaugacaacaguaaauucacgcacacaugugaggaagauaucagagagaaacauugaauuaguguagcguggcagggaguggccgggugguccagaaaggcaucucgaagggucgcacuuuagcuaagaccugaauucgaaggagucacauuaggaacagaggaagugcaucccaagcagcaggagcagccaggguggagaccccugccgccucuuccagaaagccuggugcgauccacgagcagaaggaaagcugcugugacaagcaggggcgaugaagcaggucgcauccugccccacccucugcuucugugccccuugccaggauuaacaucgugucucuucuucucucacagacgacuucgcagaggaggaggaggugcaauccuucgguuacaagcgguuuggugaguccuaacaaagcuguguuccuucucaguggucaaccugggaugcagccacgaacccucagagaccauuggcaggccacuggcaggcccuucaugcacauggguguuuguggcucugagguccaauuuugguuggaaagugagugucugugucccagggggaggguuucucacaauucugaggggccaugggacaggagcugcacccaggcauggggaagugaugggauguucaugggucugcugaauggaaaagagacagccuacuagacaaaguguagcgggaaaggcaaaucugugacaagacaacagcaaaauaccugaaauuuuucaguuuuguuauucagaaaacgucuuugcucaggccuuacacuccuaacccaguguucauggaugagugagagggagacuucuuccaagaaucugccuggacacaggggcucuguggcaggcuggggaauggcccccaaaggugacagcacccugaauccugaaaccugaauguuaccuuauguggcacaaaggacuuuguaggugugauuaaguugaagagcuugagauggggagaugauccuggguuaccugggugggcccugaaagccaucacaagcguccuuguaagagagaggcagagggagaugugacugcagagagaaggugaugugaggauggaagcagagauuuuuguuauguucucuggucaaggaauauagguggccauuagaagcuaaaaaugcaagggcauuaauggauucuuccuucagagccucaggagggagagcuguauacuccccauauuuauauuucagcuggcugaaggugauuuuaggccgcuggcccccagaacuguaagaggagaaaucuguauuguuuaagccagcacguucgugguaaccuuuuacagcagccgcaggaaacucauacacacccucugccucccaggcugcugcaccuggugcucuucuuugcuuugaccuugcuucucuuugaccuugaaaugccaguggucauugcagaguuucaaaggcagcuccagggauuggaggauuuucccaacagcuuguuucugugcuuggccagaggaaauggagaaggauagaggagaaaagagugugugugagugagugugugugugcguuucugugugugugugagagagagagagagagagagagaguaugaaaaugaaugaaucuacuuccuguugcuuaaaaaaaguccuggcuggacuuugauuagaauuaacaacccccagcugcucugccucccgcguugcuuuagcauuuuuccuucuggacacacacgucugcauuacuuucugggaaaacauaugacuuuaaaauaggaaugcaguggcaccaagcucaucucuccugcguugguucccuggcagagcggcccgcgugcagccccgucgccccuccuccgugcuccuguuccccaucuacacgauuccauguuucugcgaugagaccaugguccuguguucuuucccgggggggacgcacugaaggcagcaguaggagugaagaugaaaccaagaauuauaaaggaaaacaaacaaaaaaacacagaaagauaggaaucaagaggaaaaccaaacuugucaaaauaaggcaaaauaaauguggagaugccuacauguuuuggcaaucaguagaaauaugaagaaccaagagagaaagucucuuuagaaagggugaccuugagagaaaauuuuuuauaaauuucucagccauauuaccaguuggauggguuggggauuuggugaaaaacacacaaaaaaguacauuuaugcgugggaguugcaacggaugacucacaggagacaugguaaccacuuacaaauauuagagagcacaaacagaggcuggaagagagugaugccaagcgguacaaauagaagagaaggacgaaauuaaaaugggaaaccuuggaauagucuaugaaagagacauuccugaugcugagaauucuuggauucagccucuaggcaaggcgauggauauccagcauaggaccagaguagaucuuugcagauggaagagucuuugagguguuuuuuguguuuuauuuuauuauuuuaguuuugagacagagucuugcucugucauucaggcuagagugcaguggugcaaucguagcucacuguaaccuugaauuccugggcucaagcaauccuccugccucagccucucaaguagcugggccuacggguaugugccacuauguccagcuaauuuuuaaauuuuuuguagagacaaugucuuacuaucuugccccagcuggucuugaacuccugggcuuaagcaauccucuagccucagccucccaaaaugcugagauuacaggcgugagccacugcacccaacuuagaugauuuaacucucccuuuguuuucaccuauaagggagcugaggcccagauagauuaaguccuugcugaagcaaguuaguuggagcugggguuagaagauucuggaucuucuaacucucaggauaaugucguuuuggggaagggcucagcagugaagugaaguggagcugaccuuucaacuucuguguuguggagggggacccugcagcucuggaacccuaaaguggacuggacacccaaucugguuccacuggggaggccucaucaugguuauagggcuaggacucugauucuuuagaagguaaaugaguuuucaguuccuaagaaguggccaguugaauccagcaggacccaagaacccauuucuucaggcaugguuaaacuuuaaccauugaaggaagaccaagucccuuccaugcagcagguugauaguaaggugguaaguggaagguguccagagacaugucaacccucuagguccugccccuaaucacuccugugucuugaaaccagcuacuuaaacucagugggugucagaugcugccucugcccaaccagcagggggacaccugccaacguaggugagucuaccucacagggcuuuggugagguuaagagagaugucagauggauggacaagugcuuugaaguuacaacacuauaaaaacacaggacuguauuaucacucucccgagauuuggggcuguuagcacucucucaauguuuugguacagccacugcagaauaucaaagugugacagaccugaaaacuuacuccugaagaaauguaaaggugugauuuucuucuaaagacgguaacauuguagccuuuuauaguugcaaaaauagacugggugacauagaggguuuacuuauuguuuaauuuuagguauauauugcuuaugcaaguaugauaaacacaacccgaauuuagacuacagaagagcccgaggucaguuauucacagggcaaaggagccauuguuuuagcaaaucacuacugggugggccuguuucugaaguuauucauauagagaguuauuauucagagguguuugcuacauaaagucaaggcuguuuacauaauaauauugugcuuuuucaaauuuagcauacuauuacaguaaagagcaaaaugcacgaucuucugcagugaucuagcaugguauuguauuuggugcagucaccccuuguuuacucagggauucauuauugcauuuuagucucaaccaggucuucuguuuuucuucagucuuuccauauaccaagcuuguucagccccguucccaaaguucugggcaggugucuaaagaggagauggaguuuggucugaugguuuugucacuucuuugcuccucugacaaaagcgucaaugaggggagacuuugaaggguuaauuaagugagcauuuucaagcuuuaaucaggcuuugagggucagcguuucuuggccucaguaugcagagcuaauugggacguaacuauaguuacaauuuggcagaguucauuuucugggacaugaggcaccaguauauuuuuauuuuccauagauaugauauguacuaccacgaaagugauauuugucuauuuauuucccaguuaccuguuucauuaaaagcaucacacguggcucuagaauccuuuauuauuaugcuuagcagaaagggaaagagaggcagcaccaccugcauggccugggcccucccucuggagccugcauucucccuuucugcacuggggcgggggcgcuagacugacuuuguuucauugauuggucgcaauggguucucuucuguuauuuuuggaaucugauccgguaugauaauagacguccaaaguuaggaugauggagaagcaagagauacaugguucagccugugaaaaucacggguggaguuaaggguuuccagugagcaacugugggcagcugggaacauuuguuguuuguauuugacaaacaaagcuuugacagaauugcuucuuuggggcucaggcauaggaauuauuaauagcuaugagaguaaaagaucugaauaauggcaaacugugaaacaguaacaagaaaguaaaaggaagcauucucuauggaguagauucaaguuucuuuuuuugguaaaaacuaagugggagaguucuaaggggauugcugaaaaauuauuuagggguuacaguccaaaacgggguaucagaugucuuuuccucugagaucaguaaguguguucuuugaagcauguccuugaauaguuuuguuuauccacaacuucacaggucucucuauagcuauagcuucaaacaagccaggcuuuaacuuuccccuuucuuuccucaaaaaauaguugcagauuagcaaguauauuuuuaacaguuuggcccacacggugccgagcaugucgaagcagccugagaaaucuguguugaagggaacccagcccugccucucagugccccugccucaugccuugccaucaccguucccuccuuccaaacccagccuccaaagagauaaacacauggaacuuuaaauucauggcuccaguuaaauuauugagcuguuucuugccaagagguuuagagaaacuaaugucuaaaagcauagaggacuacugaggcuucugaaaaaucacagcacggauaugcuuaaccguauagccagaaaggaagguucuuucugaggcacauggcgagugucugcuuuuaaugccaagagauuggaagaguuuaccaagaggaugccaaacucucuuugggaagcugcucaagauaaacacuuggaugccucuacuucuuguugcugggcuuuuacggggcaggcugccugucuccccucugcugggacucuuccuggaagccuggcuucaucuucuaauuuggacaagguguugauuugaagccaucuaucuccgacaacaaggagggcuccaggcaucccucucaccgcagcccugcagaaagcugacccauucccugaugggaaugccaggaauuuccaucauuuccuguggggaacgacugaguaagcacagugagaggcuguccuuccagaggcaccuuuuccaaacauuucuaagugaggcacaggacugacacugggaggaaggugaagggcaagggaacaguggaacucggugcuccuggugggguuucuuugaaauguccaaaaccauuugcaucaaguuaaggggagaguuucauuuaugugguuuuacaaauccuaauugaguugguauuucugaauuuauuuauuuauuuauuuuugagacggaguuuagcucuugucgcccaggcuggagugcaguggcgcgaucucggcucacugcaaccuccgccucccggguucaagugauucuccugccucagccuccugaguagcugggacuacaggcgccgccaccgagcccagcuaacuuuuuuguauuuuuaguagagacgggguuuuauccuguuggccaggcuggucuugaacuccugaccuugggugauccgccugccuuggccuccaaaacugcagggauuacaggcguagccaccaccccuggccucugauuuaauaagaauucggugucaaaauggcaugugaggaacucagugcaaaagagauucucaggcugacagagcuggaaggggagucacagaguagcucuuuaucuggccccuguauccucugcuuccaggcaggcagguggagcuccuaaacgccgagaaagggaguuccuuggcugucacugcuuuuuauauaaacugaggagauuucauaaucuuuaucaccauacaugauaaccacaggcuccuuuggcaacaccaugcaccuagguuucccuucuuccugccaagaggacuucucacugguuaggucagacccuccuugccuugucuuuccugcccaucaguaaaaaaaagauucaacaccacauuccaugugauuaugaucuguuuuaaaccaugugaagagaaagucgugugaaagaaaccauuaaacgcuccuucguggauaucuauuaugugccaggugauuucccacccauuaguucauugaauucccccagaaacccuuugaggugggaauuauaugugguuuacaggugagagccaaagcucccaagguugguagcauggccaauguuggaguuaagccugauuucaggccucaguguucuuucugcucuacuugugacugggaagcucacagacacggccauacuccagcaucccaaaauuuuuaauggaaaagcaagucaucauaaaugauccugcacuaaaucagcagcuguugauauggucuuauauuucacaauuucauaauaugugucauauugaacacuggagcccugaauuuuccaccauuuaaaguauaacuccuccuccccacucucucugguuuucauucacuuaugaauccugguagggcugugggaaggagaagggugggauaauuuguuuuuccaacaauuggguugaaacugaaugugguuuguuuuuauuuuuggaaaaguuaaagaaaaaaaaaaucuacucagcucuguuuugguuaagacagcaugaagacauuuagguuguuuccaguguuuguuguugagggguagagugggaaagaguuucccuuuugguagcaacugcaagcaacuuaagacagacagacucugaaacguuucuuaaaagauaugaguugaggccgggcgcuguggcuuacgccuguaaucccagcacuuugggaggccgaggcggguggaucaccugaggucagggguucgagauuagccugaccaauguggagaaacccugucucuacuaaaaauacaaaauuagcugagcgcuguggcacgcgccuguaaucccagcuucucggggaggcugaggcaggagaaucacuugaaccugggaggcggagguugcagugagccgagaucacgccacugaacuccagccugggcaacagagcgaaacuccguuucaaaaaaauaaaaaaaagagauuugagcuguucauuuggaggccccuugggaagaggaaagcuguccuugggccauggauuuugagaaaaaacuacgauccucugcaaaguugugaacuggagugauucuuuuucucucucacguucucccuggggcccuuuguguucagucuacacugugggcuugcgggggagguggugcccaggaagcaagucuuucgagugagacaguccugauucacauacugguuuugucuuuuacuagcuaagccucauuuuguguaucugugaaauggguaugacaaguauauaguguguauucuuuggaggauugauauuuuauuauugauauucuauauauugauauuauaaaaccauaauauauaugggggccagguauacaguaggucugcacuaaauuguggcuauuauuaaacugcugacugcucccaccccucccacucugcucuuuccucucucccaggugcuccaggucuccccuugugaagcccagcaguccucauucucucugauccuucucaccuuauucccucccucccucaaaaucuuacugcccucccuccuauauucugugcccugcagcagccuaguaauuuguucagggaauuccaaaggagucuauuuucuuuucuucuguuguuuuccuucuucuucuucuuuuuuuuuuuuuuuuuuuuuuuuugucacagggccucacucugucacccaggcuggagugcaguggugccaucacugcagccuugacuucugggcuuaggcgauucucucaccucagccucccaaguagcugggaccacaagcacaugcuaccacucuaggccaauuuuuaaaaaaauuuuuuucuguagagaugggggucucauuauguuuccuaagcugguuucaaacuccuggccucaaaugaccaucguggccccagccuccuaaagugcugagauugcagaugugaggcaccacgccugaccaggagucuauuuucuugaaggacauuuuaaaaaguggaaaggguugguggccaucaguaaagaauaauacuuuuaaggaagguagcauacugagggguuggagcagcuuccauggagagcugaccugucaucguggcuaagagaauguaugcuggagccagacugccuggguucaguuuccagcuuugccaguuacgagugaguagccuugggcgacuuagccucucugugccugagcguccuccucuagaauacagggauaacuguauugucugccuguaggguucuugugagaacuaaaugaguuaauacucagaguagugccuugcaccuagaauacguacauaauccauacaagauggauguaauguauguauuaugaaaaguagcacaaaugggcacaagguggcuacaguguguccaggcuuuguuucagugccuuuuuuuuagaggcaaagcagcuuucccaggggccuucugucuacuuucccugucaucucauugaccaacguugagucacaaguccuuuucgaaauuaguuauguacaaagggaaugggcugucucugguuggcuuggacuaauuacuuggggaggaaugguuggugaggaauuaagcacuuuagccacuauuauuacuuguaacaauaauaucuauaauauauaauguaauaucauuauauuucaaauguaauacuaaguuauacaaaauuauuaaaaagcaacaauuuauauuauuauuuauauaaucugauauacuauuauuuauaauuuguuucacuuuuaaaauuauuuuauauaaacuuuaaaaauucgauuuauucauaaaauaauuacaaguuuacuuccuaauuguaacuuugcuauaaaugaagcuacaaggugcuguucuaguuuuugacaguuuauaaaaagagaagacaucaaaaacaagacaucagcauaauagagaagugaaugaaugaacaaaagucauuuuguuuucuggcucaguauucucuauagucuuaagcagauuuugaagaaaaaaaauuuggaagaggaacuaaaaaaaaaaagaaaaaaaaugagaaaguuccaaaucuuagugaauacagcucuugccacaaugaaacauugugaaauuggucuccuggucugagucaucacuauaaacgcuuucugcuucuucugauauuuuauuuuuauucuuuuauagguuuuugaauacugacauuuggccgugauugacacaugcuccucuuuuuauacacucugguaguuguauuuuuuuauaagugugaauauuuccaugcacagaucaauuucuuucacauguugcagaaggugcaggaauuuagacuugucaggaaaacaagagaaucaaacucagaagucugcaaagguucuggcagaaauccagacugcauucuuauucccaaggccugaagaugcccuguaaucucuaauauuugaaauaaccuuucuaacaugucguucucauucugugaaacgggaaaauauaaaaguaaaauuauugcugacauguaagaucucaaaccuucaaccuaagaucaguauuuccacagcaguuuaaauauguaagaaauaacuauauuguuccccuuguuaaaagcaucuggauguuuaguucguuguuuuagagacaaggucuuacucugucacucaagcuagaguucaguggcaugaucauagcucacugcagccuugaacuccuggacucaggugauucucccaccucagccuccugaguagcuaggaauacaggcguauaucaccaugccugguuaauuaaaaaaaaauuuuuuuuuuuuuagagacagggucuugcuacauugcccaggcuggucuuaaauuccuggccucuggggugguggcucacaccuguaaugccagcacuuugggaggccaaagggagugcaucacuugaggucaggaguuugagaccacccuggccaacauggugaaaccccaucucuauuaaaaacaaaaaaaaaauuagccgggcaugguggugggccccugucaucccagcugcuugggaggcugaggcaggagaauugcuugaaccugggagacggagguugcagugaaccaagauugcaccacugcacuccagccugggagaccgagcgagacuccgucucaaaaaaaaaaaaaaaaaaaaaaaaaaaaauuuccuggccucaagugauccaccuaccuuggccuuccaaaguguugggauuacugguauaagccauugcacccugccugauaaaaaauauuaagauauaaugauugucccaccucaugguuuacauagaagucuuaugauugaauugcuuuuggaaauaauugaggggaaauaugaauacuuauaauucugauacacauucaccaaaugccuuccauaugccaugaacugugguacaaagauggauaaaacaaaauucccacuugaucauuuuauuugccaacaucaauacuuauuaauucaucuuguuucaauuucuuggaaaacaaaaguuauaaaaaaaaaaucuuuauggaaguaaaaauuuucuccuaaagauguccaugcuggcagugaggccucaucaaaggcuucccaaacagagucauagaguauauguagaaucagaagcucccacuuugugcugaaaaugauaggaaguagggugucagggauccacauauaaauucugcaggugugaguaaaaaaccaguaaaacaguugggggcgggggaguccauuagcccagggaagaagugagugcaacauucauggaaauuuggggaagagaugcaggccuucagcaguucccuuuucuugggagauguaugcaccucaugaggcuuguugagaaauagaagcaagcaggacucuugggaaagggucauucuuaguccugcauaucaaagugaugugacguuuacuaccuauccauaauguguuggacaccauggacaauaaagaggagagacguggccuuuugccucugggaauuucacauguaauaaaaaauagauuuuucaaacagcgguguauuugcauaaaagaaaaauaucagccaaccuacaaacugccuccucucucacccgcagaauuuccacaggcacaauagagggcacuacgugccagauguacugugagcccucucuuccuucugucuggugguguucuagguucaguacuggcaaagcuucaaugguuuccaaauaaggucgggaacgccccucugcccccaccucuuuccgucugugcaagugaagagaacuuguaugaagucccuuuccuuuguccugcagaaaagguuggggaugagguaugagaaucuguuuugauauaaacucguaaaagaaguuuggaaggcagcauccuuccaugugcugcgcacgccaucggccacagcuguuacuaaacugcugccaugugaagccacucugcugauuaauagcagcuauguucacuuaaagcacaauucauaaagaguguaauaaugugguucagaaaccuuugcuauuuuuuccacucuugauagauuaaaauguaccuccgauaaacagugaaguccgugaauaagaucucagagggcccaaauaaccuuaaguaaauuugcaccgccagucuuuaaauuuucuuguuauggaacgagggauaacaagacuaccuauguuucagggacauugugaggaugaacuaaugcaaguggagugcuuagcacaaugccuggcacuuaaaagguacuccauaaaugcucauuauuuacuaagagagaaagacaaagauggggaauuaaaguuuaccaaaaaaaaugaguucagcauuucauuugugucucucauauguauaugugaauauacacucuguguguguguguguguuuggcuauuuaaagacuucugaauuggaagcauggagaucagaauuauagccuuucuuuugcuaugcauuaacuagcuaugugaauuuugcaaaaugauauaaacucucugggucucaaauaagcccuucugcaaaauaaaaggguuaggguagaugauuucaaagguuucuuuaggcuauacaguguuauggguuugcaucuauguaaugugauucaagguucaagaaucuauucugcuacugcauuugauuuuuuuuuuuuuuuuugagacggagucucacucugucgcccaggcuggagugcaauggugcgaucucggcucacugcaaccuccgccuaccggguuuaagcgauucuccugccucagccucccgagcagcugggacuacaggcacaugacaccacaaccagauaauuuuuguauuuuuaguggagaugggguuucaccauauuggccaggcuggucucgaacuccugaccucgugauccaccugucucggccucccaaauugcuggaauuacaggugugaggcacugcgcccggccugauuuuuaaaauauauuauuuuuuacucuuccuuauuccaacaauucaaaauaaauauuuuguaucuuuauuauggaucuaucuucccagguaucugauguaaaauuuaguuggcaaaaauugucagauggaaaacuuguauuaauuuuguucacaaaucuuaguaaucucaagacuguugguuuuccauuuggcuguaaguuguuuucguauaacucuaugaguauugaagcauuuucuaggcauguuuugaacgaacucuguuccagaucucuagacucaaacauggaagauucuuuuccuuccaagcuucauaaaagcagcuaauuauucaaaugcaggugucuguaaauuuaauagaaagcauaauguuuccauuaacaaucugaagacaguuggcaguuucucucaauucauuaaucuguuuacauuuaucauaugaaauuuuucuugguauuucucaugcuaaugaaaaacauauuggacaaaaaacauaaacccaccaguuaccaacagaggaaaaucacuuuagcugugccccuucuuaagaagauggcccauugggagcugugacucccucaucuuuucugguuaguuuucaaguauuagaauccauauacacaaaaggguauccagugguccucugugucuuggggcuuuuuuccuuccuccaagagagugguucuguaaagugggagcacauauauuuaacaagcuuguaagugagucguuuucccagcugggaaaucaugaggucaguucucucauucucugccuuuuuggaaauaguuaaccucacuuugaaaauugaagucagcauuagaaugaaggaaggaagaaaggaaggaaagagggcaggaaggaaggaaagaaggaauagaaaguguauuagaguuuuuuauuuucuauuuauaauugcaaacaccuagaaaggguguauucugauaaauugaaagucuuuuucuuuuccuuacugacuacuuggguggauauagguacacccacagcugaggagagcugaagauuuuggaguuccugaaguacuaaaggagagaagagauaggggaggggaggaaaacagggcuggacacgguaggaaguucugcaggcuuugggguuggggauaaggccaucuuguucaguucucaagggccagggacuuaggaauaaaagagugagcagcuccuugcauacuuauaauuccuuacuuuguaaaaaacuguauuuuuuuccuguuauauuguaaguugaaugaggacagagauggugucuguuuuguucaccacuguaccuggaacaauuccucagcucaacauauauuugagaaaggaagaguaacagguuugagugcuuagaaugugcuuugcacucaaggugcuuucuuaaauccuaccaaagcuccucaucuaauaagccugucccugaaagugccugugugugggcuaaaaacauuuucuauaguuagauucuggggagacagagccuagaccccaaaucaagcaguaagucacagcacacgggcugaaauucaggcaaagcaggaaacagagcacggauagucugcgaaaggaaggagacaaacuggagcuguugggagaaggcggagggccacggaacuucuagugucaggaggaaaagauugaaggaagcacguaacugcucugaagguccuggaagucucuaacugggguuggucuauguaaccauuuuuuaaaaauuuuuuauuuguuuuuuguuuuuugagacaaggucucaaucugucgcccaggcuggagugcaguggugcgaucucagcucacugcaaccuccaccucccggguucaagugauucuccugccucagccucccuaguagcugggacuacaggcaacugccacugugcccagcuaaguuuuuuauuuuuuauuuuuuuugagacauggucucacucuguccccaaggccggaguacaauggugcaaucugugcuugcugcaaccuccaccuccuggguucaagcaauucuccugccgcccaaguggcugggacuacagguuugugcccccacgcccggcuaauguuuauauuuuuugguagagacuggguuuugccauguugcccaggcuggucucgaauuccugaccucaagugauccaccugcuucagccucccaaagugcugggauuacaggugugagccacugugcccggccauagguaacuauuuacuccuuuagaaagacugggaagguccuuuugcuucaaaauaguacccuugcuugaauuuauuuuauuuuuugcuuaaaauuaauuaagauaauaggccucuuuugaaguauaaauacacuaggaaauuuuagaaaugaugaugguuacuaauagucaccuguacuuuaagguggauuauuuaaucagguuacuuucuuccuguaaaaucaaacugaaaucagugaauuauuuuuaagagauuuguauuucagagagaugaaagguucaaggaacuuuggaucuuagcaccugagacugggaaauaaaaauuucaagugauggggcagaaacucagaaaggagaaugugaaacacaaacuuuucauaauaauuuuggcugggugcaguggcucaugccuguaaucccaacacuuugggagucagggugggcggaucacuugaggucaggagucugagaccagccuggccaacauugugaaacccugucucuacuaaaaauacaaaaauuauccaggugugguggugcaugccuguaaucccagcuacucgggaggcuggggcacgagaauugcuugaaccugggaggcagagguugcagugagcugagauccaccacugcacuccagucugggugagagugacacccuuucucaaaaacaaaacaaaacauaauuaacaauuuuguuuaagucuguucccaucuccccuuucuucccagaaagcagguaagaaggggucaacuuuaaaaaagcuugagggagaaugugaucccaggagaaacuuccuguaaguagagguccccagugugaugggagcgucuagaaccugagcuuuggagagcccaagagugugucacccccagccuuggugcugagcacaccccacugggcuuccccaaccaaguucugugaaccugcuaacucucaauaggaauaaggaaugaguucuuuucauuugccugagucuugggccuuacaaugagaguucguuggaugagauugaacaguauauguuguguaccuguuguauucuggcccugaugcuggacccugggauugaauugcuaagacauagcaccaguauugauggugcucccagucuagccggggagaaaaaagaucaacguaucucuacuguaguuugagaaaugcuugaaaggaaauagaggauagaggagccagauucugaaguuauuaauucugcagaaaguggggggaaccagugauucagagaaagcaguaaagagggaugacuguuuaagggagaggcauuaaaaugaggaaguccccagacagucagugggagaaagugccuuaaggcugaggaaacagaaugaagguacaccaguagcaacgaggagcauuagugccugucccauggggaaauggacugcggcccauucaaaggagggaagcacauauacauacacccagcucugggauccauuguuaagugauagacugucgcgagaugcuguguuuauuagggaugcugaggaggcugcagaauagugacucaugacuucugcucucaagguugcuacagccaaguuaagaggacaaaagugacucgcauggaacaauagcagauaauacaaguuaguguauccguggagguuugugguaaagaugaguccagacaagaggaaauugggaaaggaaaaggagaagcgcagcagcagugcgggccucuagugagcacacgcggacaggcagggauuagcucaggguguggguggggauggagagaaagaaccaagaaagggaaccagucaaaaaccuuccuuccuggagcucgggcuggggguggagcuguagggcauagggugcaggugcagggaaugggccaggcuagugagcuagaaaacaaggcaaaagaauuucaacuugaguugauuaaaaugccuggucucugacagccuuuucacggagcagucuaauuuacuacaugguuuuaugugaaagaagagaaaguggaaauugggggcuaggggaagagggcuguggcugucaccggugaauaagcuggugauggacgugugacaacgggaaugaagugagagagaagaaagauacgaaagacaagacacuuuuaucugugacuccgagaugucgcuggcucugacuguguaacugauagcaucuguccacugagauccgaagggucagguggggagagaacagagccgagcccccgcugugcagucucagcgaacucccagcccccacaggaauccccacacucauguuuacgacacaugcugccaccuuucauugcauugagaugauuaagcaacuaauuauuuuucucucugugugugugugguuuauuacuuucuugauuuuaauugauauagaucuucugaauuaguugguucuggccaaaugcaacaauuuauaguuggguacagaugcuaagcacuuauuacuaagcaacuauggcuucacccgugugccaguauaauaauggagacauuuaugacuggggggaaaaugaaacaauaaaccaaggcuaaaacaaaacauuaugaagguaguaugaaaugaaaugaaaaucaaugacuacuuugccaaggguaaguaaaucacuuucuagaggggcugaugcugaaagccugcagagguuggaagcuuuuucuggguacgaagccuaaggaggaggccagugggaauggcaggaucaagugaacccucucgguuucagccugggcuucuucagaaccugccacccucucccugacucccccgcuucuccugagagaacagcuaucagaaaaccuuguucuuccauuguugcugaggaaggcuugaaucugagcuauuacacuuuauguuucuuaauaaacuccagcuggggagaaauuaaacuggggcuacccuacuuugccuuuuucaaguaaaagaaacguauaggcuucaacauuucaacaauugucugucuugguagaaugcuuauaaauccauauccauguggucacaugcucaaccucaugauaaaauggcaagccugaucaaaugcaugugguguggggugaccucacaggccaggugggaguccuccuccguuauuuuuaauaacagcuuuauagagauauaauuuauguaucauaaaauucacccauuuaagguguaccaguucaguaguuuuuugcaaauccagaggugugcaacuaccaccaucaauuuagaacauuuucauccauccagaaagaacccuuguauccauuagcagucacuuuucauuucccuccaacucccuuucacccuuccauccucagccaccacuaagcuacuuucugguucuauggauuugccugugcugaacguuucauaucacuggaaucacauaauauauugucuuuugugucuggcuuaugucuucaaguuucauccauguuguggcauguagcaguaccucauuuuuuaaaaauccggaauaauauuccgugacauggacggaccacauuuuacuuauccauuuucaucaauugguaggcauuuggguaguuucuacuuuguggcuauuauaaauaaugcugcugugaacuuuugugugggcuuguguuuuuaauucucuuggguauauaccuaggagcggaauugcugaggcacaugauaacucuguguuuaaucuuuggaggaacugccugaguguaucccaaagugguuccaccacuucauuauuaaguauccucauucccuucaccaaaaaagggaaaaagaccagcuugaauuauuuugcuguaguacugggaugauguguauuaacuaaaaagagauagaauuggaaugaccuaagagugguuuuagauaugacgucauucauuuccaucucauuaucuguacaucucaauacacuuugguuugcuaccauguagccuggauaacauucuuauucuuccaccuucccuaaguuccuguuauaugaguacagggcagugcuguaccugagcuugcuaguaugguagucacaggcugcauguggcuacugaguacucgaaaauguggcuacuugaaauugagauaugcagcaagucucaacuccacccugaaguuggaagacaagaugaaagaaaaaaaaaaucucuuagccggguacagugucucacaucuguaauccuaguacuuuaguaggccaaggcaggagaauugcucaaguucaggaauucaagaccagugugggcaacauagugaaaucccaucucaauuaaaaaauuaaaaaauuagcuggacauggugguguaugccugugguccugucuacucaggaggcugaggcaggaggacugcuugagcccaggaguuugaggcugcagugagcuaugaucaggccacugccuuccagccugagcgacagagcaagacccagucucuaaaagauaaaaauuaaaauuuuuaaauuuuaaaaaagaaaaccucucauaauaauuuuguguugauuauauguugagauaauaguguuuggugucuauuggguuaaauaaaauauauuauuaaaaaucauuucaccuguuuccuuuuaccuuuuaauauugcuacuagaaaaaauuuaaauuacacauguggcuugcauuauauuucuauuggacaaugcuguuauagaugauuuucaaggcauguuuuuugaaguacuggaaaaauaaaauuaaucagucuaaacauccuuuggguaaacucagccgauuauuagcaauuauuuucaucacugcagaaagaccaggaauccauuuguuccuugagugagaaggugagucaaagacaugccagucagcuuuaagcagugagccuugacugaccaaccaaccaaccuucauucaaaguuagcucaucacacaaauagaaacgugaccaugaagacauuaaagcaaaguccugugauaauuggauacggcgcuucucugacccuccgagugauaugugcaccuaauaagggcuggccugagauaaugcccaucuauguuguauaacccaggagagugaccgguagacacugcagacccaaaaaggaaagaagagaggaugcacauagcagacuguugggggagguuggugacugggucauccuucagcuaaugugugaauauuacuuaauucuagagaguuggcccugggcuucucacgugccuuuuuguugcaggucaauguugagguugucaggaaagcuauauugaaggcauaacauacuuagcaacugucuuuuguaaaacacacgcaauguacugguguuuuuaaucucaaaugucuggacaugagguuacuacuagugauaucaugauucaaaacagagaacagaccuguauuuuggcagcauacucagguaacauaauuuagcuugacuaaagaccuuaagacagauaaauuccugcauucuacuccacggggaagaaaaccucuucccuuggcugaggcuuucacugaugcguaaaaugaaacuugggcuggggaugggggauucaaaaggugacacaaaguccauaaaaccuuaggcguguaguaaaugaagaauucuggucuuucuuguggcccauuccgaaugaccacggaagaagaauaaaauuuagguacgagcuggcccauauuuuauucuuggccgacagcagggggacuccacguauguuugaaugaagucucuugucaaaaacguucuuacuguuuuacugugcugcuuacuugagcucacagcccgaucaaaauauccgagucuauuuucuuuuuuuuuucuuuuuuccuuuuuuuuccucugaugaguucuuaagugaagaauucggcaagcuaaucagucaucacucaucacuuggccauuuuaaaggaggaaccucagggcaguaccccugggaaguccugagaggucaugaugguuuacuggaaaacaagauaauuaagagacaacaaucugauuagcuaauauguguguugaacacauguauuuuguuggauuccuagauugguuucaggguuaaccguaugagcaaucaucuccuuugagaugguacuaagcauccauuucucuccuguacucucauagcugagaggcaugggagaggcaggaaauucugucuuggcccuggcucugcuuccaccauugaagcuucuggaaggugcagaaggguuagacacaggcauugcggugugcauagggcaccugcugcaccagaugugcaaagaaagcugcgcuggggccccuugauguggaccuggcuuuaguagaguuuuaggguagacaaaaauggucauaaaugccccucauaucuccacucggguuuuacauacgucccaaugaggaaagcugucugauuuacagugucacuuauaaauccauuccuuaccugugugccagacauugugcaugcuaacucuuccaaguggucauucauucaaaaguagacuuuucugaugggcagugcuuaacuccaaagaagacacagcaaaugaccuuccagacuuauggcagauugacauugacuggacaguaaguuuuguuggcaucuuucaaaucuuaaggagauuuucucugccuguaccuaagagccauccuguccugaaucaauccagaccccucauuagagucugggugauccagcuguagcuaccuaguuuuucagauagcaaguaaaaguuaucugagugccaggucugguggcucaugcauguaaucccggcugcuaaagaggccaaggagggaggauagcuugaguccaggaguucgagaccagccuggacaacacagggagaccucucccagcccccaguccccaucucuacagaaaauaaaaaaauuagccuggaaugguggagcauguccguggucccagcuacuugaaaggcugaggugggaagaucacuugagccugggaggucaaggcugcaaugaaccaugaucgugccacugcacucagccugggugacagagcaagacccugucucaaaaagaaguuaucugaguaccuccugugcaaaaugagaaguucacgaggugcagugguggaccagaaaugaaacuggggaaaauggcuucacgugggagagagaagucuugaggagugaucauauagagacagaaucugugauccuaaggucuggaagacgacaguuuagaugaagagguccaaaauaacaaggggcuuuugaacagguggucuguccaguagugggagaagcuaccccaucaggggguccucagcuccuaggucuugagcugccaccgauucacagaagcgaaggcugccuucagaaaacgggucuggacaaccaggaacagcaguuugccaaugccuguggcuagaggagagggccaaccuggaucguucaggugcacuucuccucuccccuccucagcccacccacguguguucucaguugucuggguaagucagcaagcucagcuggggaaaagacaguugcucugaauuaccagagaucugugucuguucaaacacaggauuaaauucaguagcaguuaaaaugauccuuuugcuuucuuaacaugagaagcaaaaauauguccuuagugagaugcuccaaggguauguuaggaaaugagugcuagaguuuccggucccugaugagguccucugugagcauucuuaaaaauacucauggaaaacaguaaaagaacugcaaaugggacaaaaucagaucacaagugagcugaacguuuuucucuuuuuccaacuuuuggacuugagguuuaucuaacauuagaguccuccucuugccugaacuuuucuggcaggguauggccagucccuuugccacaaagaaaaugcagugcuucuggcgaaccacaucuuugugcagucauagacauguuuauguaacucagaagaacuuauauaaauuuccaauucugcaaacuuacuguaacuguuggaaaacuaccuauauccugccaguaagauacgccgucuccucaaucguaagcacuaaacagucaaggauccagcuuuuguuggcagucacuuugaaaaaugcgcaaugaaggaggcuuguuuucauucuacuccgcuugguauagagugcugcaaagagcaaaaagucggaaacagcugagacauuuugcaacucuugggacuaggaagcccuucauggaagagucuagugagcuucauuuacaccucauuuuaaguaaauaaacaccaggcuuugugggcauccauuucgcaacugcucaucaaacuccaccaaaagaucguuuacagauuuuaacaguuguguccucuuuucgcagagaugggggaagcucuaaucaacaugauuuggguccacuuuugggauaugugugcuuugcuucaauacuguacuugccuucaucagcuccagcaugugacauggacauucuucaaggcaggguuaaaaacaucugcagccuagaaaucagcagagcuccccagggaggguguuaaauccagagugugcugaucuguuuccugucuuuguuaugauuucuucacuguaacugaaucuccuucggcgcugcagugccuggguacucugugcagcugugucagcaggccgaggacuguuggcuuagggggcuccguucccauuuacacggcucgcguccauaaucccagucaggccuguucguucacaggguaagcugcuccuugucagcagaucggcaggccucacugugcagccaugcuguuacauguaaucuaauuaagauuaauuaagaggaagagcaguuaccuggcugcacugauccuugccaagagaaaacccucgggaaugugaacaaaccaccauccuaacaaaaugccgugaaaaugcugcggaaaagcaguaaaauacugucuuuaagaccugcgagccgagaagugggagggcuggcacuucaccaaggagacagaguacggggcucaggguccucagguauauaggcauuccugccuggcucuuccuuaccacccggauuuuguuuuugcuuucuggguagagcucugauguugccaaacagccugugcuccucgugaacaaucucuccagacucaaaauagcgagcagccaaggggcugccacugcuugcgguccacagcucagucagcgggcugcucuuuguuggagaagaaaauacgccuucuggaaaucuuacagguuacaucguuuauucucaaaacacaacaucagcugccaguggguuuccaguaagcugcaagagcauuuaacccaaauggguuugugaccuuccuaagcggaggugugggaaggcucuagugaaguguggugaacagaucgucgguaacgcagaagucauccugcuguuccggcacuggaggcagagcccggccaacugaguauuucuccagaggauguuucugggcggccuuucccuccuuguguaaagcgucucaucugugugggccugguuuaugaguacaaguugcucacggcacaugauuggcccuaacuccccagugcuuucuggcacucuuaaaccagcgagggguuuguguuuuguaugaagguuguggaacuagagacagcauagcaccaagaacuauuuuuggucuucauugagaacucagacugggcauaguagcuacagugugccuguuggguuuuaaugcugucaugccuaccucugugagacaggauaaagguggaagucaaauguuuuucuccauucuuugccuaagaucaauucagaaaaguaguaaaaugcuccauagaagguacugcaagacccucuuaaaccagccagccucccaccacgugcuuuguccuaccaccugagggcugacguggucugauuucauacccugccuggguugugcuugauacacuuaacuauugugucaguuaaagugugcugugcugagcacuauuuacaauagcaaagaacuauuuacaacccaaaugcccaugaaugggcaaagaaaaugugcaaaugggcaaagaaaacgugacacauauacaccacagaauacuaugcagccguaaaaaagaaugagaucaugucuuugcagggacauggacgaagcuggaagccaucauucucagcaaacuaacacaggaacagaaaaccaaacacugcauguucucacucauaagugggaguugaacaaugagaacacauggacacagggaggggaaugucacacacccaggccugucaggggaggggggggcaaagggagggggagcauuaggacaaauaccuaaugcaugcagggccuaaaaccuagaugauggguugaugggugcagcaaaccaccauggcacauguauaccuauguaacaaaccuguacauucugcacauguaucccagaacuuaaaguaaaacacuggcuaacauggugaaaccccgucucuacuaaaaaauacaaaaaauuagccaggcaugguggcgggcaccuguagucccagcuacucaggagguugaggcaggagaauggcaugaacccgggaggcggagcuuacagugagcugagauugugccacugcacuccagccugggugacagagugaaacucugucucaaaaaaaaaaaaaaaaagcguaaaauaaaacaaaacaaaaauaaauaaaguaugcugugcuguuuuuaccacauuauagcaucacaaugccuuucauuucuauuuaucucccaguguaacuuuccgcuuagccacaaugcggccauggagcgggaagcagugaucuuuagccuuguuucucucuggccuucuugaaggaugcuguggguuugugcuaauaaagguggcucuacuggugaggggaugggaauguuucuggcaggaguaaaaucagaagcaucugugaucgucaaguaugauuuugucaacaugugucuuucauugaaaauaaaacucaaaauucugaguauaggaagcccuuucuagccaguccaaauggcucaacauuuauuuguucagcuauuuauugaguaucugucauaugccagacucuguuuuaggcucuggaaauaguuguagaaugagacagaaaagaccugcccucauggcagaugagaagacagguaacaaacuaaucgaaaaccgucauucaaauagugauaaaugcuagggagaggacaaggacaagggagcaauagagaggaguggcuauucuguuuuauuuauuuuuuuggagacagagucucacuuuuaucucccaggcuggagugcaaugacgugaucucggcucacugcaaccuccaccaccuggguucaagugauucuccugccucagccucccaaguagugggaauuacaggcgccugccaccacauccagcuaauuuuuguauuuuuaguagagauggaguuucaccauguuggccaggcuggucuugaacuccugaccucaggugauucaccugccuuggccucccaaagagcugggauuacaggugugagccaccaugcccggcugaugaguggcuguguuagauagggugguuaggaaaggccucugggaggaggucaugugggagugggaacaagaacagagugagggaggcugugauuugggaagcgcaucguagccucauggugugugggaaguaaaaagucccucagguggaaacagcauggaauguucuaggaauagaacuaagccagcuguagcuacaauagaguggcggggagauggaggagaugacgucaagaaauagggcuagaauauguugagaccagggggcccauggggagggcuuuggagucuauggaaagccuucagagggcucaacuagagaacggauauguuucauaacauaacccacucugacugcugaagugcggaagcagggagaucuguaggagguugugccucuagacuaaaucagaggugauggugucuuugauuagaacacugguccuggagaugcugagaagugauaagauuugggauguauguuagaggcagagcugaccaggcuugcugauguggcuaucagggaaagagugagauuaagggugacuuuuaggugcuugagcuaagcaucuugcugaacagggguacauuuauugaagggaggagcagauuuugaauuuugucuuuauuaugucaaguuugcgaugcuuauuauacauucaguggagcguaauugcaugagucuggaucugagucgagaaguuguggcugcacauaaaaauuaggagucuuuagcauagagcccagggacuggaugagaccacagaagaagagaguauagacagggaagauaagggcugaggacugagcccuggggcauuauuuaaguugagaagaggagggagaacuuagcauuuagcgcugacaaauccaaauccuaugugucugguucccucacucccaaccacacagcucuguguucugucucugucucugugucucucucuguaucucugcauguggguagcugaggguggggaugcuggucaggggaaacuggcugauaauuuuccucuuccuccuccuuccucauccuucucauuuuccaguuucucuucucucuuccuucucccucucauuucuuucuugauuaauucuuaaauucuagaaauccccaaccuggccaggagugccucuuguccuugugucuccuagcacguuccuaucuuuggugaucuccagaacaagccagugacacugaucauacgaugcuaauuuagaauucuugcuugcuaaguucacugacacaucuuaagaggggaaguuggacugggguggagaaagaagcaaaauaaaccaccaaaccccagagaccucucuuuguuguucagaaguucuccuguguaucagaagauggacuuggcaguguguaauaaaagaugacucugguuuccugcugguuuuuaggaugaugucuuuugguuacauucuuucaacuuguaaaauauuaacuuccaauucccaugggggaggaccccugaguggugcuauuucagugggacagaaucacagcauucuuucccaccuccuuagcugcccugugcuccacuuggaagcaccuguggccaaagcucauaggcacuuguguggcaggaagaacagaugugaaguucuguggaaaagaaauacaacacaaauuggcagaacacaguaacuuaaaaaauaaaucugaaagucaguccuggagagcccaucuuuggguccuggcuuugauuggaaagaguuaugguuuuguugggguaauagcagcugaucuuucguccucccacagaauccugccagagccaacacuuggaagcacacagcuaaugagaggauuucuuccaagguucuuaaccaaaugcucuuugauaguggugguugugaggcggaggaagaugcuucugcugaagaggggguuccuagaagcagcaaccaaagcccuuaaaagaaucaacagcgaucauuauauagccaccauuuagugagagcuuaccauaugccaggcacugugcuguacuccccguuucaucucaauuaauucuuacuauagcgcuauaagaaaguaucccauuuuaucagugaggaaacugaggcuuaaggagauuguauaaauugcccaaaguuauaggcccauagaugguagaaguuugaaaccacauuugcuuucagaacccaagcucuuaaucuaaaucauauauugagcacaaggugcacaauucaaguuuuuuuccaacacgguguaugugagugaucauugaugccaaugaaauuuauucacucaacaauaucuauucugcuuaacacuagaucacgcauaguugggcauuuaaagauaugugacgcuauucuuuuucucgagcaaguuaccaucuagguaugagaaaaggcuucaucuuuaaaaaauagagaagaguuuaaggcuguaugugaugaagugccacaaaguucucugaaaugccuuccaggccuucuccccauuauuuuggauauuauuaauaauacuuggcuccucuuuacuuacgugaauuucuguaggcaccuugauuuccucccccuggaaauggucuuuucuuuucuaccacauggccaggcugcaaauuuuccaaacuuuuacacucugcuucccuuuuaaauauaaguuucaauuucaggucauuucuuuuuuuuuuugagauggagucucgcuuuguuguccaggcuggagugcaguggcgugaucucgacucacugcaaccuccgccucccagguuccagcaauucuccugccucaaccuccugaguagcugggacuacagccaccugccaccacuccuggcuaauuuuuguauuuuuuaguagagacgggguuuuaucauaucauccaggcuggucuugaacuccugaccuugugauccacccaccucggccucccaaagugcugggauuacagguaugagccaccgcgccuggccucagaucauuucuuugcucaugcauaugaauauagguuguuagaagcagccaggccacaucauaaaugcuuugcugcuuugaaguuucuuccaccagauaccccaaauuuuccaaacuuuugggcuccgcuucccuuuuaaauauaagcucuaauuucaggucauuuagguggaaacguccagcagucaguaagaugugaaucugaaguucauaggaggggaaauggucauaacauaugugagagugaaaaccaugagaauggaugugaucacugacagggagcaggcaggaggcaggagcaggagucaaggacagagcccuggggcaugccuacuugaaagagguguauggagguguguauguucauucauaugcucacgcauaugaacauaggcuguuagaagcaaccaagccacaucuugaauguuuugcugcuuaguaguuucuuccaccagauacccuaaaucaucacucuuaagugcaaaguucuacagaucccuaaagcaggggcacaguguggccagacucuuugcuaaagcauggaaaaaguggccuuuacuccaguucccaauaaauuccuuauuugcaucugagaccuccucagccuggccuucacuguccacaucacuaucagcauuuuggucacaacgauuuaacaagucuauaggaaguuccaaauuguccuucaucuugcugucuucuucugagcccuccacacuccuccaaccucugcccauuacccaguuccaaagcuacuuugauauuuucagauaucuuuguagcaaugcccuacaccucaguaccaauuuucuguauuaguucuugcacuacuauaaagaaauaccugagacuagguaauuuauaaagaaaagagguuuaauuggcucacaguucugcaggcuguacaggaagcauagcagcuucuucuagggaagucucaggaaacuuaaaaucaugguagaaggugaaggggaagcaggcacaucuuaauggccagagcaggaggaaggugggggagaugccacacacuuguaaaccaccagaucucagaagaacucacucacaauacagugccaaagaggguuagugcuaaaccauccaugagagcucugcccuuaugauccagucacuccucccagcaggcccccccucaacauuggggauuacaaaucgacaugagauuuggcggagacacagaucccaaaccuuaccaaugacccagugaaauaggcggaaaagacauuuuccgagagcuggaaggagaaccaaaagagugugguguuauggaagccgagagaguuuuaaaaaagaaaguccuuguguuuucaucaguaacuuuguuguguaucaguguuuucccuucauguaacuuaaauguccacuaaugcaagugaaggcaaucuaugccuaauuucuucacuaaauauucuacuaauaaaugauuuacugacaaaaugaaauuauauaacugaaaagguuuaaaaaugauaagaaauaucccaauggaagcuguuuuuuaaauaauguuauuacugucaguaacaaaauuaugaugacacagguccaacaccuuuuaaaagagaggagguaaaaaggagaguuggauaugaagaaucucagacugcagugcagcucugagaaagucucagccagguacaugggugcccgggagcagagauugccugucagaagggccccaugagggcagaagugaccuggcucucgugucccugccaugaucagucauuggcuguaagcagacuccgcccggacuguguggccucggcaggaaucacgguggcagauugagaggggcagugcuggaggcugucagcuggcuaggcaucccuuauugcugaauagcuuacugagggcguaccuccguggcugccuagugagucucuuucuguaaaagcaguucagugugggagucccugagagagaguuugcugcagaagcuucauuacagugaccuaugaagcaacugacagcuuugcagaguuuguuuccauuauguugcaggucuccuucaaaacaaguuuuggcacuuuugaugccaacuagaguguaaacuauauuuuagagcgacuaguuuagaguguaaacaacaguaaguggagcagauuuccucucaacuuagccucaaagauaaccucucacacuagaguuauuuuuuuaccuaauacuucuuuuuuuccugguuacugaaaucauacacacuuacuauaacaaucuguagaaauguguaacuuagagaguaaaagucuucuauaauauucuaucccaaaauauaaucauuguuuuaaaaagguauguauucuaccuuaaaguccacuuuuauuguuauauuuuacuauaacauucuaauuauaauauuuuauuauaauuuauagguuucaguaugauuucaaugaaagaugaauucuggcaaacaguauuuauuccccuuuccccgcugggugucauuucuuugggaauagaaaaaugaccuuguuuuguguaucuagccaacaauucuuuuuaauauuugugaguauaccaaauguacaauauuccuucaacugaaguaacuuuuuaaaagaaacuagaauuuauuccuccguaugcuuuauuuucaugagguuuggguacaguauaguaaauuuaaaaaucuuuugaacucuuuaaaauggucuuuguaccuauauaauagaaaaggaucuguucaaaaaaauucuugccacaaauuccuuuugaucauuuucauuuacuuaauugcucuaauuuaugcuuauuuuuguccacugacaaccuaauuggccucacagacuucucauuuuauucaaaguccaccagcaguuacuucuuuugaauaccaccuccccuuuggacuccacgggaauuuggacaauaauugugauggguuuggcaggggcuuggggguugggcugcucauauauuaugaaaagccuuaguagagaaaaauuacauuucaaguuaauuuguuuuuauauaacagagucugggucuaagcuuuccuucaccacauacccauugaggguuuuaggaagucaacauguuuacacuguaucuuaagucaaggguccuguuuuuauacaggguuugccaaaccaaguuuacuacagugguguucugccagcacaaagauuacaggaucagacuuuagcgaacgcucguuugccagagucauguuuuaucuauucaaccccaaccacccugauucauuuuggaaagucuacucuguuuaucccacgaugaugacaaagugguuaaaaaagaagauuacuacaaaaagugauauuuucaagagagacacaaaggcacugauacagacaggcuuuagagaaagacaaacuuugugguaccacuuggguauuugaaagcagcacaauuauuuuuuuucagucacagggagacaacauuuucccauugaacuuuuuggauacguauuuucacacacacugugcccaaaagucagauucucuccuccaucccaccccuaacccaaauuacaauuuaauuugacugcuggcuguuuuugaaaagaauucugaaagugauugaccgcuaccaaagaugaagauuguaguuuuucuccugauaugauuauauucuugauauauucuugcuguaggggacaaaaagugaucaauagcuuuaugcuuaguaaaaucagagaggacaggacuugcaauuuaaugguuuuaccuuuauguuuacuacauauuagcaaaguaucuaagcucuggaaacugugucucccuguaauguugucaaguauauguggagaggugaauuuuacagaaggagaaacugggauuauccuaucccgcuuuuuacaguggcucauaaagagcaauguacuagauucucagcacacacagguuauggauugcuguuuuuccuggagugccuguaugguggaucuguuucacuuggucuggcaugggagucaaauucuauuugcaaagcccgacuggguggccucugcucagcacgccaggcaagagcugugggugaauuuccagaaguggcaggcugcuccccucucccucuaccuccuugagaaacagaggaaguucaugcugccacaggggaaguggaagggauguccaauugccucugaggaagucauauccugcucaagaagcaagaucucuucccaugcgggaaggugccacugacacaguaucucuuagauggcauaaucauagaugaccugaauuguguguagaaaagggaguuuacuggaagauacuauuuuuguugguuaacaaagggcuguaagccaaguaaagccugaauguaugugucaucugcauagugugaagaggcuuucauagggagagauuccacgugugacuaucugaccuaaaggccauguaauucccauggugaagucccucccuccaagcacaggagccagaggagcccuuaaacagccauccucuuggacguggaaagauaaacacuauaaaugaucaaggauaacuguucaggugguacugaccacucuagguaaacuguuaagaguugaacauagaauuuuuucaaaagccuguugauguauuuaugugccucaggaccuuuaaauucugaagauaaauggauagaaugauucaggaugauuuagggagaaggcagauggaaaaugggaaugaaauacaugccuuuuuguuuuuaggggugcucaguuauaaauaugaaaggcugagaaaaugcuaauuguacaguaagaucaacuggacuuguuuuaauaagacaauaauuugaaauuaguaaacuauuuuauacaaauagugcuaaaacuuuggaagguccucaaccuccugggcucgagcaauucucccaccucagccucccaggugugugcucccaugccuggcuacuuaaacaaaaaaaaaaaaaaauuuuuuuuuuuuuuuuacagagauagggucuugcuauguugcccaggcuggucuugaacuucugggcucaaguaauccuccugcuuuggccucccaaagugcugggauuacagguaugagacacugcgccuggcccaaagaugauuuuuauaguaaaaaguuaaauaucauaacaaucuggcaguuccucaaaauugaguauaaaauuuucauaugacccagcaguuucacucuuagggguguguguuuguguguguguauguacguauguacauaugcacacgugcacacacacacacauauauauauacaccaaggagaaauuaaaacauauccacauaaaaacuuguacaucaauguucauaacagcauuauucauaagagugaaaaagugaaagcaacccaaaugucuaccaacugguaaaugauaaauaaaauguagaauauacauacaguggaguauuagucauaaaaaaggcaguauuuguacaugcugcaacaugggugaaccuuaaaacucuuaugcugagugaaagaagccaggcacaaaaggccacauauuaugauuccauuuauaugaaguguucagaacaggcaaaucuguagggacaaaaaguagauuaggcugggcgcagugacucaugccuguaaucccuacacuuugggaggcugaggcaggcagaucacuugagcucaggaguucgagaccagccugggcaacauggugaaacccccucucuacaaaaaauaaaaaauuagccgggugugguugugcacacccguaaucccagcuacucaggaagcugaggcaaaggaaucacuugagcccagguggcgaagguugcagugagccaagauugcaccacugcaauccagccugagugacaggaguaaaaccuugucucaaaaaaaaaaaaaaguggauuagugguuuucugggggcuggcagagguaugggauuuauuuuuggugugaugaaaauauucuaaaauuggaaaauugguuauaguguuggguauacaagucuuugaauauacuaaaaaccauugaauuguauacuuuaaaugggcauauuguacgguguggggauuauaccuugauaaacuguuguguuuaaaaacauaacagauaaccgucagaucugccccaucagaauuucauaauuuggcauaauuggggcucaaacaaaugaggccuuguguugcaaauauaggcaacaucugcaaguuaccaggagcaaaguugcgaaaugguagcuguaaccuaggagagauggauaaugauuuuuccaggaugcucugaaauccacacuaaauggaaucugcuggugcauacuuuaugccacauugaaagaacaagugcauguuauugcacucucuggcccacauuucagucaguucuccguaugaaaauuacugcccuggucagaucugauuacuuuauuauauguucaccccagagugccaaacuucaugugggaaaaccauuuucaacaggaagaaaugaacugugaauauccuaagaagagggcaacaagucauauuugaccuucguuuaaaaauaauacguaaggaaaaauuucuuaauaaauagacauagcuuaaaacaugaaacguaaaaaaccaagcauguaguaguuuccuagaucuggaaaagcacugcacacgucagucaugcauacccuucgaaacugcaauuacuauagguuugagaccccaugggaugauuggaggauauuguuucugacaacuuaacauuucuugccuuaagauaauauggaaauaucacgucaaucccauuuguuugcagauacaucuuuuuuaaaauaaaaguuguuuucacauugggguuaguuuucuuguuuucgcgccuauauuuuaaccuauuuuaaccuuuucucuccccucccuaccucacccccaccuccaaaaaauuaaacucuuucuccauaaacaaagcugagagugucaggauuggaagccacuucugaggauaccauuucaaaauuauauuaaugucaugaaaacugcuucuuauauuuuacauugaaaugugaauaugggcuuguauuuucuauuuccaugguuauucacaguacugaugguauagaauuuuuagguuuaacuucaguuaugucauugguuuuaccugccacagcauuuucacuggaucagcccccagauauggauucuagacucuaucccagugaucuccaaaguaugguauaaacauagaauaaacaaaaauaaacauuugucuauuuuuuaucugaaaaagagacaguuaauuuauaauacuauugaauguaucaaucaucauaguguauguuuauaauuuauaaauaaauaugugcauuccgaaggauacuugcucauacuuguuucugaugagguuguuucauggaaaaguuuggagaucucuuguguuaguccauucuugcauugcuguaaagaaauaccugaggcuggguaauuuauaaauaaaagagguuuaauuggcucaugguuguaccggcuguacaggaagcauggcaccgacaacacucggcuccuggagaggccucagggagcuuuuacgaucauggcagaaggugaagggagaguaggcacgucauauggugaaagcaggagcaagauagagaguggggaggagacuccacacacuuuuaaaugaccagaucucaugagaacucacuaucaagaagaccaagaagaacaauaacaccaagucauucagagauccacccccaugauccaaacaccuccuaccaggccccaccuccaccacuggggacuacauuucaacaugagauuuggguggggacaaauaugcuaacuauaucagcacguuccuuuauucuuugcuuucuccuucccaugcuaacagaacccuucuccuuaggcuccagccacaugguagauuuccuccgauucuugcuccccuuacccuacaccaugagacggaggggaugcaggcacauaucuaaagccaagaguaccuuaaaguucacaaacaaacacauguucccaugaaaaccugaacagacaaccacacuuccagaaccaacuauuuuuaaccaccauuuaaauagaaggccaaagaagauacuuaaacaaaaaguuaaagucguuucacuuuacuaaccaaaagacaugaaagugagauacaagauaauugagcuuccuucagauuugaccuuugguuucuuucagccaugaggaaauggauguaucaauuuuuccagauuuggagauuuugaacaauaacuccaaucugaaaauaccaaaagucagcuaaauaucccucaaguacauacuauguuuuagauacugugggaaaaucagaaagguauguguuuuuaagagcuuacaaagcaauuggaaagagaauauauacauacagaauauguauuuuucauguaccauauaauuccguauuaacuaauauauguauagaaaauuaaugaacagucaggauucuauauaagacagucuugacacauuagugaaaagagaugacuccugcuagcagguggcuggaccagaugaacacugcagugaccugcagcuuuuauuuuauuuuauuuauuuuuuugagacagagucucgcucugucgcccaggcuggagugcaguggcgggaucucggcucacugcaagcuccaccucccggguucacgccauucuccugccucagccuccugaguagcugggacuacaggcgcgugccgccacgcccgaccaauuuuuuguguuuuuaauagagacaggguuucaccguguuagccaggauggucucgaucuccuuaccucgugauccgccugccuuggccucccaaaguacugggauuacaggcgugagccacugcgcccggcugacuugcagcuuuuagacagaugccuguaggauugugcagaagagcugguagaaagguucuaggaguuuggagaaagaaggggucacccugggcuggaaugcugagaguuucauaggcaagggaaacuugaacucacauagaagcagcaguauguguagagagcaaugggcagaaauacacagaacucaacagcugaaccuuccuuacugagggggcuaagucugagcuuggugcuacgcaucagcauggguuuucucccuugggccucccaacagcuccacugggccaggcuucgcuguuuacccaaggucaugccagucaagucccagaggcaggcuugggagagaaaucagggcugaggagaaagauucagaugcccucuaaauagacaugacaaucaaacuugaauuuauaagucaucucugaaggaaauauuguggagauggaaaaucggagagccacaguagccuuuauuucacaccucuguaacuucgucuuuucucucugugucauuuucugacucuuacuccucaaacauccccagcauuaaggaauacaacaucggauacaggcucaggaaucccacccauaaccuucucaguccccacugacagucaucagaagcuguguguguguguguguguguguguguguguguguguguguguguguguguagagagagagagucucacucugucacccaggcuagaguguaguagcaugaucacggcucacugcagccucaagcucccaggcugaggugauucucccaccucagccucccaaguagcugggauugcaggcaagugccaccacaccuggcuaauuuuuuguauuuuuuuuguagaggcaggguuuugccauguugcccaggcuggucucaaacuccugagcucaagcgaucugcccgucuuggccucccagagagcugggauuacaggcgugaguccacacugugccuggucaguuuccuguugaauuguguacagcuacaacuauauaaagaaaaacauuguuaguauuuguccuaauguaaauuuuuauuggggcauauucacuaguaaaaggaaaauaugagcaugagguagaauagacaccauuguuguacaagcauauggacagcguccucgucagauccaucgccgugaaugccccaaucuagagucuguacgcugcacaguacaaggcugugucugcguugcgcaccauuauguacucagcaucacauagugugaugaacaguuugaaagagcacuaaaugauuaagcccaguguuucucaaaguguguuccuugaagauaguuuccaaagaugguccuuauaaaagugucccuugagcucacauaagcugcagagcauaguuuucuaugaagacguacaguccguauagcacuuuauuuuuuuauuauuauuuauuuauuuauuuuuugagacagagucucgcucugucgcccaggcuggagugcaguggcacaaucucggcucacugcaagcuccgccucccggguucacgccauucuccugccucagccuccccagcagcugggacuacaggcgcccgccaccacgccuggccaauuuuuuguauuuuuaguagagacaggguuucacuguguuagccaggauggucuccaucuccuggccuugugauccacccgccucggccucccaaagugcugggauuacaggcgugagccaccacgcccggccugcauagcccuuuaaaacuaagccccgcuguagggagccuauuuauaucuccgucuaacaugacauuuccccaaaucaucuguuauugugaguauuugaaacuuuccaaaacucagguauccuauagguaugauggggcugacaaaaucuguuuaucuaacucaaauguuggaagaauccaaugcauuaacauaugugaaaaugcuucaaguauaacucuauacaaauguaagguauuaguacuauuuccuaauugcaguuggcccucugaaucaguggacgaggaacccauggauacagaagacugauaagggacuugagcaucuguggacuuuggcaucccagggcauccuggaauccguccugcacagauacugagggaugacuguauuguugcuauaugugcuauucuccaaacucaugaauuuuuucggcuuuguugagguauaauucacaaauaaaauuguacauauuuaaaguauacaaugugcugauuuauguauacaaugugaaaugguuaccauaaauauuaacacauuuaucccuucacauaguuaccuguguauguguguguguguguguguguguauguguguguguguguguugagaacauuucagaccuacuucuuuagcaaauuucaaguauauacuauaguauuauuaacuacaguuaccaugcuauacauuauuagauccuccgaacuuauucaucuuaucacugaaaguuuguaccccuuuaaccagcaccuccccauuccccaucccaugucgcaacuacuguucuacuuucuguuucuguaagguguuuuuuuuuuaaagauuccacauauggugauaccauacaauauucgucuucucugucuggcuuacuucacuuagcauaauauccuccaguuucauccauguugucacaaauagcagaauuuccuucuuucuuauggcugaauaauauuccagugugugugugugugugcauucauacacacaacauuucauuuacccacgaaugugucaauggacauuuagauuguuucuguaucuuagcuauuguaaauaaugcugcaaugaacaugggagugcagauaccucuuuaagauacugauuuuguuuccuuuggauauauacccagaagugaaauugcuggaucauaugguaguucuguuuuuacuuuuuuugcagaugcuucauauuauuuuccauaaugacugcaccaaauugcauuuccuccaacaauguguaagguuuuuucuuuucucuacacccuugacgacauuuguuaucuccugucauuuuuauaacagccauucuaacaugugugagguaacauuucauugugguuuugguuccaaauagaugaauuuuaugauauguaaauuauauuucaauaaccuuauuuuuaaaauuuuaaaauaaauuuuuuaaaaucuuauuuuaaaaauacauuggaaaagugcaaaaaaaaaaaagaaucucugcuucuggagaccauaagguuuagaaaauuugguuuguuguguauauuaguuaggguauaauucucucuguguguguuccagguuucucucucuugcuggccuagauaccucuuuccauucauuuguucauugguuuauucauucauucaucugaccaguacugagcaccaaagaucguauaucauuuugguugguacaggcauguggacagugacucugaauaaagcaaagacuauuuuaaggaguucacaguuuugagaaaaggcagaccuggaaacaagucacucacuauaaaacagugaggaauauaccauugugaaaguuugaacaaggaacaaugggaugaaguugauuucucagagcaaggaaacuugccucaucuaccugggaagaucuugccucaucuucuucuacuuuuagaggaaggcagagagagaaguuugagugagaucuugaaaguuucccagguagaugaggcauguuaagggcagccacuuccucuccaaaaucauuauuucugcuuccuuuauuuauuauuccuuccuuuuaguugccccuuuaacuccucaccaucauggccucgucuccuaacuuuagcucuggucuucuuucuucuguggcuuuugagcauuuguaaauguaggguaauugggacuuuccaaaaugaguauuuuuuuuuuuuuuuuugagacaaggucuuauucugucgcccaggcugcaaugcaguggugugaucacugcucacuguagccuugaccucaagugacccucccuucucagcuucccaaguagcugggacuacaggcaugugccaccaugccuggcuaacuuuuuaauuauuuguagcaaugggucccacuguguuguccagucuggucuugaacuccuggccucaagugaucuccugccuuggccucccaaaguacugggauugcaggugugaaccacagcacccagcuggaaugaggauuuuugaucuuccauuguaucucuaauauguugucuuuuuuuauuaagugcagcuaaacuugacuuauaaaucuuuaaauuauugaaauuaaaaugacaaauacuucagguuuuaguauguuuaaaauugauaaauauuaagaguuggcagaaauauagaguauauuaaaauuuggaaugaauuuuagcuccaugauaugguucuacuuuauauuugaggcuaagcugucaacuucgaagauaagagaaaaagugaauuuuucuucucucaggcuggguuguaauagcaugagguuuaugcuggcacuuugacuuuacaacaucugaaaucacucauaucuacuuuuuuauauccaauaguaucucuguaugaccaaauuaauuccuuuuuuacauuuuauucaagaauauggcuuuuacauuacaaccuagcacauagucaucuuacuccuuuuauaauuuuuuauagguuaaacucaaaauauauucaggaguucagagcugaauuauaauugacuauaaacacguaaccuauguauguagccuauaaauuucuaaaaagucuauuucuuuggaacuaugugugcuaugagaugacagaucaaagcuuuaaauccuguuuucccgagucuaguuuauuaguuugucagagaaauauuaggaauuuuuuuacacaauuuguagcucaguuuguuaaaugaacugauagaugcgacaaagcuucgaagaaaaguggcaccugggagaggcucacuuaacgcaaccuauugucauuaguauuccuucuccaaagacuuuucauuuaacucaaauauugucaugugaaguaucaccauccggguugacucaagccacuuauccaaaucagaauaaaacuuuuuagcccuggagucauuuccuguccuuucuaaucguacuuaggaauaucguaaagagacauaacucaaccagccaucagcugagcagaugacugcaaguucgucauucugugugucugcacauaccccaccagcucagccaacaccgacauuagagcuaugauagaaaggagacuauggaaacagacuugaaaaaaaaaauccauuuuaaguggagagucaugggacaggucacagugggcaggugaaagaauuuuagagaaaugaaaaugcugugcagguggucacccugaagcuaauuuaacuugggucaucugugaucuguuccagcugugaacaugugccugguggcccagcgucccagauguucuuucucggucuuuauguuguauagcccauaaaauuaaaacaggauuggaguuuaauucuaggccuucacaguccuaucaucaguguucaguggagcuauuuucugaaaauguaggguccugguaagagaggccuugguugggccaagacagccuacuguccccuguaauuuuuccucaaugacuucugcuuccaucucuccacugccuccuucauaccagucuccaauuuuauucugcucagagaauugcuucucaccuuggaagcuccuagcucauguaauuguguguuaugaacuagacauuucugaaaagcacaaguauugugcuacucaucguuuuauggcaaaaucaauuaauuaacagauauuuuuugagcagguguuaaguauuucaauauugguaacucuaccagccaugggagguauacaaagaaaauguaaaaccuggaccuuggccucgaaacuuggcagcuggugguagaggaaaggagaacacacagaagaucaucagagagcaauacccaacccuuccaucacugucggggaaagccaugcacccccuugugaugucuccuucugcuugugacuuuugguucaggugacucccagauagauuggaaguaaggccugcaaauccuaauuaaacacagaggagaucuguguaauaucuacaccaaaucuaccuuuauaacauaaaacuccaaaucuaaauuccagaaagccaccccuguuuccccccccccccccuuuuuuuuuugagauggagucucgcuguugucaccugggcuggagugcaauggcaugaucucugcucacugcaaccuccaccucccagauuccaggaaaucuccugccucagccuccggaccaucugggauuaauuacauguacccgccaccacaccuggcuaauuuucauauuuuuauuagagacgggguuucaccauguuggucaggcuggccucaaacgugugagcucaagugauccacccaccuuggccuuccaaaguguugggauuacaggcgugagccacugcgccuggccccgcuuugcccuuuauugccugcaaaauaaaaagaccucuuucucuagcuaguucccuggcagaguggggccuaugugagcagaauuuuaaucacuaacuagagcucuuucacuugaccaagaagcaagaagcaaagaguugauggcuaacuggaaguuacuuguuuuguagcaauaauguggcugacauacuaugcccauuagucacagauucugacuuaaauucucuccagagacaacuuucauacacauggaagaugaaaggggaaaggugaacaguuauuaaggauaccugacugccagaaaugccgucugagucuuuuaccauccaaauuucuguugucaucagaaauaagaguguaaaguuccaggaaauucuucaggcugacccaucaauauaauaguuauuaucuuucuacacuuuuugcauuuugaaaacaaaugaacuucuucaacuuauguguaaaaggcuacucaauauaauguuaauauuaagauuugggauauccaagauuuucuaaaaguagguagaguucugaaugcuuuguccaccucuggauagucagaaaaagccagcguauaaaaagagacuucaaauguguauuagccagauagagagagagagagagauuuggauuuaacuucugauaugguuuggcucuguguccccacccaaaucucaucuugaauuauaauccccauaauccccacaugucaagggugggaccagcuggagguaauugaaucaugggggcgguuuccccaugcuguucuugugauaaugagugcaucucacgagaucuggugguuuuauaagcaucuggcauuuccccugcuuggacucacuccauccugccaccuuugaagaaggugccugccucuucuuugccuucugccaugauuguaaguuuccugaggccuccccagcaauguggaacugugagucaauuaaaccucuuuccuuuauaaauuacccagucuuggauauuucuucauagcagugugagaauggacuaauacaacuucuuauccuucuucaaauuggaaggucaagucaguuacauuuuugugaauauuaauaaugugcaagagagugugcucggugccagaaucuuuaauaaacucagaguccagcuaggaaaguauaaaugaaaagaauuaaaauaucagaauaguugcuaaauaaacaccagaaagcugcuggucaaagucaggaaaguuguugugauaacaggcaaggcugaaaggaugcauauuccaagcugagcaaauguugugagcauggccucgagguggggcacuucugggaauggcaagugguuugguucaauggaaggauauguggcuagccaggaugagaaauggagcaggaaaaagugguuuaggcuaaaaucagaggggugcauugggaauaauguuuucauuaaaagcuauuugaaggagucuguaaggaaaaaaagagccacuguauguucagcuggggagagugagcuucaaauaugugcuuuugggaagaugauuuugauggcacuaugaccagggaagugauuggagagaggagauaucucaggcaggaauuugaguuugacagugcauugcaucacuccaggcaggaguuacuggcaaccugagcugaugaggacagugacaaagaacugucagaaggaagaguggccaagagagguuuugcagaggaagaaugggccagaugugacugcuuaugcaauauaguaauggaaacauggacuccgagccagaucuaguucauauggaagcaaaacauuagccccagugauagaguugucaugaaaauacugugugcugcauuuaucuuucuggauuguuaucagucauuauuacuuuguauuuuugaaaaauaccugcaauuuuaaacauuguguaucuucuuuuguuucuugcauuuucaaaugaugcuuugaaccacuuuuuaauuguuggcauaugcacuuacuguauuuuauuguaaguauaaagcguauauccuaauaauucuccuuccuuuuucucagacaaugagaaugacuuaaugguuuguggauaauauuucaguaguguuacauuuuuaguaauaauagcaaugaccucauauaagcguaaugacucaccuaggguaugaguaugauuuuuauaguagacuuugcaggguauuuggcucuucucuucucuuuucucucucuuaauuauguuuggaagauuauaagcugcuacaagcaaaucucuucuuagccuuuuuuuuuuuuuuuugaggcagggucucacuuugucgcccaggcuggggugcaguggugcauucuuggcucacugcagucucaaccuacugggcucaagcgauccucuugccuuagccucccaaguagcugggauuacaggcacacaccaccuugugaggcuaauuucuguacuuuuuguagagacaggguuucgccauguuccccaggcuggucucgaacuccugaguccacccagcuuggcuuuccaaagugcugggauuacaggugugagccacugugcugggccucuuuuuagccuuuuaauaagcagggcagacucuggauucaggaugcgaugaucaggucuggcuuaggaagccuuuuuugucuucugugagaaacaacuccuggagcugauuggcuuuugggcugaguaacagcuugaugucagggccuccuggggaaugcaacaucuccuaagaaaccaauggucuaguugccacaggagucucagagaaaaaacuggcaguaguacucaaauagccuucagacuaucugagguuucucgggacuuaccaguccugccucagaugaagccccaggcauccuugguuuggggguagaaaacuaaagggcagccuuucuaaaguaacaacuuuccaagcgcaaggauggagguacuuuccccuaggguggagcaaaauugauagcaagugcucaaccauuuuaaugauaugacuugauccuuuuuucccucauaggaaaaaaauguaagcucagacugaaauaagugcugcuucuuauuuucagccuccgauuggugugguucagcauguuaacuuguuugaaggacuaccauggggaaacaguccaugaacuuagagaaauuaggcagaacugaauguuaaauuugaaaaugaucucaagauagucaguucugcuguaauccaauguauuuccuuccuaacaaucaucacacugugcaaaauuaugccaugaaagccacagacuuacaggaaagguggaguaacgggcacaauacuccaaaacuuccucagugacacaugugaaaaaagagacaagaaccuaauaaaacugucagcacaguuuaaugcauguuaacuggcuaagaaauacauaaauacaaaauaaauauggcacuuuaccuugaaagguuugcuuggggaggugagcgccggaaggguugcagcuugugagauuuugugaaggggugcaaggaagguuguccaaaaucagauagacaguauaucagauguggauggguguggcucgcagcacauggugaacugagggagcugguagauuauugaggugugugcauguguauuuuguggauuaguccagcuggaagaaguuuucugcauucacuuaguguuuuucacaaaagaaaucacguauaagcaaaaaugcaaaauucaugauacacccaaauuuuucccuaauguaucaauuagguuggaaugaauuuggauacagcagaacugauugcagucuuacccccuuaguuuuuguauaaagaaauugagacccagucagacuaaaugaaguuuuguagccagguuaguggcugagcugaggauggauuccuagacaucgguuccuuuucuagcgggaguguccaccaugcucuguuuccucuuucgcuguauuuuauaaauuccugcuauuugcugaugauaauauuguuuuaguacuuaaauauuuuaauguaggucucagagcuagauccuuaauguagauaccagaacuuaauauuuggaauccaauaaauguuuguuaguuaaugaaugaauuaauuaaugaagguggugaauggacauaaucaaguccagguucacuauggauccaguuccagaccuaagaguguagacaaaaagauggagaagaugugauggcguauuuaaaguuaaugacagcagugaucuuuccauguucuauucaagccuucuuggguuggauuuuaguaaaaugauuuagaguguggggggcuuugugacagaccacaggcaaguuauuuaaccucucuagauaauaugggauuuaccucuuuggguuuuuguaagaguuaggggagauauacauauauaaaaucuccuuagcacagugccuggcacauggcaagaguucaauaaguggcuacacuuauuauuacuacugcugcugcuacuaccacuucuacugccgcuacugcuuucccaacauacuauguguugaagggaaccgaggaccaguaaaugugggggaaggagcccuggcacuccuccuaggcacuggcccaguuuucuuaacugcuuauugcuggaccucuccacccagcuguguaacaggacuucaaacucaacaugucacacucauuaccuugcuuccagugugcuccuccucaugcauucaccacauuaaugccaucccuauuugcccagacuaaacaccucagucauccuuuacuuggcugucuucuuccaccuccgcagucuauagguuauucauucauucaggucugguuuuauugauaaccaguugggucucaggcaucugccaacgugcuucaagaaauaaaccugaaugagacaugauccuuguccugaggagucuuucaauauaaggcagagaugcaaacuaugaagacucugauccaaaccccacaucaguaaccaaucauuauaaaauguguauagguugggcguggcagcucacacuuguaaucccagcacuuuaggaggccagggugcaaggauugcuugagcccaggaguucaagaccagcccgggcaauauaacaagaccucgucucuaccaaaggaaaaaaaaaaaaaauuagcugagugugguggcacuuaccuauagucagucccagcuacuugagaggcugaggugggaggauugcuugagcccaggaggucaaggcuguggugagccuugaucauaccacugcacuccagccugggcaacagaguaagaaaaaaauaaauaaaauaaaauaaaaugugugggccagugcaagaggccacagccauaguuccuauauguugccacucacuuaaaugcaaaguggacauugauuuuacaaguaaaauugauaaguauaaucauggagucauucuauauuuccaaaauuguggccccuuggguuaacaaaauauauuuguuuaggaaauuaguuuuauuacuauauuuauuuuguguccuaaaaaauguucuuucauaugaccauggcuuuacauuaaaugguuucccucuucauugggauauacaguauuucagcuggaugucuguaugaugauuguggugaaagaaaaguagguugaaaauaaauuaaaauugacuuuucgguuuaaaaaagugacuacuuuuuagauaguaggcuggauuuauaaauuuagcuuagcccauuuauacucaaauucuuagcaguuuugccuauaccaauaaauucuuagagauuuuuauucacuggaaguuuaaauuuacuguauaagugaaagggaaagacuauuuuucaaaauguacuacuaauaauuaggaaagaacucuggaaaaauauaauuuuccaaaauagagguaauuaauaugcaaaguuaucuagauauggaguaugcaguucuccaaaggauuuauuuguucuuucuucuaauuuuuuuuuuuuugaaacagaaucucucucugacacccaggcuggaguacaguggcaugaucucagcucacugcaaccucugccucccagguucaagugauucuugugccucagccucccgaguagcugggacuacaggugcgccaccacgccuggcuaauuuuuguauucaguagggacaggguuucaccaugauggccaggcuggucuugaacuccuggccucaagcuaucugccucucaaagugcugggauuacagacgugagccaccacgcccagccggauuuauuuauucuuucaacaaauauuuauugagcaaauuccauaggccaggcccuguccugggagcuggcgaugcagaacugagcaaaacagagucgcuauccuaaggcagcuuacauucuauuuggagagacggaaauuaacaauagaccugugauaccaggcaguaauuaaaauaagggcaauaaagauuagaaagcaaagggggcgcuaguuuggguagauagauggaugaggaaucuuuacgaucauagggcugcauuuaugcucacgugggccuggaaucagccauucauauccacaucugucaucaugcagcucuauguugucuuucucuuuggggccuguucuuugcuagcuuguguugguaaagaauuacaugaggccaggcacaguggcucacaccuguaaucccagaacuuugggagguugacgggggcgguucgcuugaggucagcaguuugagaccagccuggccaacauggcaaaucccugucucuacuaaaaauacaaaaauuagccgggcaugguggcaggcaccuguaaucccaguuacucaggaggcugaggcaggagaaucacuugaacccgagaagcagagguugcaaugagccgagauugcaccauugcacuccagccugggcaacaaagugagacacugucuuaaaaaaaaaaagaaagaaaaaaagaauuacaugaaaaaaaauaguuuguguuauuuacaaucaaaucagccaacuguagagauugucuggcauuguacacauuguucugauaacaguuuaaauacuuugaaauuugcaucauuaccaugggagagacaacguguucuuguuaaaaaaacaaaucaaaacaaaaaaaacauaaaaacacacacagaguagaugauuaacuuacaucucaaugugagcaaauuuuuaguuucagguuuugugacuucauaaucucuggggaauuuuccuucuuaauguuuaggaaaaaaucacucccuacugcuuuuuaaagaauuaaaagucucacuuguguguuaagaaugugcacuuaggccuguuaaaaaauuaugauuacccccaaaauggugggcuuguaugaccuuuuacauuuuuaaaguaaagccuuccaucugguuaaaaaauaccuuuuauaaaagccccuuuacgguguuuguguuccuuaguaaaugcuagauuuguuccuuagaaaauuugcucuugagcaagucuauuuugaccugauguaauugaauccaaagggagaaaaacauuaaauuaaugaaauuuuauugaaaagacaucuuauuuauauguaauaguuuggugucuuaauuauuauuauucucccaaguuauauuauaguuuuaaacuuaauuuucaaaaaaagacaacuuucagucaccuaauuacaugcaaugcagcuucuuuucagaaguaauaccuuauuuaaaguaauucuuuuaugaugaacucccaaagaccuguaccuaaacauagcagcugaauauaauuucuaauuaaugacuuuuuuaaggcauaauagcagaugguugagccauccaugggguguguugugguccauuuguuuagucacccagugaguuacuugaaauaaucacuuagcacuacuuuuaacaaaaggaucugauuuuucuguucucaucucacaccaaauguaaaugaacucuaugggaacaaggacuuuuucuguuuuaaucacugccauauucccagugcauagaacaaggcaaggccugugguaaacacugaaucaauauuggguagaaaaagcucuuuuuuuuuuuuuugagacggaguuucacucuuuuugcccaggcugaagugcagugacaggaucucagcucacgcaaccuccaccucuuggguucaagugauucuccugccucagccucccgaguagcugggauuacaggcacauaccaccaugcccggcuaauuuuauauuuuuaguagagaugggguuucaccauguuggccaggcuggucucaaacuccugaccucaggugaucugccugccucauccucccgaagugcugggauuacaggcaugagccaccacgcccggccaggaaaagcucuuuagguaggacuucccugggagcaaauaacagaguguguagaauugcauguuuuuaaacgaugauaaacaccaaaggcaauguucuucuuaaacauugaaagagaaagagaacgcccaccagacacagccagaaaagagaauauggaaucuggagagcacccugaggugggccuagggucuccuucauccugggauagugcuggguguuugguaggccccaaauaaauguagucaauaggugcgcauucgauucaauucaaugcacauuugaggaccgguuaugaauugugcaagucacuagagagaauacaacaaugaagaagacaaggucuuuuuccucagaggauuaaagccucagauuuuuuagucccaguaacagaguuuuacuuuucuuucaagagggcugcaucucugaaccaccgucuagggacuccagugaagaagcucuaaagagcuaggccugagaaaucacccaggucagcucugcccaucaagcaugagauguagagcacaccuaucaacguggacuugaugaccucagauucuaaaugcuucuuuacccgucuugaaaugaggauuucucucccuacggcccacauaggacgcucaccucgcuugcugggagucaccuuuguuggcauugcuggcguagcugaauuuggcgaugcuuuugcuaaccguguugucugcugacucaucuuuacuacacagaugagaaccagaaagguuaaguggcucgccucacaucaugcugcuugucaguagcugagccagccccaguaugcaagucuucuaacucagaggccagugcuguuuccaugacacccucuucccucaagucaucugugugugggaggcagaaaauauugaguacacccaaauugccuaucaguggaauguuagucagcauuggaaaugagacugauuacaacugcagccugccacgcacagccaucccagagggacacaagugucuaccuucuucaggggucuugcagcccuaggaaguuauuuaguuccauauauugcagacccuuagggaaaauaaauagugauggccucagagagaagggagagaaaaugaucccuucccuuccugacugugggaucuugagcaaguuaucgaauccuucggaaccucugucuuuucaucucuaaaauggcuacaagagugcuugccuuaugauuguugaaagaaauaaaugcacguaaagcccuuaguaagggcuuagacugagugcuuaauaaauguuagguguuauuaaagaguuauuauuuuuaaagauaaaaucaugacucauaccuauaucaaaugaacaugugucaaagauuuauuuaacugauuaauuaaugagggaaucaauaagauguuacagccaauucacaggagaauucaaagagcagguccauauagaagcggucaggaaugcugaagugaauuuaccuaguagaugcaaaacuggcuucuuccauagaaagggagggaaagcaacugcgcuuccacugcacaaaauuuacucaugucuaugaguaaaaaucacuuacauugcucuucauuaccuacaacuuacacaguaguaaaauugcucgcagaccccaaaacaugcagagaccucauagaaucacauaaccuggaagggucuccuaggcaaugccuaguuuuccauugacaacacccauuaaucauucugguucauuucaacaauuuucucaauuacauccuacacaguguguauuauugcucguuucuuaauuacauccuaggaauguuuugagaaccaauaaaauaugugaaaagugccauagaagccaugaugcauuuuacaaauaguagugguagucuaaaagagaggagugaggcugaccugucugaauccgaccucugauacuuuccaugugaucuuggacaagucacuuaacauccugugccucuguuuucuuagcuguaagucaauauauuuaagauucacugcacaggguugcugugaggauuagaugaggugaugugggaaaauauuugggaaaaugaaaaaugcuauaccaagaugagaugugauuauguuauggcucucggcuuagcuugggguucauuuuucuuuaagaagaggaggcuguggaacaagagaugggguggugaguucuuaaacucaccaggucauuauuacugcaagcuguaaaucacauagagaugucuuuaacucaguaacaguuauuuaugguacuacuguuaguccaaaagcacuucuccaauauucacucacccacaugcccucauggcuccagagagguuaguggugccagcaauggugauguugaugaccgugggggcugugugucuuuaauuaaaccuguaaggacuguauuuuauucucccccaccucuucccccagcgcugucaucccagagucucuccuggugaucauguacaaagagacucauuucaucagccuggggggacucucaggaauuugcaggaauugggaaggaaaagcucuggcccagcacacuccccuccuggucuagucugcauuugguaauugagaagggauaggaggguuuggagugagucuaggaugugacacugaaaucauggaaaggagaugaagaaugagcccugggugggaggggcagcugcccagccuggaaaagagcaagggucgggggcaugaccccguguguaggaagaugcuuccaguaggccggcucuccaacaaggcuggugcaagagaaaguaacuucaacugcaacucacggguuugaguuauggagacugaagagcuuucugcauacguuggugaauaccauagacacaauuaagaagguugcacuaaguucuucucuggagauuuugaagaauaagaacagaucucucccagucugagagguuacagaucaugccucccuagaggcaauagccugauuuggauuugaagaaggaaaaaaaccaaguacaggaaaccacaccucuauuguccugccuugcuuauugugaguaagggaaggccgcccggcucgccuccucucccccacacccaugaggugacccagcacacccugcucagcugugacauggcauucacuccucuaccuccugguugucggcagacuuacugcuucuccuuagacugagcucuccaaggcagagccuugguuucugccucuguguccccacauccugaugcaggccugacacagaguagguccaacauacuuguugagccaguacauugacgagugacuuauugaccagcugaggccaggucagcagaaaccucagugccugagaugacaacaucagaaguccucuugaaaagccaguuugguaagccaaccuuugggcuugagcucuggugagcuauucaccagaaaauaguaaaggacacugaauuucaguguucauagugagacuauuuucagcuuucucagagacagcaucuguaaauaaucaggcagaagccucuuauaaaacaacauaggaaaaaccucaaaggcuauucuaaggcugcaccauuuaaacaagauuuuuaacccauggggacgccaagaucaacauggagcuuccugcacauaaaagucuggaauuucauagcaaugugggggcaaaagcuaugauagcauuucccccuuucuaaauuauauacugcuuaguguuaaugugagcagagggcuggauggcgacgggcucgcagcuuacguaagucccacuacgaucuucauuccuucuguaaugcaggauccauggugauggagguugggggagucaccaggcuggcugcacugauguaaggcggaagggucacuccuaggucaugccaugauuuaagucuuugguguaauuuauaacagggcuuucauuccacauagaaaaaugaucagggauguugguucuauaauuguuuucucucucuaaaagaugcuguucuggaaacucgguuuaguggcagcuaugaaugcucaucuguagcaccucccuuuucccucccauuuggaaggagcaagagacugucuucuaggaugagagagaugagagagauggcauuaaagcuugacaucagaugagcccuucagcucucucaaccugcauaauucucuuuugggaaggagagacuggucuccaagcacuucuuacaccuccucugaaccaggaaccauaucagcacauucugacugaguuaaccuuaauuguaaaagacugggaaaaaaaaacaaaacaaaaaaaaacaaacaaaaaacaaaaccagaagucguucuuacuaucagaccagcccugggcguguguggucaguaugauaggaaagcuacugaaaguucagucuguuucccuuaaaaucucauuuacugguuucucaaguuaccugaaauuucugcuagaaagaguaauuucuuaagauuuuucuaggaaggcauucacugauacugggaaggcuaguauuugaacaacuaucaucauggcaccugauaguuuaugcacugugaagaagaaaaaaaugauuuauaaccaaaaggauuuuugaggcuauuuuguuaaaaaaaagaagaagaagaauuuuauuuggaagaaaauaauacauauuuuaauuuuaauccuguguauucuagacuugagggaaaugucacaucuucauuuuuguauuccuaguuaacacgauguccugcacauguucuaggccaauaaauaaugguuuuauuuuguuuuguuuugagauaggaucucacucucuuguccaggcuggagugcaguggcaugaucauggcucacugcagccuugacuuccugggcucaagcaguccucccaccucaucuucccaaggagcuaggauuacaggcaucaacaucacacccagcuaauuuuuuuguuuuuuuagagauggggucucacuauguuguccaggccaaucuugaacucuugaccucaaacgauccuccaaccuuggccucccaacguauuaggauuacaggcguaagccacuguacccagcuccaguaaauauuguuuugaacaaaugagugggaaacguauuuacagagaaagcuucuugggcuggcuggcuguggguccaguugugucuuauuucuaaaaacuaagaaguuuauauaaacaaaaaaucaaaguaggaauuuaaagagagcauuaguauaauuuuuaauaacuuacacguuuuaucucauggguuucauaauguguaugagcaaauaaccggacucgccccauacuuccauauguacaugcuuagaauguaaugcauagguucugugugugugcacguaugcaucuauguguauguauuuuguaaauaaucuauaauaaucuauaaaauauauuuauaaaauaaucuauaaaaauauaaacuauuaacaguaguuaccucugggggguaaaauuggaaaagguaaaggaaacucacauuuuuaccuuauauauugcuccuuguuugaauuuuucuuuuaaugaguaugcauuuguauaucuugaguucuuagcauauggccuggcacuuaauaaacauuuuauucaauguuuaacaaauaggggaaucagucaauugaguggcacaaaaauuauacucaaacauuugauuuugagagguuuaggagaggaaugaugauaaagaaauugaacugagggcuuaggaaagagagcauggucuggauguauugcuaaaagaggccgucggaaauaaaggaauacuuugggguuaccauugcuaaacugcguauuuucuacccuuaaaggugccccaaguuagauaccugucuggcaaauuacguaguccuaaucauagguguucuuaaggguuuaugucuugacugaaaagggacaaaucaccuggcaaggagaccacuaccuaacccuggugacucuuaccuuacagggcuggacagacaugacagugugaaaggccuuuguacucucagccauguggcuugcuggaccaucugaaggccuacugagacuguccugggaaggggacagcaauccagugacucacccagcaguaauuugccuggguugacuggauaggccuguccuguagauugguauccaaagauuaauaugaugggugagaacuuuuagcuccaauccagcuggugugacccaaaugcauaaaacucacucuuggcuucucaucgaggaacuaaguuggagauauuuuaaaaugcuugaauggcaguuuggagucuauuugaaaacacuggcaggaaugucuagauaagacuaccaucaguggucaaucacuggaaucacugaaguauuucaacugagugaaggaagugccacucagcuucagucuggguggcagaguccuuucaaauguggcuucagcaccgacuuucugugcauuacucaugcugugaaguaggugauuuaagccacugacuuucuaaauuaaaggcacaaaaaggcagacauguaauucuuuuaauuacacauucauauuucucuuacauuccucugagucguucaugucugccuccugccucaucagccuacaagcagaaaacaagcaacagggaauguggaagaucuguaaagggaugaaaaacccaacucacuuguuuguacuguggcuuuucucaaagaaaaauaaaagcaccgugucgggaaacagacaaugggagaucugacuucuacugaucguagggaauagugaaguauuucaagauaggaaugagucauaccuuuauacauuuuuugccaucugcucucuauuaacaugggcuauuaguaaaacauauuugguuuauaucaccaggcaaggagauugcauucaucuuguuuuucuaucaaaguauaugcauauaaccuuaauauagaguuuucacaacuuagcaguagagacagguuuuguuuucagauguguagcccuguacaaguuaaagcuguguggcuuuguucacugccuuuauuaggcuuuccaugggaaaggccaggcagggcaggguaaacagguuaggaacggcuaguuugaauaauuuccgauaggucuaaacuauagauguggucccuaguugcuugguaccuggcccugggaugauuaggagagaggagcauugcuuccuggguucuaugggccagguagaggagguguggcucuagguugguuaguuugcauaacaaaggcaugcuccuuucugggcccuuggcuaucuuugagaauuaccuagcccuggagggagguguagucucuccccagccugaaaggguuuuuuuaaggauguuaaaacaucaucauaauauacaaaaaauaagaaauauacacaaacaaaugaguuuaacauucgaaucuuucucagucaccucucuuggaguugcaaaaucauuugccaaaucuguucucauuuacacaguccuuaaguuacuguccagucaggcguuuaaccucuaccuugagggaaagauaauccagaacccccuuugcuuuaccuagaaaauuuuuuaucgcuuuuuagaauuuuagacucuuuauguuucugcuguauuuauacagaaggcauuuaaucuacauauauuuuguugauuuauaaaacccagugaggcuuuuuuccuuuuugguguccuuggaaauaccgaggcaucaccccaguuugccaugauuucucacugcagcuauagccagaggaaaauuuuuccuguucugagacuggagcaauguuggggcugaaauuucauuuuagugauacacguguuacauugccaucaaacauuuuaucaucucauguuuggaugauuuuccaguuaucuauugcaugaaacaaggcauuuuaaaacugagugucuuaaagcaauugauuauuauuauuauugcucugguccugugggucaggaauucagacuguacagcagacacaacucuccucugcgccacaauccagggucucagccggcaugccaggcagggaugagaguuggaauugcugggggcggccuggcacugucuccuccuaggcccucuccaaguaaccagcuugggcucccuccagcauggcagccucagggcagucagacaucuugcaagggcuccaagaacaaaucuuccaagagucagaaaguggaagcugcuggucucuuaaggcuuagcuuggaaauuggcacggcauucuuucugcuguauucuguugguuaaguuuucacagagaucacccccaccaacccacucugcagguucaaggggagaggacauagauaucaccucuuaaugaggggaauagcaaagaauguguggucauuguuuaucuaccacagaugacauaucaacaaucccagacauucagcacaucuacaaaaauuauuuuuaucucacucugcaucugcuuaagaagguagauauucaacugcaguucauuucagaguucuuccuguauaaagacuguugacagcaaauguuuuguuagaaacguuuugauagaaacauuuugacuucaaacucagauaaugacucuguaucauuuaaaauauauacagggcugggcacaguggcucucaccuguaauccagcacuuugggaggccaaggugggcagaucaccugaggucaggaguuugagaccagccugaccaauauggugaaacccccucucuacuacaauuacaaaaauuagccuagugugguggcaugcgccuguagucccagcuacucaggaggcugaggcaggagaauugcuugaacccaggaggcauagguugcagugagccaaaauugugccaaugcacaacagugcaacagagcaacagagcaagacuccaucucaaaaauuagaauagaauagaauagaauagaauagaauagaauagaauagaauagaauagaauagaauagaaguaugaugccuuacauugauuggauauuuuccagauaauuuuaagauauauuagccaaucccuacaucagcucuuuucauuuuguggaugaggaaccugaggaucuaaaugguuaacugacuugucccagaucacaugacugacuaccaaugggggcagagguguuaaaggaaagggguccugauccagaccccaagacaggguucuuggaucucgcacaagaaagaaaucagggcgaguccucaguguaaagugaaagcaaauuuauuaagaaaguaaaggaaugaaagaauggcuacugcauagaguagcccugagggcugcugguugcccauuuuuaugguuauuucuugaugauaugcucaacaagggguggauuauucaugucuccccuuuuuagaccauaucugguaacuuccugauguugccauggcaucuguaaacugucauggcgcuggugggaguguagcagucaggacgaccagaggucacucucaucgccaucuugguuuugguggauuuuggccggcuccuucacugcaaccuguuuuaucagcaaggucuucaugaccuguauuuugugcugaccuccuaucuuauccugugauuuagaaugccuuaaccaucugggaaugcagcccaguagguuucagccucauuuuacccagcuccuauuuaagauggaguuguucugguucacaugccucugacagagacagacccaggauugaguuaguuuguacuuucacugauaguuuccuugaauuccuuaauauagguagaaguaaacugaagaccaugguaaggacuuuuuaaagaaauaucaccauuugggauauuuuaucucuuagaaugaagaaaagauccuuuauuuuaggcaaauacuugguguuuauguggcucuuaaacuuacaaaguaucuccauacccauuaucuacuuugcuccacaugcugauccaaugagagagauauuaauaacacuauuuucaaauagagaagcagagguacagagagguuaagcaaaucacuuaagggucacacggcuaacuguagaacuggugcccaagcccagaacuuuaaacucugaauccugccauuucucacuguguucuucaccccucccucacccuggcuucuugggccuuagagcagcccacacauggcuuagcugugcggggcagggccauccuccucagggacaaaaaugggaggccuccgaggacugaaucgcccaaagugguuagaggaaggcaaaaguuucaagccaccagcagcaacauuagaagaaauggggaacacucucuaauuguggacaguuccaauuuuguccgucuccagggagaacuaauacuguuacgauuucuccugaugcaugugaaaucaguugcuacagcaaugaccaguguuucuuggaacuugcugacagcaacaggccucagaaaugaaauuucuguucuguguaucguguuucuaacgcuggcuccacuauuucagcaccucuacuguguccacuucccaugaugaucucuuccugccccuuccugcccagaagguagggcaagauaagucucugccccagucacuagacaggcauguugaugauggccuugggaacuguggcuuggcggugguccuuaggggaagggaacuugucuguguuggucaccacuauaaccuuuagaacaaugccuagcucaagugcuaagaaaaaacacacauagucaugcacugcauaaugauguuuuggucaaugacagacugcauaugugguccuguaagauuaugauggcguugccuuauacagguguaucauuguuuaucuuuuauaucauauuuuuauuguaccuuuucuauguuuagauaugcucagauacacaaauacuuaacauuguguuacaguugcuuacaguauucaguacaguagcaugcuguauagguuuguagccucguagcaauagccuagcuguguaguaggcuauacaucuagguuuguguaaguacacucugugauguuugcaugaugaugaaaucacuuaaccaugcauuucucagaacaucucccuaucauuaagugaugaaugagugugugugugugugugugugugucugggugcauguguguguauauauguaaaguuaaugaaugauugcuaauuacugcaguucuuuaaaccugguauacuuucccacacauccaugcccuugcccaugcuagacccucugccuggaaugcccuucccuuccuucuuccuuuucuaccaacccuccgcccccaccccccaccgcccccaccuguuagcuugccaagcuucaucucaugcucuccagaguguaaggcaagauaggucuucuaaauuuaauuauuauauuauauuuuaaaacuuuaaguacagagaccugaaggaccuuaaucuucccuagagcuggugccuuccccaugacccccaaagggaaggaucugaacaguguuugugccguggcaggggcccauggcaccgcccagcauggcgguggaggagucccaaagcuuuauaaugugaauggaaacuuggaguuaccucuugcucauaaugaaagagauucccuaccagagaggaggcacagaagccauuuucaaugagucauggaauuccucuaggauauaauaacaagccauuuaaccaaaauguugagggagcaguuaaagagacccauaagucacagagagccuugcauugacucccauuauaucucucgucagccucugaccugauucauccugcuuuucauccuucccucuauaucagaucaucucauaauccccaguucuguugaguguuucagucaccuccagcagccagugugggaucaguucuucacuagaucccuggcugcucuuuacuguuuucagcuuguuuuuucuuuuugaugaaacaauccccaaaaugaauuuuuuugggggggugucaacacuuguaaaaugucagguuugcauuguuaucuguuagauuuuuugguuucuuuaauacagcaggaacuggagaaucuagacaaagagguuuaaaaguugagucaucuccccacaaauauuucacccacaucuacuagcaugaugauaacucaguuaaagguugugaaaaucaguagucugacaaggaacuaguacuauugauuaucauuucucauuauuuuucuucaguccaaacuuauuuuaagccaaacauauucaacaccaaaguauugaguaguugaagaaaggcagaugugcauuacaguguaauuagguucauaaguuacuaugacaggcaacugaauaaaccucaguguuacugcacauuuugccagaaaaguugugaagcuauuuuuuccacuucucuuagauccugaagagccacuuccuuuucucugcugacacauaccugcuugccccagugccuuggaggaacuuccaaaggucuaaaugaaaagccuuuuaaauuucuuagaagucaugaagucaugacuucguacauacagcccaauguguguagaugacaagaggggcaacuuuuacaaauuuaagucaauuuuauagccaucuguuguaggggauacaaauauuagucuaugacagguaaacaauuauaguucaguaagccacaauaacagcaucuuguacaaaaugaugugauggugcagagaagcucuugaggagggugguaaggaguuaggccuaacuugcaucuagagacuggaauuuauaucugggauggaguuagcuuuguaacgauuuaggcgcuaccucaucccuaggccuaggagaagagauaucacaaugauacaaggaaaaggcagcaguaacugaggauagaaaaucuagguaggagcccucguucugcgguuugcuaguuccugacuucgaguugucuggucacuuuagugaggggguaguugccuuaucuguaaaauggaaacggcauuaauucccacaucacacagaacuguugcugcaaucaaaugaaauaauguuaguaaacugcaaagcuuccugcaaauguuugccauugccuuggcucuccaguguauguaaugcuggugacauaaauaauagcuucauuccguguuugcacugaugcauuuugaauguaaccuuugaaaauuaggauccucuugucuuugggacaguaguuuuauuaggugcagagaagcauuugaauauuccaagugaaauauuaggaaauaacuccugcaauccuuccuugcuuugcaggugauugcacaguuuuaaaaggugcuugaaaucucuuggccacacucacaaauguauuacuggaccuuaaucagcaguucuagagaagcagcaccuguuugcuguggucugcaggcugggugucugagaacaagccuguuuggggguuagaggcccagcuuuauccuugggcaagucacuucaucucugggccgcccuuuccuaacuucagauucagaggucaaacccacugauaauuaagggcucuucuauccuuaaagaucuguguuugcauaagaguucgguuuuguuuuuuguuuuuuguuuguuuguuuguuuucugagacacaguuucacucuuguugcccaggcuggagugcaauggcaugaucucggcucacugcaaccuccgccucccggguucaagugauucuccugccucagccucccaaguagcuaggauuacaggcaugugccaccaugcucagcuaauuuuguauuuuuaguagagucgagguuucaccauguuggucaggcuggucucaaacuccugaccucagguaccucaggugauccacccgccucggccucccaaagugcuaggauuacaggugugagccaccgcgcccgacccaaguuugguuuuuguucauuuauuuuguuuugcuuuugcuuacucucuuuaccaauuugcaagucaccccugaagcuucccauuugaaaauuaaauuuuauuuuggaaaucauuguaaauucacaugcaguugcaagaaauaauauggaguuccuauguaccccuuacccaguuccucccagugguaacaucuuacaaaacuguaguacaguaucacaaccagaauauugacacugacaaagucaagauacaaaaaaugccuguuaucacaaagauuccacauauuuucuuccccuuuccuccaccuacuucuucaucacuggcaaccacuaauauguucuccauuucuauaguuuugucauuucaagaauguuguaucaauggaaucauagaguauauaaccauucaugauugguguuccccaaccccacugagcauaauugucuagagauucauuaagacuguugcauguauuaguacuucauuccuuuuuauuggugaguaguauuccaucagguuauauguacuguaucauaguuuauuuagcuauucacugucuaaggacaucugaauuauuuccagguugggggcauuaugaauaaaacugcuguaaacauucacguacagaugcuuuuuuaaauuuuuuauagagauggggucucauuauguugccuaggcuggucuugagcuccuggccucaaacaguucuccugccuuggccuccgaaagugcugggaucguagcacugugccugaccaguauguacauauuuuuguguaaacauaaaucauccuucucuagaauaagugccuagaagugaaauugcugagucauauagccauuguauguuccauuguuuuagaaacugccaaacuauuuuccagagugacuguaccauuuuacauucucaccagcagcauaugagugaucuagcuuucuuacauccucuccagcauuuguggggucaccguuuuuuaugucagccauucugauagaugucuagugguaugucauuaugccuuugauuuacauuacccuaauggcuagugauguugaauaucuuucuauguguuuauuugccauccaucugucuucuucagucaaaugucucuucaugucuucugcccauauucaaaugagaucauuuguauuuuugucguucaguuaauuccuuugauuaauguuugugugguauaccuucuucuaucuucuuacuuucaaccuuccuguauguuauauuugaaaugaguuucuuggagacagcguauaauugagucauauguuuuuaaucaacuaugcuguucuccaucuuuaaaucguaaugcuuuaaauguaauuauugauauguuagggcuuaggucugcucuuuuauuuuuugucauuguuaccuguuuuuuauagcucuguuuucauuuuuuugccugccaguggguuaucugaacaauuuuuaggauuuuguuuugauauaucuauagugguuucuagugagucccuuugcaugacuuuuuuagugguugcuuuaggugcuggauuaugugucuacauaacuuaucaaagccuaccucuauugucauuucgcuaguucuagugaaguacggaaacuuuaccucccuuuauccuuuccauuuauaauauguuugucuuuaaauuuaccuauauacauuaagaaccagaccaguuuuauaauuuuugccuuaucaucaagcauaauuuagaaaacucaagaggaagagaaaaggcuauugcauuuaccuauauuuuuguuugcuuuguucuuccuuccuaauauugaagguuuuguuuucuuucuuucuuuuuuuuuuuucuguuuagagcacuuucuuuagcuaauuuuucagauuaggacuguuggagauaucacuuaguuuuccuuccucugagaaugucuuccuuuccccuuucauuucugaaggauauuuuugcuggauauaggacucuggguuaucaguuuuuuucuuucagcacuugaaaacucucucaccucuuccuucuggcuuccauauuuucugaugauaaaaucaccaucauucaaauugucuuuccaauauaaguaagguguuuuuuuaucuugcugcuuuuaaaauguuuucuuuguccuuuguuuuuggaaguuuaauuaggaugugucuugauguguauuuuuuuggcuuuauccuguuuggaauucacucaucaucugaauauguagguucauuucucuugccaaauuugggaaguguucagccauuuuuucuucuauuacuuuucuaucugcuccuccuuucuccucuccuucuaggacacuuaugacauaaauguuagauuuuuuguuauaguccacaaaucccugaggcucuguuauuugcuuuucaaucuauauucgcucuguuauucagauuggucauuuuuacuguuuuguuuuccaguucacugauucucucccuauuuucucuguucuuuguuuuuguuuuuuguuuguuucugguuuuugagacaggauuucacuuuuuugcccaggaacuacaggugcaugccacuacgccuggcuaaucuuuguauuuuuuuguagagaugagguuucaccauguuucccaggcaugucucagaugucugggcucaagcgauccacccaucuugguuucccagagugcuggaauuacaggcgugagccacugugcucagccugcucuguuccaaugaguuugauugauaaauaacuuugguuauuuauuuuuuaguucuaaauuuucaucugguucuucuuuaggucaucuauuucuucucugagauagucaguuucuuuuccaaggcuuuuuuuucucuuuguuugaaacauauuaauaauugcucauugaagugauuuaucauggcugcuuuuuaaucuuugucagguaauccuaaaaucucuaucaucucagucuuggcaucuauugauugucauuuuucauugcauuuaagaucuuccugucucuugauaugacaagugauuucagcugaaaccaggauauuuuaguauuauguuacuagacucugaaucacaucaaaaccuuuuguuuuaagcuggcuuucucuggcaggacuucagcaagggacggguaggcaucaccucauuacugcuuagguggaugcagaaguccagguuucuacuggaucuccauugauaccugagugguaucaucauuauuauugcuaauuauuaagcauuauuggugggaagggauagaaauuccagcucuccgugugguucuuuugauagcgcaguagggguggcuccauuauggguaggcaguaguaaaaauccagucacucuacuaagcauucucuuaccccaccccagugggguacagcccaacaggugaggagagucuggguuccccacccaggcuuugcuggcauggguggagguggggauucugugguuuuuggcugguguugagcauuuauuauugaaaaguuuucuauuuugcuaggcugcuucauuccugaagagaugagcuuuuuucggauauuuuuuuuuugucugugcucuuuggcauuuccagguuguugucuucuucacuauaagucuaggauagaaauaauugccuggugugauggcucacgccuguaaucccagcacuuugggaggccaaggcgggcagaucaccugaggucaggaguucgagaccagccugggcaacauggugaaacgccgucucuacuaaaaauacaaaaauacagcaugccuguaaucccagcuacucggguggcugaggcaggggaaucacuugaacccaggagguggagguugcauugagcugagaucaugccacugcacuucagccugggcaacaagagcggacuccgucuuaaaaaaaaaaaaaagaagaacaacucagccauguguuguucugugaguucugagaucucuagccaggcuuccuuuacuccaccuuucacagucuucuuauguuuguuuccuaucugaugucaggauuuuaguuauacuuggcaggagaaguggggaaaaguguguccacuucaucuucuacaaguggaaguccuggaacuuucauuuuuaguugacuugguuuuucaagcucaauauuuuaugaacaugcugcaccacuuaacaaagcagaaggauaccaaaccaccugcaggaaacauuuguuucuaggguuuaugugaaaggaaaagugucuaccaugugcuuggcacuuuaugcuuaauuucacuuaauccucagaagaaugcuacagggaggguauuauuaaccccgauuuacagaggugagaacugaaguucagagaaauuaaguaacuuguuccagaucacacagcuaguaauuagaagaucuaggucucgaagccaguuuugcccacauuuuucuccccgccacaugccucagucagcccauuagcgcaaugaggacagagaugaucuuuccuccuucuugugcuuaucugugccuaggaaauccaugcaacuccaugucaguuuucagguaggugaaacaugcucauauaugcaugguauguguauaaguguagguauaacugcauaauaacaaaggagcucuauacuuacaguggguaauuaauaucuaugguaucaaagugaacaauuucacaauguuaacauguucuaguauuauugcuauauaaaguguguucaugauauaagagacugauuuucaaugaugaauaaauaccuacaaaaucauaaauaaaacaacucauugguacuuucuauaggaaugcuugcuuuuuugggaaaguagacauuucuuuuauuuuuuugagacagagcuuugcucuugucgcccaggcuggaguacaguggugugaucuuggcucacugcaaccuccaccucguggauucuccugccucagccucccgaguagcugggauuacaggcgugcaccaccacacccagcuaauuuuuguuuuauuaguagagacgggguuuugccacaguuuggucucgaacuccugaccucaggugaucugcccgccucggccucccgaagugguuggauuauaggcgugagccaccacgcccggccuaggagacguuucuuuuacagccuaaaccauuugcaugcagaauagccagauaauuuucuuuuaguugugaaaacucauugguucuguuuaagaggaauaagcugauaauaagugugguacauggccagaugcgguggcucacacuuguaaucccagcacuuugggaggcugaggcaggcggaucacuugaggucaggaguuugagaccagcuugaccaacauggugaaauccugucucuccaaaaaaaaauacaaaauuuagcuaggcguggugguaugugccuguaauaccagcuacucaggagucugaggcaugagaaucacuugaaccccagagguggagguugcagugagucaagaucgugccacugcccuccagccugggcagcagagcaagacuaucucaaaaaaauaaaaaauaaaaauuaaaaauuaaauaaguaugguacacaaucauuucugaauuaggcaguucaauccuauuuuagugugaaauacauuauuauggcaaaauuauuuccuaaggagcucuaucuauacacauuaaugaauuuagaccuacuuccucugucugaaauuugacuuaaagaaauaaccuuaaaucuuuuuccucccaugcuuuuauuuuccugucuuuuuuuuuuuuccuuuuucucaauauuugguaauacuugaauucccuggaggauuucaacuuugagaccgcuaugaauaauucaagcuuaaucuugccuucauuccuuuccaaguucaaaaucugacauuuuuuuuucuguuuaugaaccacaggaguuuuuguuaucaugauugaaaagaccacuaaaggagaugcaguaugugauguauuauuuauugaaaacacagaugggauuacauuuaugaugagaauguuucugauucuuaaauuuaagaaucugauaccugcugaguuaggaaaaagagacugacauuugcagguaucaggggccaggcacugugcugaccuuuuaauaacguuuucucagguaucauuguaccuaguuucccaauuaggaaccuggaguuuaggguuaaauaacuugugauaaggcugggauugaaccuaaagcccaugaucuucccaggacacuguccucacaccaugcugaaaaccaaagaaauugacuuaaccucuugcauucugaauuagaguuauuaaaaauucauuuccuagguuagugccaacuggauuccuucucugcaugagucauauucaucauucauccagccauuuauuauauuccuucuagcccaggguuuugcaauucugacuauauauccagaucaccuggggagcuuuuuaaaaauauaaaugucaggccccacuccccagagauucugaucauuggccuagggcgggcuccaggcagcuauuuuuaaagucccugagugauucugaugugcagccaggauugauacauugcagucucauugcaaccccucaucucugacaucacucccugugggguccauuuuauguguugacuuuacugguugugggguaccuaggcauucggucacacauuguugugugucugugaggauguuucuggacaagauuaacguucagauugguagugugaguaaaguugguuaccuucccuaaugcggguggguuucauucugucaacugaugaccugaauaaaacaaaaaggcugauucuucucugaauaaaagggaacucuuccugccugacugccuucaaagcugggacauuauuuuucuuucuuuuuuauuuucuccugccuucagacucaaauggaaacauuggcucuucuuggguuuugagccuuggcuuucagacugaaacuagcgccaucaacucuccugggccuccagcuugccgacugcagaucuugguacuuaccaggcuucguaacugcaugagccaaucccuuauaauaaaucccuuucuguauauacacuaccuauugguucuguuccucuggagaucacugacuaauacacuuccuuuuuaacuaagaccucuaggcacuuuugcuaucucugagguuuuucauauuuuauaucccuagagacaaaaucaaagaaaauuucuuuaaaaugggguuuagauggacaucucucugagguuccaccucaacacugacacagggcagauguggcucagccucaggaagcugaaauucucaccccuguguuucccucagccagcggaggccuuucgacugugcccaucuagcagaagcagcugugagaucagggaacacaggaccuugcuaacagaccccaggcuugcugagugguccaguugcaggaagagcagccuagggagugaagcugccuacugcaaacucacauugucccgucaucgcuccugaggucuggggucaguccucucagggugcuggccagaugccaaagcugagcuuaggaccuggagcccagcaccgagugaggagguaauuacacaacgacacaagagaaagacacaccaaaguggggagcagaccaguccuggagagcacugaggaccaggccagugccugacuccaguccaguuguuacaggaaaaggguccccauccagacccugagagaagguucuuggaucucacacaagaaagaauucagagugaguccauagaguaaagugaaagcauguuuauuaggaaaguaaaggaauaaaauaauggcuacuuuauacacaaggcagccccgggagcugcugguugcccuuuuuuuuuuuuuuuuuuuuuuuuugagacggagucucgcucugucguccaggccggacugcggacugcaguggcgcaaucucggcucacugcaagcuccgcuucccggguucacgccauucuccugccucagccucccgaguagcugggacuacaggcgcccgccaccgcgccuggcuaauuuuuuguauuuuuaguagagacgggguuucaccuuguuagccaggauggucucgaucuccugaccucaugauccacccgccucggccucccaaagugcugggauuacaggcgugagccacugcgcccggccugguugcccauuuuuaugguuauuuuuugaugauaugcuaaacaagggguggauuauucaugucuccccuuuuuagacccuauagaguaacuuccugauguugccauggcaucuguaaacugucguggcacuggugggaguguagcagugaggacgaccaggggucacucucauugccaucuguuuuuggugggauuuagcuggcuacuuuacugcaaccuguauuaucagcaaggucuuuaugaccuauaucuugugcugaccucuuaucucauccugugacuuagaaguccuuaaccgucaggaaugcagcccaguaggucucagccucauuuuacccagcccuuuucaagagggaauugcucugauucacaugccucugacacagugggcaagcagaugaacggcaggccaggugaaaaggccagaagccccauggguaugaccagaagagaaaauguugggauggggugagagagagaugggaagguaagucagaagucucuccacuguugcauaccuauaacuuauuuguguugaccaccagccauauggccaugaauggaucagcgugauugaaauaccuguguuggagcagcugauuuuucauucagcuuauacagccccacccuacugggggaaccugcccccaauauuucaacguagguucuauuuucuauaagugucagccggcugagaaauaaagagagacaguacaaagagaggaauuuugcagcugggccacuggcggugacaucacauaucgguaggauugugaugcccgccugagucucagaccagcaaguuuuuauuaaggguuucaaaaggggaggggcuguaagaacagggaguagguacaaagaucacacgcuucaaagggcaaaaagcagaacuaauaagcaucuaacaaagaucacaugcuucugagggaacaggacaaagggcaaaagcagaacuauucauaaggguccaacaaaggucacagggcaaagggcaaaagcagaacuacuaauaagggucuauguucagcggugcacguauugucuugauaaacaucuuaaauaacagaaaacaggguuugagacagagaacuugucugaccacaaauuuaccaggguggaguuucccaacccuaguaagccugaggguacugcaggagaccagggcacaucucaguccuuaucucaaccgcaucauacagacauucccagagcagcuguuuauagaccuccccccaggaaugcauuccuuucccaggguauuaauauuaauauuccuugcuaggaaaagaauuuagcauuuauaggcucucugcaagaagaaaaauaaggcucuuuuugcccaaccccgcaggcagucagaccuuaugguugucuugccuuguucccuaaaaaucgcuguuauucuguucuuuuucaaggugcacugauuucauauuguucaaacauacguguuuuacaaucaauuuguacaguuaacacaauuaucacaguggucuugaggugacguacauccucagcuuaugaagauaacaggauuaagagauuaaaguaaagacaggcauaagaaauuauaaagguauuauuugggaacugauaaauguccauauuaaaaugaaaucuucacaauuuauguuccucugccacggcuccagcuggucccuccguuuggggucccuaacuucccacaacaccacccuucgucccacuuuaaauucaugugugacuccauccugucuuuugaauauuuugcuuuauucaguaacacaaguucaugacuugguaaaaaaagccgcggcuuacaacaucauaagcuaguuccccauaaauugcugccacacugauaauaccuuuaaacauaggaaacagcauuuuggaauucuguguuuucaaguaaauuuuaguucauuuuagugucuugcaaauagcaggcagaggaaugauacucuuaccauuugcuuuuuuuuuaaaccacauuuucccaaacuuugaaaaacaauugcuaauaaacaaaccaagccacaggaauuauuucaguucaagagaauaaacagauuucaagagaucaaaagaagucacugaaguucaucuagcaaugcuuucauuccuauauuauacucgcacaucggcgacauggugugugaagauaauggcaucagaauuuccauuucaugcuuaauuuucugaugguuuuugcuaucuucauuuuaccuuaaagaagauaaauaaauaacccaaccaaccaggaauacauuuggggaaaaaggaagaugcccaggguuauauauuggaguucuuccaauuccagagcagcagaagaaagccucuuccaauccuuuguuugugccauagguaugagaacaaauggcaagacaucccucuuccacguugacuugccuucaggugaaucugaggcugcccagugaccuggcaaaauuggcuauggagauauuguagacauuuuagauuugaaaagauaacuuuucucuuacuuuuacccaauuaggaccauuuccucaacucugcacuuagguuaccuaauggagguacagcuuuaauaaccaauuccauuuaucuuuuagaaauucucaaaagaaauaagaaggaugugucuucaguuaaagcugucuuucaaaaagauagagagccaugggucacugaaaggaaaacaagccaccagcaaaacacacguugucucacacgcucuucugucgugaauaacaauguguaguguuagugugagcauacccaggcugucuguauucuguggggugaagaggagcaaaugggugcugcugcccuagauuuucccacucuaggcauuagaaucuugucuuuccuaaugaccuacuguuuacccaguucauauauuuauaaugacaccugcaaggguuuucuuucuuucuuuuuuuccaaacccagagacuuugaagacaacaaaaggauaacuugggugauugaaaacacacccaaugguaagaacucuauacaauuuguguucauguguacauguaacaaaccauggagaaaaucauguagguccugaaauauguugccaguucugucucacugaggacucagccguagccagaggcuaaguccuuuguaucaugauccugucccacuugagccgguuugcacuucuuacuuugggauccuuaauacgcuggccauacauagcucuuagucuuugguucugaagucuaguccuuaagaacugaguauugaaaaguccucucaguaggauuagcauucuucugaggcuaagacuacagccaggaaguugaaaaccccuuuugaagggcacggugacuuaacccuugaaggagaaguggcuguggauggcucauugucaggaacagggacacugacucuuccugagagacgcuucagacccuuccccaaagugguaacucaggccauggcuucuaaucacuucaugcccaauuuuauguacuuccugcuugugugcacacuccugcugacccaccaagacccacacgagucugaaagcaaggaacaaacuuucgcagcaguagcgauaacucuaauucagcuacugcaaagaccuuuuguuaggugaaggugaaacacuucacaagggaagauuucuggaucuuuagaucucugcuagauuucccaggugcagcagaggagccaagagacguccccaccuccccacacucuggucagccuuugugucauccggccaugcuuaacuauuaaaaguacccucuuucauacuguuguguugccguuuuacucugccaccuucugcuagggcguggugcugaggcaggagaauagggucuggaggcaggaaaccugaguugcugaggcaacucccuuuucaaccccuccuuuuucugcguggcauuuggaaaaugaaaguaccucugauugguccccucccacaaccagacuggucaugggccuacucuucagccagucagacugguuguaggccaauagaggaaccaacgggaaaccucuagaggguauauaaaccccagaaaauucuguaaccagugcuccugagucucuugcuugggccaggucccaccuuguggagugaacuuucauuucacaaaaaucucugcuuuggcugcuuugcuucuguguuuuguccaauucuuuguucaaaacaccaagaaccuagacaacuacccucaaccgauaacaaugcuaaguagaauagaauuguggaaucacacaagccuggaaggaguucugaagguuagugccuuaaaguauaucacguuuucugcugucuuaaaguggaggcccuuguuggacccacaugucaacuccuccagaagcccuaugucccuuucaggcccucucagguccgccaaguuucagaucaucauguagcguggccaguguguucagccuuucuguccuugaacccugaagagagagggcuugaagccugcuaugaagccucaauacauuguacccaguaccauguccccaagaacuauacuaaagcaaauuuuugauuauacucccucuaagguauuaaaguaucuccaagggaugauaacccaacuuuguaagcaaaaacguugggauaccaggaggaugcauugugaaucaaaggccagaacacuggcccucccuguuacaccucaacgcuucuaguccgaggcagucgcugagcacuaaggacaaguccuuggugacaauuagaaggaucuuuucugaugauaauaauuauacuuucacaggcaacugagaagccuuggcuguaacauucuugcaauuggccuuuugaaauccuggucuguuucccuuggaauacggguugaaucccugucaggaagccaaugguaacugcauuuucuuuaguggcaguuacuggagauuuuacagaggaauuauuuaaaagaccagccaggacgaauggcaacagaucugaagaacuauaaugcaaauaaaaauauuugacuucacucaugaauaacugauuuuauauuccuaaauacuaagaagguuguacaagccuccgaaugcagauaguaccaaaaagaacauaggaggcguauuggugagaauagcuggguuuugaucagaacacauucacauggaagacaaagucuaccuuccacuccacccuugccuucucaugcuguuaugagauugguguuuccauguggauaagucacaaagaagaaaaaaguuccuucacugaucuaguuguaguuucacuagggauacagaaugcaucuucacaaaaugaaggaggaaaguuuacuuuucaggaagcuggaccauauguucccagaugcugcuuugcuccaaaauucagggaaagaagguuuaggcuacuucuuaaaacacacacacacacacacaaauuguuauuucuugaaacaacagcacacccuccaaaauaguaaauguuaccagaacaauaauaaauaguggcacacaugcgcaucuuuaaaacagccagucacaccuuccauugcauaaccgacagccaugugcucaggcauuucugugaugauugaagacacauuccaacagucauaaacauccaucacagauucaaguaugaguugcaggauuccaaaaccacaggcugccaguuuuuggccauuagugacauaccaaguguuacugagaucucugcgcaaccucuggguuugcacaauacggcugaaaugcuacucaguggaagaaaguacuaggggugaaauuacccuucagaagguaauucugaagaaauuccuaauaaagaagaaaggaaacaugccguuuagagcuaaaauugcuuuacugaaacacagucaagucauacaugaaauacaauggccuuuaugcucaguuccccugcaugccuugggcccucuuuucccuuaaguuuugucauauguuuaaguauauauuacuggucauuccaagagcuugaacuaugacagccugaaaggaucuacuuauccuauaaacuguugaacacaauuggcaugaguuggaccaaauuuugcuccauuuuuuuagagcacaccugggcuucauuguccaguauccagagauuauccagauuagaauuuuucaggacccuuuccaucuccuagauccccccggccgcugucuucuugcggucuccuuccucucuagugacaccagcagaccugcacuggagauacaaauggagaugaaaggguuaaccauuuauacuaagagaaagcuggaaguccuugcaaaaacuaugucaugggauuuucuauacacucccaauaaauacagccucuucagucacuaucccccacccgcccccaccacccuuuaacaagcguugucugaggaucaagccaaaaacugggggcuguuagaagcugggcuagucccaagcaaacugugaagcagaugaaaauaaauuugccaagugcaccagcauaguccucaccacauaucugcccucagccuccuuccuucagugguagucauggagaugggggaacgagggcauauuccuucccagcgcucggcauccaccccaaauuccgcauccccguugaacuaacaacagguaacagcacaaaguaggguucuuccccaaagcggcugcauuuuaacucagauuaaaacucaagcaaauaaccugccagggagacuuagacaaaagcuucagaugaggguggagaccaucugugcuccauuccccagcauauccccagggccugacacuuaggaggaggucaauaaauauuugcuaaaugaauacauuagugaaugacacgguaggaaacagcagaguguggccugcucuuggagcugguuugacaaggaaggauuccagcuaucagggaguggcugggcaggggcacagagcugcgcgcuacacagugaugagaacccuuccaaaaagccucucgucuggccugcuuuccuggcccuugccacacacacaaggucuguggugcugguggugcccauuccaguagucugaaguucauuccaucaauagcaucuuacgcuuagccugagacccacguagcagaaaaaucucaacuucagacaccgcugugcguuuuuuggauaguguuucagauugggguuuuuuuguguuguuuuugguuccuuugcuuuuuaaacaguuccuugagcugcugacagaguagcccaguguacauggguggucccaaaaugcuuugcacuauuuggaccuacucuguuguauuacauggguaacaagaucagaggaauuuggauguguuuagguuaggauuuagaucuggauacuacauauagaccugcuuuuaauucccucuuuccuucuuguauuauuuaaguccauggacacuuagaaucaauauauaaacaucuccaagaagcacaaaaagaagcagcauguggaacgugaggucaaagcugucagcucacauuuccccuccccagaaaagcccggagauuuuggaguuccucaguacaugucuucaguuggcuucaaugucaguuugcuucuuguucuuuauauaauuguugacuucuuugaaguucauuauagacaucacuaagucagauagucccacauuauaagcagacucuucuaauucuucugcagugugaauuugcuuuucccaucugugagauuucccugugacuggcccacugacagucaguugccugcaucagggaccgcugaguguacagagcugcuucuuuccuucagagggaggcucagaccuggagaggggaccacauucaaaagagccgauuguuuucaagcauuggagaagcagcuccagaaaauccuugccuggcaacauuggagaaaugcgcugaucuuguguuuuuaccauagaagugguuggaaaggggaauuugcugcugguuccuuucaucuugauggugguugcuuuucuuggauaaagucacaaaauucuucugaaacuagaaauugugacccuugauauuaaaaagguauauaagggcucuaauuuuuucaaaccuacuauggggugacaaaauccauuuacugaagguauuaagacugcagauaauauuucugcugaauaagaagcaguguggacuaaugggaagagacacaacauauucuucuccaguuucucauaguuucgaugcuuucuugaaagugccugugaggcaaagaugcaugaagacauguucugcuuuuugcuguuuuuuuguguuuuuuugguaacauagaaaguuaggucauagaccugggccauggaccuguguaaguauuuaagacauuuggacauauuuuguaucuguaacuucccuucccuuuuuaaaaaguucucuaaacuagaaaugguguagauauggaaucaacugugaaacuauccuucucuggcagcuccaaaauccuuuacauuuuuuccuggcugggugacacgauuuuaacccuaacugaaugggccaaucuuuggccuuuucuacaaguucucaaauucaagggcagagagucuaguggaccuggauacuuguaccggguuaaauggacuuaucagugagguauuaucuagcuuuaaccuucacaagauggacacauggcuuaaaaagccuccucugaagaaaccauggguuaaagauagacuaauaacacaggccacccaaaaaaccaaacugacaaaaacagcaaagguagcacuucugcuccccuucccaaaagcucuuugccagacaccauuacaagaaagaaagacugaugaucugaugugccaagcagcuggccaaaacaaagaaacaaaaaacccuucaaaauuauaaaaaucuaacuaggacacagggaugaaaaaucuacaucuauaauuguuaucauauaucuuacacucaaaguauauuuugcgccuuggacuauuaaguaaugauaauggccuguguagauaauuuauuaggucccaaauaaauaaugaauaaaauagagcaugggguggggguguauguucaaaaugcuuggaaccuacugcuuagggaaugucauugacuaagguugauguucaaaaguaggggugguggccucagaggacaaaccugccugcaaacaaagucugaauggaugauagaagccacggauaagagggaaagaacuuggaggacauacuguacaaaucagaaggacaggaaaucuccuugucuuucuauagauacacagaacuaaggaaggauccagggaaaguagacacaaacucaacaaagcaacaagguccauccaagaucugguuccagagcugacugggcauuccaggucacuugacagauggugguaggagaugcauucgugggaccugggugguguacaucacccaggcuggccucuccaaccugcccucagugcaguccaacauugagaacacaggcaaagguggagaguggguuuugacucaagcuuuuggccucuugcauuuaaucauccaaguguggccuuucccaguuaaggcaaacaaaccuuagaguucucgucacuuuucaagguuucuggaaagaaaaggccuaugagcucuugccaaggcggcugcauucaguugucaguugugcagguuuugcuuugcagaaaggcuuccagaagggcugguccaucuggaggggacacguuuuucuaacucacacaaagacaucuauguugacuggccuuggccagggccuugugguaaauuuuggcagaauagagccaaaaccagaaaaagagauucaguggagaaaacccuaaauuggaugaauuuuuacuuuucaacccauaauauggcuucuguaggcccugaugaaaucaguacauguuauuggagaagccacugaguagguuaguagguuguguaaguccuggcuaguagauucgguguuguuagagaagccacuuggagucagauuggaugguggagaggagcugaugugaaaauguuugcaauuaccaggcucugagacugcagggauuuggagaaaaagcacaucaguuuuguuuugugaccaggacuuuuugaguuguugcacaaaugcuguuuguuugcagaaacucaggagcccuguacuucuuacucauuaccugcugccacucucccaaacacaccgguguugggauccuccccuuccccaacuggcaaagaaggaaaggguucuuugugacucaggcuaggaagugacaggagagcucacuagaggcugaggggugccaucuccauuuacaaagcugauagcaaaguaaucaaaccuagcagcaccaagagccuggggcagcuccuuggcagcgcucuccaccacauugugugcucugggucgcacagggccuguaaauugcacaguaauggcuggguccacagcaggaauaaacaugugcuuugaauuuuccaaaugagucagacgcacgcugcgagauaaaugcugauagcaagcagaugugacaugugcuuuucaagaggauggauggggggaauuggggauuggcaucuucuacacucuuugagucaauggacugacaccuaaugggaccuggucuuuuaacaagaaacauugggugaugggugacauuuuccccacuucuuucuuuccguaagaggaaucuacauuuuaagucucaaauguaaacgugcucugguuccaauuugucggcugacucuaaucgccucggaacuuauauaaacucuaggugaguaauuuccccaaguacaguacccucuuggaaugcaugagcugugaacucagauuaaacuuuuaaccucacauuuuucugggaaggauuauuaucccuguuucuaucguuugaaaaggccaucagaaacuccaaaagguccagugcucgcagggguugaguuaguacacucucucaagagccuguccccugugcugaguaugccuggccucccaaaaaugggaugagagggucuguugugccagaauuaaaacuacaaggcaccaacucucuugccuuccucauaacacucucaacuaaaugugcaguuuggagggcccugugcccucccagcucaacugcaaaagcccugagugucuuugcugaugcaugccaugugccaguugccaagcaacauacauaacacauucaucagcagagcgugaggucugaguccuaaauuucugcugcauucuuccacacuuggcuuucauucaccuugucuccuuccagcaacuggaucaacagauguuaggcuuucccagaguguuuggcagaaccagucccagaugccaagcuugaagauacaacaucucuuugcaaccucuaauuccuaucacuguacucauuaaucacuugcucaaaccuuuaacugaguccauuaggacuucaauaccagguguuuuuuuuguuuuguuuuguuuuguuuuuacugaguuggcaucaacauggaaacaaguggacugguguauucucccagaagcuucucauuauuuguacuuaguuucuguuugaucacuaccaagaggcagcuggcauggugucaugggaagaacaguaggcuugggagucaaguggcgcuucugcggacaacucauuauggagccuuggccaagucaguauuuucgaaagggccucagcuucuucuuuuauaaagugaagauauuggacucagugguccucccguugaaacaauaauaaucccauuaguuuuacuaugcaguuucaaagaaaagcagacaccaaagcaagaagcaaaaaugggaaaccuucaaggucaaaaguuucaguucacuguauugaauguugcucugcaaugucuuucgaauauguuuugauacaacauucugcuguaaacaccaugaugccauuuucaugugguauuacaucacccaauggauauuuuuggauucuuaaacgagaaacccacuguucuagcacuagaagaacaagggaggcugugauagcaucauucccacuuccagcccccucugggguuagaaaauggaucaaauaauugguugcugaucuuaaauuuccucagcauucauguguguuuacacccacacugaccccaguaccagguugccucccacccuccuuucuggacuccuguccucuguccuauggaacgacaaaacagaauugggcacaauuuucucuauuucugacuuuacucaauugcuuuucugguguuggccucaucaauggacaagcugcuggaaguugacugaguauaaaaugcuauaagggaaacauuguaggaaaaaaagcaucccauuauuccugucuccaaaagcaagauuggagauuggggucuucucuaagacagacgccaccaccugcacccgggaccuccagcaaccaccuccacaaagccuauguaaacaguguaauguguuuugauauuaaccuuguaacaaacaucuuaaguuuccuucauguuggugcuggaacaggaguguucaauuacucacuaauuuuguagacauuuguugaacaucuauuaggcaucuggaacugaggauacaaagauaaacguacauggcauugccugaaaggaauuuaugaucuagcaaagggcacagacguguauauagucugcuggaauauauuaugauaagugcuacacuggugguguggaugaaaggccacacgggcacagauaggagcuaugaguuccgccaggauuucacuuaucuaaaagacaggcaaaggguauuccaggcagaggaacaugcguaggcagacgcagggcaacaugaaagugcauggcagauucaaggaauguugcaggucggugugaugggaucauagauucaugguagagaguggcuuguuuauauacaguuuauguacaguuguuagaggugggaagaagauuugacuccgagcucccuagauaccaaagaaaaaagggaaauaugaaauuugcugugccuccgagcucccuagauaccaaagaaaaaagggaaauaugaaauuugcugugccuacaugagaaaagccaaaugcucgagagaaacaggcuucuucuggaauuaagagccaagggacacuucucuguugauucucuucagaggcucaagaugggauacaguggaaauaucuucaacaauauccccgcacuagcaauuuuuauaagacuguuucuuguaaugucccucagugcgagccaauggcaucuugccaaaguguaauucaguaaaagcagcucuacaugggaccagaacaauucagccuaagccugcuguuuuuugaugguuuggcuugaugugugaauacaacuuaggguaucuagaggaauggauguucuucauaucuuucaggcaaucauccaugaauauuauuucuuacaacagggcucuuaaaaagcauuagguagcaggcaaugaacuugagcuucuauucauuggugaagaccucaagaacaaaggagucugaacauuggguuauguaacaaagaaaagaaucuuuuccaaagauguuuagucauggaagagaaguaaccggucauucuggacuaagugcaguccaauggcucagcucaaaccggccugcauuagggcuagguuguuaaguaaaguuuccugcccugacagcacaugucuugcugugaacucuaggcuggaagugggcccauaaaaggcccucacauuuuaggaguaaaacugugggcuaagcaccuuuugagauuuggcccuuuuuccuuaguagcugaaguaauugugugaugcacaaaccuggguccagaaagcugggacaaggguguggcauuucaccaaauagcaucugaaaugggggcuaaaagagaguguaaguuucgccaaauaccaaauccuacauauuuauauaacaugguauaauuuauaaacuauauucccauccaguauguaauuuaaauugcauaaaaaccuuguacaggagucgugugauuaucacauuauagaugggaaaacuaaggcuugaucaaguuagcauggauguucggugacaaaaccagaauuguaacccaggucuuuugauuuuagugcaguuauuuuuuaccuuucaagguucaggcgaguuauccagaagaguagugaauuguagguaaugauagccaugcccagcagguaccaagcuacaguagcacaaguugaaaaauuacaaacacuguagguagggaaggcuuucugcaguuaacuuagaaaaaagcauccauuugauuggcaagaaugcuccaaggaugcucuuuguucacggagagacaggcacagucugguuccuggaucccaugaauggccccagguauacacuggcuaguagagacaauccaaagauuuguucuuuccacccuuuauuuaccaaacaugcaaaguaugaugccacguaugaauuguggaugaggauauucucagcagaaugcgagauuauuuucacaaucauuguaggaacuuuaaauaaucuuaccuguugauauucaauagccagaucuucccaaaaguccuuacucauuguaaauaauaaggauaaacuugaacucuagguuuuaaagauugccuuucugagugcuauacuuaaguaaaaauaacuauugccaccuccugccaacauuuucauuaaacaucuaaaaaauaacuuggugugugguggagaauugguggauauagacuguuuucucugguucccccugaaaauaccaagaugggagauaaauucagacauugauagcucugcugccacagugcacuaaauuauaaacuagugucccaaaagacaggauucuccucccaaucaacaagaguacuuauaaccagagagccauaggugcucaguauagaaccaaaacaacaacaacaacaaaaacccccaauuuauagucagggaggagauuccggaccucaguaccauagguggaccugguaccacaacacauguguauucgcugaagaacugagacacuuugaugcaauuauuugccaaagguuucaaaaagcaauccacccccaaauuguggaggguaaaauguucuuuccuguucucuucucuguuugcgcacacacaguaccacucaccgcauuccaguuggcaccugcacacacuccuaaaauaagagaauguguaaucuccugagucucuuuuggcucaaagcauugagaguuuucagagacugggucuacaagaugcaggaagcuacacaccaauagcccuccucacguuaaggcgauaggaauaagacccccugacagccaaaucugagacuuugguuuagaaaacccaucauuuagaaauggcuuuguaauaaaaccggaaauucagguuuuuguaaaaaaaguaauagaaaaaaagagcggaccaguuccccaugggcacacagcugcccacagcugcugccugguuacuuccugacagacauggguuugcugcuaugggaacgaugucugucccacaggcaaggagugucccugugcccgugugcuugcugcuaaacagugacaaggacauuaggaaaacagggccuucuuaacucuugaggaugacagugcaugcaccaaagaaaccaaaggagccguugccucugcuaucauuuuucuucuuuuuuuuucggagacggagucucacuuuguggcccaggcuggagugcagugacacaaucucggcucacugcaaccucccccucccagguucaagcaauucuccugccucauccucccgaguagcugggacuacaggcacacaccggcaugccuggcuaauuuucguauuuuuaguagagauggauuuuacccuguuggccagucuggucucgaacucccgaccucgggugaucugcccaccuugccucccaaagugcugggauuacaggcaugaaccacugugccugacccucuguuaucuuuuuaaucuuuuaacacagaaauaguuauuugcugaaugauccuuagcccauugaacugguuuaauggaacauacagcaacaacagaaagcuaagucccagacaguaguuucugcuuuggaagaguguaacucaaguuugucauccugccucuuuuucagaaauagcucgaaggaggagagguauggcccaucuuuuugcuuuuauagcaaaucaacauuugggcagcacgauggccucccuucccagguuuuaggaacaccugaggccuguucuugggaagugcagcugugauugguggggaccuagcccccugcugggcaaagcacuucuagguccugggaacugccucgguugagauggcacugugaaauaagucucaguguguuugcucaaugcuuuguguuuuguuuauuuaugcuuuaauauuaaagaaaaaauuccaucagaaccuuaucuuuagccuuagauuagaacaaaaauuagaacaaaagucacucaucagaaagcuacagauguaguuuguaaaucccucacuggaaaaugaauuugccuuuguggccagaucugugagugugguuugaccacgagaaagccgcuaauguuuguugguugggcucagagacuacuagcaacuuuucagaaguacucuucugaguucugcaggcuugagucugugggugguaccgaguaagccugauucucucagggaguaggggaaagagagggauuauucugaauuaguggagaaaguccggggaugaccuuauuugugaguuuguggcuggauuuaagaaguccaaaaggggcuuguuguuacaguaucuuggagaguuuucauuucaguauauauagugcuauaucuuuuuuuaaaaaaauugcugcacagugggcugggcucgguggcucaugcauaguaaucucagcacuuugggaggccgaggugggcggaccaugaggucaggagaucaagaccauccugguuaacauggcgaaaccccgucucuacuaaaaauacaaaaaauuagccgagcaugguggcgggcgccuguagucccagcuacucggaaggcugaggcaggagaaugacuugaaccugggaggcggagcuugcagugagccgagaucgcagagcuugcagugaaccuagaucgugccacuaugcuccagccugggcgacagagcaagacuccaucuccaaaaaaaaaaaaaaaauugcugcacaguauucuauaucauggccgugugugugugugugugucuguguguguguguaauggacauuuauuuuuuuauauccccuacuuuucaaaaauuauuuucuaauucugccugaaauaacuuccuuugcaaaauuacuuuagcugaaugcuaucaauuauaaauccaauuguaucaacaagcucaucuuuuccauuguuaauauuauucacugaauugugaauaauguaacugggcugcuuuccuucccacaccugauguagacacuccacaggagagggaguguuguuauaggaggaagaaguacuuggagagaacuggagaagggcaccaugugagcacacuuggacacaaggagagaggguuccagagaaggaagagcagugcagaguuggaggcaggaagacccuaagauccaccucuucauugccaggauuaccuucaguuguuucuucaaccucaucucuguuuaguccauuucugugacaugccagcucugggaccuggguggccacagguagcucaugaaaugacuuaagcauuauuaaaacuggaguuuacccaggaggcugaggugggagugagcugaguucgugccaugcacuccugcuugggcaacagagcaagacccugucucaaaaaaacaaaaugaaacaaaaaauccuggaguuuacaaacaucacugaugugugguuggcauuuggagagacccaugcgcauacagaaacuugacaagugaaucguuucauaaagaggcugauagaugaucagguuagcugcuacuuuaaagccagugagcaugugcaguaaccauggugccacguuaauuaagacuaauggccaaaggagccauugcagaugauccaauuaggcggauuuaguuagagauuauacggauaacucugacugaaacaucaaucuaggccucuauuucaaaugaggugguauuugacuauaauaaaauaguauacuaaguagcugaugugucuugcaauuguggaaguugagggcuacuaacagccuuaaauauuaauauuuaagcuugauuuucuuucaagaaccaauuauguagaugguuuauuaccaaguucuuuuuguuccuuaccccuccugcugucuaguuggggcuguuuuacaguucauuagccccuugacaagaagguagaaaugaaagaaggugcagcuuacaucugucugccuacuagccaauuccguaaacuguuuugcggggaagauacugaaacuauaggccaaaacggacuuuguguucccuuccccaugcauuaauuuuuccuagaucccaaguauuggagagagcuagcaauuggcugaacugacaauuucucaguugcauaaaaaguaaucaguggaauuuugcuuaauguggucccaguuuugucguacauaaggaaaaauauucugauaagccccacaagcuagugaagcgucuuaaaauuacacacuggguuauacagugauuacacucaucaaaaugauuuuuugccuaacuuuaaauucucucaacaaagaucccaaauuuuccuagcguacauauuuauuuuuaagaguuaugaaaauacacagccguauaugguuguaucugaauccauguugccgugagagacugagcaguucucaaguauuaagugagaaaucaucgcagaaggauugcacuaugucauugacgccuucaaacauguccaccauauuuuacugguggaaauuucaucauuaggcuuaaauuggaagccacugauucucugccauuaaaaaaaaaauggaguucuagccauuaaguaugauuuucguuuaauuuuuuugauggggagaugagaaagaaggaaugaaaguauaaagaaaagggaaaaggcuaguagagggugcugucgucugcuaauuuuuugcuuucucuaaagcgcuucugcucacugccauaugguaaauuccucagugaauuauucagggucuuguccugaugcaaaagacacuuuaaaaaaaagcagaacauucuuuaucccucuuggaaaaagaaauaacaaauaauuaaggccacagcgcucagggacccaaguuuauuggcaauaaaagguagcugugcugacaacgcuaccaauuaaucugccaaaagcgagcucagugguguugccauaaagaucauguguuggaaaacaggacuggagacauccagggaucuauauaaagcauagacaacagucuuagcgaucauggggcagcaaugugggcacccuaccuucagcagauaugguagcggucugcguucuuucuguaacaaaacuccucacuacguggagaaccccucaaucccaagucagcuguacaccuggccucuucagaagcuaugugugcccagaaggugcuggugggaacagaaaaaaaaaauugaaaucaaauuuuauuuuuugagaccuauggaaacuagguugcuuauacuugaggaauauuugaggaaguauaagcaacuuaguuuccguaagugagaaaacugaggcucucagcuuccaaauucaggucugccugguucccauauccauucuuuuccuguaauauauguuuccagaugaagcaucaagaaauguucuaaaccuggcugcuaugaauguguggugugaccuugagcaagucaccuaacuucucugagccuuggguuuguaucugaagggugagagguuagagacucugaggucuccaauggcagugcuucuccaauguuaauggacauaggaaucaccuggggaucuuguuaaaaugcagauucugauucaguaggucuggggacaggcuugagguuguacaucugagaauauuccagauaaugcugaugccacuaguccacagacaguacuuugaguagcaaggucuuguagcauuaucauucuaggguuccaagauggcagugaccacguuuuagucuuccagucaccccugccugcccauguaugguuacaacaugacuuguacaguuggugcucaacaauguucaauacauuggauuuagguaguaaagaauaaguaguucaaagggacauaaucuaagggaaguuuguagcucaggaagcucaauaauucuguaauuuccugaaggcaccaucccucaagggucaaacugaagccuagccuucucccccacccacaaaagguacccugauaauccuaacuuuucccacaguggauuuauccaccccuacuguauccccagcucacucugacugacuuaaucugaaaucagaucaaccuuaaaggacaucugguaaaugccauuagguagcacuuuacucucccaaagauuuuauuuuguagauuaaaucacaucuccccuagauacauucugacauauaaaguuucuuccuccauucugacaccccucuuuguucugguaaccaguaucagcauuuuacuaauuuucugugguauuuccauccuuucuuccauguauguacuuugcuguucuuagaaugguugcagaggccagaagccagauuuucauuaucucuauggggaaacauuccauaaacucaagacaaaaaauauaccaugaauugaaaaaacggaaauaauuagccacuaaaaucucuuuucuuucugucuuuaaaaaaauuuccauuuuuggccaggcacgguggcucaugccuguaaucccagcacuuugggaggccaagauggguggaucacgaggucaggaguucgagaccagccuaaccaacauggugaaaccccauuucuacuaaaaauacaaaaauuagcuuggugugguggugugugccuguaaucccagcuacucaggaagcugaggcaggagaaucgcuugagcccgggagguggagguugcagugagccgagaucgcaccacugaacgccagccugggcaacagagcgagacucugucucaaaaaaaaaaaaaaaaaaaaaaaaaaucccauuuuaaaccacuuguuuagaguugggucuaauuagaguacuuuagaaauaaaggcuauguugugccuguaaagaaguggaugcuauuuuuuuaaccugaucuuucuuauaaugcccaaaaggacaacacuacguauuuucauaugacugucaagggacagagucaguuccaacuauuugaccuagauaaacagauuaccauucacuucaucugaaaguacagggauaauuaacuuggacaaccauguaaacagcaggggucuccuccagaguucugccuucuuaaaucagcagauauccuucuagagagcugccacagcaaggccauuuacugugauugcguuuuauugcuguauuuuaaguuguucucaugaacuguauggugauauggaaagaacuucuaggcauuucagucuucuuaggcuuauuccuaugucccagccuaucugugcuuauccauuugguaagguuuaugauggauuuguucuccugaguucaacaaaauguuuuuauuccuucugcaaaguugguaauuaguccaugacaaaccauugagccccuagaaucaaagacaccuggaaucacaguuacacaggaccuuaaaggucauggaguccaguucccugugucuugugccgaccuccuucuacagaaucucugaccaacgggguuucacucuagcuuacgugcacagcauucagcaguagguugcacauucuuuuaacugugccuccuacucccugcucaaagaguucucuuuuuagguugagcugaaauucaauuuucucuaguucccaccuuuaauagcaaugcagggaaaacaaaauaacuuccucuuacacguggcaguccuucaucuaucugcagguaacaaccacaccucccugagccuccuguucuucauguccuuuuccagcugucuuuaugucaaacauuagacuccucucuauccuggucacacuccagccuuccucaaguuaguggcccggaauggguaccauccuccaggugagguggacuagcauucuggagcaguuguucucaaccuuggcugcacacugcgauccgcuggaugcaugccugggacccacaagcagagacccugauauaacagaccuggaauguggucuaagcaucaagauuuauaaaagcuucuuggguaugucgauuguagccaagauucagaaccacugaugugguuugucuguguccccacccaaaucucaucuugaauuguagcucccauaauucccacauguuguaggagggacccagugggagauaauuggaucaugggggcgguuuccccgauacuguucucauggaaaugaauaagucucaugaaaucugaugguuuuauaaggggaaaccccuuuuugcuugguucucauucucucuuugccugccaccauguaagaugugacuuugcuccuccuucacuuucugccaugauugugaggucuccccagccauguggaacugugagucaauuauaccucuuuccuuucuuuccuuuauaaauuauccagucucggguaugucuguauuagcagccugagaauggacuaauacaaccacuguucuggauucuuuacuaaucagaggcguugauggauacccagguagaguguggagaaggaguggguagggggcaguuaggggagaugggagguuacaaccuauuguugaauggauagaucucuccguaagcuaaaacucaugguuguuucuugguuuuuaguuuuuaucuugauuuuuguuuuacguuuauacaaaaccaauauaaucguaacuuaaguuccacagcuaggguagcuaaacucaucuuuuaucauguuucuggcagguauuauuguauuuuguccucugggacuuuaugaugagacauacggggaguugggcacauacaucucccuccugagaccucacucccuccucaccuccaucucauugcauauuaacagcaccaaaucacugacucauacugaauaggcuacucacucaaacucuuacucaugcuacuacuaagccauuacucucgucuuauguucuggcaauuuuaauuuaaaaaauuaaauuaaauuauguucuggcuuuuuuaauuuaaaaaauucaccuuuaauucugauaaaggcccaaaugagaggauauggguuggguaugccacaagaaugaacuucccaguccuggacuccagauuagacagacuugcccacacaguacaggcaguccuggaaaaugacagagucccguugggggaauugcguuguaaaauggacagcauggaggugcaggccagaaugcaugcucuuugccuguagaugacaccccaaaaaaucauugcauuuuuaaaggauucugaaugaucacaacacacaaaaaaagaaaugauaaaugucugaggugaugcucaauacuauaauuugaucauuacacaauguauacauggauagaaacaucacauugugcucaugaauauguacaauuauuaugugucacuuaaaacaaaauuuaaaaauaacauuugcuugaaucagcaaaaaggagaaaagaagcaggcacuuacuauacacuggcccacuuugugccaccuauacuguauucacuguaaaugcauaauuucauuuaaucuauacaauaauccuauaauguggcuguaaugaugcccauacuacacauuaagaaaccagggcucggggggauuagugcuaauaaguggaguguccagauagaaacuugagccuaagguaagcagggacuucauuccuguugaauuucauuauauuggguuugcuccagaguuccagccuuucaaagucguuuucaauccuguuuuuucaggucauguauuugcgagguuaggaaaaccuacucuguugugaugagaugcagaacacuuagaagacacucuucuugccuacaaguaaauuuacuauauaaaguaguaagaccacauaucugugaagcuaauuauauucuugauucugggcaugaaaagcagaaagaaaaagggauuuuuuuuccaucuguaucugauuuauacagggacucccuaacuuaacacaggaagggugaauuauuaggcagauuuugauaauuuaaagacacaguuugcccuagaaauaauguuuuucacugguaaucagaucaucuggccaucugcaaugccuguuugacccacaguauaccugguaugugcuaguaaaaauacuguuccaacuccgccauggguguguugcagaugacuauagcagggcagguccuaguaaugcuucugucucccccaugguugcaguaagucuuuuuuuuaagucuguaagagaucacagaucugcuuacuuguuuaacaugccccaauaaugaguucuuggcauuuguaaauccagucauuauuuuccugaugagaggugagcuuuuuaaaaaaaaaauccuucagcaacuugcuuuauuuuacuugaaacuauguauaucauagggauauaucuccaugcuacugcauaugaauuuauuguuuuaucuacugcacagaauuucagaccaugaugccccgugauuuauacaauaauuucccuuuggauggacauuaaaaguuuccauuuuuuccuucaugacaaguaauguuuuagugaauauucucauucauauaccuuuguacuguuggaauauuucagaagaauuuauuucuauaacugaaauugacauaucaaagaauauauacacuuaaaauuuugguugcccuccaaaaagguuauaacaacuuauauucccaccaaaaugugugguaaauagggauuaucauuuuguuuucauuggcauuuccuuuauuauuauuauuuuaauugacacauaauacuuuuacuuauugaugggguacagugugauauuuugauacauguaugcaguguauaaugaucaaaucaugguaauuagcauauucaucaccucaaguauuuaucauuucuuuauguugacgugaacagaaaccacaucaaauuuuagaacugcagaacccuugagauuucaauaucccucuucucuccugccaguuucaugccagacauugaaaacuuggguuuuagagcagaaguaugucucaauacaauugacucuugcagaaacuccuuccuauguaaauagccauuucugcacuuuucuucaccugccuugcaaugcaaggaguuccuuccaguacuuaccuugcuuucucugagccugguucuguuugcuuugacauuuauagaaggcucaacuucuucucucagcacuuuugacauucuguggcucuuugggaaaggguucauaaaaaauggaauuaacaucuauggaaauaauauauggcucuccagauagaaccacucaucaggggccgguugccuagggaacuggaagagaaccaugugggaggcuccacacaagacccuguaccucuuucuuucugccgucucucacuuuugucuacucuacguucucaugcaaacuuacguacucugccugaguugaaagcugaggccugugcagaugaggucucuaagaacguaaagacauucccaaauuucaaacuugauuucugauguacagcucacuucuuuccgucacauccauauuaucacuggggcaugaucagaaacuucauggcaggggcccaccuggaacccacaccccuagagaugcaggagaagacauccugcaagcgugugugugugaguguguguaugugaguguguguaauuaaauguguguacauguggaauucaaaugaaugcugcauuaaucaucgacacaaauuugggguacuuccuguguuaggcaccguugaugaaaagauaccauucuugucccuauuacaaugacugaugauuagcaugaugggauggcauucaagugcaguagguguuuagaagagggaaccccugagaacucacacuucacagaggagugugaguuuugagauggguuauagaggaagaguacaauuuagccaggcaaggagguaggggaaaguguaccagucagagggaaaagcauauuacacaagggagggaagagccagcauaaugugcucugcaagcugccaguacucugaagcugcacugaggaaugcggaaagaugacgguaaagaguaagcuagugguuccaucaugaaggccucauaugccaugcuaugaauuuuguuuuauacucuaggcaaagggaaacuacugaaaaauuucaggcuguugaaaagacacugccggaccuauugggcaccaaugcugaggcauaugugcuaaaaauaaugcaaaucagagggaaguaggauucuuucuucaucauuggaaaaaaaaaauaaagcucuuaccucagcuuuggguagaaaucuuugcuuuccuccggaaauacagcuucaucuucuccuuugugguuuuugugcuggugcuuucuuaaucuggucuugcaagcaaagcuaccagauggcuuucguccugcgcacugucccagccaugcucacaugucggguugaugaaugaacuccucccuuauucaucugaccuuugcaucaccaccuuccugacugggcaacuucggcuuucucgaccgaaccaucaugcaugaagauuugcaagccccugugggagcagaccacuuuacucuaaaucacuugucagaagcaccgagaggccacuacuuaguggaacaauagaaacaguuuuuauauuuugggcuuugacuggaauaaauugugaucacacugaaguuaggucuuucucucuacucuuuguuccuuuuacuucuuccuuuuucccuuugucauucuccucuauuuucuucacuuuuccaaaacuuuuaguugcauggaccugcuuuggaguaaacagaccuuucugcuuguuagaacuuuuucucccggcugggugcagugggucacauuuguaaucccggcauuuugggagaccgagaugggaggauugcuugagucuaggaguuugagaccagccuggguaauauagugagaccccaucuguacaaaaaauaaaaaaauaaauuagcuggauaugguggcaugugccuguggucccagcuacuugggaggcugaggugggaggaccacuugagccuaggaggucaaggcuucagugagcugugaucacuccuccguacuccagccuaggugacagagcaagacccugucucaaagaaaaaaaaaaacaaaaacaaaaccuucuuuuccuaauaaaaggagauaaaaagauugcaccaucccuccagccuuagucgaccagagugcacccugcguuggggagggcaugguugccagaaaccacccugugcauuuccaccggcguggcucaauccucacccaaggccauucaggauuauggcuggcaguuugggugugaaguucuugagggcacugguggaaagaaagaacugggaagaaaaagaacugcugagaaugagggggauggcagagcaaagcagguacuuggggaaaagaaggaaggagauguaagaauggaggggagaacaaucuaggaauagaaaggaaaaggggaaauaaauugggaagaaguacaccauguagagaagaagggucuugaaaggacaagauaaaacaugguucuccuaguagacccuuuggcacugauggagaccucacggagagcacaauaggcuauggguaaggagcuagauaucuaccuacaacuuuuacuagcaauugccaagaaauggauugcaaaguccuccugauaaggcccuggaggucgagaauugggugcuguuugcuucauucuuucucccucaguggccacacccugugggccucuguguuggcugaaaaacccgugccaauugcaucggacguuucaguucaccgaaacacaaaagaauggaagaauagucuccauguccuggccgcuguuccuugcagcuauuuucccuaaacaguggagcaacuuaaaauagccauccuucugucuacuuuuauuuaugacgguuuuuguguuuaauucacaacuucuucugaugugcccucagcucugugcagccuggccagcgcugugcagggugcccuccaggaagagcgccaggcaguugaaaacuucugccaacacugggaaauguguuggcugcccgggagauuccacccacaaguaacugcagugguauuuuuuuaaaugucucuguuggggcacaggcaggacugagucucaacugggcagcagcaggggguauccuuucucauugaucagugccagagcguuuguuaaauuuuuggauuaucacccguggauaguggguuagggcugaagaugugcacaauucuauauucucuuuuugguugaguugguauuugggauguggguuguuucaauguccagaugaaaccacagcuuucucaguggggaaggaguuaaagccccaacccgccccgccacccuauuucccccagccccacuccucaccagguuccagcccaggagugagugcuuccuaagcacccagcuggugguguccuucugauccaggcccugucuuucuugggccgcucaucagcuuuugucucuuuggauggcaagugcuccaagcucaggcucugaauagacaaaggauuaaaagcuuuggaaauaaaaaauaggucuucaaagcugccagcaauggccaaggauucccuccagugcagcaggguccaacaacccagcccagcgcacuucucccaaauguuuugggaggcuccuuuccuuugagcaacaaggccuguguugucugugggucucauacuuggaggccgaagaauaagcauugcuggaaggggcgagaaagguggcuucugugcugcccaagacaccgcagauugcaggggauacgccuguaacuggcauaucccagcgcacacuguuagaucuagccagggaaugcaagcuugcuggggguuccaguccuaauuccuacggguucuuuaugaguuucaggcggcagccugaccaaugggcaucagaccccucgggcucacacgugccgggagcaucaugcugcugguuucucuucugccaucuggaagccauuugcauugaaaugguuucagccgcuugcugagcacuggguuuuacaggagucacagcacagggcagcccaggucccaggagccaagagccuucacuuccuguaggauuuccaguuuaaaacccacugaagcucugcccuccagggcaccaccagguccuccguccccucuucccuuuccuccccuuuuggaccccaagagcaaugacacgugcaggggaacccugacaucuauccuucuucuauuucuuaccaacuuuguagguuggaagggaaggggugcagaaaagucccuuuauaaaaaacgcuucaggcaagagcucguacuuuacauucucugcugcaugcauuuuguaaaaugcaguaucucaggagagcucugaggacucacacucaagccucuagccaucuaauuucaugauaaucauaggugccuguuaccgugccugacacugugcuagggucucuauuugccuuacucuaauccuuagaauaacccugcagagaaagacgagagucuuggguuaagcagcuaauaaaagaaauguaggauucucaucaaggucuuugccauuccaaagcucuuucugcucuagaaacucguguccccauuuaggccuaagcagggugggagcuccccaaggacagagaagcaaaggaagaacaaacaucugcaguucacacuagauaguccagucauggguuuuuuaaggaagcaaaaugaucuuuugaaaggaaacucaugcagucuguccgcuucuugccaacucuacuacagugcaacgugccaaaaacagccaaaccuuguuugagguaugaaagcagcuguuauaauaaacuccucugcucuaccucuuuuccuguuaugguggaauggcuguuuaaaguaaaugucuccaauccauggauuuucuggggucaugaaaacauuguuuaauuggcagacuguauuacauuuuuuggugaaguuaggaaguaaacagaaugccacacgccauguuagauccaugcaguguaaaggucuguaaggaaacggucccuggauucuggagccauuauuccccacuucccacccccugggguggaccagccuucucagguuuugagguuguuccagaaagaauggauuucugccucucuucuaucccaggacuuccaaagcagagcaaggggaaauuagugcacggaauggagucgaucuggguuugaauccucucucugccagucacuaauguggaacuucagguaaauuacucugagccuccaucuuggaaucuguaagauggauaugguaauaacuacccaauugccuucaucauaaaauuuaaaacaaaaucaaaauuauaacauauauugcuguaguucuuaguauagacccugugccguucagguguuuuacaggcauuaauucauuuaaucuccucaacgacuuuaugaggcagauacuguucuaaccaucuucuagccucuggggagacaaugggcaguucaaccaacaaagaucucugccugcauggaacucacauucuuguuagggaggccaacagauaaguaaaauacauaaguaaaugaaauggugauaagugcuaugaagaaaaauaaacagagcuaaguguggucgugcacgccugugguccuaccuacucaggaggcugaggugggaggcucgcuugagcccaggaguuugaggcugcagugagcuaugagugcaccuaggaauagccacugcacuccagccugggcaacauaaugagacuccauagcuaaauaaauacauaaaauaaacaagaaagggagauggaggcaugggggaggaggauugcauuuuucaaaagaauggucagggaaggccucucugagaagaugauguuuuuaaguaaaaacccgaaaaaagggagaaagccaugaggguacccacaggagaguguccuaggcagaggaaacggcccaugcaaaggccuugugguggcaggccugguguguucgaggccuggugaggaggccagcauggcuggagucgaaacagcaaggcaggcagcuuuggaggcagacaguguagggccucaugaaccucagcucuuucucucaggagaggagaagcucccagaagagcuugagcagaggagggacuugacccagaugaaacuaggugugaggaaggacacuucuauuugugcacugcagcugcugcuccugcugcugguucccaugagaacaguugccaacuuuuccagacuaaguaggacacuucuuaaugggacaucugggccuccacugucgacauuguacuuguugauuuuaacaacagaugaacuuuccccaacuucccauguaucuguguccagccuccucccuccuuuugggugguucuguccuuugccacugcucugcacuggaucgucuugaugaugcuacuuaacuggcuacauagacagcugcggucugaacucaccaugcauaacguguugcugucuugaguuaguuauuggggccaguggcucacagauaaguauugcuugggccaggaaaccacaagaaugaauggggaagaagggugagggaaauguuuauaaacagaauugcccccucaguggagacuaugaagccuauuaguauaacaagccgccccaaaacuugcuagucuauacaaauucuggugggaaaaauuaggauauccucauacuuccuaugggaggccagguaucacaaguuccgagccucaggccuacaggugguuucuagagcccauggaucuccugaaaucaugcccaaacauaugccugugggugauuuucaggggcgaggucauaguuuccauguggcuuguucuuugaauggcuugaauggcuugauugcaauugcaggucauacuuucaacacuggcugguguguuacuguaugugcaaacgugaaaaaauguauguauuucaaaacagaguuuaaaaggaucuuuuaauucccuaauauuaaaaguccauaauaucuguauuugacaaauaugguguuaucaguauagaaagauaaauuauggucucuuagaaauuaagggauguguuuuugaggacaucgagguguacugucucccaagcucuguuugccgcuuuucucaauggcuuuaaaucaucaggaauucacucucuguauuagaucauuuauucucauaugccgcucgcugccuuugaaauaccuccaauucuagcaaugguuuacagacaugcacaagagccaaguggcuuaaagcaacacccuaggacuuagguguuuggaagccccuuauccccuggagucauuuguggaacagggccugcaugcaagaggaggcccaagcucagaaaugagcaaagagcaugacuuaacagggagguuguagcgucuucacagcagaguacagugaauagaauuacauguuccucaagucccauuggcucauauuggcaucauucgguacuggacacagggugugcaccaaguauaucugugagucaaugcucaccugcagauguaccacgaagcauaccagacagaauucuuggggggagguggggggcugcugcuucucccaggcccugggguucuaucacaauauuugauucuacccgguucagauaagcccuuacggggauucuuagcugggacuuacagaaauugacaacgagauuuguuaggaaugacugaucccaugcccuggaauguaagccaugcacaguuuaugguacauaauuauauacaauaaacuauaaaggacauacaguggauuuugauaucagguuccaguuccuccucacugaggaauuaguacaaacccuucaucuguguggcuaaggaaauaguucugguccugcccgaauccguuuccauguguccacauggcccuuuuuccccaccauguacuucugacgggagaggucugcuccuuacauuaggaucgaaagccucgugggagaaguugcaagguguucccuuuccagcggucacuguggaggaaaaaaggauaaccguaugacugucagagacgugaucaaauaggaugagcuuacauuggauaaguagacaaaauacaaaaucagcaauaagauuaugacacagaaaucuguguauuuguuccucaauugcauacaaauuucccauuuuucaucaagauggaaauugaauaagaggaaaacuaagaggcucuuaucacagaugagcuuguguuccaguucaccauggcuaccaucagaguuuuguccuggucacaggcagcuguagucuguguuacucucuaacuagaauacacacaucccucagagggauucauugccuuuugccacagagcuguagucucuguuuccuuugaagauggggggaagguuuaacacauuuguccagaagcacucuucugcuggaauaugggacuacauguggauccccucuuccugagucaucaugacacuuccugugucacagcguuaaauguccccuuggcagaauguucuagguacacccuugaauuacuaaauguucuauuuugugugaaucauauuauccugugucaguuaaacaacacucuuuugggcgggcaugguggcucauguuguaaucccagcacuuugggaggccgaggcagguggaucgcuugagcucaggaguuugagaccagccggggcaauauggugaaaccccauuucuacaaaaaauacaaaaauuagcugggccugguggugcacacauguagucccagcuacugaggaggcuacggugggagaauugcuugagcccaggaguuugaggcugcagugagccaagaucacgccacugcacucuagccugggugacagagcaagacccugucucaaaaaacaaacaaacaaaaaacacucuuucaguuauacccuccaaaaugauaugggaaauuauuuugccccuacuucugcaccaacuucaaggguuuggauugccugcucccagcuuugucucagugacuucaggacucuggugcuugauuuaauagaaaugagacaauacaauaaaaauuaauggaaccaguuuggucuuuucaaucuauuaccuauuuuguguuucgagaggggaauugagacuggaggagaacuguggaaugcauuuaccaaagaaggcuuucacugucuaaacguagugucccugaauggggggaggugggauaggcggguggggucguagugucugguucacaguguugguacugcacaaaggcaccugagggaagaaugagagcagaaguccagcuccacucugcagaccaagugugcagauauaaaaccuuugcaggaaucaccacagugccugcaucagaacucacguacuugaucgauucugcccuggauauccaaguaauguuacugcugugccgaugacugcugugcagauguuaguuucauaccgcaguuuguuuccccucacucucuugaaccuguucuuuauuaggaacagaaagaguuuguguccucucuaggucccagugagcaaagcacagauccuuugccucaggcucucgcagcuugucaggacacaaguuacccgcuggcagggacauuccuacaaucaacugucacaaggccuguuacugcuuauuuucauuucccuguugccgcagcuccccuuucuccuguucugucuagauaaucagaagauuuucuucucuuucuuuaaaaaaaaauuguuucuauccccuacucugugauccuuuccauccuacccuaggccugugcagcagaaaccuuugaaagaagggguccucccugcaccccagggcccuccuggaguccuggcuuuuccagcuccacuuggauaaacauuucucuuccgugauuugugcccaguugcggcgugucugggaagugagcaggaguagaaacagauggaucuuccacgggcucaaagucaagaagauugacuucuaugcaguaguccucuggauaaagcuuaguaaacauauaaucacaccaucaucuggggcucuguauacccuaguaaaugagugcuucuaauuuuauaagcacugucauuaccacaguucuacaugagauuuuuccuuugacuguaguauauguucuuuugcuuuacuagguguuguuuauuagguguuguuucccccaaguacuguagaaagugacagauuguuucagggcaaccaguagguuguauuuacaggugguuggcugucuugaccagcuuugcugcaauaacauaacugcuuuccagcaggaaggaacauugcauaguagugagggcugugaaguccagacuucauuguauucuucauuuaggaacgaacauuuucugaaucacugaauccuucuuuuucaguuccucuucaggucugugcauaaugggaaggugaugaaugagcccugucuuggugcaugacaaagaugcaaaaauggcauuccuaguccaucaucagcaggaccugagcuucuaguugcuuuuccagaguaggguugagaggccuggcugccccaggcaggaagagcucuggcuaggcaccauuuagaagggguaugccuccuagauccaucaagcugagaccaucccugggaucccguugugugguggaccucucaagacaaguaucucuucuuaauggaagggucucucuuaccacaggcuguuuuaaagaauaauaagcaaugaacucacaguguguucuaaaccgcaugcaguguacugggaguuuauguaaacaaauauaugcugcaaauuaaaaauaaaauguaugagugaaucccuagugggugauucugguacuaauuccaaauuccauauucaccggggaaguggggaacaccuucagcaaagugcggauuggacaguguuguuaaguccucacccaaagccgcuucuucuuuaagcccguuuaaccaguuuacaacuguaauuaggagcuguuuggccaucggggaaauaaaauucguuucuuugggcaugaaauacaaugaagugauuauaccauaaaaauuucauaucauaugaaauuauauauguauuuucugcaucucugaucuccauuauucacuuguuuccagagcuggugugcuccuggucacauuuucugauucucugcuguaagagcugaaguucaaaaggccuucugccugcacugugaauggcucagcugguagaaucugauuuuuuccuauuuugauuucugagucugcugcuuuuacagucauuuaugcaucucaugaauguaaugaaguguugcuuuccucugaacucuuguauuuuuuucugccuuguaggucggguuuuaaucccugcaugauuuugagagguaaacagaauaucuuccagaucgggguugcucuucauaauccuuuccucgguggugauuccuccaucugaauccaaauguguccuccauagcugccuguccuaggcugauucaccagggcuccacaucuugacuuugcuaugccaccucauuuccacgugagaaggaagugcacguucagggugguuggucagaguuaagucagccuguauccguggggugaaauuaacagacaugugggaauugaaccuuaaacauucucaguuucacuaggaaccuaaaauuauaaucacgccacagagauuguaaauuugaaauuuaccuuguuuccauggaaauuuugaauucaaaacauuuaauguguaaaauaucacuaguaagagggcacauagcauugggagauauaccuaaugcuagaugacacguuagugggugcagcgcaccagcauggcacauguauacauauguaacuaaccugcacaaugugcacauguacccuaaaacuuaaaguauaauaaaaaaaaaaaacauuauuccaaaaaaaaauaaaaauaaaaauaaaaauaaaaauaaaaaaaaauaaaaaaaaaaagaucuguaucaccuccggggaaggaaaggaacgaugcuucauguccaagcuugguggugccagugauccugaacuucucaaguaauuagucuauauggacagauuaguucuuuacuuguuuaaaugcaauggaucaguugcauuaagugguaugugcucuuuacuuguuuaaaugcaauggaucaguugcauuaagugguaugugcauugagugguaggcuggcaaaugguaagggcgcugaguggaaugcuggcaaauguuuaacagccggcucuccagaaggcaaaagcccugauuuggagcuuuuugcugauuucaauggugugaauacuuccagcaugaccaauuucaugcuaccaauauaaagucacugaacauagaguugugaagagauaacaacaauugggggucaccagucaguauaagcuggcuccagucacgcccaugauaaacccaugggaaauugugauuuuugaauuuuuuuuguuuuguuuuuguguuuuguuuuguuuuguuuuugagacggagucucgcucuguugcccaggcuggagugcagugacgugaucucggcucacugcaagcuccgccucccggguucacgccauucuccugccucagccucagaaguagcugggacuacaggcgcccgccaccacgcccggcuaauuuuuuuguauuuuuuaguggagacgggguuucaccauguuagccaggcuggucucgaucuccugaccucaugauccgcccaccuuggccucccaaaguucugggauuacaggccugagccaccgcgcccggccuuguuuuguuuuugacagucucugucuaucacccaggcuggagaguacuggugggauuucggcucacugcaaccucugccucccaggaucgagcgauucuucugccucagccacccaaguagcugggacuacaggcaugugccacuaugcucagcuaauuuuuuguguuuuuaguagagauaagguuuuaccauauuggccaggcuggucucaaacuccugaccucaagugauccacccaccuuggccucccaaaauguugggauuacagacaugagccacugugccuggugauuuugaauuuugcuuuagaaauccuuuucuacaaacaucucuagugucugaagaaagucacuuugugugaguguguacaaacguauguucccaucuaguuauuucaguuuuaaacaauuuucuaaauuuaacugucauuucuaaacuccauauaaaggcauggaaaauuaaauaagccuacauguucccauuuauuuuauaugccauaauucauugcaugccuucugacuuuuuguuuaaugguuuuucauuuuuauuuccaguuucauugcuuugacuuccaaaaguauagcugucugccccaugaaaauauuucucuccccaucccccuuugucuaguuuuguuuuguuuuguuuuguuuugguagagacagcaucucacuguguugcccuggccagucuugaacucguggccucagggauccucuugccucacccucccaaagugcugggauuacaggcaugggccacgacaccaggccuuuguccaguuuuaauaacaaguauguggcuagugacagggauggucgucauuccgucuggggccacucuccccucacaggcgucgugggccaauacucuauuaaaauaggucccucccaguucccuccuuguuuugccaacuuuuccucauuuggaucauuucaagucgauugacucauuucucauuagguucaagacugaggccacauucaauguggaacagaaugacuguuuuaaaacagcaguggugaagucuccugcucugucuuggcuucguucccuuaauuuuaagugucuucgacuaucaucuucacuugaagaaaguaaaaaacacauguuuuugaggaacgaggaaugucugucagguugauugauguuuucauuuacauugaaguccacuuuuuuuccccaucaaaacacuaguuuuggugguuaaaaaaaaaaucaaaucgguaugugagggagaguggauguaggcaugucuuugccagcaccugcucagcagcauaauuuucacaugccccgacacugugucguugacaaacagcaaauaucuugucauuaacugagauuuguccugcucagcgcuguucccccucgucauuauauuaguccuucagcugcccccaaaugacacuuuguaaagcagccacacucaaggcaaguguuggauugcagguuuacaguucucaucuuggcccuaucacauggaguuuugaaagugccgagacccacaaaauggagaaaugcuguagggucuugggacucacuucagucugggcaggggucugaaggcauguuuugcauuccuuucaucauaaccuucauuccacccucuaccuccagcggguuugaggcugcggcucccuguggcaucagccuuggcugugugggaggaaagggcucucaucagugucaguguuuuaacugucaggccccugagcugugccccucucccaggacauccauaccccggcccacaggacagugagaucagcaaaucaccuagaagacuggagacaaaggugggagaggagauugugaaaucccuugcaccugacagcagauuccaauuugggggcagggagauugcuccuggaagcgagggcccacuucccacugcccggaucuguacuccagucaugccuuuguuaagccgcaggaugugccgaguacuagcgggugcuccuuugcuuagggaaaugcaaacgcaacacagcagaaaaacaaaacccucaugccuguacaaggagguagcuaugaagaucauggggaguguggaugugugcaguaucaacuacacaggugcuuagggauucaaggcaaauuaggaaagggugcauugaggaggaaaucugugaguaagcacaaaggaaguuaguuaguagggaagagcguuucagggaagagaagggcaaaucucacagcccagaggggaaaugagcagagcccugucagagaccauagcuaugcaggugccugggguccuucccaugcucccucaaacucuugcucaaauguuacucugcggagagggcuccagacacaccauacuuaaaauugacaucuacgucccccgcuacaugcccuucgcucagugcuugccuuguuuuuacuauagcauucaucaccuucugucauaugaagacauccucccacuggaauauaaguuccagaaggcagagauagauuuuugucuguuguguucaccaguauaacuacugccugcuacuuacaccuugaagaaaugaauaaacaggauguagcaagaauggaauguggugaugugggcagaauucuggggucgaaggaacuccagcuggaagguagaaaacccgagcccuaaagccagccuggcuguguauaaacuugggguggggggaguaggagagaggaguggaguuccuugggccucaguuucuucacuggugagaugcauauuagccaagaugacagccagcgccccucccggccucaagauucugagugccaacauggucagagggugcgggagcaacuggagaaucacuguggauuccugaaccacagggucaaggagguauugguaagaaaaaaauauuuuuugccaguguauuccagauaauuuuuuuuuagagggaggcuaagaggcuagagguaaauaaauuuuuuaaucgccaucugauaaacccuccugucaccuucuuccuugccucugucuuaccuugcccagcuccugcaagcuugagccacaagcaguuuuuuggcucuguagaugaaggagccauugaagacuggcuuuugggguucauuucaagcauacuagaacuucaaaagaaaaccauggggugaccaauuuauuugguuucaagcuuaaacugaucaaggcuccugcauaucccauaguuugcuuugaaauuauaaagguaccuucuuucccuggcccaucucacuccaaaaacucccucagcauugggagauauuccccugaggggcuaacaugccuuaccagccaaaccuucaagccacucuugaccucuccuagagagaaugagcauuuauuuagggcagaauuuacuugcugcuuaaguaugucaccacagucuaauaaaggagaaauuauagccggcagaagcaucaggccuguaaguuaguuaacccaccggagacuacauuuuauugcuuauuucugagaaaggcuuaucuaucaacaugugaaaggauguuuccgcaccccuuuauuuugacagaauacuucuacugguaugucuaacugguccguuuucuagauuaucucguugggcauccuuuaucuugcuuuguuuuguuuuucacuucuggagaugaauaagcuuggagaagcaacacacaaaagauuuggguucaacucccagcucagcuacucacuggcuuggguacucacccucuuugaccuccccacuuuccuaaaaucuguaaaauuagggucagaauuccuacucugcaggguuguuaaagacauuauaaguaaccaggagaggguuccuggcccauaucagguccucaguaauagccuucauccucagcaauuccucuucacauucacagcaauagcaaacucucacccacucaagaaaugucucauggccuuccucaauuaccugucagagucagugucuggcucaauucuacagcagauugaugacccaagcuagagcugcauuuucaugaguccuuuuaaugaaaagauucagcacuuaaucccagaaggacauuguaugguagugccagauaaugaaguagucaggcugcugaaauguugacaguucacucugugcccauagaauaaaauguauaggaauagagccaagaggaaggggccagcuaggagagacaacuguaagagaugugaugguugagcuccccagugagcaaggauuccucuccuuggaauugaaagcauuuguggacaguucaucuaauaaaggauuucuuauaaaaaccacaaagagaaaauaauggcguucuuuugagacacuauauauucuggcagacacugcauacucugagugggaccguuacaucuggcuuuugccuacgacaauucuuuuuuaguaggcaggguauaaauuauaaauuuuaaauaaauaaugcauaaucuuaaaaaaaacaauaaaaccaaaccagaacugacugccuuuucuuuuuauacacaugaaaaaauuucaaugaaaacaaacuauacccuugguaaaugcacagaauuugaauguaaguucagcaugaacgucgaagaguucaugcugucauaaaacucucuucuaaguaacuuuuccgguuugaacacaucuuuaugaauacagagcugcugugaggcuucacuuauuuugcacagaaagugauuucauuuccaauucuuguccugcuuccguuuucauggcuauccacaucguuaggaaacuuggcauaguaagguguccagggcugggauuuguauuuggggaacuaaauuacucacuaauaaaaaaaauuuuuuuuacuaauuccauauuucaucauuuaguaaauagccuucaucauaaggaaaagcuaguuauuucgguggauaaaguguuuuauguauuuaacuuuuguuccagugauauugcguaacauucaagcaacuaaccggguuguuaacucuuauuguuuuguugcuuuuggggccauuuuaauuauaggaauuuauuugaaucauccguuuuacuguuagagccaaaucauucuuauggguuuaugggaaucuauaccaccaggcaguagauuaauaacuguaaaaaaaccacaugaaaaguucacugcgaaucucagaucaaaacuugugguuuucuggauuuugcaauugacccuuuuuaaagcuucucuuugguaacaugaucuuuauggcaacaccacugagcuauagacacuugugaucaugaaaauagcccagaagugucccacacucacccacagugccggccuccaccuaccaaggaaggggauggaucugcaauguauccauuuuaacacacaagcccaccuucagugauauacauggcaaaaaaauaugagagugaaggagacucuuuuuuuuucugcaaaaagaucggaaaaacagacuggauugagacuggaccacagcacuugggagggcucuuuauggagaaccacagcagaaaggaauucucuuugcuggugaauucuucuggcccuuugcacugucauuccuggagcguuucaauuauucccccaaccagcaaacggcucacugaucagcagcccccauucccccccugccagcuucuuacuugaaauguguuguuggaaccagggcagcccaggggacuuugaguuugggcacuggggaccaaauugucagccuauucugaacuuccauggaauacucaaggaguuaaccagagcgauuuuggcuucacugggcccccacacuuuuuuguauaacaaagacucggacacuggaaaauacauucaaaacaugagccaagaguggaguucagcgggagauaguucaagagggaaaagcagcggaaaggcaugcacccuucagguccuugcugccuguaggccucugaauuucaaaugugcuauuggcgccagguucuuuggcacgcuggaucucuuaauggugaggggcagcacugcuucacuuccugaacugaaaucucuccucugcagcacucuguauaucaguccccagcccuuccuucccugcccacccccaccccgccaugggaacaaaguccccaggcucuggaaaguaaugcuaagaaaacaaacacuacaaaggcugguaacagggggauaucucucuugaauguuauuuuguaaccaucuagguucaaggaggagggggugccccagcuacaggagccagcagggucccuuuguaguaggcauccguguguuuggccagauguccucccagcggagggcagagaggaagauaaaacagaauucuuauuaaaaagaagucaggggagggggaaaacaagacagagaaagcgugucaaguggaaagggaggccaggcagugccaucugauauugauuaaaugcugauagagucagcagugagaaaugcacacggugaggaagugccccagcucuuuggaaugugaaccagugacagcuguccgggcuuggaucugcacgaauaccacaugcaccagaugccuggcggccacagggcuagcucacggggaaggaugggagggaaagaugagugugcuggagucaggaccuguggcuucugauccugcuuccccucucugggccucucuuuucccaucaaugacacaaugacgcuugaccucugcacaaccuucuagcucccagauugugucaucuacuauaaucucugcucuaaccaaaucuucugaggcucucuuaguggaauguaagaaaucauccugaagaggcauaagaagcucacccagcaugguccaaaaauccaaaaggaauaaacccgcccaucagccaugggagugccacccaguccuucagcgggaggucaggccagcaccccgugucugucgcccuucugugcuucacaguugccaccaaagcaaguucaugguuucucagcauggaauguggcgugucugugggucuaccuauauguuccuuucucuaaauuucaaaaauauuuucacccuuauuggauguaaagagucuuuuuucauuuuauaccaucagauuacagagagcuuaugcgcugguccguguguguggugggcuggggagaguguggguguguguguucaugcgcgcauccuuuaguuaagagugccuucuugaaagcuuguuguuuuguuuuuuuccuuuuuagcaaaugucaugaggacagugguauuuuaauaaagggugaggcuagauuccagugggaauggaagaggaagcuuccacugagaugaaaagaucucacacuagggugguggcaggggaaauggagaggaaacgaugacuagagagagggaccauggccuaguggagagaucguggcaucuagagucugacacagguuggaguccugacugcaacauuguauagagugucaguucagcucucaccaagaugcccccuugcaguccuuuuauggauuagagaugcuguguguaagggaucuagcucagaaccuggcacacuguaggcaguaagugaacaucaauaagcuguagaugaugaugaucaugaugaaaaauagcccacaaggccugugacugaauuggagaauaaguacaagagaagaaaugauggugucuuugaguuuaaccaccugagggauugggauagaaauaguaguugaguugaguacaauaagaaaaguuggguggaaguuggagaucugguuuggcagggcuagaacugaagucaguuuuagacauaagagacggugcugagacauacagguggcuauaaggaaguaagacagaaaggaaggggaggggaaaaauggaaaaauuauaauaaacaaguuuauuuacucuaggucuguuugaucagugagucuaauuuuacaagcuucaccuucaagggauugguuaaccaaaggucaauccaucaugaccagcuucuaaacuaaauccuugcuccucgaagugugguccucagaccaguugccaccuaggccuugcagaaauguagaaucuuagcuccucccucagacccacugaaucggaaccugcauuucaacaaugugauguguaagcacuuuaaaguuugagaagcauuguuccugagugugguccacagaccgcagcaucagcaucagcaucagcaucagcaucaccugggaacuucuuagaaauccaaauucuuggccaggcgugguggcucacaccuauacucccagcacuuugggaggcugaggcggcgagguggguggaucacuugaggucaggaguuugugaccagccuggccaacauggugaaaccccguuucuacuaaaaauacaaaaaguagccguguguggucgugggcaccuguaaucccagcuacucgggaggcugaggcaggagaaucacuugaacccgggaggcagagguugcagugagccgagaucgugccacugcacuccagccugggcaacagagcaaaacuccaucucaaaaaagaaaaaaaaaaaaaaagaaauccaaauucucaggucccuucucagaccuccugaauuagaaacaguguguuuuaaugacugcuucaagugacucucaugcaccccaaaguuugagaagcacugcucuaagucaugaaauugacagaugcaccuccucccuuugugucuacagccagagggaugugcugaacaccagagggauugguugagcccugaaagcuaaauuuaagucauuguuauaugcuguuucucucaucauuuugcauuaaacacagcugaagaacucuuuucacugaagaagggcacuaugcguaaaauuacaaaccaaaggagagaaacuucaacuguggcuuaauccucaugacuuacccaucaaaaguuauugagcacaguuauagaucaguccuuuaugugcuguugcuccugggggacgcuauuaguaagacacacauagggaaacaggucaggaaaacagggaaucuccugauauuccuuacaaugugauuuucacauuaaaacauccacagucuuugucuuguguguguuucuaaucuaucagauggaaauucucuuuuuaaagguuucuggagucacuugcagcauugaugcugguugaccacucagacaagaauguuuuucaaaaacgaccuuuuagcaguaaaaauuuaccuccucucaucaaaagugucugguuuuucuauuuguucuacagucauuauucaaaucgcugugauaacuaauauaagggucacugucuguuucuuguauacauguaauaugcaaaauuuguuauauauugggcaguuaauuauaagauuacuuguauuuucugccauagguuauaauacauuacaaccaguggcaugccgguaaacuaguuguuugcggccagggaaugggggccauccuaauucgcgguguuugccaauuucuaugguguaaauacucccugcagggcugauuucaagcuaccaacaguuucacaaccagcucucaaaguucuuacaaauuuaacaguuggcucuuacaagccaguaggaaccaacuucagcaugccacugaaacaaacaucaagggaccaaucaauaggauuuuuuuguuguauuugaauugcuguaggccuaacagugucugaaauaaguaaauuugaauguuuaaauauuuugucauacagagauuuuuauugaaauuaucaucguaauuaucauaauggaauuugauuugaaacuacagucaugugccacguaacguuucagucaacaauggacugcauagaugauggcagucccauaagauuauaaaacuguauuuuuauuguaccuuuucuauguuuagauacacaaauacuuaccauuguguuaaaguugccagaaauaaaguugccugucaguacaguaacaugcuguacagguuugagccuaggagcaacaggccauaccauguagccuagguguguaguagucuauaccagagguccccaacccccagggccauggaccaguuaccuguuaggaacuggacugcauagcaggaggugagcagugggcgagugagugaagcaucaucuguauuuacauccauuucccaucacuugcaugaccaccugagcuccgccuccugucagaucaguggcagcauuagauucucaaagaagcgcgaauccuguugugaacugugcaugugagggaucuagguugugcgcuccuuauaagaaucuaaugccugugaucugucacugucucccaucgcacccauacgggaccaucuauuuccaggaaaacaagcucagggcucccacuguuucuacauuauggugaguuguauaauuauuucauuauauauuacaauguaauaauaauagagauaaaguacacaauaaauggaaugcauuugaaucaucccgaaaccaucccuaccccuacucugguccauggaaaaauuggggaagaagauggggaccgcuggucuauaccaucuaggacuguguaaguacacucuaggacagugguccccuaccuuuuuggaaccagggaccaguuucauggaagauaauuuuuccauggauggacagggggcgggagaugguuucaggaugaaacugcuccaccugagaucaucaggcauuagucagauucucauaaggagcaugcaaccuagaucccucgcaugugcaguucacaauaggguucacgcuccuaagagaaucuaaugcugccacugaucugacaggagacagagcucagguggucaugcuggcucaccugccacucaacuccugcugugcagccgguuccuaacaggccaccagacugguaccaguccauggcccgggaauuagggaucccugcuccaggauguucacacagugaugaaauugccuaaugaugccauucucagaauguauccccauuaacugaugcaugacuguauucuaugaaacaaaguuaugugcuauuuuuaagucauauuaaauacagcuauaacaauagaaugguaauauugaagugcuuauguugcucaagcaguguguuuacugucaaaauaguucucauaguauaguaaggcauuuguaaaaauuauucuuagucccaauauuugaaccuaaaugcaaaaagauaaauuuuaaaaugacaucuuugcuuacuguuauuaaaauuugacuucucuuacagguauucaggaaggaacacaauguaccaaauguaaaaauaacugggcacugaaguuuucuaucauauuauuauacauuuugugugccuugcuaacaaucacaguagccauuuugggauauaaagguaagcaugcuuucuuuuuuuucuuccaaauaacaaguguuccuucauuaauuuaagcaugagaaaacucauauuugcaaauacgaaguauuucauucauacaacucagaugcaaaauaacaacaugauaaacuucaucucuguaucuuaaacuuacagcuaugagaucugaaaggggggacauaguaauuccuuuugacucauuucagcaauaaucagcguccucucugagaguuauaaaguuuuuuuucccuuguugcuuuuuucuaccuauuucuagcuacuccuucuuccucuauuuuuuuuucuuucguccuaucucuuggaggcuuuauggaaacccuggagucagcacacaggaaaacuauauugacagagaauaagcaaaacacaagaucuccagagauacaacauacuucacccagggaucggccaacuaauucccuuuuuucucugcagcacauucacuguggucacuguuguuuauauagcucuauaaaaauacugcccuguagaaauuaagcacagaggcagcacuaccaccucacccuacuuuauaggauguugggccuaaacauaucugguuuaggguaagggcaggauuuuugccugaauccuccagacuugcagacacaguaaguuccccaugcaccuuucagagaccauagguagaaggugucgugauucagaaucacaaaacuacauaagcccuuuucuagaaaacagccagggaaaccuucuuuaaaagacacgugaggcaaacacggccauuugguuucagaacagaggcagacguggagucuguggaucaucaggucuucccucugcuguguggcccacagacugacccaggaaaagaaagacuccaagugaauucccuccaacuggucauuccucccaccucucucccagcauguagcaguuuccugagaaagcacaguguguauuggaaugagaugggugucagggccagacaguccaaguucaagccuugauccuaccauuuuuaauacaauugugaauguucaguaagugcuugcuacugugccaggggucaugcuaugucuucugcauggcuccauacccaggugugaaucauagccucuuagagcuucugauuucuuaucugcaaaauggcaguaauaaugcuacuugucaagguguuugggaugagcaaagaugauguaauugaagaaucucuccuauagcuggucccaggaaaucauaucuguaucucucuguuccuugcuucuuccuagccacauuacacagcacuagcaguuagaauggcaaaaccugucaaacauccucaguacagucgggacuuuuagucccaucucuaaggccauauacguggaaaauaaugugcaucauugaguguguuggcugauuaguuuggacaauggaaaucuggaaaacuaccaggucguucuauccauuugugaugaguuagacugugaucuaacccagagcaucuuaaguuuuuagaugaagcagcaaacagaguaagugauuaaggaaggcuauuaaaucaugauuagcgcugggcagagguggggugggaagcugaugagagaaaggaggguuuuccaugucccagguaauccggacuaucucucuuccuuuuguuuagauuauuuaggucauuacucacuucuccaugacuuuuccuagugagccaagauaaaggagaagcuugaaaucagccauuuaauaaguacuuuuaagccucaguacuguguaaucacauuuacugcuaaaagagagaugagagugguuuggcaaauauauaacauguuguaauuuuuaccugugcuaggaaauaaagucugggacauuuaugcauucagaauuauacaaaaagagucaaagaagaggcuuuuuuucuccuuucuuuuuuuucuguuuguuuguuaagguacagauauuuccucccuuuuuauccauggaaagcccuuccuggcucuggcguguugugcgugugcugguccauuugcccacagcaccuuuucucugcucuccagcuaaagugccucccucccacccuucaugucucauguagacacauggcagcucccgaaagcugaauuaggccccuuccuguuuguucccauagcacccagcauuuacucuuagccccugucacacugugucauuagagucaguggacuugucugugucaccacccaaacuacgaguuuccaugaagacaagagacuaccuuuuauuuauuauaucucccaccagcaccuagucucaugauauuuaaccauugcccaggaaaguucacugaaugaauuaaugggaggauggauggauggauggauggauggauggauggauggauggaugcauggauggauugauggauugugcauuagggcugccuuccaggaaggcaaacagcagaugcucagggaccucuaagccaaucugcaucuaggggauagcugccccuaaaagcccugccuggaaaccuaauguuuuggagauuggcuuggccugcucugugggggcagucucaccaagaugaaggaagaagagauaauggggagcaaguacaaggggaaacgagaugaugucuugccccucuuuucuuuccuucagugccccccuccuucaggccuccacugaccaaaaaaaagauaauacaacaugcacuuuugcuuuccaaacacaccauuaaugaacuaaaauguugauauuuuccagaugugcuuucucuuuacucacacagugacuccucuuucuugcugguaagauucuagugacccaauguuguaagaggcagaaagauaaaacccaguucucccuucacacauucccccuuugaagucuagagaaacucucuccguuacaaaagaaagaaagaaaagaauauucaaugaaagaaacacaauaaggcauuccucugaaggagaaaucgaaaggaaaggaguaaaaacuuuuauuuaucagagcuggcaaaggcaacuucauacuguuuugcucaaaauuguucuuuucuucuuucaugucacuuacauagccacaaguuagaauacaaugagcuuccaucaagagaauuugcugaagaagccagagaaucgcucagucacccagacagggucugugcaguggucgugacugugaggcguaucagccacuuugcagaaaacauguucuuggacaguugagcuugguacauccucugccccgggcuuuuuaucauuagucaacagagcuuccauagcaggagucaucucuuaaguucaaugugucauguuucuuccagaauauuuccugaacaggaaaauccuacuccauuauccuuuccaacaggcaaccuucuaaagguaauuaggaaaaagaaaaaagacagaaaucugaaucuuucucaauaaggaucuccuuuaauucaacauuccuagucacugguagucuacuuugcugcuaagcugggucaguguagcaguuuacaacuggauuacuauuuaggcuuucaaaauacacaucaaaucacacuggagagcgcuuuaggauccaggauaacacccuacaaucagauuuucuguauuucuguaaggaaaccuaaaaugguguucaagguagaaaugccuuuauuaaauuccagaggaguguaacuaauguuacugggaagccccaggucccagagagaggaaguauuuaucccacagugccaugaucagucugguacaaaaacgugugagcaccagcuaggagcucugugcucuguccucagggccgagaccauggccugugucucuugaauccucaaugucuagcacuaugccaccuacauggcagauacuugguaaaugucuggugauguuaacuuuaaagagaauauaaacagaaauaauucuuccccuuaagggauucuuuauuggaggaaaccagauuuaggaaaaagaaauaccaaaagagaggugauacggagucauagaaagagcauggauuuuggaguuaaaccuuccagccugguaucccacauagucacugacaagcugugugacuuuuuagcaaguuacugaacaucugugagccucaaucucuucaucuacaaaacagcaguuggaaggauuaacugcagugaugguguagugcauccggcaaagagcaggcacucgauaaauagaggcuauuauuauuaucauucaaauaaagaucgaguuggugugcaguggaaucaacuuguagguguggcugaguacaaugggguagugagguguggagcggaccuucaaggagaaguggagucaagacgagggaagaagaaguuaguggcccaggccaagggaugauaccgaagugcuuuuauaaaaaagguuuuauugucagaguauccuagagaauuauacuuuggauacuugaagagggacagaucuucagguauaauaccugaaacaccaauauucuguagaaaaauucuaccuuaagaaacaauucccaauacaggagagccuaugagaaaccagacugcuggucacccuucuguguauccugcucauuuuucucaugugagaauggucugcaaacugaggucuaugucuauagacugggaauuuccaggguaauacaggauggcucugcgacuguauuccugauugagaauuggugcuaauaaauucagaauaaaagucaaugaaagugcugugugcuguuacagcaaggguaaguucuggaucuccaccagucugguauuuuuaugcaguagcagguuccagcauugcaauccuaacauuuccagcuuuauaccagauccuauuguuaaacaaagacacacaccccccagugcauguaaacuguucauuagcacuugugggcagggaaaauaguuuccuuuugcugcacagaagaaaacgucgacagauuuuuuuuguucuuuuuuuuaaugaauguauuuaucccuuuuguauuuauucuacacaaaccugaguuaucuguccaugacaguucucuguuuuucaaaacuaaaauggaagaaaaaguagaaaggguagaaaaugacugacugucagcauauuugaagguuucuuuggcuuccaggaaagaagggcaggacuugagauccugcaugugguuugaggacagaccgaggcauauguuuugauuugaggaucaaaacugaaccuaaaccuguaaacauucuguauuuuaguucuuaaaaauuagcuuugcuaaaaacacauaugcaacauuuuauucuugagaguuuccagggauuuaggaguauguguaccuaugaagcaacccuaagguacagauuauuagaacugcaucucucugucuauguaguaauuuuaaaaauaauaauuacucagcgaaaugucauacucacugccaaugcucaggcuucccuggguugguugggaaacacguguuugcuugcccuguagcucagccggcagauugcuacuuauuuaaauaaaucccucauuccuguaauccuagcacuuugggaggccaaggugggcagaucaucugaggucaggaguucgagaccagccuggccaacauagagaaaccccaucucuacuaaaaauacaaaaauugacgaguuaaugggugcagcacacgaacauggcacauguauacguauguaacaaaccugcacguugugcacauguacccuaaaacuuaaaguauaauaaaaauacaaaaauuagccgggcgugguaacaggcuccuguaaucccagcuacucgggaggcugaagcaggagaaucacuugaaccugggaggcggagguugcagucagcuaagaucauuccauuguacuccaaccugggcaacaagagugaaacuccgucuaauaaaaaauuaaauaaauaaaugacauaauaaauauauauucauugacuaccuacaaagugccacacacugagcuaagaggaagagauggaauugaauguaaauuuuccugcccuaaaggauauaauaguagauaagucaugacagcacagugcagugagucccauaauagagaaaggacuacuugccaggggaauucugcaaggugcaccucggcaaaggguucccacaggaagugacaagcagagucuugaagagcaaauaggacuuagcucaguaaaaaaaaaaaacagggaagaacauucuagguagagagaacacauggaaaggcucgugugagagaguguuugucgcagugcacacauuucauuaugaccagacgguagaagcuugagggaaaacagugagcuucuccagggacaauuccaggauccaaggagccaguucacuuugggucacacaaacacaugggaacuuacuacuucuuccugagaggagccaggagaaucucacacagucaugcguggguagaacaugugaugaauacaauaaauuagauccguuggcucauaauugauauauaaagcauguucucauuuuuugaagucuuuuuuuuuuuuuuuuuugagacagagucucgcucuguugcccaggcuggagugcaauggcgugaucucggcucacugcaaccuccacuucccagguucaagcaauucuccugguuccaccucccagguucaagcaauucuccugccucagccuccuaaguagcugagguuacaggcguguaccaccacaaccggcuaauuuuuguauuuuuaguagagaugggguuucaccauguuggccaggcuggucuugaacuccugagcucaaaugauccacccaccccagccucccaaaguguuggaauuacgggcgugagccaccaugcccggucugaagucuuuuuuuuuaagcuauugauacuaagaaggacagucagacuugaucccaagcugcuagaagcuguaucucacauaaaucacuuuuggagaaacauccucuuauuuaacauuuuagaaacguguacuugaauucauaacuguagagaauuacugccuucugaaaaugaauaagaacugaagcuuuuauuuaguguggcuguauuaguccguucccaugcugcugauaaagacauacccgagacugggaagaacaagagguuuaacuggaauuacaguuccacauggcuggggaggccucagaaucauggugggaggcaaaaggcacuucuuacacggcagcagcaagagaaagugagaaagaugaaaaaguggaaacccaucagaucucgugagacuuauucacuaccaugagaacaguaugggggaaaccgcccccaugauucaaauuaucucccacuggguccuucccacaacacauguaaauucugggagauauaauucaagaugagauuugggcgagaauacagccaaacuguaucauuccaccccuggccccugccaaaucucauguccucacguuucaaaacaaaucaugccuucccaacagucccacaaaguuuuaacucauuucagcauuaacccuaaagucugcaguccaaagucccaucugagacaaggcaagucccuuccgccuaugagccuguaaaaucaaaagcaagcuaguuacuuccuagauacaaugaggguuacagguauuggguaaauauagccuuuccaaaugggagaaauuggccaaaacagagggguuacaggccccaugcaaguucaaagucagcagggcagucaaauuuuaaagcuccacaauuaucuccuuugacuccaggucgcacaucccggucaugcugacgcaagagguggguucccauggucuugggcagcuccaccccuguggcuuugcaggguacagccucucucccugcugcuuucauggcugguguugagcaucuguggcuuuuccaggugaacggugcaaacugucaguggaucuacccuucuggggucuggaggacgguggcccucuucucacagcuccacuaggcagugccccaguagggacucugugugggggcuccgacaccacauuucccuuccacacugcccuagcagagguucuucaugcacaucccacccgugcagcaaaccucucccuggguauccaagaguucccauacauccucugaaauccaggcggagguucccaaaccucaauuauugauuucugugcacucacaggcucaacaacacaugaaagcugccaaggcuugagacuugcacccucugaagccacggccccagcuccacauuggccccuuucagccauggcuggaguggcugggaagcagggcaccaagucccuaggcugcacacagcauggggacccugggccuggcccacgaaaccauuuucuccugggccuccaggccagugauggaaagggcugccaggaaggcucugacaugcccugaagacauuuuccccauugucuuggggguuaacauuugggacggcaagagaaaauuagaaagaugcaaaaguggaaaccccugauaagaccaucagaucuugugagacuuauucacuaccaccagaacaguauaggggaaaccacccccauuauucaaauuaucucccaccaagucccucccacaacacaugggaauuaggggaguauaauucaaggugagauuuggguggggacacagccaaacccuaucaguggcauuacuuucccuaucauaugcaaucaagaaaauacuaccaaaaaauacuucuuggcaaaucauuguuuggaaacaccacucaggcaucuacuugagaacugacaaacuacagaaucaguugucacuaacaaaaagcagauuuucagggccuugugguggaacucauaacagaaaguggcagacacucuugacuuugcaaccuuucuaugccgauuuuguguauagaauugagcuggguuuuccuugccaauggaauccucuucuagguaaaugagucccaccugccaagaauguuagggaagcugaugagugacaacauuuuguaaauuaucacagugugccuugccuucaucuauggaaauuaauauaggaaauagcagauuagggacuucuaaaaugcaugaaaauuuuuaaauuaguuccaaaugauuucugaaacauccaaggcauuacagaaucauaagaauaguuaagaacauacaauucucaacuaaguaaauuguaccccuggguuuugugacaaguaaguuauuuuuccaaaaagauggcuuuucuuuccuauauuugauuucaguuacacuguuuucguucaaucuguuuccuuuguuccauaaugaaaugaucucuuguuuugaaacugaaaaauaaaauaugagcagauauguauacuaaugcaucauuuuccaaaucuuaguuguagagaaaauggacaaugucacagguggcauggaaacaucucgccaaaccuaugaugacaagcucacagcaguggaaagugaccugaaaaaauuagguaaucugugacaagacuaaaccaugaaauccccugacucuacauaaaugaccacagcuucuuagaaugauguugcuauaaacuccccauucacccggaaggacauucaauuuuuguguugcauguugagucuccccucaugauuuaauucaaaugcuuaaauuuuaaaguuaagggucaguuuuggaauuaaguccugccaagaaaacuauuaugugccaaauaauaucugaagaucaauccugacugaaaaaaaacacaaauacccuuuauuaaaaacugucacauaaauaggaauuuacugagcauuuuugaaauacuuuaaacuacauagaauuguagaaauuaaguuauaaagugaaagauccuagcauauucuauuccuugauuuuugcuuucauuaaaaaaaaauuugggaaauuuaaaagguuaguuucuucuugacagccugcccacugcccuaaaaucuaguaaauucccccucccucuuugagaaaaauguucagccaaguuugucauuccuaguucugagcuucuuuuccgauuccccaggacccaguuuuaauagauauguacauuuuacuaaugcagagcuguccgcuuauacugccaauuuugcaucuaaaauacagugcauaccgauuaaguguguucgggaucuuuggccuugccugaacacuucuccauaccaccaauauaagucacagauauuucuuauuccaggugaccaaacugggaagaaagcuaucagcaccaacucagaacucuccaccuucagaucagacauucuagaucuccgucagcaacuucgugagauuacagaaaaaaccagcaagaacaaggauacgcuggagaaguuacaggcgagcggggaugcucugguggacaggcagagucaauugaaagaaacuuuggagaauaacucuuuccucaucaccacuguaaacaaaacccuccaggcguauaauggcuaugucacgaaucugcagcaagauaccagcgugcuccagggcaaucugcagaaccaaauguauucucauaauguggucaucaugaaccucaacaaccugaaccugacccaggugcagcagaggaaccucaucacgaaucugcagcggucuguggaugacacaagccaggcuauccagcgaaucaagaacgacuuucaaaaucugcagcagguuuuucuucaagccaagaaggacacggauuggcugaaggagaaagugcagagcuugcagacgcuggcugccaacaacucugcguuggccaaagccaacaacgacacccuggaggauaugaacagccagcucaacucauucacaggucagauggagaacaucaccacuaucucucaagccaacgagcagaaccugaaagaccugcaggacuuacacaaagaugcagagaauagaacagccaucaaguucaaccaacuggaggaacgcuuccagcucuuugagacggauauugugaacaucauuagcaauaucaguuacacagcccaccaccugcggacgcugaccagcaaucuaaaugaagucaggaccacuugcacagauacccuuaccaaacacacagaugaucugaccuccuugaauaauacccuggccaacauccguuuggauucuguuucucucaggaugcaacaagauuugaugaggucgagguuagacacugaaguagccaacuuaucagugauuauggaagaaaugaagcuaguagacuccaagcauggucagcucaucaagaauuuuacaauacuacaagguaagucaaaauucugaauuuguauuuguauuaguuguuuauugcugcauaacaaguuacucuaaaacuuggcaauuuaaaacaauaaauauucaucaucucauaguuuuuguggaccaggaauucaagagcagcuuagcuagaugguccugacucacuguuuuucaugagguugugucaagaucucagccagagcugcagucaucugaaggcuugacuguggcuggagggucugcuacuuaaguggccuguucacauagcucuuggcaggaggccucaguuccuugcugugugaaauugcuugaguguccucacaauguggcagcuggcugcugccagaacaaggaauucaagagagagaacaagaaggaagauaccaugacauacuagccucagaagccacacaccaucacauccacuucauucuguuucuuagaaauaagucacuaaguccagcccacacucaaugcaaguggaauuaaguuccacaucuugaaaagaaguguaacuaagaaucuguggacaguacuuaaagggacuccauuaauuauuuguugagugaaagguugguuaauuugaauuuucuugguccuugagcuauuucaaugcaauauaaaucaagcuccucugaaagcaagaucaagucuuuugggucacaaagcuaccauuaagggaguuacaugucaugaguagaugaaugguuggccaucacaguaacacagaggucacaguaaggucacagaggaaggaaacgaugugucuugcuuauaaaaucugaguuuugguaggugugcuggcucaugccuguaaucuuaacacuuucggaggcugaggugggaggaucgcuugagaccaggaguuugagaccagccugggcaacauagcaauaucccaucuccuaaauaaacaaauaaaugaaugaauacauacguauaaucugaauuuuacuguuauccagaucauccauauaaauuaaaaguccuugacucagacuaaguccacaguugaagaauuguagcaucauauauuaacaguauuuuccagucacaaacuauuuucacagguuuuaaguugaaaguacugguggaagaugcugugcucagcagucugggguauacaaaugaaaccaacgguccucacccuuagggaguuuaacauaaagagaauuucagggcaucagaagaugggcuguaagcaaacauucaaggggaagggauuacacaagggccugagucacuaggggccaccuugggguaugucccccacacuggucuaauaaucaaggguaaagagugguaguuaauaagccccugugaggcugaaggcagauccggauagcagauggcaggacucuguucaauagcuuugucagugacuagcauggaugaccugcuaaagcaaugcuugugugacuugaaacuguauaugccagccaguggcugauagacucauaauccacaaugaucuagagaggccaggauaguaucaagaugucaaucaaaugaaguagauaggaauacauguaaaauccugcucauaaauggaugagacaaaacagauaaauguugaugggaaggcauggcuggaaggaagugugcaugaagcauggggauuuuaguugacuggaagcagugaaauaugucuuccagggaagggaauguguuccuugacuguggacuguguuaagaaaaagggaaguaacaucugacucuguucaguaugccaagaccaccucuggaagauaauguuuacuuugaguagccccuuucaaaagagacauucccagaccagcaugcucagaaaagcaacaucagaaugauaggggcuagaaaccacguacugugaggaaggguugaggaccugggagcuuucaccccuaggagagccuguucaguggagaacaagacagccaucugcacuuauuuaaaguugcucugucugaggaaugccacugggugaaacaagacuaguggguguucacuaagggaagaucaauuuugguuuuacagaauguuccucauaaaauggguauuagcugaaaauauaauggcuccccuacucaaucaggaugccccagcucuggaggggcuggacaguugcaggucagggauaugguaggugugagucuuacucugaaaaagggguagcccuucaaaugauuuaaaaaaaaauucuuagacaaucuuaucaugguauucuggauauuuucuaguuauuaauuuuauaguuuuauuauuucauuaauuuaauuguuaccuugucuucaguuauuuaguuuauagacagcguggcuuaucagccaaguaaggacaugaaaagcuaguauuugaaggugagacccugaguguuuaaguuaauguuucuauuguuaggauucuuuuaucagcuaguauugaaagugaauguacugagcacuuuucaccaacgucccaaugaauccugacagcagcucuaugaagcagcuacuuacaaugucaucgccaguuuauagacgaggaaauuaaggcuuagaagguuugaguaacuugcugagguuuacacaaguaaaaaguagcucaguggaauccgagcccaggccgucuggugccaaaccugaugccauuaacuccaaggauagucaccgaaagugugugccccucccuacgguacccggucaccccagagagagccuagaaggucagggaguugggauuuuauucuaagcgugagggggagguuuuaagcaagguguugagaugaucugcuuuauauuuucacaaggucacucugggggcugcgaggagaauagagagcagggaggggucaccgagagcacggaccagcuguuggugacuuggccuagaaugcuggcaguggagaagggagaaguggguacccucauucaggaggagaguuggagauagaaucaagggcaucccuuuccuugcccugacaacagggaccccagcuuuaggaggucccggccggccucccccaccugagccuugcugaggugaggaguccucggccucaaggugcugugaguauucagagcccacaccaaccccugcuuguccauguuugugcccaggacccuggaauucccuacccaaugugcccagaagcaaaggggcagccaagaggcacuuguguguuguagggauugggggugauguagacagaaauugaacacaugguaggggguuggugugagugucuggacgagacuggcaggcaggaccugcugauggauuggcuguggggagugagugaaagagaggaacaggauguuuccuaagucucuagcaugagcagugagguggauggugauacagacuggggagcugcagaaaaagaggcccauguagacacguuaacaggaugaugucuauuauaauagaaugagguuuccgacucauggaaaagcauaugugauaaagaaaaucucaauucugaaaucaggcuccaagguguuucagagacacuaucacauuuaucacuggucuuguuguucacugcacuuucugugaguugaucugagaagcuucccaagccaaccaagcugcucccuuucuauucauucuauuccacugccuccagaccagcaaugcccagcagguauucuaagggaacgagagacugaggggaagaaggaacuccauuucugaaugcaaguguuuucuuccacaccuuuucucucuagcaccuuucccuuucuguacaugcagaucucaucccagaggaugaagggcagauggauaaagcaggauggauuaacguuggcuuauguggggcuggcaucugcaagauucaaaauaaucugaugcuuuccggaaaauuccuguugacucgcacuugaugaaccccagugcucacuguccaguucagccauauagacauuugccgcauuaggaauugggagcugaagcugacugacugugccgaaggcagaugauaguguagagauagauguucacaguaucucuacauccaucaaccaagaagccuuguuaagaaaaccuuauuuuuugggaguuugcaaccagccugaccaacauggagaaaccccaucucuacuuaaaaauauaaaauuaaccgggcgugguggcacaugcccguaaucccagcuacuugggaggcugaggcaggggaaucacuugaaccugggaguuggagguuguggugagcugagaucucaccauugcacucuagccugggcaacaagagugaaacuccgucucaagaaaaaaaagaaaaaagaaaaccuuauuuuuugauaaaaaucauauaaagauuuuuauucuaauuauguacacagaagacuucucacacaugcuucuagguacaaagaucacuccaccuccugggcuguuccucugcaagcuaaggaaagcaucaguugcauccuuccuguacaaucagacaucuucccucucugcucuuccgagagucaucagauuuaaugagugagaacaagagcucuggaaucagacagagcuggauucauguaccaaguuccucauccucucagugccucuguuuccucaucuguguguaccuuuuagaguuaugaggauccaaagauguaauauaaagaaaguacuuaaugcagugucuagaguggggucagcauaacacccaaauguaaauaaggucacuuccuucaaagcuuucccuucugcugcagcuguagccaguacauuacaguggaaaacaaaacagcuucauaugcacaaagaauaaaaucacacaggugggguuaaggaugauuugagucuaaaagugcuuacugcuggauuucuagugcccagccuuagagaugaaucagaccccaggaugcugacaucuagcuagcuuucacucauuuucucaguccacauuucuggggugucuaugcuaugccaaucacgcugcuaagcacuuggauaaauuaucagcuuucauuguuacaacucuuuaagggaggaguuauugacauuccccauuugcgggggagggaacugagacgcagagagccugaguaacuuacccaaggccaaacaacuaguaaauggcagacagugccaaacucaggucugucuaguugcaaauucaugcuuccaccaugaauagaugacauguuuggggagguggaaaugacagagaguuuacugacagcagagcaauugguuaaaguuucaauagggauugacauuucagcugaaacuugaaaggugcacaugaagguugacgggacaggggacagugcaaugugggucaggcaggggccucaguuccucccauugccaaccacucccucaugcuacacuuccccaaacaagacggcaugacuggagauccuggagagcauccauuaacaggcucagaagcagaccauggacaauuggcaagaaacagugguuaaauacacccuccucuguggacaaggugcuuccaaggcuuuccaaaagcccaacuguauuucuuuuuaaucuguacauuccuuuucaccucagugaagcgcaaugacuuuuuccuaugguaggcauuuaauaaauauuugauuaagugcauucaaaguagauuuuuaaaugagaagaaaaacguaucagauuguaucacuguuuuuccucuaccuugucuaucuuccaaucuuaccaccagugggucuuaacauugagucucuaagauuuuggauggcaguaagaauuaaagugguuucucuuccuuuuguuaagcaccgggaguuuuguuggaaaacacauuugaaacuucucuuggguaggaaacugggcugggcacuucucaggccuacaguuugguuugccaaagcacaaacagcacagugauuuaaagucuuccauccucuuugaacugcuuauuuagaaaauucagguuuucaaggcucccagaaccgugggccuggggaccgugggguagaggugucacugacagcacaaaccccgggcugcuuggagcucugguauuguucauauucaggcaucucuggagcuugugacagcuuuaccagccgcguggguauccuggcauuucagaaacccgagccagugagccacccguacuuggccuugacauugaguuaaaauuucagucaguuugaaagcaaaccucaaauguccuuccacguaggacaucacauguguuuccacaugcggcguugcuguuuucucaacucugaauucaaguuguugcugcacaagcucauaaacacucuguucuuuuuguuuuuuuuuuuuuuuuugcuuucaggcacuaaggguagcuucuauuuuauuucauuauuucauuuuauuuucaccuugacagcugcccaauaaaagauucaagugcaaccucaaagccugagaucauccagaugcuaaucagcagugccagcaucccggguccuagaggaaaaccaacccuggcauuaauaaucuacuuuuuuaugaggagccaguauugacuuuuuaaauggcuuuagcucuucuucucaaugauuuuuuuaaaggaaaaaaaauccaggaaauuucuagccugucuuaaugagccaaaguagauuaugugaaucuccugaucuauaagacacauagaauauguuuugaccuaacccagcaucugagggcagagagugccagcuccuuugugguuuuuggaaggcuggggcagcuguaauggaagacaccaaucacagugggcuugccaguuuagccacagccaggaauauuaagccuuaucugauuaagagaaagacagguaaccuauuuaggauagauguaguacuucggauggggaaauuugcugggaagucaaucacaaguagaacuggagaucuuuaucaacggcaaaaacgugcauuuccccccgauauuuacucccuuccuucacaagaucuggagauuagcaccugcugaaaucuugugcugucugugggauccacguuugaggucauucuucacguaagccacaacuuacacauugacuggguggggagauucaauagccacuuccaguccagaggaaaauagcugaacaccauaaacuacccuaccccagaaagaaauaggaugaaugaaaagcugucaccccaggugagggaggccuuggauucaugucaggagaggaagggagaguuguaucuuuggaacucugucacaagcuagaagaagguguucuggaagaaauacagcuccccccaccagcagucugucugagcagacacaagccugugaucagucccucuuucauggucacagguaaacucauuucccauaacuugcaaggauagcaccaaccccagaugugagugauggagaaacacaaauuaucagcaaaaaaaaaaaaaaaaaaaauuaagacaauaaggcuaaagauuauuucuuaaaacacuugaauuucccaauaugccaucuucauuauuuggauuuccuaaaguucaacacagaacauaaguaaaacagaaauaguugagaaaaaaguuuauuuuaauuuugcaguuacuccacauacacuagaauuuuuuguuuuguuuuggccuaaauugucaguauuuuuucccuagaacuauccauaaugcuacguccauuguggcggaacauacgugacaccuucaccacuauucaucucugggaugcuauuucccaacuacacagaggcacuaaguuacuuuuuuaaaggagauagaucuggcagcaaaaagucuaccuucccgaucuuuacuaaauggcauaggcuauuuaggugagccagaccagguuaggcagaaaaaaaaguccaacuguggauguggagacccacuggauuaauucaugagggucaguagcaaggaaagauggaucuccuuaugauuauuucguaguggcagucacagcccaccugauacagagauuauaagaugcggggcaccaggcaggucacccuuccccaaaaaccugucccuacugaucucaccuggggcacaaauugugagcguuagagugcuggacuuuuuaaccaugaugcgcauguauuugauaaacacuugcuuaauagugacugugagccagacccuacaaggggcuagacauggagaagggucuugaguagaacaaacaaggacuaaaagauuagagaagaagagaaaacuuccaucugaaguggccugggaggaugccaggaauuuugcagaaggacaugggcagaggaaauugucggagaagagauguguggaaaauacagaggaggauggaauaaacacaggcgagacuagguugggaggagccuucaugccagacugaucagguggggcugcauauucuugagcaaguggagaucagagcugggcuuaaggaagacaaaagucagaguggaaugaauggagaggaaucacagguaggaagaucaauuaagaaguuacugugaacaccuuccaaaaaagacagagagaggugggaagaagagagcccacacuagggucaugaccagggucagggcgaggaaaagaggguuguggcaauguggugggagaagggaugauggaaggagaacacgcacagcaaagagacaagaaguucagcuguagacacgcagguuagaggugcuggcggaaccugagaaaauggacccuucacuagcgggugcaaauaaggacccagagcccaggguugcugaagacaaggaggagucaacaggagcugugggcagaggucagugacaugggucuagguagaagugaguucaucccuaagucuucuaaagucucccauuuauggagcagauaacacuagaaagaaugcauuuaggccaguccuugccauuagcguaaacucucuuuaccacuggaagaggguccugcuuauaaaucugugagcaagauauggguagccuuacguaagcaaauuaaguccagagccuaagcuucugcuaagagagaacacagacggauuggcuugacugggagccauggauauuaggguacagaagacauccaucaagaccuggguugggaaggagacagggagaucccccuacagagguaggaagguccuguccucagaccaaugggagagggaggccaaggagcaggagggauaaaggaacuuaggguagaucugccauccauccuccauugcuccagcacuucuauccuucuaacuuuagaggcuuucugcuucuguagaaaaaguaaggccaggcacaguggcucacaccuguaaucccagcacuuggagaguccgaugggggaggaucgcuugaagccaggaauucgaggucagccuuggcaacacagugagagcccuaucucuacaaaaacauuaaaaauuaaaaaaaaaaaaagcaggcaauguggcacaagccucuagucccagcuacaugggaggaagcugagguuggaggauugcuucagcccaagagugcaaaguugcagugagcuaugaucaugccacucuccuccagccugggugacagagugagacugucucuaaaaaaaaagagugagacucugucucuaaaaaaagagagagagagauuaaguguggccuuuuacuuauucaugcagaauugugagauuucagaaacucuaagauucauucauuucaacaucagaagaccugaguucaugccccagcuccacuacuagauugugacugaccaugucuuacucuccuugguaucuguuccuaguagcuaaguauccucgaacaaauaguuuggcaucucuggcccuacauguccucauuuaugcaaugagaauucuaccgcacaggcaaggucagguggcauaauguaugugaaaguacccugaaaauugucauucacuauacaguuccugguaggagauuauuugugugaaauuuccuguuaccccugagaaauuaaagaaagaaaaacaauccuguguuacaugggccucuuugugggauaauggggaugagcaguauucgcuuuucuucccaauuagaugguccacauaccuuuuuucucuagccuaccuuccuuauguguauuauuagacuuacaaacccacccagagaguuuggacaccuguccacaaugggcagcaaagucccaccaggcuuucccacagagaccucccgucccucugagcuggcccaugggugagugaggcccagcccuaaggacagcagcacccccacagcuuugguggacagcacaggcaugccagcugggguacaacagagaggaagcuuacagggaaguuauaggcuugguuauggggagagaauuaauacaucaaucuccuucaguucuuuaucccacaauaccuuaacacggugcuugucauauaagccuuuaauaaauauuuaccaaauuaaggacaagaggaaauaaguaagaggaaauccugauccuggucuacacaacuuuccugcugaugacaacacaggcccaggugacuaagagaacccaguuuaaucaugugagucacugugaagaauaagccccuggcugucagugucaccaugaaggacaucaguggggcacuaaaacguugugcacuguuacaauacauucuaaaagcuugaagaagaagggugagcuuacugaagaacacacaguauauuggcuugcuugggcugccauauacacaguacacaguacacggacugggaggcuuaaacaacagacauuucuuuccuuacgguucuggaggccgcaaguccaagaucaaggugucagcaguguuguuuccuccgaggccucccuccuugguuugcaggaguccaucuucucccugugcccucaagcgaucuuuccucuaugugucugugaccuaauccccucuucuuuaaguacaccaguccuauuggauuagggucacucaugucaccucguuuuaacucgaugaccucuguaaaggccgugucucuuaauaagucccauccugaggugcuggggguuaggacuucagcauaagaauuuggaggaggacauaauuuagcccauaacagucuacaguaguaugauaaacagauggucuuucccugcuguauauacuuuguaugcuagguuuuuuuaauuuggagauuuuauaagaagaaaaauuauucauaacuaucauucacaguggauuucauguugacaccuuuuucuuuuaugcuuuagguccaccgggccccagggguccaagaggugacagaggaucccagggacccccuggcccaacuggcaacaagggacagaaaggagagaagggggagccuggaccaccuggcccugcgggugagagaggcccaauuggaccagcugguccccccggagagcguggcggcaaaggaucuaaaggcucccagggccccaaaggcucccgugguuccccugggaagcccggcccucagggcuccaguggggacccaggccccccgggcccaccaggcaaagagggacuccccggcccucagggcccuccuggcuuccagggacuucagggcaccguuggggagccuggggugccuggaccucggggacugccaggcuugccugggguaccaggcaugccaggccccaagggcccccccggcccuccuggcccaucaggagcgguggugccccuggcccugcagaaugagccaaccccagcaccggaggacaaugguaaguccaagcccucccuccagccagggggacagggcagugcaugugcuugagacugagccaacccccaguguguggccccacccauguuauuuuuguuuuuguuuuuguuuugagacagggucucacucuguugcccaggcuggagugcaguggcgugaucucggcucacugcaaccuccacaucccggguucaagugauucuccugccuuagccucccagguagcugggacuacaagcgugugcccccacagccagcuaauuuuuguauuuuuaguagagaggggguuucaccguguuggccaggcuggucucaaacuccuggccucaagugauccaccuaccuuagucucccaaagugcugggauuacaggugugagccaccacgucuugucccccgcugcauauuauuuaacagcaaaggcaucauaggggcuggcacaggagcccugcugccagaacaggccuccauaccaggcauguguuucucucuaaacgccauuggguucucuagugcucauuuguuuuauguauuauguguguauguaugggacagggucucacucugucacccaggcuggaaugacgaagugaaguagugcaaacauagcucacugcagcuuugaccuccugggcuuaggugaucuucccacucagacuccugcguagcugggaccacagggguaugccaccacaccuggcuaauuuuuuauuuuccuuuuuguagagacagggucuugcuauguugcccaggcuggucuugaacuccuggccucaagcaacccuccugccucagucuugcaaagugcugggauuccaggugggagccacugcaccuggcucuugcacuuguuuauuuauaggagccagcccucagaagacaaacacaaugcaaaacauuuccuucagggaagccugcuggccgcccugagcgcucuucccucguuuuacauccucacucuggagauagaugggcucccucgguuagcuccaucaacauguggauggaacccucugcuauugaugacuacauuuaauuucuuuuugagaaagguguuagauguuacggugccuucuagucuuuugauaauuaaaccuuuggcaaaacucgaauguuugguuagcaaccaagccuauuuuucucuccuuugacccaaccgcuauucuacuugauuuuggucggugaggcccggguuauuuuuguugauccgugagcccaguuuuggugcuggguucucacauccaaguguuccuggguuccguaugauuccagacugacgcugaacaucugugccugcccugcuucuuguuguugcuucuguuauuucugucauugugaagacggauccagacacagaagaacaaagacccagucaaagaucuuuuccagauuaugugguuuuggcuugugcucugcaguccacuuugggucaugcuugcugcgagcacguccgugaacgucagcugugggccucgugcagggacgcucaggcugcucccagcgggaccacaguuuuggccucugaaacacagcugaagaaaggcagagugcuuucugugaucuuuuaaucaauguuuuccacuuuugcauuccuaggcugcccgccucacuggaagaacuucacagacaaaugcuacuauuuuucaguugagaaagaaauuuuugaggaugcaaagcuuuucugugaagacaagucuucacaucuuguuuucauaaacacuagagaggaacagguaugccugccacauacuugguuggggaaaacuauaauuuaaggauaguuuacaucuggaaauugcaggcuuguuggggauucagagauaucacgaauuccuagucacguaaacaugggaggcaacauuacagagauuuggguuucauccaguggcuagaagcauucguggcauuggaauuguaucuucaugauucuuccuggaagauauugccuaucaagccuggagauguguggcuccuucugguggcuguugaaauaauuauaaugcagagaagcuugagggcugccaccaggcaccuguggggacagagagaggcaugaacacuguagggauggaguggggugcaagggaccacgcauggcuccagaggagucaggaagagcgaagaaggcugaggaggcagagcccacgcaugcuaaugcuaguguccacucauuagacccucuauaugccaggcaccgugagaggcauuugcucccuugaaccucacagcaacccuagaacauagguauuauuauuacccucauuugacggcuaggaaaacugaggcccggcaagguuuaugcagacugagaccaaaacugcagcccaucuagcaacaaugcagcgcuuucuuugauaccacaccaauuccaguggccuccucccuucucccuaaguuaucuccagcagacacaauccuguaaacagauguuuccuguaguaacugacuggaaugagcacacggcagacagugaccaagcaccugggcuuuagaauacacagaccagggcccaagcccagcucagcuacuucucauguuuguucaguggguuguuauaaaagcuuggagacacacugcgugcaacacacugcacguggggcccagcccagaggaagugcccaagaauaucaugacuauuccuaugauuaggacaugggagaaaugggugggugguaggaggaagugggaccaauggacauucacuggguugucugagugauuuagaggaagagccucacuuuaacauccguuguaaacuuguaagaggaaaaaagucaaagccccccaaacagcacaaaacaaagcaaguagcaagaaaaaagcagaaagcaaaagcaggcuacacauucugacaaccauccucuuuuaaauuguccuuuuuucuaaauguuaaauaaaagaaaaaggccugagacaucuguucugaaaaauagucacgcaccaccccugcuuuguuuuucagcaauggauaaaaaaacagaugguagggagagagagccacuggaucggccucacagacucagagcgugaaaaugaauggaaguggcuggaugggacaucuccagacuacaaguaaguacucagaagcuuccagauugguggucaggcucucacuguucuguugucacuucuugcccgacucccaacaguuucuuccuuaaugaccucguguccuagacgcuccucccaaaccggggcuccugguaccaguugcauauuuccccuggggaaaucgugguugacaguugauacgcugucaaauaaggcuuuccuuucuucuuuucauggagugaauuuuuuuucauuucuaagaaaaaaaucaugaaacucauaaaaccacacagcauaauacuucuggccaagucauuuucuuuaaaugcuaugggaaaagaugaugaagcccaggcaaccucaggcauguucagcguucgccccaggcguguuuccaaggacuggggagcucccuucaggaucacacugugggugccccugaccccuaguugggcuucuaggcagagugugauuagaaacuacaaaugaguaauuuuccuggcugggcacaguggcucacgccuguaaucccggcacuuugggaggcugaggugugcggaucacuugaagucuggaguucgagaccagccuggccaacauggugaaaccucgucucuacuaaaaaaacaaaaaaaacaaaaauuagccggauaugguggcgcaugcgggugaugccagcuacucgggaggcugaggcagaagaauugcuuaaacccaggaggcggagguuguagcaagccgagauggcgccacugcacuccagccugggccacagagcaagacucuaucucaaaaaagaaaaaaaaaaaaaaaaacuacaaaugugugauuuuccuacucauaguaaguuaaaauacacuauaaacaaaguugcauuugcgggauaaccauccccuagagguuugaagauuccccauaaguuccaugugaccuaaguucuaugaaaggagcaacaaagaauagaaucacuuugagguaccuucuuggauaaccuagaagucuccagggccucauccuacccuaggggguguuagcuccuucccuaauucuacccaaagaucuaacaaugacuguauugcaucaguuugauuaucacaucuccauacucuggcuuugccucugacgggugugaaaauugcaaggaacuguaacaaaugaagcagaauuuauaaaaaaaauaaaauuaaaaaaaaaaaaaacccucugaguaaccuuuaguuugcuggggacggagaggccagacccugcagggcuccaccaggcacaggagcaucaccgcauuggaagcaccuucugagagcacuaggcaaaguccacgguguggccucuggggcugucccaggagaggagaaaacaaggguguuucaggccuaagagagucucaugggcauggaggccuagcccuguaucagcugagcagcagggaggagggucagaggugauggagaagccagaucgaguuuuuuaaaugucccuaugugcgugugcaugugcauuuggauaaacaggcucuuuuguacuuucaaauucuccaugugaguaggaucagaggauaaaggaggaaaccagaauaaggccaucucucuuuuguuuuuauuuguuuguuuuuaagggacaaggucucacucuguugcccaggcugaagggcaguggcacgaucauggcucacugcagccucuuaucuccccagcucaagcgauccucccaccucagacucccaagucccuggaaucacaggugcacaucaccacacccggcuaauuuuuaaaguuuuuggauagacgugguccacuauguugcucugguuggucucaaacuccuagccucaagugauccucccaccuuggccucgcaaagcacugggaucagagguaugagccaccgcaccuagccaggccagcucuuuauaaaaaauaaacauguggcgaaauauugauuuggaacauuagaagauuuuaggucugcucugaaggugagccucagacugcccuuaagggcaaguggauaucugcugcaggccugucagagacucgucggcuccucugcgccuguccuggggagaggaagggguacccccuggcauaaucuggcacuugagacuuugccugaugagccaaggaaagugcccaacacagcagggacacacuuuaggagacucaaaacaguugcaggaaucaccaucuaaaacaguagcuguagaagguuggagcuggggaugggaugggagacagagacuguuuuuuaaaaaagacaaaauucugcuuuuuugacagccaagagcgccggggucuuuuuuuuaagagaguugggagaagcugaaacaaaaaaucaucuucuccacauuuuucacugccguaaaugcacaaaggucuggguuagacucacuaagaaauucaaucuuaagccuuuccccaagaaaaaaacuggauuggcccauauggaauggauugagcuggaacauuacugucuaugccagcucucccaaugugaaauuuuucuccucuucccugggguccagcaagaauuacaugaucuggauggagcgcacccgcuugguacccaggaccugagaagaaugacgucaccagacaccuuacugggcacccaguccccaaccacagccauuuuggagccucccaaauccucagcuucugcaccccagccaccacacaggcugugcuucucguuuuccacccaaaggaauacauaggaacauaaaaauccccaggaucaaauuuuaaaagcaagaauaaguuagacaggcguguuaugaggucucaauaaccaaaggcuaauuuaauuugacauguaauaauaaacauugcacaaacuagaaagaaagccagugcagccgagggagggagugcaucagcuagaugcuagagggaucuagcaucagcaagaucgggguucugggccuugacccagcaacacucaaagcugcaaggccucgugugaguugcucaacucugcaaaaccuccauguccccauuuauaagaugaauuuuccaaaauaccuaugucaguauugugaaaauaaagugugauagcuguaugcaaagcauuuagucgagggcuuggcacauaggaagugcucaagaaauaguaccugcugguauugguauauuauugcuauuaucaucauaauuauuaucauauuaguuagcaguugcagauaaauacuacauagaauguauauauuuuacaguauccugauugggauguccacacagugucucacucaagucccacaacaggugugugaagaagacaagaaaaacguucucugcauggccugggaauggggacugggcuucaggcucucaagggucuccuaccagcauaaaccgccccaaauaugucuccuccuagucagacucacuuuuacucuccuugucuuugcaucuguggccuccaaggauuggcccauccaccucccuuuccccugccgccagcagugauuucuggaacagaucaucgcaggagacgauuaugaacaauuauucaccaacaaauuggaugaccuagaagaauggauaaauuccuagaaaccuacagccuaccaagacuggauccagaagaaauagaaagcguaggcugaggugggaguaucauuugaggccaggaguucaagaccagccugagcaauagagcaagaccccaucucuuaaaaaaacgaggaaaaaaaaaggaagaaauagccuggccagccuaauaacaaagaaggagauugaaguagcaaucagaaaccucccagaaagauaagcccaggaccagauggcuucacagccaaauucuaccaaacauucaaagaagaguuagcaccaguucuucuuaaacucuuccaaaaaauagaagccgaugggccuggcaccgucccaucccuugcccaggcuaggaagaauuaaguaccacugcuuuccccuuauucuuuucucccaacacgcgugaaauccuuuuaaaacaguuugcagguuuugugguuacuguuaaagagcaaauagacgagggauaaaaggcucucuccucugcgucucggccucaccucauuuuucaugcugagaccugguugagaaagagagugcuggaacagacagaaggcaauagugacauggaacagaagccaaaggcuuaggggacacacagauugagcucaggcuuauuucccaugaaacacucaaccugacuugcugaaucuuauggcucuuucugcaccgcagcaggacaggaccagcugaggggaaaggguggcgugagaugccaccugcaauggcccggacaguuccaaggauggguccccagaugcuuuggauccacacaccaauacaauuucaaaagaaagacuggcagggccaacacagaucagcaggauuuuauuugccaauuaaggacaaggcuuuuagaaaguaccaaucagcaaaucucagcauuaaaaaaaauaauaauaaaccuauaauuauuuccaagaagagauggcuggccaucuuacauucacacacacacacauuguccuuauucuucucauuucaccagguccugugaaaacuucauucuuggccaacacccagccccugacuggagauuagaguccauuggcccacagucucaugauaacauuugauggauuaucuugaagugucugccaugagccagccucugugcuggccugcaggaucuuuucuggagugugggggcagcaguaugagugagcagucgucauugggaucauguuuuaaaaaggcagguuuccagggccaugucacagucaauagaacauagcaacccuaacuguggauacagcaaagaacaggccuucaaaggagauuucaacauuccccucucaauuacugauggaaaaauugauagggauauaguagacacaaucaacugacuugacuuaauugauauuugugggauguuuuacccaacaucugcaaauacauauucuuuucaggugcaugugguacauucaccaagaugaacuauauucugggccauaaaauacgucucaauaaauuuaaaaaaaagccaaaacuaucaggccaggcaugguggcucacgccuguaaucccaacacuuuggggggccaaggcagguggaucaccugaggccaagaguucgagaccauccaggccgacauggugaaaccccgucucuacuaaaaguaaaagacauuagccaggugugguggcggaugccuguaaucccagcuacucgggaggcugaggcaggagaauugcuuggacccgggagguggagguugcagugagcugacaucgcaccacagcacuccagccugggugacagagcgagacuccaucucaaaaaaaacaaaaacaaaaaggaacuagaacuauauagaguauguuuucugaccaaaauaauuaaauuagacauagauagaaaaaugucuguaaaaucccaauuauuuuaaaccacacauuucuaaauaacccaugggucaaagagaaaaaucacaaaggaaaucugaaaauguuucaaagaagaugaaaacauaucaagaucugugggaugcagcuaaaauaguauuuagaaagggacacuuauaguuuuaaauuacauauauuagaaaccuuguuuaaagguugaaaaucaaugaucuaagcuuccacuuuaccaggguagaaaaagaagaacaaauuaaucccuaaguaagucaaaggaaggaaagcagugaaauagaaagaccaacaguagaaaggaucuauaaaaccaggaacaugucaaaguugaucuuuuccuuugggaggcgaaggcgggaggauugcuugagccuaggaguucgagaccggccugagcaacauagcaagaccccaucucuacaaaaaacuuaaaaauuagcugggugugcuggugugcaucuguggucccagguauucaggaagcugaggugagaggaucacuugagcuugggagguugaggcugcagugagcugugaugacaccucugcauuccagccuuggcuuuuuuucuuuuuucuuuuuuccgagacagaacaagacucugucucaaaaaaaaaaaaaaaaaaaaaaaaaaaaaggcugauccuuuuacucuugguguaaugaguauagguguaagcaugugauugggagacugucauuguuaauggaggcugccugcuagaccugcgggagccggacacauacgggaccuggguacuugcccaccugcucagagcagaaugcuaagggagguuguuaaggccucucuugccuacccugcuugcaguugcccaccuuagaucaccagagaugugacagucuuccugagaaucuccccaaacgcacuagaagcucuucuguuccucuguccacgggaccucauuuggugggagugugcugucacacuacgagucacagcuuucaucuuggcaucacaaagauaaaauguggugccuuucugucuaugcagacugcuccguauaauaucauacauuguguuuucaguuuuuuguguuuuauuuuuuauuuuuuaagauggucucauucuguuguccaggcuggagugcaguggcacaaucacagcucacugcagccucaaccuccgaggcucaagugauccuccuacuuuagucuccugaguagcugggacuucuggcaucagcuaccauaccuggcuaauuuauuuuaaauuuuuuauagagaugguggucucacuguguugcccaggcaggucuugaacuccuggccucgagugauccuccugccuuagccuccugaagugcugggauuacagugugagccacugcgcuaggcugaauuagaagauguuaaagguucuguuccaggcucuuucauucuaugguccuauauucuaaauccuauuuuuuucuuuugagauggagacucgcuuugucacccaggauggaguacaguggcaugaucuugggucacuacaaccuucaccuccuggcuucaagcgauucucgugccucagacuccugaguagcugggacuccgggcaccugccaccaggcccggcuaauuuuuguauuuuuaguagagaugggguuucgccauguuggccagacuggucuugaacuccugaccucaggugauccacccaccucggccucccaaagugcugggauuacaggugugagccaccaugcccagccucuaaauccuauucuaaguaucuuauauuuagauauauauauuugauguguguguguguguuuccagcuuacuggagcaaucaguccaagcauuuccaagauuccugguguuuucagagugugauguccaaguauauguaugugcugcuaccgcucacuucugugacauguguaugauaauguagaauucagggcuuugagccccagacuucagccauucaucuugccagaaucuaccugugaaugagguuaagcacuauuuaagcugacauucuucuccaaaauauauacauuuugcuuauuugacacguuacguucuauauuauuauaaacaugcagacugagggguuuugccacaaaucacuccaugugauuuuagcuuugccaaagagaugcuuugagacucuggguggucagcccacagaauaaauugucccuucagucuggcuucaggcuacccacuuuccacccauucuggccuacugcagucaccuccgcuuauggccacagaacugcauucugcuuuuaguccuaaggaaagccuugaguacuguaugugaagaauuccagugaccuggaaaaacaaauggagaaaggcgauaaagauuaucuccuuucuuaucacucaguuauuucucugccugguugauacauccuuuuuauuuauuuaacuuaaaaugacuuaaaaggaaacgcaaggggaaaauauuaagcaggacuucuaagcccaaagaagucauauuuauauaauuucccaauuaacugagaagucaagaauaucaaauauccuaucauuauacauucaggaaucauagaucucaaauuuuauaaacaaaaauggaaucaaaccccccauauuacuggcagaaaugaacgaaauguauguccacaagauuaaacugcucaggcauuguugacaucuccagaagaaucucacaaggugaaaagaguuacacaaaaaaccaaaugugaaaguaaacuacuuuucuuuccaacuucaucucuaucuggcgucaggcugagauugucacaggcugagauuuugaacucauugugacucaucuguuauguaagcuguaagaguugggacuuugucucuucucugcacugcuauguugccaucacccagaugauaccuggcucauagcaggagugcuauggaugccuggugugagugagugagugagacuauuuucuaacucucccuucuaaguagcaucccauuuuuacucucaccaaucgaugguuuccucugaauucucuuucaucacuagguuuauuuaauugaggccacucaauguauauauauauauguauuuuugagauggagccucgcucugucacccaggcuggagugcaguggcaugaucuuggcucacugcaaaccuccaccuccuggauucaagcaauucuccugcuucagccucccaaguagcugggacuacaggugccugccaccaugcccagcuaauuuuuguauuuuuaguagagacaggguuucgccauguuggccaggcuggucucgaacuccugaccucaggugauccaucugccucagccccccaaaacgcugggauuacaggcaugagccacuacgcccggccuucauacucauuuuuuuuaaaucccaaaauacacauuuggugugggggagucaguucuacccuguccccacccuuugacuaaacuucaacuguccuuucccgcugccucugguuuugcggguguuauuguccaaagauacagggccauacaggcugucuccucgggugacccgaggacacccuguggccagugcgguaaugagucauuguuuauaggaagcacccuccgcugcagauguucuuccagacccuccacaugaggcaggcuuguccucucaggcagcagccacaagcuucugugcaugaaucugcuucuuagacaagauugaaccuucaaggggugagucuggaagcacaccugauuuauucguggaaacguaaucaagaacuguuauccauggcaaggugcuguucugagcagcagcauccaaguuaagaagccccaugugaacucauccuaaagaaaacuuguuuuuaagaaucucucucccaaaaaagggagugaaauguaggagucauuuucaguaagauuaaguuacuauuucuuucuaaagcaaucaaccuucuacaacucacccagacaaucauaaccaguuauuuguaauuguagguucuuguaaauguauaucaaaagucuuucacuuucucuuccuggcucuuggacuuguuagaggcaagauauugaaauguacaaggucccucuggguucucacaagaucaugugugcguguguguguguguguguguguaucauguccucauaaugaauagauauucacacacauauauacacucaugcccagaagucagcauuccaguacacauuagaaaguuauucaucuaacugucccaaagcaagauucgcucccucugcauucugaugaaccagccuagugaguuugguucaugguagcaaagaucacaagcgcgcagggagaugccgcauuaugcauuacucugcaaaacagcugcuccuuucucugaauaagagcauguacugauuuuuaaacugcauuuucauuccaggauaaaugacaugcuucaauuuuguuuuuuuauauucucugcugcucuugaguaaagaaaagcucugcauuacugugcaaauaacauucaauuucuguuuugcuaaaagaaauuggaaagcuggacagccggauaacuggggucauggccaugggccaggagaagacugugcuggguugauuuaugcugggcaguggaacgauuuccaaugugaagacgucaauaacuucauuugcgaaaaagacagggagacaggugagcaguagaugggauuuaagagggagcugccagcuuauguccuaugaaagggugagggguggugaguacaagggcccugaaugcaggcacugcaauuagguuucagcccugguuaugccauuuauuaacugggcaggugauuaaccucagggaaauaguaauagcaucuucuucacgagguugugaagauuuaaauaaguuaauaaaugugccucacauguaggaaguacucaacgaaugcuaaacuaacugacccacauaaguaucuuauauugugaguuaauuguucuuuaaaauauagcaccagccaggcacgguggcucacgccuguaaucccagcacuuugggagguggaggcgggcagaucaccugauguugggaguuugagaccagucuggccaacacggagaaaccccaucucuacuaaaaauacaaaauuagccgggcaugguggcgcaugccuguaaucccagcuacucaggaggcugaggcaggagaauagcuugaacccaggaggcagagguuguggggagccgagaucgcaccauugcacuccagccugggaaacaacagcgaaacuccaucucaaaaaagaaaagagauauagcaccaauguuaguucuuuuccguagacauccauacacagcuaauccagguggccaagcguucaauuccacguguaucuauugagcaucuacuauaggccagauccugugauacauaauagagggagauggucugugcugcuuaucagcucauaagccaaagcagcuuuuggagauuuucuugacuucaaaggcuauguaucuaaagcuucauuuaacacacgacccucuuuggaauguggcaucuuaguuuucuucaccagaaugagauuaaaaguuugugauaggggacagaggaaauggggaaugaaugcuaauggguaugggguuucuuuuuggggugauggaaauguucuaaaauuagauuagauugguucuaaauugcauaacuuugugacuauaccaaagaccacugaauuauaugcuuuaaaugggugaauuauacaauuugucaauuauauuucaauaaagcuguucauauaaaaacaaaaaccucaaauauauuuuggucaaacuauuuuuggaaguaacuggggcauaaauuauccguauugccauucaacagacaguuacugagcaccuuugaugugucaggcauugguccaagugcuagggaccuuaagacacauaggaacucacagcugggucaguugagggggaaaaacacagauaucuaaacaagggauuauaauugauggugacaaguaacucagauuugucuuuuguaugcuuuguuuggccauuugggauuugaguagggaccaggcuuucccagaauaggcuuuucaaaaugaaacuuggcuuuucaaaaugaaacuuaucuuuucauccaaauaagaucuucuagacauuucuuugaaaauauaagcauuguugaaugauguauuuuagacacuguccuauaaaaauacacguucccuuuuuuugaauugcacauuaacuuuauuauuuaagaaaaacuaaugcccauucuuauuucucucuuuuaguacugucaucugcauuauaacggacugugaugggaucacaugagcaaauuuucagcucucaaaggcaaaggacacuccuuucuaauugcaucaccuucucaucagauugaaaaaaaaaaagcacugaaaaccaauuacugaaaaaaaauugacagcuaguguuuuuuaccauccgucauuacccaaagacuugggaacuaaaauguuccccagggugauaugcugauuuucauugugcacauggacugaaucacauagauucuccuccgucaguaaccgugcgauuauacaaauuaugucuuccaaaguauggaacacuccaaucagaaaaagguuaucauuggucguugaguuaugggaagaacuuaagcauauacuguguaaacagugccauacauuucuaaaaucccaaguguaggaaaaauaugcagacauacagauauauaggccaacuauuaguaauaauaugaaauauacuuaaagagcuuuuaaaacuuuguauuuuuguacaaaauauuugucuuuuacaauuuuuuuccuuuuuuuuuuuuugucauuuuaccgacauaauacauggagccaaagaaaacaauaaugguacuaauaaaaacuccuaggguuuccugucagauuuaauucuacccaguggcaaagaauuuuuucaauuguggcuuuaaaaaaauaauuaaauauacauguguauauauaua

SEQ ID NO: 192734 - RNA, 55257 nt, Homo sapiens
gucuccucgcugcagucgcuccggagcugcacggguguuuugcguguugcugcgucaucgccaguggccgguuugaaugagacucgucgcaccgaagccgccgccaccaccgcgccuccgccucggccgccgccgcagcugcuccugguccccgucccuuugccgcccucgucaggcccagcucuccugcgccgccgccucccgccgcgccccgccaugccgcucuacuccggugagcccuguccuggccucgcgcgcagcacaccggaccggcgcuaggccuccgcguaggccuggccugcacgggcgggcacccggcauggacugggaggggccgggguggggugcgcggggccggcggcgcggagaugacccaggcaccguccccucucccggcugggucggagcccugcguggcaggggagcgccgucccccugagccaccgauggguggggggaguggagauggggaagccucucaaagucgugacucugcagaauaguuucugacgcugcccuggugugcggugaaagugaggguguguccuggggcgcugggccaggcuggaggugcagggagauuccuuugggcuucucaguggucgccguggaagggagcggggaagaaggggagggauggagcgacccuucuugggguugccaagcggcguucgccgcccuucgucguccuucgcccuucucuugccccuugccuuuguucgaccgccccuuugguaccaguuuuaguuuugucccgaggcagauuguaaaccuuuuugcuucguuuucguuucaucaaacguugcauuggauuucuguauccgaaacguggugugagcuuucagaaguagaugaauacacauauccccggggugucauuucuugauuggcguuugacaggggcuuguauuguuugcuugcugacaguccaggguacuggccagggaucacuuuuacuuagggaauggaccuugcugcucccuagccuuauucaaaauggcaccuaaaauauguguggugucuccaauuggcuguaggugugugauucguugaccaucccuguuuauucuguuacaguuccuuuauugaagauucagcauuuacaaagcaugauacgaaucaagaguauuguuugaucucaagguggauucuugauggucuagaaucuugaaucgaauucuuaaugauugcccaaccccuuucuaaagccauaacaacaguagaauggcucuugaaauauucuaauacuuaaacacaccaguagauucacacacauaaaacaaaaccccucuguuuccucaaaaugccagcgcugaccagaguuucuuuuuuaaaauuugagcuuuaucuuaaauauuuaaucagaucuuuuccucaucccccaaaugaaggaacucaaguagauuucuaaggucccuuccuuugaccucuccauauugagaaucuguauuuugagggucagcaaaaagcucuauauuaaaaugaagagaacauuuuaaguacuauuucauaagauuuaguagaaaauuaaguaucuagucugagcgcgguggcucacgccuguaaucccagcucuuugggaggcucgaggcgggcggaucacuugaggucaggaguucgagaccgccuggccaacauguugaaacccugucucuacuaaaaauacaaaaaaucagucgagagugguggcaggugccgguaaucccagcuacuggggaggcugaggcaggagaaucgcuugaaccugugaagcggagguuguagugagccaagaucgcgccauugcacuucagucugggugaaaaaagcgaaacugggucucaagaaaagaaaaaaagaaaauuacauaucuagauuauuaaaugguuaaggauaagugcaguuaaaaauuaaagccaggggccaugauguaugcuuuuaaucccagcuacucgggaagcugaguugggaggaucacuugagccaaggaguuagagggugcugugaucugugaucacgccacugcacuccagccugggugacagagcaagacccccgucucuaaaaauaaacacacaccugugccucuuauagaguuaggguuuuguacauauugcuuuguuuuaaucuucaacguaauccugugauacugguauaauuccucuuguaagcaugagcaaaaaguuuuaaguaacuugcucauggcaauagcacaauaaauuucagguagguuccucuccuuuacuucuaguacuguuuugguuuaauccuguagcaucuuuagcuuguacuauuguaauaugcuucuaguuuauuuuagugauuacaguaugccuucuucaagccugauuucucugcugcugcaagugaucuaauaguauucaaaccagacuaaaguggccuuuaugacagccuuucaggaauuacacauugccuacaacauaaagccuuuacguauuuuauuuuauuuuuuuuuauuuuuugagaccaaguuuugcucuuguugcccagucuggagugcaauggcgcgauguuggcucacugcgaccuccaccuccugguuucaagcgauucuccugccucagucucgcgaguagcuggaauuacaggcgccugccaccaugccuagcucauuuuuguauuuuuaguagaaacgagguuucaccguauuggccaggcuggucucaaaccccugaccucaggugauccaccugccuuggccuuccaaagugcugggauuacaggcaugagccaccauucccggccucuuuauguaugauuuaggaugacuuaucuuccauaauuugauccuuagccagcuuccaguuucaucuacugcugcuuucccuucacucugguaauuaauuacuuacaucuuagaacacaccaugcugcuuuaugcuguggaauguuuuccuucuuuucugggaauucuucuguccucuccuagucucugacuaacaccuaaucuuuucuugagauucaaaauugauagugauaacucagaaguuaacacuucauccaggaaaucuuuccucauuuaugaagcauuccacuuuguugcuguagccuuuguaauacuuacauaguuaauuacucuagccuccucccacccccccauuaggcuguaaguuuauggagagucuucccaaugcuuuguaccgggcuugucauuaaaugaauacucaacauauuaauugaacugaugauagaguugggauuuggugucugagugagguuuucaaauucugauuucaggaguuggaaagcaauuaacaguugugagguucuuauuuuugagaagguauaaaauuuucaguggaaacaauauauauccuuggguuuuaaaaauauauauuucaaaaguuagcuauuuuaugaggcugauugaaauuuuuuauugugguaaaauauauguaauaaaguuuaccauuuuaaugauuuuuacguauacaguucuauagcauuaaauauauucacaguguuuuguaacugucaccuucauucacauccucuugcaaacaccauucucuuuuuguauguaugaauuugaccacuuuagguaucucauauaaccagaaucauccauguugcagcauguauaagaguuucuuuccuuuuuaagguugaauaauauuccguuguauguauauaccacauuuucuuuguccauuaauugguugauggacacuugaguugcucccacuuuuucggcuguugugaauaaugcugcuguaaacauggguguacaaauaucuguuugaguccuugcuuucugaucuucuggguauacccagaaaugaaauugcuggaucauaugguaauucuauguuuacuuuuauuccccccagcaguguacaaguguuccaguuucuccacaucuuugcuaacacuuguuauuuucuguuaaauuuuaaaaagaauagccauucuaauggcugugaagugggauuucuauauauuuuuaaaugauuuagauaugucuuuggauuuuuucuuaauugagcaccucuuguucagaaaugacacuuuucaauucucccagauuucuuaugacucagaaucuguauuccuuaaguuguucuagaugugcuuuauucucccaggaauuuuucuucuucucuuaaacuaucuaaccuuucucucucucucuucuuuuccaaugcugugugcugaugugaaugauucuucaauuaaacacaugggggcugcgaaacuuaucauuuugggaaauauuucaauaugaucauauuguuggaguaggauucagaagacuugggaguuuauuaaccaauuuuaugacauuagcaaaucaaucuacuucucugaagucucaguuucuuuuuuuuuuuuugagauggagucucgcacugucgcccaggcuggagugcaguggcgugaucuuggcucacugcaaccuucgccucccggguucaagcgauucuccugucucagccuccugaguagcugggauuacaggcgugcgccaccacaccuggcuaauuuuuguauuuuuauuagagacaggcuggucucgaacuccugaccucaugauccgcccgccucgaccucccaaaguacugggauuacaggcgugagccaccacgcccagccugcugaagucucaguuucuuuaacuaugaaaugagaaguuagguuugauccagugaaauuuuauucagcaccuacugcaugcaugcuccucuugauuagguaaguguuaugggcauagaaagaugaaugacauguuuugacucccgauaacugccuaauuggugaucuucuaagggucuguaaaucuugucuuguuauuuuuuaauuaaaaaaauugugauuuuguuugcaguuacuguaaaauggggaaaggagaaauuugaagguguagaauugaauacagaugaaccuccaaugguauucaaggcucagcuguuugcguugacuggaguccagccugccagacagaaaguuauggugaaaggaggaacgcuaaagguaaaauguaguccaaauuuucaucacauuacuauuauuguauacuuuuugaaaaauaacgccagaaaauuauuuaauuuuaauguagcauuugaagugcuuuuuuuauaugaugagaguaugucagcuaugguguuaaaacugucuuaugccuguuagaguaagggagaaauauuguagcuguuugacaacacuauaugguauuauaaaaacaucguuuuaaaacucuuuuuacuuuuguuuauuuuuaacuuuuagguucugagauacauaugcagguuuguuauauagguaaacuugugucacaggguuucaauguacggauuucaucacccagguacuaagcauaguacccgauagguaguuuuuuuuuuuuuuuagauccucuuccuccucccacucuccacccucaaguaaguuccagugucuuuuguuccugucuaugugucuauguguucucauuauuuagcucccacuuacaaaagagaacaugcaguuugcuuuucuguuccugcauuaguuuacuagggaacuagcagguaaugaucuccagcuccauccauguugcuguaaaggacaugacuuuguucuaaaagcaucauuuaaauuuuauuuuaaaauguguuguauuaccagauaccucugugggucaggagaguggaacacuuuacaguuaucuguauugugugaauuuuuuuuccuaugaggauguauuaaaaguauuaguuuuauuuuguuuagacuaaaaugaaaccaauuaauauuuccuuaguaauuuucuguaaugagguuggaaaauuuuaucucaguuuaaaaauguggaacaauacagauagguuuguuuucuuaaaaaaacuacuacagaauguaauuuuguacaugcauuuguauguugaaauucaaagcacuucagcauuuuuaccaaagcccugguucuggaaaacuguucauuuuuuuuuuuuggccuuuauugcauccuacccauuaacgaagagcuguuuuucuuuuucuuuuuuuuugagacgagucuugcccuguugcccaugcuggagugcaguggugcuaucuuggcucacugcaaccuccgccuccuggguucaagcgauucuuaugccucagccuccugaguagcugggauuacaggugucuaccaccaugcccggcuaauuuuuguauuuuuaguagagaugggguuucaccauguuggccaguuuggucuugaacuccugaccucaagugaucugcccaccuuggccucccagagagcugggauuacaggcgugagccacugcacccagcccccuuuuuucuaaacaguaauuguuaccuaacuccuaccuggagaugggaggaaaaaauuuuuguuuaaaaagagaagaaaccuaauuuuugucuuuacuuccuuuggaaugaucucagugaccacaguuaagaauccaucccugccagcaucauugaugaaggacugcagaaaagacaagaagauaucuauuauuauuauuauuuuuuuugggauugagucucccucugucacucaggggcuggagugcaguggcgccaucucggcuaacugcaaccaccgccucccgggcucaagugacuguccugccucagucucccgaauagcugggauaacaggucaccaccaccaugcgugacaaauguuuguauuuuugguagagacaguguuucaccauguuggcgcuggucucgaacuccugaccucaagugauaugccugccucgggccucccaaagugcugggauuacaggcgugagccaccacacccggccucuauuauuuuuaauaauauaaguauagcuuuaaaaaauacuuccuucaaggguuagauaaaaugcuaaagaucuauaguuaacuuuagagauaaagacaggcuacccccacugggcaguaaaacacacguuggaggaaaaucuuuguuuacccccgaagguacaguaugaaccuuuggccuuuagugaacuucauagccuaaucuaugcugaacacuguacuagugguaugcugucgagaauuauagaaguaugcgaauuaaaugaaacugugacugcuaaugguuaccauuuauugaguacuuauuuuaugucaggcuuuuauuauauuuucuuuaauucucagcuguauguuauccauaucuuauauaugaggaaauuuuauaaaugagugucaaagagguuuaaguaacauaguaaggcaccaaaagagcauaugauuuauacaucaagcagaucuguguucacuucccaguuuugugugaccuuggguaagugaucuuagggggcauuuauaguuaucauucauuauguuuagcagucauagaccuuaaauugagaagggccuuuaggaaguuaccguuccauuuuaaagcagauaaaagagauaauuaguggcaccaaugaaggguagacaagcauauuggguacccgauaccuucuauaaaagggaguaauauagaaucgacuuuauccuaugaggggaaaggccuagcuguaguuaguaaaaauauuacucuggacuaaucaugcauuuaaaaaaaaaauucuugauuuuuauucaacauauugaaaggaaaguauauacuugcuuuauagaugcguuauagacauuaacucuucauucuugccacguaagcuuguuauuuauuagcucugcugguuccaaacauccaaaaaauaggaucuaucauuugucauuagucaaguguuuuuuaguacuugcuaaaaguauuuuuuuauacuuauguguuuuuuaguauuugaugcuguaaauacagguuacugccuuuuguauuguguuaccuuaugcaguugaagcaaauuauuugaaacccuggcuuuaguaccacuuguguuuaaaaaaaauuuuuguuuuuuuuugagauggagccuuguucuguugcccaggcuggagugcaguggugagaucucggcucacuguaaccucugccuccuggguucaagcaauuaucuugucucagccucccgaguagcuggaauuacaggugugcaccaccaugcucagcuacuuuuuguauuuuuaguagagauggaguuucuuuauauugguccggcugguuucgaacuccugaccgcaggugauuugccugccucagccucccaaagugcugggauuacaggcgugagccacugugccuggccaaaaaaaauuuuuuuaauugccauaauuuuaaauaaaaucugcauauaggauaaauuuuauucuguuuugaaguacauuaaaauaaauugauuauuagauuguguucagcuuguacaguggugguuaaaugucuuuuguuugucuuugaaacaggaugaugauuggggaaacaucaaaauaaaaaauguaaguauuaucuuaugaacguuuauuauaaugcaguaaccucauuaugauaccaaaauacauuccagaugacuuuuuuucauguguauauccaguuguuccagcacuaucuguugaaaauacuuaccuuuucccauugacuuguguugggcucuuucuugaaaaguaguuauagguuuguuuuuggguuuuuguuucauugaucuaguagauuaaaguuacacuaguaccaaaugguuuugauuacuaaagcuuuauaauaaaagccuugaaaaaaaaauuagcugggugugguggugcacgccuguaauccuagcuacucgggaggcugaggugggaggcugaggcgggaggcagaggcaggaggcaggagaaucacuugaaccugggaggcggagauugcagugagccgagaucgugccacugcacuccagccuggcaacagagcgagacuccgucuccaaaaaaagagucuugaaauaagauaguauauguucuuaugcucuccaacuuucuccucuuugagauuuuguuugagauuacauugaaucuguagcucaauuuggggagaauaaacaucuuaacaauauugaguauuaaaaucccugaauaugauguacuuccuuauuuauuuaggucucuguuuuucucuuagcagaguuguaguuuuuaaacauagagguuuugcaugagugguuuuuuuuuugagacagggucucacucucacguaugccggagcacaguggcauggucauggcucgcugcagcuuuaaacucccagccucaagcaguccuuccaucucagccuuccaaguagcugggaccacaggcggguguuaccaugcccaguuaauuaauuaauuuuaauuauuuuuuguagagaugggggugucacuauguugcccaggcuggucuugaacuccagggcucaagcgauccuccugccuuggccucccaaagugcugggauuaacaggugugagucacugugcccagcccuugcaugacuucucuuaaauuauuggaacuuaacauuuguucgcugcuuaaaauaauauuaaaaaauauuuccaguguucauggcuagaauguaaaaauacaauugauuuuucucucuuuuuuuuuuuuuuuuuuuugagacagagucucacucuuauugcccaggcuagagugcaauggcgcgaucucggcucgcugcaaccucugccucccggguuaaagcaauucucuugccugagcugggauuacaggcgcccaccaccacgcccagcuaacuuuuguauuuuuaguagagaugggguuucuccauguuggucaggcuggucucgaacucccgaccucaggugauccgcccaccuuggccucccagagugcuaggauuacaggcgugagccaccgcacccggccaaaauacaguugauuuuucuaaguuuauuuucauucuuuauucuuguaagcaauucacuuacuaauuccaguuguguuuugggcagauuccauuggguuuucuguguacauaaacguguuaucugcaaauaaugacaauuuuacuucucccuuuucaauauucgugacuuucagauuucuuaaacuuuauugacauauaauugauaagcaaaugacuucuuuuuuuugagacagagucuugcuuugucgcccaggcuggagugugguggugugaucuuggcucacugcauuauuugccuccuggguucaugugauucuccugccucaaccuccugaguaguugggauuacaaacgccuaccaccaugccuggcuaauuuuuguauuuuugguagagacaggguuucgcaacguuggccaggcuggucucgaacuccugaccucaagugaucugccugccuugaucucccaaagugcuggaauuacaggcgugagccacugugccaggccuuguccuacuuuuuaauaggacuucuaauacaguguuaauagaaagugauaagaguggccgggcgcgguggcucacgccuguaaucccagcacuuugggaggccgaggcggguggaucacgaagucggagaucgagaccauccuggcuaacauggugaaacuccgucucuacuaaaaaaaaaauacaaaacaauuagccgugcaugguggcaggugccuguagucccagcuacucaggaggcugaggcaggagaauggcaugagccugggaggcagagguugcagugagcugaaauugugccacuguacucuagccugggcaacagagcgagacuccaucucaaaaaaaaaaaagugauaagaguggacaucuuggcugggugugguggcucacaccuguaaucccagcacuuugggaggccaaggaugguggaucacuuaaggucaggaguucgagaccagccuggccaacauggugaaaccccgucucuauuaaaaauacaaaaauuagccgagugucauggugcacgccaagagaauugcuugacuuugggaggcggagguugcagugagcugagaucacaccacugcacuccaaccugggcaacagagcaagacucuaccucaaaaaaaaaaaaaaaaaaaaaagaguggacaucuugucuuauucuaguucacuacaacuuaaaauuaugaaagaccguuacauuuuguuaaguguuuuuucuguuuguuaaaaugauggugugauuuuuuuuucuuuuuuucuguugguagugugguuaaucucauugauuuuuaacuuaaaccgugcauuucugggaugugcaguucucaaauuucuugguuuugugacccuuuugcccucuuaaauauuaugauugaccccagaguuucauauaaaggcacaccucauuuuauugugcuucacagauaauugugauuuuuauaaguugaagguuuguggccaccuugcaucgagcaaguuuauaggcaccauuuuuccagcagccuauguucacuucaugucucuuugucacauuuuggugauucuugcaauauuugaaacauuuucauuacucucaugucaaguauguugaucuuugauguuacuuuuguaauuguuuuggggugucaugaaucacaccuguaagauggcaaacuuaaucgacaaaugugucuucugacagccucaccgacccgcaguucccuccucccucuucucgagccucccuauucccugagacaagacaguauugaaauuaggccaauuaauaacccuacaggcugagcgcgguggcucacaccuguaauccuagcacuuugggaggcugaggcggguggauuccugaguucaggaguucaagaucagccuggccaauauggugaaaccccaucuccacuaaauaaaaauagaaaaauagccgggcguaguggcacaugccuguaaucccagcuauucgggaggcugaggcaggagaauugcuugagccugggagauggagguugcagugagcugagaucaugccacugcacuccagccuggccaacagagcgagacucugucucaaaaauaaacaaauaaauaaauaaauaaauaacccuacagugaccucuaaguguucaagagaaaggaagaguuucaugucuuuuacuuucaacagaaagcuagaaaugauuaagcuuaguaaagaaggccuguguaaagccaagacaguccaaaagcuaggcauuuugcagcaguuaaccaaguugugaauacaaagguccaguuuucaaaggaaauuuauaauuuaaaagauaaguucuugaaguguuacugcaaugaacacacaagugauaaagcaaagcagccuuauugcugauauggaguaaguuuaagugguguggauagaagaucaaacuagccacaacauuuucuuaagucaaaaccuaaccagagcaagacccuaauucucuuuaauucugugaaggcugagagaggugaggaagcuacauuguccucaucagacuaacacaggaacagaaaaccgaacaccgcauguugucacuuguaagugggagccgagcaaugagaauacauggacacagggaggagaacagcacacacgggggccugucaggcagugggauguggggagagcaucaggauaaauagcuaaugcaugcugggcuuaauaccuaggugaugggucuauaggugcagcaaaccaccaugacacaauguuuaccuguguaacaagcaugcacauccuggacauguacccuggaacuuaaaaaaaaaaaaaaaaauauauauauauauauauauauauauauauaaacugaagcuagcagaaguugguucacgagguuuaaagaaagaagcaaucucuguaacauaaaagugcaaggugaaacaguaagugcugauggagaagcugcaguaaguuauccagaagaucuagcuaagauuguugaugaagguagcuacacuauacaacagauuuucaguguggaugaagcagccugauauuggaaaaagaugcugucuaagccuuucauagcuagagaggagaagucagugccuggguucaaaggccagacugacugucuuguuagaggcuaauguagcuaaugacuuuaaguugaaaccaaugcucguuuaccauuccaaaaaccauggaucucuuaagaaugaugcuaaaucuacucugccugugcucuguauauggaacaacaaagcccagaugccaguacgucuguuuauaguauggaguacugaauauuuuaaggccaccauugagacuuccugcucagaaagauuccuuucaaaauauuacugcuuauugacaaugcaucuagucacuuaagaguuuugagagacauaaacgagaugaauguuguuuuccugucugcuacaacaacuauucugcagcccauggaucaguaauuucuacuuuuauuauuuaagagauacauuuuguaaggcuaaaguuucccuauaaaguuauuucuccaugaaucugggcaaaaucaauuaaaaaccuucuggaaaggauucaccugaauucuugauaccauuaggagcauucaugggaggaaguuaaaaugaagucaguauuuaccaggaguuugaaagaaguugauucuaacccucauggaugacuuuggggaguucaaaacuugaguugaggauacaacugcacaugugguguaaauaggaagaaacuagaauuagaaguggccaggcaugguggcucacuccuauaaucccagcacuuugggagucugagacaggaggagagcuucaggcugggaguuugagaccagccugggcaacacagugagacccugucucuacaaaaaauaaaauuaguugggcauggugguguauaccuguaguccuagcuacucuggagacugaggcaguaggaucgcuuaagccuaggaguuugagguuacagugagcuaugauugugccacugcacuccaaucugagugacagagugagacccuguaucuaaaaaacgaaaaagaauagaaaaauggagcuugaaauugugacugaauugccacaaucucaugauacaacuugaacagaugaggagguaacuuauggaugugcaaagaaaguaauuucuugagauagacucuacuccuagugaagaagcugugaauguuguugaaaugacaauaaaggauuuaaaauauuacguaggcuuacuugauaaagcagcagcaggauuugagagguuugacuccaguuucgaaagaaguccuacuguggauaaaaugcuauuaaacagcaccgcaagcuacagagaacucuuucaugaaaggaagucagucagcguggcagguuucauuguugucucauuuuaagcaauuacccagccuucaggaaccagugccgugaucagucaguagucaucaacuuggaaacaagaccccccaccugcaagaagaucauuaacugaaggcuuagaugauugucagcuuuuuuuuuuaagcaauaaauuauuuuaaaauuaagguaugugcauuccuuuuuagacauaaugcuguugcauacuucacagacugauauaaacaugauguuuguaugcacugggggaaaauuuuugugugacuugcuuuauugcgauauuugcuuucucaugcucuggaacccaaacuguaauaucuucaagguaucccuguguuuuaaucuauguaauacucuuuuguuggauagaagauaauuuuaucuaagucaguugaucacauuuuuuagugauuuguacuauguuguaagaaaucuucgccugugccaaguuuacaagauuuuuuuuuucuguuuucuuguaaagcuugauaaguuuuagcuguuacauuuagauauauugucugucuuuuuuuuuuuuuuucuuugagacggagucucacccuguugcccaggcuggagugcaguggcacgaucucggcucacugcaagcuccaccuccugguucacgccauucuccugccucagccucccgaguagcugggacuacaggugccugccaccacacccggcuauuuuuuuuguauuuuuuuuaguagagacgggguuucaccauguuagccaggauggucucuaucuccugaccucgugaucagcccgccuuggccucccaaagugcugggauuacaggcuugagccaccaugcccggccuauauugucuguuuuuuugagacggaguuccguucuuguugcccaggcuggagugcaauggcgugaucucagcucaccgcaaccuccgucucccagguucaagagauucuccugccucagccuccugaguagcugggauuaaaggcaugcaccaccacacccagcuaauuguuuguauuuuuuuuaguauguuguuggucagacuggucuccauguuggucaggcuggucuugaacuccugaccucaggugauccgcccaccucggccucccaaagugcugggauuacaggugugagccaccgcacccggucuauuaucuguuuugaguaaauucuuguguuugcuguuaagcaaugguugagguuauuuuuuucacaugaguauuuagugagcaacauuuguugaaaagacuauucuuuuccauucuuccucagugccuuuguugaaaaucaguugaccauaaacauaaggguuuauuucuggauucuguuuucuuccauugauuuuuauauguaccuuuguaccaguacccauucccugcuguuuugauucuucaggccuugaaaucaggucgucuaagucuuccaguuguuuuucuuuuuuaaaguugcguuggcuauucugggaacuuuguacaucuauugcacauuuuuagauucugcuugucauuuucuccauaagagucugcugggauuuugauuggaauugcauugaaucuguaugucagucugggacaucucaauauugagucuucuaacuuacaaacaugguaaaccuuuccuuuauuuaaauguucaauguugggacuuacacauauuuuguuccacauauuguuaaguauuucacguuuuucuuucuuuuuuuuuuuuuuuuugagacagucuugcucugacgcccaggcuggagugcaguggcgugaucucagcucacugcagacuccgccuccuggcuucaagugauucuccuuccucagccuccugaguaacugggauuauaggcacuugccaccaugucugacuaauuuuuguauuuuuaguagagacggggugucaccauguuggucaggcuggucucaaacuccugacuuagagugauccaccugccuuggccuccccaagugcugggauuauagguguaagccacugcacccggcuuauuucaugguuuuuaauguugucguaagugguacuuuucuuucuuuuuuuuuuuuuuuuuaaagacgaggucuugcuuugucggcuggagugcaguggcacaaucauagcucgcugcagccuugaauucuggggcucaagggguucucccaccucacccuccugaguaguugggacuauaggcaugcaccauugugcuuggcuaauuuuuuguuuuuguuuuugagacagagucuugcucuguugcuugccuaggcuggagugcagugacgugaucauggcucacuguaguuucugccucccagguucaagcaguucucgugccucagccucccgaguagcugggacuacaggaaugugccaccacgccggacuaauuuuuguguuuuuaguagagaugggguuuugccauguuggccaggcuguucucgaacuggucucaagcaauccuucugccuugagcucccaaagugcugggauuacaagcgugagccacugcacccagcugugguguuuuugaaaugucauuuuccaauugcuugcuaguauauaaaaauaaaguuaauuuuuauaauugacuuuguauccugugacuuuauuucauauauuaauuucuuaggauauuguuagguauacaugucaucugcaaauaaggacaguuuuauuucuuccuuuuuaaucuuugugcauuuuguuucucuuuuuuucuuuauugcaaugcuuaagacuuuaaacaaugcugaguagaagugguugauaguggacaucauugccuuuuuccugaccuuaggggaaaagccuccagucauggcuggugguaguuuauagauguucaucaucagguucaggaacucuuucuaguuugcugagagguuuugucacgaauggaaguugaauuuugucauuuuguuaaaugccuuuucuauaucauuucuuccucucauuuuauccauuaaacuacacagacuuuugaguauuaaacagaacuuauauucuugggauaaaccccacuuggacauuauauauugcuagauucuauuugcuuaucuuuuguuaagguuuuuugugucucuuuucauaagagauaaugguuuguaguuuucuuguauucuuuuuuaucugguuuugcuaucaguguaauguuagucuuauacagugaguuaggaagcauccccucuuuucugaguuuguauuaauauuuuuucuuccuuuuuuauuucugcucccacuccacugggauauuuuuucuuuaaauguugccuaaaauucucuagugaagccuaguucacuagacuucauguggguuuggaguuuucuuuguaggaagacuuuaagaauuuagugucuuuaauaaauguaggacuauuuagauauuauguuuucuuuccuaucaguuugauaaucaguauuucuuaaggaauugguucauuuaaguugcugaauugauugucauauucuacuguuauuacccuuuaacucuagaauguguagugcugcuuuuucguuuuccucucuaguauuggcaaauuaugauuugucuguuuccucuaucaucaagccagaguuuugucaguuucauugauuguguccccccaaaaaaaaaacauuuggccuguucauuuauuacuucguuuauuuuuucucuuugcuuucuuucuuucuacuucgguuuuaaauuuuuuaaaauuuugaaaauuuuuauauaaucauauuuuguugaaugaagugcugaaacccaggcaaaugguggugacuuuuuugguuuguuuuagagauggggucuugcuauguugcugaggcugaccuugagcaccuaggcucaagcaguacucccaccuuagccuuccgacuaccuuggacuacaggugugugccaccacacauggcuugguuuuaauuuuuacuuuuucuagcuuaagguagaagcuuaccuaguucauuaauuuuaagccuuuuuuuaaaucucuuuugcucauuuuuguaguauguauuugcuuuuucuuauagauuugcuuuuuugagugcuuaguauauaugguauaguuuugccccuaguuuauuguuuucaaauguuuuauagacauuuuuaagauuuguguagcuaguuacaucaauuguuaauauuuaugucaguuuuagaaaaucuuccaacaaugcaugaguuuuuugauucacuugcauucuuuuaugaauauuaauuuuuuuacauuuaaaucuuuaauuaauuguuguugugguaugguaugaaguagagagcugauaguauguuuuuucuaaaguauacaguuuuucucaauauuuuucauuguauaaucccuuuuccuaauaauuuuuuaagggcauuguuuuagucucuauucuuuuucagaaauuucuuagcuauuauccuggguauaaauuugcugcaugaaugaaucauuuugcaagguuuuguaaaggaauuucauuaaauuuauauaacuauaauugcaucuuuauaguaauuuuucaaguccagagcuugucaugucuuccaguuuauuuaggugcuuuuuuuaaaaauauccuuaaguaaagcuuuauucucucauuaaaguauuacauuuuucuuguuaugcuuauucuuagauauauguuggcauuucuucuauuguguuuuccaacugguuauugcuaguguauucuuuaaauaguuggcucuugagacaguugucuuuggaaaaagauucuuggccuggugggguggcuuauacuugcagucccagcacuuugggaggcugagauggggggaucacuugaggccagaagugugaggcuacagugaccuauaauugugccacugcacuccugccugggugacagagugagucccugucucuaaaaaaaaaaaaaaaaaaaaaauucuguagugauggcuuaguacugcuuuacugcuuugcaaugaucuuauaaaaugucuauguagaaauaaaaggugauagaauaaaggucauuaaauuuaauuguagguauucuuaacugaacuaauuuccuaauuuuaaucaucaucuggauauuuuuagucuucuggcuaucauuuuucccucccuguuuuuuuuuuuuuuuaaaucuccacuucugguccuaccuuuuacuuugucucauguguucaugccuuccaauuaagauacugaguaagagaguaagauguuauucauauuuuaagauuaugagcuuuacaaugacagugucuuccuugucuuucuauugauuguauggaguguuugcauauguauuaaauaaaaguauuuacuuagguuaauguguagaauuauauaauuggauauuuugaacaaauuuacucuguauuugguuugauauuuuuuaguaauagagaauuuaaugcucuaaaaauauuuguauuuaaauguaaacaaucacuacaguuacacaauagacauucacagaaauaauuuuauuaguguuuguuuguuuguuuguuuguuauauuuuuugagacggggucucccucugucgcgcaggcuggaaugcaaguggugugaucacagcucaccacagccucaaccucccaggcuccagugauccucccauuuuagcccccaaguagcugggacuacaggcaugcaccccuaugcccagcuaauauugguauuuuuuguagagaugggauuucgccauguugcccaggcuagucuugaacuggacuccaaccauccacuagccuuggccucccaaagugcuaggauuacagcaugagccaccaugccuggucugaauuuuauuaguuguaaguuuguuauggagagagauaaugccacuaaauguuaaugaucauuugaggaauucccucugcuucaauauuguaaacauuauuagguguuuuuauggcaauacuuauuuuuuccuuaagcuuuauucagguacaauuuauauagaguaaaauucaccuguguuugauguacaguuugaugacuuugggcgauucuauauugucauguaaccacuaccacaaucacgauuuagaaguuucaucacgaaaaaguuucuuuguacaccuuugccuuggccucaaacagccaccccagugcuuuuuacuuguuuuaaacaaugcagugauuuuuaguaguguauuuacagaguugugcagccuucaccacagucuaauuuuagagcauuuccauuaccccagaaagaaacuuguaccauuuaaggucacucccucuccccaucuccaguccuaggcagcaacuaaucuacuuucugcagauuuacuuuuuuuggcaaauagaauuauguuauauguguucuuuuguuccuggcuucuuuugguuugacauaaacauuaccaacuuuuaaggauuuucaugaaauuacuuuuuuuaaaaacagggaaugacucuacuaaugauggggucagcagaugcucuuccagaagaacccucagccaaaacugucuucguagaagacaugacagaagaacaguuagcaucugcuguaagacacaccagauuuuauguguuugaucacuacuuuuugaaggaccauuauuaaggugucuuucagaaaguagcaucugaaugucuugaagacuuaaucauuaauaccaagauagauauuuuuagcaguaaauaagaguuuuauuauuuuugauuagcuuaagggaguccuucuguaguuaaauaaggcacagcuagggguuuuuuuuuguauuguacaccuuacuacugguuuucagacuuccaagugaauuuacuuaggcuuaacuuacauauauuuagcuaauaucuguaauaaauauguuccuggcagauaguacuauauaaguauuuacuauuacuauuuuaugagaaaacagggucaaagaguaguuuaaauguugggauauuuaaauuuuuaaaauccuucauguggaaaauacauacauuuuauccugaauuuaaaugcaaaaucaguuuagaaacuggucaacacgugucaauuuuuuuuuuaacaccuagcauuuauuuagugccauucauucauuuucaugguuuuuuuuuuugcuuuuuuuuuuuuuuuccuugagauggggucuugcucugucaccccggcuggagugcagugguaugaucauagcucacuguaaccucaacuuccuggguucaagugauccucccaccucaggcuccugaguagcgaaaauuguaggcgugcaccaucaugcccagcaaauaaaaaaaaaaauuuuuuuuuuuuuuuguagagauggggucuugccguguugccuaggcugaucuugaacuucugaccucaagcaguccuuccaccucagccuuccaaagugcugggauuacaggugugagccacugugcccaaccuguuauuuugcuuuuuguuuugaaguguuucuuugcauauuuugccuauucucuucucuugauaaaccugcaaaaaaggcaagacuaguaugauuauucucuuauuauauuuaagaaggaaacuaaaacauaauaugauggccagcaugauccaaguaaacuuuuuuuugggggaaauaaaacuguuucuuuagcgugaaggcagaauauaaauugguagaagcuaguaaaugguacuugauucaaaaugagaauuuuagugauuuauauaugccaugucauuuuguaaaaaugguuuaaugauuuaauccuuuuuuuuuuuuuuuuccaacuagauggaguuaccauguggauugacaaaccuugguaacacuuguuacaugaaugccacaguucaguguauucguucugugccugaacucaaagaugcccuuaaaagguaagacugcagucuuuuuuggguaagggauguucacauuuggaugaguaguauuguuuuguuuugcuuucuuuagcaucuuaauugagauauaauuaauuuauuauacaauucagcauuuuaaaguguuuaaugcuuuuuauaguauuuacaaguuugugcaaccaucaccaccaucgauuuuaggacauuuuccgcccccuccaaaagcagugucguacucacuggcagucacuccuuuaaccccuucacccaccucuagcccuagccaaccguucaucuacuuucugucauagauuugcucauucugggcauuucauguaaauugaaucguauaauauguggccuuuuugcggcuaacuucuuucauuuggcauguucccaugguucauucagguuacagcacacguaacaccucauuccuauuuuauggcugaauaguauuucaugguucacucacguuacagcacacguaacaccucauuccuauuuuauggcugaauaguauuucaugguucauucacguuacagcacacguaacaccucauuccuauuuuauggcugaauaguauuucaugguucacucacguuacagcacacguaacaccucauuccuauuuuauggcugaauaguauuucaugguucauucauguuacagcacacguaacaccucauuccuauuuuauggcugaauaguauuucaugguucauucauguuacagcacacguaacaccucauuccuauuuuauggcugaauaguauuucauuuuauggauauaucacauuuuauuuauccauucauuuuguugauggaaauuugaauuguuucuccuuuuuggcuguuaugaguaaugcugcagugaacauucauguuuuuuguguagaugaacguuuucauauaguaacucuauguuuaauguuuugaggaacugccacaaugauuuuccaaagugacgguaccauuuuacauucucaccagcaaugugagaaaauugccaauauugucugucuuugauuaagccaucuagcgcuaugaagugugguaucucauugugguugucaugcacauuuuuuuuaguggcuaaugauguugggcaucuuuucaugugcuuauuggccauuuguauaucuucuuuggagaaaugucuguuuaaaucuuuugccuguguuuuaauuggguuauuugucuguuuaaaaauucaauuguguuuuuacauauauacaaguuccuuacccaauggauaauuugcaaaucuuuucuucuauacuauaagcugucauuuuacuuucuuuuuuaaaauuuauuuuuuuccuaagucuguuguaugcagucuccuuuuacuuuucuugaugguacguuuguaaugcaaauguuuuuuaauuuugauguaguuuaaucuuaauuuuaauuuuuucuuuuaucacauaugcuuuugguuucauauguaaaagccauugucuaauucuagguuacaaagacuuacuucuuuguuguuuuucaagaguuaauauacuuuuagcucuucuauucaggccugugguuaauuuuuauguauggugggagggagggagguauuugccuauuauuuugcauguguauauccaguucuuccaguaucauuuguugaaggcuauuguuuccccacugaauugucuuagcaccuuuuuugaaagucaguugaccuuaauguauagguucauuucuggacccuggauucuuuuccauuuauauauaugucuauccuuaugucagucaguacugguuucaaaaaagaaagaacauuuuguuuuuauaccaucguaugaaaggaaaagaguaaagaauuaauuacaaauguuuugagaaccuguaaaauggucuacaaauaagggcccuuucuuccggugaguauaaguguaacuuaaaaaauauguaacuuaauucugacuaaauuuauacaacugucuugauacauaaauugucaguucuuuaugauagaauucugaacuacaauuuggauucuagacagcuuuaugaauauugauuuuuguuuuuuccccucagucuauugugaaauguugugauagaacugagcagaagagaagggagagaaggagugugcaaaaaucugaaagagugacuuuaaagguuuucuacauuucucugaagcgaauaguugucagguauuuaugagaaauugcauagauugcagcugauauauuaucagugaacaagacacaguaucugucuucaaggcaccuacagucuaauagagaaagacuaucaaguaaacagguacuguuucagaacugcuuugaugggaaauguaggcugcuaugagaacaucuaagggaguucaucagggguaucugaggauaguuugggaagacuucuuagaguaacugguauuuaaacaguuagguguuaucccagccuggaugagagguuagggaagugugagaguggacuggaggaaagaguuuuuaagcaacagucuggaggcaggagacugcaacauacucagugcaacugccuggagaaggauggauguagaaacggugauagaugggagauuagcaggggccagccagaaaucuugaagucguuuuuaagaaguguggacuucguguugugggcgaagagaaaccauuggaagauuuuaagcagaguacugacauucaaauuauccucugaauucuagguagcuaagauuauuauuuuauucuucaacaguuuuuauuuuaauuuugcuuaaaaaauugccuggugaaucuuacugugucuuuuauauauaucccaaaauauugcuuuauuuuacccuuuccucuuauccuuggaugauaauauugcuuggagcaagagucuaggucaaagccauuuuuccucagugauugguaguuauuuguccacuauuuuuguguguccaugcuuacugaugagaggucugauaucagucuugauuuuuauucuuuucuguuaguagcuuuuaggguuuucucuuuuuuuuuuuucuuucccccaguuuuccaagaaugugagacuguggguuuuauuuaucuuauaaaaguacucagugagcacuuuuagucugaggacucuugucgcaaacucuaggacauuucuuggucauuauuucuuuagguacugcuucuccuccaccugguuucuuauacauauuaaaauuucuagaucuguuuuuuagucuucuaacuuuccuccguguuuuaaauuuuuauaauuuuuaugugaugugcucuaggaaaaugccucaguucugucuuacauuuuacugauucauacgucuacuuuguuucacugcuuacuuaucaugaccuucuguucuuuuuuauaacuccuuauucuuaauuuuuggaucuaaauccugcuuuuauuuuucugaggcucugaaguauuuuuauuuaaagguuuuuuuuuuuuuuccuuguuguuuggccuuuuaacucuguucuuuuuggauguaaggguuguucuucccucauuuguuuaaagguugugugcucauaucaugcaaccauauucucuuccuuaugucccaguugcaaauuaucugaauagguaguuugcugggguagcuuucuggcuagcacccuugggaguggcugauggagauagccuuggcucacuuccaagauuuccucuuuacuguuuucuucuuggaugccuuuuagccucuguuccugagagagugcucuuuuauguuuuggaaagaguucuguguaagcaggggagauuucauccuaugugguucuauuuuccugaaaccaaaagaaguauuuuuuguuuuuccuuuuuuuaaaaaaauaaaagugaaaguuacuuuuuucgcuuuuugguuuuuauuuuuaguauuuuuucuuuuuuuuguacagcaaccucugaugccaaacaaaagaaguaguuuuugaauucuaaauuuucucaagagagugcacuuacuaacguaauugauacaagaugucauggauggugguaugucuuuggaaaaauggcacuaacugauaaaacaagaaugaaagaacagaaaaacauuccacgagagguguuuuacagcuggagaugaggaagaccauccucacaaauacuuagcagaacuugucuuuggcagguucuauagagugggagguaugggucccgagugugauggcucacgccuguaaucccaguacuuugggaggccgaggcagguaucucacuugagcuuaggaauuugagacuagccucggcaacguggcaaaaccccaccucuacaaaacagacaaacaaacaaaaaaccaaaaauuagccaggcaugguggugugugccuguagucccagcuacucagaggcugaggugggagauugcuugagccugggaggucgagucugcagugagccaucagugugccacugcacuccaggcuggguaauagagugaggcccugucucaaaaaauaaaauaaaauaaaaagagagugggauguauaaugauggaggguagaaggaaaguguguucaagagaaauagacuggauuagcuuaagaggcaguaaggaucaagaacuauagccacaggugaaaauaagguuugaaauggcuugcuuaaugccgcccaacaguggaaucccaucauacuccuggaguuagauucucaauuuagaaccuagagugaaaacuauauguuauaaaaaaaucauccuaaaauucuauaaauuacuccucaaaagacaguaucacauggccguaucuguuguauuggagacuggcaagccccagcucucaauauacacagcguuaacaguuacuagguugcugauuuucuuucauuuuuuuuuucuuauuuuuuauuuauuuauuuucgagacagagucucacucccucacccaggcugcagugcaguggugcgaucucagcucacugcagccucugccucccggcuugagcaauucuucugucucagccucccaaguagcuggaauuacaggugugugccaccaugccugacuaauuuuuguauuuuuaguagagacggguuuugcuauauugucaaggcugguuucaaaauccucacaagucaucugcccgccucagccucccaaagugcugggauuacaggugugagccacugugccuggcugaaaauauuugucuguuaacacuagcgucucauucaguucagugagaugcucauauuaugagaggcaugcaagaacugagacacucggagagaacagaaaagccccauaucucaucucacagcugucuaggggauauguucauugaguggaauugcaugugggauugcuuacacuacuuaaauuauuuucuuuuuuuuagcuuuuugagggcaugucuucauuuaaaauuuaaaaaaauuuuaaauuauuuuuuauuuuuugagacaggcccucgcucuguugcccaggcucuggaguggcacgaucacagaucacugcagccuugaccucuugggcucaaggauccuccugacuuggcuucccgagcagcugggaccucaggcaugcaccacuaugcccagcugauuuuuuuuuuuuuuuuuuuuaaguagagacaagagauggcuauguugcucaggcugguuucaaacuccuggccucaaucaauccucccagcucagucugccaaaauacugggauuacaggugugagccaccacaucuggcacacauaucuucauucuaaguaacagauuucaacuuguucuugacaaaaaaauuuuaaauaacagaaaagucuacauauuugauauucacuuuuucucagccaucuucucggcccuuaugucaggauaugaugaaaaugcaucauacauuuaauucauacagauugaagaugugcccugggcuggaugugauggcucaugccugugaucccagugcuuugggaggcugaaucuauagcuugaggccagaaguuuaagaccagccugggcaacauagugagacccgcaucucugcaauaaaaaagaaauagcugagugugguggugugcaccuguaguuccagcuacucaugaggcugagcugggaggaaugcuugagcucaggaguuugcaacugcagugagcugugaugaugccacugcacuccagccugggcaaugcaaugagacccugccucuuaaaaaaagagaugggccaggagcaguggcucaugcuuguaaucccagcacuuugggaggcugaggcgggcagaucaccgaaggucaggaguucaagaccagcuuggcuaacauggugaaaccccgucucuauuaaaaauacaaaaauuagccagguuugguggcaggcgccuauaaucccagcuacucgggaggcugaggcaggugggucgcuugaacccgggagcagaggcugcagugagccgagauugcaccacugcacuccagccugggugacagagggagacugugucucaaaaaaaaaagagaaagggaugaagauuugcguuauauuuggguuuuuucuuuaaacauauguguagcaguguauguguuuuuuuauaaccaauucaaacagucuuaaauuugugcucaugucuuuguuuuuaugcuuacauauuaacaauucugcaguacaucuugaugcauaggauucuuuggaucaauuucuggaaguggaguuaguggguuaauaaauuagaguggauaguuugaccuuucagauauuggcaguuguuaucccaaaagguagaaaaauaugaaugcuacauucuguacauauucaucaauguaaaauauuauaaugauaaauauuuuuugacuacugguaagauugaacuacuguuuacucgugaguuuauuggugacuuacauuucuaagguaaaaaucuagguuucucuuuuuucucccaucaccauuuauuguauauugauacacauugaucuuuuaucauauguauuauuauuaaauauuuuugagaccuguuccuagauuuucuaacuggguuuauuuauugaggucugauuuucgauauguguuuguauuaugccauuuuaaccaucugguguguaguaaugcauacuucuuacuuucaguguauuacuggauaguuugauccauauuuuacauaucuuugaacuucauagucauguucaauacgccuuucucccucuaaauggauauauagugggagugucagccuuugggauuuugaccauaauggcuuuaaguuugggauaaauugacauuuuugcaauauuuagcuuccccauccaggaauauaggcugucuccccauuguuucaggucuuauuugacuuucaguaagauggauuuuuuucacguguuuuauuuccaacuguuuugaauuuuuguauuuuguaauguuagaugaauuuucccuugaucauuuuguuauuggcccugcuagcugaugggaagaaaucaggaguacuaauuucaaauaucagauuuccaugguuccaagauauacuuuccccuaauauugaaauaguccuuauauucuaugaaaauuuuaauguaguuuuuauuuaccuugaaaacacauuuauuuacccugaaaacacauuuuaguuaugaugauauuuaugauuaugauuuaugauauauuuaugaggaaauaaggcauauuuucuauuaguauuuggauuuucuaaauagauaaucaaauccauuacucagguuauuuuugucuguuucagguaguuuacuucauguuucuuucgugcuucacuggcuagaacuuuuaacacaauguuaaauaguagaugguuguggaauucucucuuguuuuugauuuuaauaggacuguuguauuuuaggguuaaauauugaucuuggguuugguggaaauguucuuuuuuucuuuuuucuuuuuuucuccuugucuucuuccccucagguuugguggaaauauucuuaagaauguuaagaaaguaucccuccauuuguuuacuggagguuuuuuaaaaauaagaaauacauguuaaaauuaucaaauguuguuuguugaccuaguacuaagauuuuucucacuggaucuauuugugauacauuauguuaauaguuagccuaauaguagacuauauuccugauacauucguauucuuucaauauauagcgcugaauuuaauuugcuggaacauuuuaaaaggauuuuuuggggucauuuguuaguaagacugauuuauagcauucugucucccucuggcuuuuuuuuuuuuuuuuuuccuuugugaggguuugguguuacaguuaugcuagcucuaugucuaucuuuuccuggaacuuuuauuuucuuucauguuuuuauaggacugaucuguuguugaaagccuugcccaugaaauugucugcacucagcuuuuuugggguauuuuauuuuauuuuauuuuauuuugagacagagucucgcuguguugcccaggcuggagugcaguggcaugaucucggcucacugcaaccuccgccuccuggguucgagcgauucuccugccucagccucccaaguagcugggauuacaggcacccgccacuaugcccagcuaauuuuuuguauuuuuaguagagacgugguuucaccauguuggccaggauggucuugaacuccugaccucaggugaucccccggcuuuggccucccaaagugcugggauuacaggcgugagccaccgugcuuggccuuugggguauuuuaaauguacuuauucucuucuaaagucaguuuugguaauuuauauuuuccuacaaaauuguccugucuuuaaauuauuucagcuuaagaguuauucuacuauuggaccuguaugguuuuuuuuuuguauuuuuauuucuuauuuguuauauuuguguuuuccucccuugauuuucuugcuagagauuuguauuuuaguuuucaaagaauuggcuauuagauuuguucauucaauuuuuugaguugucugauucauccuacuuuuguuuguauuaauuuuuucuuauuucuguuuaccuuaggcuuguuuuauugucuauuuucuaacuuaaaaguuucauauguggauuguuuacuuacccuuguguaguaaugaaagcauuuaguucugagauuuugcuuguucucuauuuguuagaugaggcuguucaaauguugacaaaagccacuagaaagucucuuaucuuuuccuuuuagcucaguuuuguuuguuuuuucuuuguuuuuuuuuugagaaggagucucacucugccuccagacuggagugcaguggcacaaucucggcucacugcagccuccgccuccuggguucaagugauucuccuaccacagccuccugaguagcugggacuacaggcgcgugucacaacgcccagcuaguuuuuguauuuuuauuagagacaggguuucaucauguuggccaggauggucucgaucucuugaccucgugauccaccugccucggccucccaagugcugggauuacaggcaagagccaccaugccuggcgcguuuauuuuugauuauggaaguauaacaugccagaguauacaaauuauaaguguacaacucaaugaauugucccagggugaacacauccauauacccaaaauaaaggcagaacccuucuagcacucuaaaaauccccucacagaucuuaaucacuaacaccguuuauguuucccaaauuggaaauacuauccugacuucuaaucucauagaucaauuuuaccaguuuugaacucuaugaacagaaauguacaaauugggcccauuugucuggcugaugacuggguaaugggucuggcucaugauguuuaguguauccauguucuguguauuggugguucguuuauauucaugcuauauaguauaguauuccguuguguccuguacuaccaaguuauuauccauucuucuguugaugaauauuugguuuauguucaguuuuuggugauuaugaaaaaauauacucugaauauucuaguacauuuuugggcacaugcauuuguuucuguuggguauauaugaguauguaugcauaugcacaaaauauauaugagugaaacugcugggucauaaaaggauuuauauauucaguuuuaguauguuuugccaaccaguuucaaaaacggagguaccaauucauauuuucauuagcauuauaugugcuuuccaucuguuccacauccacccccaagaguuuaagccaaguuauuuagccaguggauuuagaaacacauauaugaaagcauauguuauaaauguacuuuauuucacuauggguaaggauuguggccuacauaacuuuugguuuuuggaaauuugaguuugucuuuuugaucugauguaugauugaauauuucauagggacuagaaaagucaaaauguccucucuuuguaggugucaaaguauaauagacauuagguuaauuuuauuauguucugauuuucuauaucauuacuuuuuauuuauugacuugacagagauaaggaaagauucucaguacuuuugacuguaaaaccucucaguauuucugucaguuuccuuuuauuuucuaaguuuuucuuuauaaacuucaguguuaauguuauuuggcuuaauggaugguuuuacaugaauuaggaauuacauuuuauugcucuaauaugggaauuuuuuuuuggauauuaaauuacauaugaccuuccuuaguuacaaaaaaaagguugauaauucauuaguauaucuuugccauaaauguagaaauaguuacauauucauguuacccuauaacaagaaguaaaauucaguaacagcagcgauuauauagcuaauuacauacccaagugauguucaggguaugucugcuauauuaguacuuaauuuuaauuucaaaaaugccuuuuaagaaguugcuaaaaugucuuaacagggaaauguaaugauuuucagguuuuuaaaaaugaacacacauaauucaggcauuauugugaauuauuguguauugaaaaauuaagaaaauucguugagucacaucaguuuccgaaagaugcaaacaaaugaaaaagggaaaaacaaaauccuucaauugaguacaauuuaacacaauacucucugugauuucuuucauacuacuuaacauaagcauagagguuuugcuuuuuaaauugagauauaauucacaucuagugaaaugcauauaucuuaaguguuugguuugaucaguuuugacaaaugcaaauucucuguaauccauuugccuaucaaaguauagaacauuucuaucaucucagaaaauuucuugggcaugccuuuucucaguuaauccuuauccucuccacccccuuccagcaacuacugauuucauauuaguuugcacauucugaaacguaaaauaaacggaauccuacaggucaugcuuuucuuuuguucuggcuuguuucacucaguaucuagcuuggagauccauucauauuauuacugacuagaucaguaauucugauugcuccacaaucuugccgauauugggugauacuaguuuuuuuuaaauuuugauuuuagucacucuaauggguguguaguauguacacauaguuuaaucauaguguauaugcagucucccucucacuucaguguuugauauuaacugaaugauaauuucugagcuuuuguaauaagacauugugugaguaaugacuaugguuugaauagucauuugaaaaggaauuugcauggccaguuuguuguacuguuguaaauuaagugaggaucauaaagcugaaagugaauuuagaaaucauuuaauagaagcuucucaguuuacagaugagcaaacugaccuacaaccuuaagugaccuauuuaaugauacacagcaagcuaaugcugaauguagguguaugauuuuugauugaauguuuuugaucuaaugcuuauuucuuccaaguuauuucagagauuguguuauuuuauuuucuuuguaauuaaugaauaguguuguuucacaauacuuucagaaaauguuuguuuuagcuggguacaguggcucaugccuguaaucccagcacuuugggaggccgauguggguggaucaccugaggucaggaguuugagaccagccugcccaacauggugaaacccugucucuacuagaaauacaaaaauuagcugggcaugaugguggacgccuguaaucccagcugcuugggaggcugaggcaggagaaauugcuugaacccaggagguagagguugcagugagucaagaucaugccauugcacuccaaccugggcgacaagagcaaaacucugucucagaaaauaaaaaauaaaauaaaauguucguuuuauaugaguuugacaaagggaaagagcuuaaaguaggcuccaucuaaauucccuuuucagcauuccuuuuuuucuccauauuucuggucaugcaagaccagaagagaagaaaaggaaaggugggaacaacucugagaaacuugcaguugagggugucauaagaacuccuuuuaacugguuucuucccauuugaguguuagaaugaauugaauucuauuguuuaacucggcuuuaauguuccuagguaugcaggugccuugagagcuucaggggaaauggcuucagcgcaguauauuacugcagguuuguauacuaaauauacuacuuuuugauaggaguaagacauucuauuuuucgcucacaauccuuugcaguuuacagaaugucuuuuguaaaacaucaccucauuaagccuggaguguacauuauacuuaaguuaaacaacuugguacuuauuuuaucguccagauuauaaaucaaugaugucugucguuugugaaaaauaaucuuuggauuuuuuuggauuaaauuauaauuuuggcuucagguuugauuuguauaauacauaucuuugggguugacucuggggauagccagcgacggguuuuaucauaauccauguaucauuauaaaagagggucuuagugaauauugguguaaagaagugaugugugugaggagaaauaguaaucuuaaaggauagaaauaacugguuucuucauugcauaagagaauauaacccccaccuaauuuuggacauuuuaauacuguuaaaucuuuggguuaggucaauaggguuuuacagccaugccuuuuuuuuuacucucucucuaacagcuuuauugauauaguguacauaucauaaaaucugcccauuuaaaguguauaauucauuguuuuuuaguuuauccacagaguugugcaaauauuacuaaaauguuaauuuuagaacauuaucauuccaaaaagcaacuucauaacaucuagcagucaccuccuuucccauuucuagcccuacccauuuaucuauguguuauuucucucuagauuugccuacucuggacuuuuacucuaaauggaauuaaauaauauguagucucuugugacuggugucuuucacuuaguauaauguuuucaggauucauccacauuauggcauguaucaguacuucauucuuuuuuauugcuaaauaagagugccuuguauggacaagccacauaucauuuauccauucaucguugguggauauuuggguuguuucugcuuuucgacuauuacaaauacuccugacagucguguacaagucuugguguggacaaaugcuuucauuucucuuugguaugcaucuaggaguggaguuaauuacugggucauaugauuacuauauuuaaccuuuugaggaacugccagaauuuuccaaaggagucccaccguuuuacauuucccccagaaggguaugaggguucugauuucucugucuccuuaccaguacuuaguauuguaugucuuuuugacuauagccauccaagagguaugaaguguuaucucauuguugucaaccauugauuuuugauauuauaaacagguuucuuuugugucauuugcaguuagagagauuuuacucuaacuuuuuuuccuaaaguagacuuacuuguugaaaugaaguuuuuagugagaaagugugaucauuuauaucuacuucauuugacagcucauguaucuuagaauaacuuagaauuucagcagcuucugcagcaucauauaugcggcuaauaguauugaugcgaugaaaaauacuguucuuuacauuuuugcuucuugauuuuuuaacuuuuuguuuugaaauacauuuaaauuuacagaaaaguuguaagaauucaccaguuacuaacuuuuagucgcauuugguuucucauuuuuccguuaugcauguaauuuuuuucugaaccauuuuagaauaaggcgccagacauccugaauauuucaguauguauuuccuaacaauaaggacauucauaaccacaagacaauucuuaauuuucagaaucugggcugggugcgguggcucaugcuuguaaucccagcauuuugggaggcugaggcgggcagaucacuuaaggccagggguuugagaccagccuggccaacauggcgaaaccccgucucuacuaaaaaugcaaaaauuagccggguguguuggugcaugucuguaaucccagcuacucgggaggcugaggcacgagaaucgcuugaaccugggaggcagagguuacagugagcugagauugugucaguguacuccagccugggcaacagacugagacacugucucaaaaaacaaacuuuuuuuuagaauuugggaguuucacacaguacccuaaaauacagucuuuauucagauuuugccaacuguccuaguauuguccauuaaaaaaguuuuuuuuuuuuccuucuucaggauucaguuuaagaucccacauugcauuuaguuguuauaucuuauuagucucuuuuaaucuauauuucuucuugaccuuuuucuuucaaacuaaugaaauacuuuugagaugcucuguugaugguauauacuagaucuuaaaucaucuguuuuuuugaguaguguauaaaauauuguuaaaauguaggcuuuuauuuaaaaaaauaauuagcuugguagugaugcccaaauuucagccuucccuccaaaaauauuuuuuaaacauuguguucaguuuuguuauucaggaacauuuuauugagccccugcuuugugcuaagaugcuguauuugguggguucagucuguauaaugaugauaggugacauuucacaucuuggguauuaauaaaacauacaaguugagauaagcuagaggaagaguuuugcuguacaugaaggagggcaagguaugaucacuaggaaguccgcagaggagaaaugguucgaaauccaagagaacagacuaguccaugacugugagauucaugcugcugagagggguaaguggaaagaagguuuucugaagaagguaaauucuuaguaguuuugguucuuagcuguccaguagagucagcuguuuaaggacccagauuuaaaucuccaggaguugaguagaugagaaccaacuauagguuuaaagggagguaaguugggagaggugacccgcuauccugaucuuggcagaguagcagaacaauuacauuaugccuguuugucccuaaacagagguuauguguucuuuguacugaauuaaaacacccugcuuuguuugggaagacaaaggcuggcaagaagaaagagagagggagggcucagaaguuguuuacagcuagugauugcuuuguaaggucuucuggugaguuaagauuuaaaaaggauuuuuuuuuuucuuauugagaguccaacaauugucaaagaguagauacacuuaaaaauguuuaagcagcugggugugguggcucacaccuguaaucccagcacuuugggaggccgaggcuggcggaucacaaggucaggaguucgagaccagccuggccaacauggugaaacccugucucuacuaaaaaaaaugcaaaaauuagccaggcaugguggcaugcuccuguaaucccagcuacucgggaggcccuucuguguucaagcaguucuccugccucagccucccgaauagcugggguuacaggcugaagugagcggaucaugaggucaggaguuggagaccagagccuggccagcauggugaaaccccaucucuacuaaaaaaaaaaauacaaaaaauuagccgggaaugguggcgugugccuguaaucccagcuacucuggaggcugaggcaggagaauugcuugaacccagaaggcggagguugcggugagccgagaucgcgccacugcacuccagccugggcaacggaccaagacuccaucucaaaaaaaaaaaaaauuaaguaaguuuuuguuuguauuaauuaaaauuaauuuacagucgcguguauuaaauaugugacuguuuuacuaaggcaauguuugcuuugucuuuaagcccuuagagauuuguuugauuccauggauaaaacuucuuccaguauuccaccuauuauucuacugcaguuuuugcacauggcuuucccacaguuugccgagaaaggugaacaaggacaguaucuucaacagguaauuagggcaagguauuuuucauucuguaaauguaaaacuuagguuuccuacauuuaccguacuuacuggaacauaguucgaaauauaaacaucagucuucucuaguucaugccacggcugucucuugccuggagccgcacaguagucuuaacugauaucuggcuucugccuuugccccuuugcaguuucucuacacagcccgcaauguccuuuuuaaaaugacgauaggauuauguuggccccuuguucaguacucccuagugauuuucuaccgcaguccuaaauccucuagccccuggcuuucucucugaguucaucacuaccacucugucccuugcuugccucucuccagcugcacaggcuuccuuaaaccuuucaagugcccucuuccugcagggccuuugcucuuguucuuuggcugucagauaagugcaagaccagcucccucaccuccuucaggucucauggcuccaaggccaaagccuuaggcuuucccugaugaccuuauuggaacagcacacuucccuuccccugaucacuuacuguuuccauccugcuuuuuuucgcuucauaacccuuaucucuacuugaauuuuauauauucacugcuauuaugcugaguaucuaguacaguguuuagcacaaauuggagcucagcagaugucuguugaaugaauaagcuauucuagaaugcuuuauuuuuuggaagaucguaugucuuauuuggcuuaauauuuuuaaagaaggaaaccacuuucuugccuaggagacagugauuauuuuggaagaacuuuguagaucauucacugccaggauuacuuacuuugucuuuuuuuacauuacaggaugcuaaugaauguuggauacaaaugaugcgaguauugcaacagaaauuggaagcaauagaggaugauucuguuaaagagguaauugaaauauauuugugauuauagacuuucguuauaccuugauuuuuuuuuuuauuuuuuuuccccucaaaggcuuaaaauaaguuccaucuuauagguagauguguauuuaaauacuuuagaugcucaaucuguagucagaauuuggaagcuugcauacgacauuuaaauuuaauguauuauuuauuaaacuuaauucauuguugauuuuugguaauguuuuuugaaggauuuuacuguaagggacuacauuuuuaaaaaaauauguauuacuaaacuggauuguguggaagaaaaucuacauuaauauuuauauaaaguuggaauuuuuauuuuaauuuuugcagacagacuccucaucugcaucggcagcgacaccuucuaaaaagaaaaguuuaaucgaucaguucuucgguguugaguuugaaacuacguauccuuaugagccaagauauagacuauacucauaccuuauuagaauuggcauaaauagcaucauuggcugauugauuggugguggguagaagaaaaauucuucagagguuuuuuuucuuugagacggaguuucgcucuugucgcccaggcuggauugcaauggugugaucuugacucacugcaaccuccaccuccuggguucaaacaguucugccucagccucccaaguagcugggauuacaggugcaugccaccauacccagcuaauuuuuuguauuuuuaguagagaugggguuucacccucuuggucaggcugguauugaacuccugacuuuaguugaucuacccaccuuggccuccaggugugagccaccgcgcccagcccagagguuuuuauaccuaaaaaaauacaauaauggaaauuaggaauuuggaaaaauauaccuauuggagugaucuugaaggauaaugggauuauucauuauguuuugauuaauauaauuauuuuaaauuuauuucuugaaggauauuuauuauuuuuuccuaagaacaucuuuagcagagucuaccucauuuucauucaccuuauaaagaauuaauuucuuauaugucaaggugacuguuaauaauaacuuuuaaaauaaaaaaagaauuuuuuaauuuuauaaaaggguguguaucaacuauacaugagauugaaccaguuaauaaaacaugaaucaggaaaguacugucuucuaggucaugguuagaaaaacuuagaaacaauuuauguaccuuugggcuucuaagaccauuauaagaccauacuaaauaccagcuuauaguuuagaguuuauugcaguuuaucuuuuaauacacauuuauuacucauuguuguuucuagaauuguugguagccaaaugaacauucuuaaguauguugaaaugaaucuugggagacuaaaagguuuuaaaugccaaugaaugauacuauuaauuuuaauggaauuaggauaauguauuauauucaagaguauauaacaaauugaauacccguuggcauauuccuuaucuuaguuuacaaagcaugaaauguacagaaucugaagaagaagaagucaccaaaggaaaggaaaaucaacuucagcuuagcuguuuuaucaaucaggaagucaaguaucuuuuuacaggacuuaaauugguaaggacaaucucaguccauccuuguuguuugugaauuccauguuugcgaguaagccaaagucauuauucacugggcuuuaauggucauuuguagacaugugcagagcaauacgcauuuugaguugcccgauacacacagucccaucugaggucaaacaaguacuuggccuucuuguuucagcuugguaaacaaauaccauuuuagcaggaauguuagaacuguuguuuuaaaaaaaaauuucugcuuuuuguugguuauuucacuguuuaagaugaccccccaagcacagggcugagugcugucuaguguuucuaggugugggaaggcugugaugugccuuacugagaaaauauacuuguuagagaagcuucaguugggccugcguugcacuguuggcucugaguucaauguuaauuaaucaacacaauaugugaaauaagguguccuuaaacagaaacacacauaaaacaagguuauguauugauugguugaugaaaauguugugaucaaaggcuggcgggaaucuaauccuguauuuccccuaggagcagugguucaguauucauugauucagugcuuguggugacuuuguagaacauaauuaccgugacuaacaaaaucaacuguauagucagaaaucaaacaaacuucaacuagcucuucauuucauagacaaaagcauuauugacaugguugcauaugcuaacaaauauugggacaucucacuuuuuaaucacuggguguuccugcuucacacugugaagaagcaccuagugcuuugugcuguaccuugcuuuauuuuaaagcacucaagaaauguuuguugaauaguuuacauguuuguuaagauuuuuccuuagagauaguuguuuucaugggcccuauaacuuagcugaacuguuaacuuuaaggaaaauuacuuaaucuaagcuacuguuuucuuacgugaaaaugagaguaacuauaggguuguuuguggguuugugcucuuaaccauuaagggugaucauauaauguauugucuaaaccaggacacuuugguggagagugaaugaggguauguuaguaauuaugcaauauaaacugggauuuuucugugcaaaucagggcauguagucguucugccauugcacugucuugcaguugaggcccuggaauuuaaaguaaccuaauuggcuuuuggcagagccagaacuagaacuugcuucuuucauuauucaguuagugcugcuuuuccagugccauacuaaagaauacggacucacauaaaaugucagcuuccacucugcuaauaagcccauggauaaaacauacgguuuugcuugcugacuuacuaauuuggugugcuuuggggauauguauaucucucgaaggaucuccccauuugaacugauaccuuuuaauaguuuucaaauuauaguucaugugauuccacuucaaaagcacugauaauuaggauuguuuauuuuauuuuauuuuauuuauuuauuuacuuauuuugagacggagucucucucugucacccaagcuggagugcaguggcacaaucucggcucacugcaaccucugacucccagguucaagagauucuccugccuuagccuccugaguagcugggacuacaggugcgugccaccacaccuggcugauuuuugguauuuuugauagagacaggguuuugucauguuagccuggauggucucaaucuccugaccuugugauccgcccaccucggccucccaaagugcugggauuauaggaaugagccaccgugcccagccaggauuauuuauuuuaaaaguuagcuucuuccuaaacacaguuguaugaaaaauaaaugcaugaauaaaaguuagccauugcaacaucuagauauuugaagaagggccuggagggcagaauuuuuaaaaauccugguugauccucuuugcugucuccucuaaccaugaccaauaaagagaagucuugaaggaagaaaagucagugaaaaaugaugagacauuggaauagguccucugugcagaggccuaguuugggcagaggagguggguugauaaacacugaagugggacauggauuauguugauaaacaagaugauuuguuaucugggggcucucaucuauaguuugggauaagguuggcaaggggaaggguuguuaaagggcauaagaagaagagugagugagucacgcucugucuuaugauaccgaggggagaguuuugagccaguguggauaugaacauggugacuuuuaagagaaauucauuuaaaaacacacaaaacuucuuaacccccaggagccaaaucauguaaggcauggugugcaaguuucaggauauaccagcaaaugaagucucaguguuaacuggagaguguggaguggagugcuuuggcagggacucuccaggaugguauuuucuucacaauuuuguaaaaguauaggaaaaccgaacauacccagaaggucuagaugauaguggauuggugguaauaauaagauuucaccagauauacuuucuugaaaaaccuguauuccuagaauguauuuauuuccuuuauaacuuuuaagauauuuuaucuuuuguucugauaauucuugaguaauuuggcuucguuucuccacugcuuugcugcugaauaaacuugguuaaauguuaaaaagcuacuccacagugauuccuuuuguaauaugauuaguaauuuuaaaaaaucagacuuuaaaauuauacaaguguaacaugcuuaaacauuaccaguagguuauuuuaauucuaauuucuuuuuuguuuguuuucuuaaagcagagcacauaaguagugcuaauucuuucugugacauuagaaauaguagugaauguuuguuaaauguagaguauaugccaaauauuuuaccagguuuucuacauguacugacuguaauucuaacaauaacacuauaacauugauuaccacuaccaccuuuuccaaaugaugcccagagggauaaauaccguuuccacuguuacacgggcuguaagaagcagaaaggugaucaugcugguuaagauaugugcagcagcuaaaggcuuucccacaucuguuagguuaacagagguuucuguguuaugacuuuuuucaaauuuaacaauaauucauuggugcugauuggcuuuuaugcauaaaacguaaagaacaggaguuucuugggcucucuuaauuuuccucuagagugaauauucugauaauaaacaggaaugacagcuuuguuauauaaaauacaauauaaaauucucugaaucuaagcaucauuuggggcauagcuaaaaaagagcaaacaguauuuacacucggaggaauccacaacaacguaaauuauuugaugccuuguaagaauugaacaguaucuaaaagucuucccauauugucaucaaauugugucucagugguauaaacccauugauguacuguauauugccucuuagguagugcuaguuuuuaaaaggcuuacuggugugauucuauauugcagaaauaaaauuuuuaaaacuaauguuuggucuucuguuauguucuuucuuagcgacuucaggaagaaaucaccaaacagucuccaacguugcaaagaaaugccuuguauaucaaaucuguaaguuaugcaguccuuucgaagccaaauuccgcuucacugaaauauuuccaguuaauuaauuuuauccagucuuaauuuuuaccaccaaauaauuaaaacuuguaugguauuuugauguaaugggauuucuuuacauuuugucuccucaguccaagaucagccggcugccugcuuacuugaccauucagaugguucgauuuuuuuauaaagagaaggaaucugugaaugccaaaguucuuaagguuaguaaugaacuuuacuuuguauaagaaauguaauucuuugaagguaauugcuaacucacaauugcuuucauuauuccuuuaggaauaguuaagcuuucuuugaaauauuuaggggagcuaauauuagacaagugauucuuaacucagaacguauauuagaauuaucuauugucuuuuuuauuuuuaacuguacacacaccuggcuucucccucacccccaaacaucuggguaggucuucgguggggccuaggauauuauauuuuucaaaagauucauauacaauucugauggcucuccugcacuacccagaaauagugcccuagaccacguccucagcuucagggauacugauucaguaggcuuggagaugggugugagguagggagugauaacucugcacuauacucuaggugguuucuuucuuuuuuuuuuugagacggagucucgcucugucacccaggcuggagugcaguggcgcuaucuuggcucacugcaagcucugccuccuggguucaugccauucuccagccucaaccucccgaguagcugggacuacaggcgcccgccaccgugcccggcuaauuuuuuuguauuuuuaguagagaugggguuucaccguggucucaaucuccugaccucuugauccgcccgcuuuggccucccaaagaguuccuuucuuucaggugaaaggagaaagaguuaaaucacuggugcccaaagaguacuuaaauuguaaucccuugauuuaggauccagccucagaaucugacuguuuuuguugaguuguaguucugcuacaucuccauagaguccugggaggggccuaucuaucauuuuagccuuuugagcuuaaauucuuaguauauuuuccaguauacuuagcguuguaugagaagguuaaauguaguugaaguaucuaguguuguauacuuuaaauauauacuacuauaagcuauugaacuauaucacuauuacuucuauguaaaguuguauuucaaauaaaaaaaaaaaaccauaaguuuauuccaguuugggagguccauuauuuucacagcagcuuguccaauauuucugagauguuucuuuucucagguaaauuuugguacuuccucugugguuaguuuuguggguuagaguauuuaauggaaaaacauguuuuagaaauuucucaccuuaaaaaaguuagaaccagaucauucuugaaaauaggcacucuuaagagguuucaacugcagauuuccaagugauuuucacagauuuuauuuucaacuguaucugaauuaugaaagcauuacuucagauaugugauacuuuaaauaaauaucuuuauaaauguguuuacacauguuuuuuguuuguuuguauauaggauguuaaauuuccucuuauguuggauauguaugaacuguguacaccagaacuucaagagaaaauggugucuuuucgauccaaauucaaggaucuagaagauaaaaaagugaaucagcagccaaauacaguagguucuuacugcugacuuuauacucuuaauaucuuaaucucccaucagugcucagcaauuacucugucuuuuuuuuccugcuucauuuuuccuucagaacuauacuuuguauaguauuauuuggaucaaucuguauuacaauuagcagguauacacauccuccauauaucagugcagaucuuuaaaguuuugcauguguuuuauuuuccuuuuuuuuuuuuugugacaaggucuuccuuugucacucaggcucacugcagucucaaccucccaggcgcaaaugauccucccaccucacccucccaaguagcugggaccacaggcgugcgccaccaugcccagcuauuuuuuuguauuuuugguagagacaggguuuugccauguugcugaggcuagucucgaacuccugagcucaggcgaucugcccaccuaggccucccagagugcuggggauuauaggcaugaggcaccacaccuggccuuuagguguauuuuagcaugagaaacagaacucuacuuagaauaaaugaguccuuugugguagaauaagcuuaauauuuuccuucccccuguaaucuguagcucauauuccuuuuauacuuaucuccucaaaguacuucacguaaaaccuuaccuaguguugaccuugaugcagucaaaauacaguacauuuccaucaccacaaagaucuugcauuauugccacagggccacuuuucuucugcccuaccccuuccuuaauuccugacaacuaccaacccguucauuucuauaauuuuugucauuucaagaaaguuggccaggcaugguggcucacgcuaguaaucccaggacuuugggaaucugaggcaggaggaucacuuuaggccaggaguucgagacuguccugggcaacguagugaaacccugucucuacaaaauaugaaaauaaaaaaaaucaguuggaugugguggcauacaccgguaguucuagcuacuugggaggcugagaugagaggaucgcuugagaccaagaguuaaaugcuguaaugagccaugauugugccacagcacuccaaccuguauaacaaagcaagacucuguuucuaaaaaaaaauuauacaaacgaaauaaaaacucuuccacuuuuuaauauaaccuuucucacucagcauaauucucuggcgacucauccaggguguugugcauaucaguugcuccuuccauuucauugcugaucaguauucccuggugugaauuuaccacaaucugcuucaccauucaccuauugaagaacaccuggguuguuucuaguguuugucugugaugaauaaaccugcuguaaacauucguguacagguuuuaauguaaacguaaguuccauuucucuggaaugaaugccuaggaaugcaguuguuagauugcaugguaguugcauguuuaguuuuucaggaaacugccagauguuuucuagaguggcuguaccauuuuacauuuccaccagcaaggugagacugauucacuuucucugcauucucaccagcauuugguguugucacuauuuuucauuucagccauuggauagguuuauagugauacuguguuuuccuuugcaccuuccuaguggcugaugaaguugagcaugucuucauguguuuauuugcuaucuguauauccucuuuuguaaaaugcuuccucuugucuuuucccuauuuucuaauuguacuguuuuuuuacucuugaauuuugagaguucuccauauucuagaccuuuguuggauaugugguuugugaauauuuucuccuagucuguagcuuauguuuucauccucuuaaccuagggucuuuugcagaagaaagguuuuuuuaauuuuuaugaaauccagucuauuuuuuucuuuaguugcuugugcuauuggugucauaucuaagaaagcauugccgggcucggcaugguggcucucaccuguaaucccagcacuuuaggaggcugagacaggcagaucacuugaggucagggguucgagaccagccuggcaaacauggugaaacccugucucuacuaaaaauacaaaaaauuagcuggguaugguggugcggaccuauaaucccagcuacuugggaggcugaggcaggagaaucgcuugaacuggggaggcagagguuguagugagcugagaucacgccacugcccuccagucugggcaacauugcccaguccaugcccucagagauuuauacguauguuuuuuucugagaguucugugguuuuaguucuuccauuuaggucuuugauccauugaggguuaacuuuuuauauagugugagguguggguucagauucauuguuuugcaugugaauaucugguugucucagcaccauuuuuuaagaagacuguucuuugcccaucagauggucuuggaaccuuuguagagauuaauuugaccaucuguauuuaugaguguauuucuagacuauuaauuuuauuccauuggucuauaugucuguccugaugcucauaccagacugacuugauuacuguaguuuucuaauaaggcuugaaauugugaaguaucagccuucacuuuuguucuucuuuuugaaaguuauuuuagcuauucugagucccuugcauuuccauguauauuuuaggaucagcuuguccauuucuucaaaaaagauugacggggauuacacggaaucuguggaucaauuaaaaaguauuacuaucuuaauaguauuaagacuaaucucagcacuuugggaggccaaggugggcagauugcuugaguccagaaguuggagaccagccugggcaacauggcaaaacccugucuccacaaaaaauacagaaauuagccaggcgugguggcgugugccuguagucccagcuguucagaaggcuaaggugggaggaucacuugagcaugggaaauggaggucauagugagccaaaauggugccacugcacuccagucugagugacugaguaagacugugucucaaaaaauaaaaaguauuaagucuuacaauccauaaacuucaugugucuuucuauucauuuaggucuuuaauuuuuuucauaauguuuuauaguuuucaguguacaagccuuggacauuuuugguuaaauuuauuccuaaauaguuuauucuuuuugaugcuuuuguaaauggcauuccuuucuuaauuucauugucuagaguggcuaguaaagcuagcauauagaaauaaaauuaacuuuguauauggaucuuaaauccuugacuuugcugaauuuauuagcuguuuuuauccauuaguguuuugaagagauuauguagaauugguguuaauuuuuuuuuaaacauuugauagaauugguggaacagucugcuuagagauuuuacuuucaggaguuuuauuuguuuauuuuauuuuauuuuauuuuuauuuauuuuuuuucuauugccuaaacauaggcaggcacauuuucaggaguuuuuacauuucaaauuuaauuuccuucauagauauagggcuauucaaaugaucuauuucauauuguguuuguuuuuguaaauuguuuucccagaauugauccauuucauaagcuuaucaaauuuguauguagaauuguuucuaguauuuauuacccuuuugaugucuguagaguguuuagugagugagauccaucccguuucauugcugauauuaguaauuuguguuugucccccuugcuugaggauuauuaauuuuauugauaucuucaaagaauuggcuuuguuucauggauuuuucucuauuuucuguuuuuaguuguauugauuucugcucuuauuuccuuuauucugcuugccuugugauauaaauuucccuuucagcagugauuucacuauauccuaugaauuuugauacaugguauuuuuauuuucauucuguuccuuguauuuuuaaaaauuuaucuugagacuuccucuuuggccauugguuauuuagaagggucuaaguaauuuuccuguuauguuucuguugauucuaguuugaugccauuguggugacagaacacacuuacuugauuuaaauucuauuacauuuauuuauuuauuugagacugagucuugcucugucgcccaggcuggagugcauagguacgaucccggcucagugcaaccucugccuccuggguucaagcaauucucaugccucagcgucccgaguagcugggauuacaggcgagugccaccaugccuggcuaauuuuuguauuuuuauuagacacaggguuucaucauguuggccaggcuggucucgagcuccugaucucaagugauccacucgccccggcguaagccacuauacccggccuaaauuauauuaaauuuaaaugugauuuagguauagacuauuuacauuuagugcaaucaucgacauguuaggguuuaauucugcuuuuuugauguuuugccuuuuuuuuuuugucuucuuguggguuacuugaacuguguuuuagaauccuguuuuacuuuauguuuuuaaauguguuucuuuguauaguuuuuucagugauugcuguaggugauuucauuaucuguauaaaaaagaugugauuaaccuaguugccauuuuuuguuguggaauccuuugacuucuugccaucacagcuaccuguaagcugcuggcauugucuucauuaccauuauaguuuuaaagaacuuugugcuguauuccuagauaaguuauuuuucucauguugcaugcuaaaaugaguugaagcagugaguuccuccuaagaguccuugucuaauuuaaaucauaccucuuuaauguagguaagucuuugcugaaaaauauuucaguucauuugugcuggcgugguaaguggacauggcucaggagguuuaauacaaauugcaggaauucuuguuuuagagguaguuguuuuuuccccccaccucugugguuugacaguauuuugguaacacuggggaauuggguuuuuccuuuucugcccuagagcacuguuuaacuguacugcuguauucacugguacgcuuucacuuuaaugguuuaaaauuggucaucacauucagggugucuguuacuguacuguaacaagauuuuauauuguugaaguguaggacugcuggguuuacaguuuuaacugugguuauaucauuuuaguaauuuggaagguagacuguauuuugucucugugcacuguagacaguaaauauuuaugaaauugaacacuuacagagaauucaaauuuuauuuccaaaaucaugauuuaaaauuaaacauuuuuuucuccucagagugacaaaaagaguaguccccagaaagaaguuaaguaugaacccuuuucuuuugcugaugguaaguaacauucucauuuuaauugaguuauuguaugugggucuuuuuaagguaaaauuuacaucuuaccccauauuuacuuauucugaugugcuuuucaaacaaaaugucagguuucuugaacaauuuaccuuaaugacauauaguaaauuuacucauuggcauacaguucuaugaguaaguuacuuauuaaaacaucaaucaugaagccuuaacuaugauuggacaguaguaucuuauuggauucugauaauacuuucguaaugugaacuuuagaguuauucuuguuacuuagcuugagaaggcacaugucuauucauugucuaauauuaauggauuuacaucuuucuuuagauauuggcuccaauaauuguggauacuaugacuuacaagcaguacuaacacaccagggaaggucuaguucuucaggucauuauguaucaugggugaaaaggaaacaagguaaaggguauucuuuuuucaacuguucaauauuauuuuaacaguucauuuauuauaaauuuuauagcagugugguuuucaaacuuugggucucagaaccacuuuacauucuugaagccccaaagagcuuugguuuaugagguuugccucucuuaauacuuacuguauuagaaauuaaaacugagaaauuaagaaaguuaguuuuaaaaaugauaguaauaagcccauuacauauuaauguaaaaacaaaaugagugagaaaugguacugauuuacauuuuuaugucuuucuguugucuggcuuaaauaggaggcagcuggguucuccuguuaguguucgcauucagucuguugcauuaucauacauuauguagccucuggaaaauuccagaguacacuugagagaauguggguggaaaaggcaagcagugcucuaguggugucauugaaguaguuguaaccugguggaaccccugcagugcccuuaagccuguguggucacugggucgcacuuggaggacuguugguguggccaguggagcacugcugugccuccgaugacuugauacuuuuuuugcaguggaacucugagacgaauccugcauaacauuaauucaucuucuugucccuguuauuuagaugaauggauuaaguuugaugaugacaaagucagcaucguaacaccagaagauaucuuacggcuuucuggugguggagacuggcauaucgcuuacguucuacucuaugggccucgcagaguugaaauaauggaagaggaaagugaacaguaaucuucauuuuaguauuuaugcuuagaugugaaaauaaauguuauuuguugaucauuucuauaauccagagcuuuagaggaagacacauagguggguuuauguuucaccucauuuggaacaaaagaggacagaagcagaccacucugugcaccaaccuaaaaaauuacagagaagagaaaauuaucuuuggauugugcugcccuauauaaagguggcagaaagacauuuuuaaaaagcuuauuauuucuugcauuauuuuaaaaaguucagaguugaaaugccuuucaaccauuuccuucuguggucauuuuucuugcugccuuuuucacccaagauucagcagucagauguuuacugcacaccuauuaccuauuauuugcuguucuugcaugguucaaaccaccauucuguagccacccauccuuugccuuaucuaacaaacauuuuuccaggaagguggaaaaggaaguguugcucucauugugugacucagugcugcuguccaucccauggaaacaugggcacaaucaaguauuuguccagccuauugcaggcuuuuccugacuuuaaaauaaauugugaucaauaauaguaccuuugauuauacauuuauuauugugucucucucugauguacuguggauuguacauuuaacuuuggaauggcuuuguaauaaucagucuuaagaaaauguugacaagcucugguugcuuauuuuuagaaaaugaggacauuuaauaauaauaaaaaaaaagggauuaauagcuuuugaccucaagucuuuugucuucugaguguuggagcuuggcugaagacauguuuaauacuguacaauuucugaagaugguuauuaacacugugcuguuaagcauccauuuaaaaauauuuguuaucuucuuugccugccuguauuuuaaaaagaaauacaaaguuguaaaaguaauggauuucuuuggaugcugaaugcagugauguuaucagucagauucuuuccuuggcucaguuguguuuguauuuccuuucuuaauuccccaaaucuuggcugggcacgguggcucacgccuguaaucccagcacuuugggaggcugaggcaggugguucacuggagguugaguucgagaccagccuggccacauggugaaacccugucucuacuaaagauauaaaaauuagcuggaugugguggugcacaccugugaucccagcuacuugggaggcugaggugggagaauugcuugaaccuggaaggcagaaguugcagugagcugagaucacaccacugcacuccagccugggugacagagagacucugucucaaaaaaaaaaagaaaaaauucccaaaucuuaaugucuguuucagaauuuuagugauuuuaaagugauaguagaaaauaccaagcauaugagguauuucaauaugauaggcuucuuacauuuuaauaguuacucaucuuuguuccaggacccuugacugaugcuagggaaaggauaaagcauagaauaccagccaguuuggcucugauuuugaguuauuuauaauaaaguuuggggauuaucauaacaucucauaucuuuguguauguuguuuuaaugcucggcagagcacaacacugaugauaacuauuaaaaauagaaaauaacagccauuuuacuuucaaaucugaugugaugcaaucugugaacacuaggaggggauaaaauaagcauugcagggaaacuuauuuguaaauagcuuccucaccuaaacuuugacuuggcaaucaauacuuucuacuuuguggaggggauuaagaauagaaugggcaggaugagaccaugaaaauuauaaugauucauguauauuuguaugaugcuuguaacuuugcaaagucuuuuuuauucauugucucauuuggucagaacaauuuuauugaggacaugaauuuaacaauuagaauuuagauuuucugacuguagcuacuaaauguuguagcuacuagaccaggugagcuagguuuagagcaaaguauauaagccuuguauggacuauauuagaauuuuaaaaauuguaauuaauuccuuaucaucauuauaaaaagcuugauuuuuuuauuugaucuaaaaaagcauuauuccaaagaauuuuuucaaguagaaaugggaguuaguuauaccaguguuguuuuuaacuaauaaggcuauuuuagaauucagccuugccuguaaggucuuugagaagggagaggaguaggccaaaaaaaaaaaagucuugauuccugaaugugccuuauaugcugugccacucacaccgaggccaucaucucaacauuagaguugugcuagauuacugcuugacugacuagcuagguuaggccuaagaguguuuaccgaauaaucugcacucacucaguagcccuucuucaggauuaaaaacgaugaugaccucaucuuagagcccuaaagggaaaugcuuau

SEQ ID NO: 192735 - RNA, 17949 nt, Homo sapiens
agugcuccgcgcgcucuugacguccggagccccuggaguaggcgcuuccggccauucauacugcagucggucaguguucgguugaaggauucugugugcugucggacccagagggugacggcgccgcuaggaugaagcucgugaggugagggagugaccaagcagcucugggggcugugaagggagggcuuggcccggaguccggaaggcugggcucucccauuugcaggaggcgggaaagccgcgugugcgcggccugcuaacggccggccuuacugcgcccgcagcucgugcucgggccugggcuuccgccugggucgcucgcggaucccgcgugucuuccaagagauugguauaaaggccgagccuuuucuuccugccuagugacuuagaggcuuuaaagaugcagcgccuccugggacacaucucccucuuacaguuacucauuuucuuuuugaguggaacuccccaguccugcuuaacaguacuuagaaagcuguaugagcuuaucuggaaacaaaccuguuugcaaaauauuuuaaaucagagaaggacuuccggcuucacaaguuuuuguuuuuuuaaauaaagauggugucucacuuuguugaccaggcuggucucgaacuccugggcucaagcuuucugcccgccucgcccuuccaaagggcugagauuacagguuugagccaccgugcccggccgauuuuuaaguuuaccuuuuuauccuccuuagauuugugauugauuauuccaccucuauuucccuuuaagguaggcuuuuuauuuaggaaaaucucccaauauagggcagaaauuaucacaacguaauuguggcugauuacucagauaauauauaguucuccuguuuuauuucuuaagaaauaaauagacccugucaguuaggugagucuucugaaaacuuguuugcugaugugaauaauucuaaacuaccugcaaguagauuugguuuugguguuuuuccuugagacuaagccuggaacagaggcagacguuucuaauagcuaagccagcaauuauaaauauuuagcuuguuuuuuuccuguugagucaaggauugucaauauccgcuaaauaguuauugggcaccuguuacauacuaggcgcugguaauaggauuuuuuaaaaggcagaguaccugccuuguuggaguuuucugguuaguggggaugacagacaaguagauaacgucugaaguaacguuuguuugaaacguuuuaaauaacacauaaaagccuucaacacucagggaggaggccaggcgcaguggcucacgucuguaaucccagcacuuugggaggccaaggcggguggaucacuaggucaggaguucgagaccagccugaccaacauggugaaaccccgucucuacgaaaauuacaaaaguuaguggggcgugguggcgcgcgccuuuaaucccagcuacucaggaggcugaggcaggagaaucgcuugaacccaggcggcagagguugcagugagccgauaucguggcacuacgcuccagccugggcgacagagcgagacuccaucucaaaaaaaaaaaaaaaaaaaaaaaauuauauucagggaggaguugguacaaaagacauuuaagguuaauuuuugguauauuuuuauuugaacuauaacuuuggauaggaagucauagaauuuaaagugcauuuuuuaggcuggacgugguggcucacgccuguaaucccaacacuuugggaggcugaggcaggcggaucgccugaggucaggaguucaggaccugccuggccaacguggugaaacccauucuuucgaaaaaauacaaaaauuagccgggcaugguggcgggcgccuguaaucccagcuacucaggaggcugagguaagaggaucacuugauccugggagguugcagugagcugagaucgcaccacugcacuccagccugggcaacagagugagacucggucucaaaaaaagaaaauuacauuuuuugaaauuucuccauaccugccaaucugaaucuuaauccacucauaguucaauuuuguguaauacaccuuggauuccauuuguucccuuuaaagauacugcauguuaugacaauuuuccaguaauuuuuaauaccuguacugaauccuguuuugugucuuagguaaaauauagaaacaaauuuuuuuucuuaccagagaauguauuuuuccuccagaaaaugauuguuugacuaacugguuugcauuuucaguagauuuauuucuguaucucaguuggcagcauugucauccuuauucucacugucacccuaaccaaaaaccugggaggugagcuugacuuuuucucuccugauguccuugacauuugauacauugccaauuuugccaguuuuaccuacuucauaaaagugacccacauuauccuguuugguuuuuggguucaaauaguguguuuuauacugagggacacuguguuacuauuugauauccaaguuucacuaaguggaaagaauucagacagugaaagauucaucugaaaauaauuugaauccauuugguuccugggcucaguuagggagggauaauuguguauuuguccugcccauaguagccuuucauuccagucaccaccauuaaguucaggcccuuuuuaucccacucauggauuuuuguuuuccuucuuuaagguaaauaucuuauacaaugaaaugcaguguauauuuccugcuauugaaaaauguaaacacuuuuguaaccuaaacccauaucaacagaaguaacauuaccaaaaccucagacaguuuccucaagccuuucccaggcaaccucuggcuccauaccccuagaugcaaccaguuucuuccaccagaaaugaauuuugccugcgcuagaauuucauauauuuggaaucacaaaguauuuuugcguaaaacuucuuuuaguuacauguuuuugagauucauccacauugugaaguguaucaguaauguguucauuuuuauuacuggauauuagugcauuguguguuuggaaguucuguauuuuaggccgggcgcaguggcucacgucuguaaucccagcacuuugggaggccgaggcggguagaucaccugaggucaggaguuugaaaccagccugaccaacauggugaaaccccaucucuacuaaaaauaccaaaaaaguagcugggcaugguggcaggugccuguaaucccagcuacaagggaggcugaggcaggagaaucccuugaacccaggagguggagauugcagugagcugagaucacgccauugcacuccagcuugggcaacagagcgagacuccgucucaaaaaaaaagaaaaaagaaaaaaaaagcuccguauuuuaaaaaauuacaagaaaauaaaauaaaaaguuauguauuuuguuuacaacuacguugaauauucuucagguuuuuggagggaaacaaauuuucguggguaaauacucgaguggaguugauggacuguaacauaguuauguguuuagcuuuuuaagaaauuuccagaccauuuuccaaagugguuguaccauuuuacacuuccauuaacaauauauuagaauaacaauugguccacauccucaccaguaugugguguuguuugcucagucuuuaauuuuagccauuuuaguggguauguagugguaucuccuuaggguuuagucgguuuuuugcuuauuuguuuguuuuugaggcggagucucacucugucacccaggcuggagugcaguggcaugaucuugguucacugcaagcuccgccuccuggguucacgccauucuccugccucagccucccgaguagcugggacuacaggcgccugccaccacgcccggcuaauuuuuuguauuuuuaguagagacgggauuucaccguguuagccaggauguucucaaucuccugaccucgugauccgcccgccuuggccucccaaagugcugggauuacuggcgugagccacugcgcccagcccagaguuguagaaauuagaucuguguccuggauaccaguucuuugucagauguguuuucucucagugugugguuuacauguucauuuccuuaauagugucucucuucuuguagcucaggcuggaguacaauugugcgaucucagcucacugcaaccucugccuuccagguucaagcgauucuccuaccucagccucccaaguagcugggauuacaggcgccugccaccacgccuggcuaauuuuuguauuuuuaguagagacaggguuucaccauguuggucaggcuggucucgaacuccugaccuugugauccacccgccuuggccucccaaaguacugggauuacaggcgugagccaccaugccugacugaucgauuuuuauguaucuggaacucuuuaagucuuuuuuuuuuuuuuugagauggagucuugcucuguugccagacuggagugcaguggcgcacucucggcucacugcgaccuccaccucccagguucaagugauuccccugccucagccucccgaguagcugggacuacaggcaugugccacuaugccuggcuuauuuuuuuuguauuuuaguagagaugggauuucaccacuuuggccaggcuggucucgaucuccugaccuugugaucugccugccuuggccucccaaagugcugggauuacaggcgugagccacugugcccagccuauaucuggaacucuugggcucaagugacuaucauccaucuuggauuacuuuuggaaaaugguguuagugguccagguucguuuuuuuucuguauggauuuccaguuauuccagcaucauuuguugaaaacacuuuccuuugccuguuacacgucuuuggcaccuuuguaaaaaaucaaccauauaaggccaggcuugguggcucaugccuguaaucccagcacuuuucggaauccaaggcaggcagaucaccugaggucaggaguucgagaccagccugaccaacauggugaaaccccggcucuacuaaaacaaaaagaaauacaaaaauuagcugguugugguggcgagugccuguaaucccagcuaaaucaaccauguaaaugugggaccagaaauagaucuguuugcuuguauuguuucauugaucuauuuguuguuccuuaugucucgauuacuguaguuuuaacuuguauauguacugcucuagucacauaauuugucuuccuagagauuauacuuuggucucuugucuuucuaaaaucuguuucugaacauuggcccuagguucucuuuuaaaugugaauaugagccugguacuccacuucauugaugaaaauccuucaguagcucuccuagaggaauucuuuaacagagcuuaggcuuuccaugaaaggaaccugccuaacuccucucuacucauaggaccuaaaauauugaacuuaacauuucaucggccaggcguggugguucaugcuugucaucguagcacuuugugaggccgaggcaggcagaucacuugggccaacaugguaaaaccccgucucuacuaaaaauacaaaaauuagcugggugugguggcaugcgccuguagucucagcuacuugggaggcugaggcacaagaaucucuugaacccgggagacggagguugcaaugagcucagauugagauugcgcuauugcacuccagccugggcaacagaacaagacuccaucuuuguaucuauaauuacucugugucuuaugcuguauuuuuucuuuuguuucuucuugcugcauauuuccaacuuuucaggcuucuuacuaggaguccccuaauaccugacuccccucuccacaugcuacaauauauucuuaguaaaaaaccuguguguagcugggugcaguggcucacgcuuguaaucccagcacuuugggaggccaaggcaggcugauugcuugagcucaggaguuuaagacuagucuaggcaacauggcaaaaccacaucucuacaaaaaauuuaaaaauuuaaaaaauauuagccgggcaugguggcauagucucagaaaaaaccuaaacuaaaaaccucuguuuaaaaaaaaacacaaaaaaaaccucuguauaucuuuauugcuuucuacaacuuaguuauuuuuacguaucuuuuauguaucugagccaccgcgccuggccacauaagguuuuuuuuuuccuuuuauuuaucuucuuugcuuccaaaaaugauuugaagaacuuuuauaguaaaaguucuuacuaacugggauaguaaauucguguaaaagauaaaaacaaaaacuugauaaugggaggaaaccauuaguucagaauucuaggcuuuucuaguuauaauugauuguuaaauuuggagcugaauaacucucuggugaaauaaaguguuaccaauucguugagaaaaacguuuucuugaugucauauauaaaaagagauucaacucaugagucuucuuaaaguuugaggcuuguuauaucccagaccaaguaauuucuuuuuugugauggcugucuauaccacuaaaaaaaaagaaauuaaaaaaaggcauuuuaagguugguuucccuuuauucauuaaaacauuucagccaacauuauucagugccuauuacagucuaggauuagauauagagcuuacgaucccuacccucaagaauagucuagugcgggaggauaauagguuaucuuauguguaccauuuagugugaugauaggaucuguuaauucaaaguauauauuauagacuaaaaguuuuuauaugaacuguguauuguaugauagugugggguucauuuucuuagaugugauugugagauuaugguuauauaggagaaugucauuagaaaaugcaugcugaagugucguaaugccuacaacuuacuuugagauggugugaucaauuuuuuuucguuuguuuuuuugacaaagucucacucuauuguccaggcuggaguuuaguggugcagucuuggcucacugcaaccucugccucccaggcucaagcaauucuccugccucagccuccccaguagcugggauuacagucaagugccaccaagucuggcuaauuuuuuuguauuuuuagcagagacgggguuucgccauguuggccaggcuggucucgaacuucugaccucaggugauccgccugccucgcccucccaaagugcugggauuacagggaugagccaccacaccuggcgaagacugucuuuaaaaaaaagggccaggccugguggcuuacgccuguaaucccagcacuuugggaggccaaggugggcagaucaccugaggucagaaguucgagaccagcccaacgggugaaacccugucucuacuaaaaauacaaaaaucagccaggugugguggcaggcgccuguagucccagcuacuugggaggcugaggcaggagaauugcuugaacccaagagguggagguugcauugagccaagaucaugccacugcacuccagccugggugacagagcgagacuccgucucaaaaaaaaauagaauuuuaaaaaaagacggagucuugcucugccacacaggcuccagggcagugacacagucauggcucauugcagccucaaaguccugggcucuagcgauccucccaccucagacuccgaggagcugagacuacaggcaugagccaacaggcccagcuaauuuuuuuauuuguauuuuuuucgagauggagucuugcucugucacccaggcugcagugcaauggcaugaucuuggcucacugcaaccucugccucccagguucaagcgauucugcugccucagccuccugaguagcugggauuacagaccugcaccaccacaccuggcuaauuuuuuguauuuuuaguagagaugggauuucaccauauuggccaagcuggucuccaacuccugacauugugacccgcccaccuuggccucccaaagugcugggguuacaggcaugagcuaccgcacccggccaacuaauuuuuuuuuuauuuuuauuuuuguagagacaggaucuugcuuuguugaccaggcaggucucgaacuccuggccucaagugaucaucccaccuuggccucucaaaguggugaaauuacaggcaugagccacugcacuggcaauugacaauauuuguaaacccuuuaacuuuucauccucugcaaaauuuuauaaaaaggggagaacggaaauuuagaugaagugagaaguggauagauuguucauuauauauuaucaaggcaacuggcuauucaguuggggaaaguaauaaagacagauuugugccuuacacugcauaaaaaagaucaauuccaaguagauuagaacucuaaaaguagaagaaaauaagacacuauuuuuuuacaaucuuggcauagaaaaaacccuuucuuagguaaauuauguaucccaggagggugaacaaauucaaaacauaaaagugaaaaaaguuugugugacuaaagaaaccauaaacaacaaacuugaaugacuggcaaaccaguagaaaauaaaagaaaaacucaaccuaauugagaaugucaauaaugugaacagguaauucacggaagaaauaguuuucccauguuaaugaaaagauauucaggcagggcgcgguggcucaugccuguaaucccagcacuuugggaggccgaggcggguggaucacgaggucagaagaucaaggccaucgugguuaacauggugaaaccccgucucuacuaaaaaaaaaauacaaaaaauuagccaggugugguggcgagcgccuguaaucccagcuacucgggaggcugaggcaggagaauggcgugaaccuaggaggcggagguugcagugagccgagauugugccacuacacuccagccugggugacagagcgagacucugugucaaaaaaaaaagauaagauauucaaucucacagguaauuaaggaaaagcaaauuuuuuccccaucaaauugacaaaaauuugaaagacuuauagcaacuuguguuggugaggguuugcauaauuggguuuguaaugggaaaaaauugaaccaaaguaauguccgucaacaggcgguaauaaauuuugacauuuccauauaguggaauacuuuccaguucuuagaauguuauuuuguuauuuuggcuuuuugugagauggagucuugcccugucacucaggcugggguacaguggaacaaucucaccucacugcaaaugcugccucccggguucaagcgauucucaugccccagccuuccaaguagcugggauuacaggcgugcgccaccuugccucgcuaauuuauuuuuauuuuuuuuuaauuuuuuuugagauggagucuugcucuguccccagguuggagugcaguggugcgaucuuggcugacugcaaucucugccucccagguuuaagcgauucuccugccucagccuucugaguagcuaggauuacaggcguacgccauccugcccagcuaauuuuuguguuuuuguagagauggaguuucaccauguuggccaggcuggucuugaauuccugaccucagaugauccgcccuccucggccucccaaagugcugggauuauaaauaggcaugagccaucacgcccagccucaguucuuagaauguuuuguauguugaaauggaaauauguccaauauaaacugcuaaacgaggacuacaaguuauagacgugaauaaaauaugacccaauuuaugucaaaagaaaucuguauauauccuucugaaugcauauaaagugaucuggaauaauauuccuacauacccacagugcaggggguuaggaagggagauuuuuacuuuauaggcauuauaauaagcuuguaaucuuuuuaccgacuguaauucuuuauuucuuuuuuuuuuuuugagacggagucucgcucuguugcccaggcuggagugcaguggcgugaucucggcucacugagagcucugcuucccagguucaccccauucuccugccucagccucccgaguagcugggacuacaggugcccgccaccaugcccagcuaauuuuuuguauuuuuuaguagagacgggguuucaccauguuagccaggaugaucucgaucuccugaccucgugauccgcccgccuuggccucccaaacugcuggaauuauaggcgugagccaccacgccuggccuauuucuuuuucaugguuuauaaugagucuaagaucuuguaugucuggauuucagguuugagaauuagaaacguccaaaugacaguuuauguuaguauuguuguguuccuucauaaagguugaggauauaauucaggaaagcugaaauuguuaugcagauuauugauaggaauugaugcagauagcaucuagcaaauuuucaacaucgaguuguuucacccuuucaccuuaauaaaugugauuuuaaaguguuacagguaaaaaugguuuuauuccuauuuauagauuuuugaugaaauugagucaugaaacuguaaccauugaauugaagaacggaacacagguccauggaacaaucacagguacggagguuggacugcuuuuauaacauuuuuuuucuucucuuuuaccuagccagaguuuauuuuuuuauugcuuaaugaacauuauuguaguacaaauccuuauuuuuuuugucugaauuauguaauuuuuuuuuuuuuuuuuuaaacaguuuugcucugucaccugggccggagugcaguggcacgaucucagcucacugcaacauccgccgccuggggucaagcaauucuccugucucagccucccaaguagcugggacuacaggugccugccaccaugcccggguaaauuuuuuuuuuagacggauucucacucuguuacccaggcuggagugcaguggcacaaucucaggucacuacaaccucugccucccggguccggguugaagcaauucuccugccucagccucccaaguagcugggguuaugggugcgugccaccacacccagcuaauuuuuuauauuuuugguagagacgggguuucaucauguuggccagguuggucucgaacuccugaccucaugauccaucuuaacaaaagcaguaacaauucuuauauacagagagaagcagaaacaaaggugaggauaguuugguggaauggggauuaugaggaaguuacaaagacagugggagaaacaugaaagaaauaccugucacaucaguagugagccuaaagcccagucaggguucuuccauggcuugcugcauucacuucuguaagcaaaacauuagugugcuaggaaaaaucucuaggaaggaaacacugcugacauucccccauuuaccaguugcacaugugcuaaauugugucauagaaaacuugcacuuuguagaagaacaguaaucuuuuguaguccaguauuuacuguggcucaguagauuaauuaguugccuuaacuuguaucauacuaauaacugcacaauuauuuuccucuuuagguguggaugucagcaugaauacacaucuuaaagcugugaaaaugacccugaagaacagagaaccuguacagcuggaaacgcugaguauucgaggaaauaacauucgguauuuuauucuaccagacaguuuaccucuggauacacuacuuguggauguugaaccuaaggugaaaucuaagaaaagggaagcugguaaguuugaaggauuauaaacauuuuugugaaugcuaauccuaauccacacuauucauaauauagauauuauuugcaaacaacacaagugucuuuguuguuuaauauuuccuauaguauguauaguaauucuugguguugcuauuaaaaacauugagcaaccggacgcaguggcucacgccuauaaucccagcacuuugggaggccaaggcggguggaucacgaggucaggaguucaagaccagccuggccaacauggugaagccucaucucuacuaaaaauauaaaacuuagcugggcaugguggcgggugccuguaaucccagcuacucgggaggcugaggcaggagaaucgcuugaacccaguaggcggagguugcagugagccgagaucucaccacugcacuccagccugggugacagagccacugucucaaaaaaaaaaaaaaccaaacaacaaauaucgauguggucgggcaggguggcucacaccuguaaucccagcacuuugggaggccaaggugggcagaucaccugaggccaggaguuccagaccagccuggucaacauggcgaaacccccucucuacuaaaaaugcaaaaaaaaucaggcgugguggugcgugccuuuagucccaguuacucgggagguugaggcagacgaaucacuugaaccugggagguggagguugcugugagccaagaucacgccacugcacuccagccugggcuacagagugagacuuugucucaaaaaaaaaaaauauauauauauauauaugauuguaauccauagcuugaaaaacaaugauuuaaucucucucucgguccuuuaucucaugcugcuuuccacuuuaaaaaaacccccuguggguaccaaaaucuacagauucuuaagucccuuuucauaaaaugguaguaguguuucagugcacauccuuuuguacccuuuaaaucaucucuagauuacuuguaauaccuaguauaauguaaaugcucuguagauaguuauacuguauuguuuaggcguuaaugacaagaaaaagucuguauguguuuaguacagauacaaccaucauaggccuaaacuacauuuuugauccucaguugguuaaauccauggaugugcaacccauggauauugaaggcuggcuguauuuucaaaucugaggauguuuugcuuuaaugucguuaggguuauucuacauuuuuuuuuuuacuaccuaccuaccugucggggaauugaugauugaaagccccccgccucauaucaucuuacuccacgcuucugaaucuuagauuuuucagaaguuauucuuccuuuacuaaauguuacaguucccagucuacuuucuauuuaaaauuuuguugaaaaaaauuuuuuuuuuuuuuuuugagauggaguuucgcucuuguuagccaagcuggagugcaguggcaggaucucagcucacugcaaccucugccuccuggguucaagcgauucuucuguuucagccucccaaguagcugggauuauaggugugugccaccacacccagcuaauuuuguauuuuuaguagaggugggguuucauccuguuggucaggcuggucucauaccccugaccucaagugauccacccgccucggccuuccaaagugcugggauuacaggcaggaaccaccgcgcccagccgaaaucuuuuuuugagauggacucucacucugucgcccaggcuggagugcaguggcgcgaucucggcucacugcaagcuccgcuucccggguucacaccauuguccugccucugccucuccaguagcugggaccacaggcgccugcaaccacgcccggcuaauuuuuuguauuuuuaguagagacgggguuucaccguguuagccaagcggucucgaucuccugaccucaugauccgccugccugggccucccuaagugcugggauuacaggcgugagccacggugccuggcccaaaaucuuuuaucuacuguguuuucucugcuuuucuuuguuccucuggguaguuaucauuuuuguuccuuuucuaucauaaauacuauuucagaagaaauugaagguaaguguggucaauuuggcccauuuuaacguguucuagacuuacaguuuuuguguguacacauuuaaaauaguacgguuuaaaauaacugaaauuggccaggugcgguggcucaugccuguaaucccaguacuuugggaggcagaggcgggcagaucgccugaacucggaaguucgagaccagcccgggcaacauggcaugaacuuugucucuacuaaaaauacaaaaauuaaccaggcaugguggcagaugccuguaaucccagcuacucggguggcugaggcaggagaauuucuugaacccagaaaauggaggcuccggugagccgagauuacgccacugcacuccagccugggugacagaguaaaacccugucgccaaaaaaaaaaaaaaaaaaaaaggaaacuacaacaaauuaaauaaugaaaaugagucuucguuucaaguuugucauagucuaguguuagggaguuauuuaaaaauuauugguuugggccaggugugguggcucacgccuguaaucccagcacuuucagaggcugaggcagcuggaucacaaggucaggaguucaacaccagccuggccaauggugaaaccccauuucuacugaaaauacaaaaauuagccaggugugguggcggucaccuauaaucccagcuacucgggaggcuaaggcagggaauugcucgaaccugggaggcagagguuguagugacccgagaucgcacuacugcacuccagccuggacaacagagagagacuuggucucaaaaaaaaaaaaaaaauuguuuuguuuguuguuuguuugguaagagacaagaucucacuguguugcucaggcugcagugaaguggcaugaucauagcucacugcagccucaaaccccuggcuucaggcugucuucugcguuggccucccaaauguuuggauuuuuuuuuuuuuugaauaaacauuuauuuucuuucuuuaaaaaaaaaaaaaagaagcagcagcugggcgcgguggcucacgccuguaaccccagcacuuuggaaggccgaggcagguggaucaccagccuggccaacagaguaaaaccccaucucuacuaaaaauacaaaaaaguagcugggcgugguggugggcgccugcagucccagcuacucgggaggcugaggcaggagaaucgcuugaacccgagaggcggagauugcagugagcaguuguuuucuuaauuuaucuuucuuuuuuacagauaugcaccaccaaaccuggcuaauuuuuuauuuuuuauuuuuuuguaaagacagggucucccuauguuguccaggauagucuugaacucuuggucucaaacaauccuccugcuguggccucccaaagugcugggauuauaggugugagccaccaucauaccugguccauuuucuuuucuuggguuuuuuuuuuuuuuuuuuuuuuugagacagagucaugcucuguugcccaggcuggagugccauggcgcgaucuccacucauuacaaccucugccucccagguucaagcaguucuccugccucaaccucccaaguagcugggauuacaggugcccagcccuuuuguuguuguuguuguuguuguuuuacaacaccccuccaacucuguuuuucccauuuucuuuauuuuuuuaaacacuucauuuugaaauaauuuuagacacaaaaaguugcaaaaauaguacaaggaauucccauacacuuuucaccaagauugucuaaauguuaaaaugucauauaacuacaaaaaauuagaaauuuuacauugaugugucacuacuguauuaucuagagaccuuucucacauuucucugauugucccuuuaauguccuuuuccugguccaagauccaauccaguacaacagguugcauuuacuuguacguuuccuuaguuuccuuuaaugcguaucagcugguucuccucaguuuuccuuuugugaccuugauacuuuguaagaguacgggccaguuauuuugugaaaugucccuuaauuagcaucuuaaacuuacuauuuauugcuuagaaugguaagacuagaaucaguguguacaaauuucuaauguggccaggugcgguggcucacaccuguaaucccaccacuuugggaggcugaggcuggaggauugcuuuggcccaagaguuugagagcagcuugggcaacaaagggagaccucaucucuacaaaaauuuuaaaaauuagccagacaugaugguuuguaccuguagucccagcuacucaggaggcuuagaugggaggaucacuugagcccaggaguucaaggcugcagugagguguaauuacacuccagaugggacuacagagugagacccuguauuuaaaaaacaaaaacaaaaacauuuagaaugugacugacuucuaugucaagauuuucuaauauucuuagcugucugaagaugaaauaaguuuauuugggucaugaauucccuaucaccaugauacucaacuagaguuaggaugacccaguagggauauuacuauuuggauuaaagcacuagauuauguguaggucaaaugaguuuuaauuuucugaagaguuaauaagauugugauuugauguaauacauuuaaacuuuccugguuuugaauuaacuugcuuggauuuuauucaguuaccaaaacucuggcaucaaggugaucauguuuuauucugugauauauaucuucccuuuuuuugugagguucaaaucauuuuauggugaauuugagacaugauauaaagaaaaaguauuuuuaaauuugacacauuucuuaguaaauaaauugaaaugaaacaaauaauaaucucccuaggccuuuaguuauugguucugcaugauaauguguugggggguggagggaaucugaagucuaacacauuuaacagaagcuaguuaaacuuuauuuacuguagcuacuaauaaagagcuauaaacagggaaagguguguguguaaauguuguuuguggugucuagguaacauuggugcaggagagaauugaacuugguuuguuuuucuuuuccuucaguugcaggaagaggcagaggaagaggaagaggaagaggacguggccguggcagaggaagaggggguccuaggcgauaaugucucucaagauuucaaagucauaugagauuugggauauuuuuuguacagguuguguuuguuuaugucaguuuuuaauaaacauaaaugugggacagagcugucuauuuaguauaucaaaguuuuaguaguuuccuccacauucacgaaauuaccacagugagagcuaagcauuucuacugggcaguuucauuuuuaguugaucagguuuuaaguuuuugaacuaaaauuuuucuuuuucuuuuuaugaugaauaagguuaaaauaaaagccuuagacaaauuaaauuuggcagaguuuaauugagcaaaggacaauucacaaaucagguagccccugaaccauaauaggcucagaggcuucagcccagcugcauaguugaagauuuauggacagaaggaaagugauguauggaaaauggaagugagauacagcaacagccggauuaguuacaguucagcguuugccuuauuugaauaugguuugaacaguucgcugucuuugguuggcugaaacuuagugauugccacaagaguaggguaccgucuguuuacacguccaguuaggcuacaguucuauguacugagaaaccuuuaagcugaacuugagauauguaaagagacuuuaggcuaaacuuaacaauauauauaggauauauacccuucuacuucacaugcacugaauaugcauuuuauugcuuuacucuucauucuguggcaccuacccacaggggaaguaagaaguuuguuuugguauuucggaaacuaaaguccuuaugggauggggucuagaauugauucuccuuuccugaguuuuacuccacggagucuuagguaccugguaaaaaguugucuucuaaauuaagggucauugcuuuguugucuagcugcuaaugucuuacuuuuguuucuuuugcuuuuuaaucaguucuuaauaggauauaguuuuauguuuuccaaguuauaacuuggaguuaauggucacuagauuaucaguuaugagcaguguuaaaaucuccuauuaauguguaauguaccugucagugccuccuuuauuaagggguucuuugagaauaaaagagaaaagaccuacuuuauuugacagcaaaa

SEQ ID NO: 192736 - RNA, 17949 nt, Homo sapiens
uuuugcugucaaauaaaguaggucuuuucucuuuuauucucaaagaaccccuuaauaaaggaggcacugacagguacauuacacauuaauaggagauuuuaacacugcucauaacugauaaucuagugaccauuaacuccaaguuauaacuuggaaaacauaaaacuauauccuauuaagaacugauuaaaaagcaaaagaaacaaaaguaagacauuagcagcuagacaacaaagcaaugacccuuaauuuagaagacaacuuuuuaccagguaccuaagacuccguggaguaaaacucaggaaaggagaaucaauucuagaccccaucccauaaggacuuuaguuuccgaaauaccaaaacaaacuucuuacuuccccuguggguaggugccacagaaugaagaguaaagcaauaaaaugcauauucagugcaugugaaguagaaggguauauauccuauauauauuguuaaguuuagccuaaagucucuuuacauaucucaaguucagcuuaaagguuucucaguacauagaacuguagccuaacuggacguguaaacagacgguacccuacucuuguggcaaucacuaaguuucagccaaccaaagacagcgaacuguucaaaccauauucaaauaaggcaaacgcugaacuguaacuaauccggcuguugcuguaucucacuuccauuuuccauacaucacuuuccuucuguccauaaaucuucaacuaugcagcugggcugaagccucugagccuauuaugguucaggggcuaccugauuugugaauuguccuuugcucaauuaaacucugccaaauuuaauuugucuaaggcuuuuauuuuaaccuuauucaucauaaaaagaaaaagaaaaauuuuaguucaaaaacuuaaaaccugaucaacuaaaaaugaaacugcccaguagaaaugcuuagcucucacugugguaauuucgugaauguggaggaaacuacuaaaacuuugauauacuaaauagacagcucugucccacauuuauguuuauuaaaaacugacauaaacaaacacaaccuguacaaaaaauaucccaaaucucauaugacuuugaaaucuugagagacauuaucgccuaggacccccucuuccucugccacggccacguccucuuccucuuccucuuccucugccucuuccugcaacugaaggaaaagaaaaacaaaccaaguucaauucucuccugcaccaauguuaccuagacaccacaaacaacauuuacacacacaccuuucccuguuuauagcucuuuauuaguagcuacaguaaauaaaguuuaacuagcuucuguuaaauguguuagacuucagauucccuccaccccccaacacauuaucaugcagaaccaauaacuaaaggccuagggagauuauuauuuguuucauuucaauuuauuuacuaagaaaugugucaaauuuaaaaauacuuuuucuuuauaucaugucucaaauucaccauaaaaugauuugaaccucacaaaaaaagggaagauauauaucacagaauaaaacaugaucaccuugaugccagaguuuugguaacugaauaaaauccaagcaaguuaauucaaaaccaggaaaguuuaaauguauuacaucaaaucacaaucuuauuaacucuucagaaaauuaaaacucauuugaccuacacauaaucuagugcuuuaauccaaauaguaauaucccuacugggucauccuaacucuaguugaguaucauggugauagggaauucaugacccaaauaaacuuauuucaucuucagacagcuaagaauauuagaaaaucuugacauagaagucagucacauucuaaauguuuuuguuuuuguuuuuuaaauacagggucucacucuguagucccaucuggaguguaauuacaccucacugcagccuugaacuccugggcucaagugauccucccaucuaagccuccugaguagcugggacuacagguacaaaccaucaugucuggcuaauuuuuaaaauuuuuguagagaugaggucucccuuuguugcccaagcugcucucaaacucuugggccaaagcaauccuccagccucagccucccaaaguggugggauuacaggugugagccaccgcaccuggccacauuagaaauuuguacacacugauucuagucuuaccauucuaagcaauaaauaguaaguuuaagaugcuaauuaagggacauuucacaaaauaacuggcccguacucuuacaaaguaucaaggucacaaaaggaaaacugaggagaaccagcugauacgcauuaaaggaaacuaaggaaacguacaaguaaaugcaaccuguuguacuggauuggaucuuggaccaggaaaaggacauuaaagggacaaucagagaaaugugagaaaggucucuagauaauacaguagugacacaucaauguaaaauuucuaauuuuuuguaguuauaugacauuuuaacauuuagacaaucuuggugaaaaguguaugggaauuccuuguacuauuuuugcaacuuuuugugucuaaaauuauuucaaaaugaaguguuuaaaaaaauaaagaaaaugggaaaaacagaguuggagggguguuguaaaacaacaacaacaacaacaacaaaagggcugggcaccuguaaucccagcuacuugggagguugaggcaggagaacugcuugaaccugggaggcagagguuguaaugaguggagaucgcgccauggcacuccagccugggcaacagagcaugacucugucucaaaaaaaaaaaaaaaaaaaaaaacccaagaaaagaaaauggaccagguaugaugguggcucacaccuauaaucccagcacuuugggaggccacagcaggaggauuguuugagaccaagaguucaagacuauccuggacaacauagggagacccugucuuuacaaaaaaauaaaaaauaaaaaauuagccagguuugguggugcauaucuguaaaaaagaaagauaaauuaagaaaacaacugcucacugcaaucuccgccucucggguucaagcgauucuccugccucagccucccgaguagcugggacugcaggcgcccaccaccacgcccagcuacuuuuuuguauuuuuaguagagaugggguuuuacucuguuggccaggcuggugauccaccugccucggccuuccaaagugcugggguuacaggcgugagccaccgcgcccagcugcugcuucuuuuuuuuuuuuuuaaagaaagaaaauaaauguuuauucaaaaaaaaaaaaaauccaaacauuugggaggccaacgcagaagacagccugaagccagggguuugaggcugcagugagcuaugaucaugccacuucacugcagccugagcaacacagugagaucuugucucuuaccaaacaaacaacaaacaaaacaauuuuuuuuuuuuuuuugagaccaagucucucucuguuguccaggcuggagugcaguagugcgaucucgggucacuacaaccucugccucccagguucgagcaauucccugccuuagccucccgaguagcugggauuauaggugaccgccaccacaccuggcuaauuuuuguauuuucaguagaaaugggguuucaccauuggccaggcugguguugaacuccugaccuugugauccagcugccucagccucugaaagugcugggauuacaggcgugagccaccacaccuggcccaaaccaauaauuuuuaaauaacucccuaacacuagacuaugacaaacuugaaacgaagacucauuuucauuauuuaauuuguuguaguuuccuuuuuuuuuuuuuuuuuuuuuggcgacaggguuuuacucugucacccaggcuggagugcaguggcguaaucucggcucaccggagccuccauuuucuggguucaagaaauucuccugccucagccacccgaguagcugggauuacaggcaucugccaccaugccugguuaauuuuuguauuuuuaguagagacaaaguucaugccauguugcccgggcuggucucgaacuuccgaguucaggcgaucugcccgccucugccucccaaaguacugggauuacaggcaugagccaccgcaccuggccaauuucaguuauuuuaaaccguacuauuuuaaauguguacacacaaaaacuguaagucuagaacacguuaaaaugggccaaauugaccacacuuaccuucaauuucuucugaaauaguauuuaugauagaaaaggaacaaaaaugauaacuacccagaggaacaaagaaaagcagagaaaacacaguagauaaaagauuuugggccaggcaccguggcucacgccuguaaucccagcacuuagggaggcccaggcaggcggaucaugaggucaggagaucgagaccgcuuggcuaacacggugaaaccccgucucuacuaaaaauacaaaaaauuagccgggcgugguugcaggcgccuguggucccagcuacuggagaggcagaggcaggacaauggugugaacccgggaagcggagcuugcagugagccgagaucgcgccacugcacuccagccugggcgacagagugagaguccaucucaaaaaaagauuucggcugggcgcggugguuccugccuguaaucccagcacuuuggaaggccgaggcggguggaucacuugaggucagggguaugagaccagccugaccaacaggaugaaaccccaccucuacuaaaaauacaaaauuagcugggugugguggcacacaccuauaaucccagcuacuugggaggcugaaacagaagaaucgcuugaacccaggaggcagagguugcagugagcugagauccugccacugcacuccagcuuggcuaacaagagcgaaacuccaucucaaaaaaaaaaaaaaaaauuuuuuucaacaaaauuuuaaauagaaaguagacugggaacuguaacauuuaguaaaggaagaauaacuucugaaaaaucuaagauucagaagcguggaguaagaugauaugaggcggggggcuuucaaucaucaauuccccgacagguagguagguaguaaaaaaaaaaauguagaauaacccuaacgacauuaaagcaaaacauccucagauuugaaaauacagccagccuucaauauccauggguugcacauccauggauuuaaccaacugaggaucaaaaauguaguuuaggccuaugaugguuguaucuguacuaaacacauacagacuuuuucuugucauuaacgccuaaacaauacaguauaacuaucuacagagcauuuacauuauacuagguauuacaaguaaucuagagaugauuuaaaggguacaaaaggaugugcacugaaacacuacuaccauuuuaugaaaagggacuuaagaaucuguagauuuugguacccacaggggguuuuuuuaaaguggaaagcagcaugagauaaaggaccgagagagagauuaaaucauuguuuuucaagcuauggauuacaaucauauauauauauauauauuuuuuuuuuuugagacaaagucucacucuguagcccaggcuggagugcaguggcgugaucuuggcucacagcaaccuccaccucccagguucaagugauucgucugccucaaccucccgaguaacugggacuaaaggcacgcaccaccacgccugauuuuuuuugcauuuuuaguagagaggggguuucgccauguugaccaggcuggucuggaacuccuggccucaggugaucugcccaccuuggccucccaaagugcugggauuacaggugugagccacccugcccgaccacaucgauauuuguuguuugguuuuuuuuuuuuuugagacaguggcucugucacccaggcuggagugcaguggugagaucucggcucacugcaaccuccgccuacuggguucaagcgauucuccugccucagccucccgaguagcugggauuacaggcacccgccaccaugcccagcuaaguuuuauauuuuuaguagagaugaggcuucaccauguuggccaggcuggucuugaacuccugaccucgugauccacccgccuuggccucccaaagugcugggauuauaggcgugagccacugcguccgguugcucaauguuuuuaauagcaacaccaagaauuacuauacauacuauaggaaauauuaaacaacaaagacacuuguguuguuugcaaauaauaucuauauuaugaauaguguggauuaggauuagcauucacaaaaauguuuauaauccuucaaacuuaccagcuucccuuuucuuagauuucaccuuagguucaacauccacaaguaguguauccagagguaaacugucugguagaauaaaauaccgaauguuauuuccucgaauacucagcguuuccagcuguacagguucucuguucuucagggucauuuucacagcuuuaagauguguauucaugcugacauccacaccuaaagaggaaaauaauugugcaguuauuaguaugauacaaguuaaggcaacuaauuaaucuacugagccacaguaaauacuggacuacaaaagauuacuguucuucuacaaagugcaaguuuucuaugacacaauuuagcacaugugcaacugguaaaugggggaaugucagcaguguuuccuuccuagagauuuuuccuagcacacuaauguuuugcuuacagaagugaaugcagcaagccauggaagaacccugacugggcuuuaggcucacuacugaugugacagguauuucuuucauguuucucccacugucuuuguaacuuccucauaauccccauuccaccaaacuauccucaccuuuguuucugcuucucucuguauauaagaauuguuacugcuuuuguuaagauggaucaugaggucaggaguucgagaccaaccuggccaacaugaugaaaccccgucucuaccaaaaauauaaaaaauuagcugggugugguggcacgcacccauaaccccagcuacuugggaggcugaggcaggagaauugcuucaacccggacccgggaggcagagguuguagugaccugagauugugccacugcacuccagccuggguaacagagugagaauccgucuaaaaaaaaaauuuacccgggcaugguggcaggcaccuguagucccagcuacuugggaggcugagacaggagaauugcuugaccccaggcggcggauguugcagugagcugagaucgugccacugcacuccggcccaggugacagagcaaaacuguuuaaaaaaaaaaaaaaaaaauuacauaauucagacaaaaaaaauaaggauuuguacuacaauaauguucauuaagcaauaaaaaaauaaacucuggcuagguaaaagagaagaaaaaaaauguuauaaaagcaguccaaccuccguaccugugauuguuccauggaccuguguuccguucuucaauucaaugguuacaguuucaugacucaauuucaucaaaaaucuauaaauaggaauaaaaccauuuuuaccuguaacacuuuaaaaucacauuuauuaaggugaaagggugaaacaacucgauguugaaaauuugcuagaugcuaucugcaucaauuccuaucaauaaucugcauaacaauuucagcuuuccugaauuauauccucaaccuuuaugaaggaacacaacaauacuaacauaaacugucauuuggacguuucuaauucucaaaccugaaauccagacauacaagaucuuagacucauuauaaaccaugaaaaagaaauaggccaggcgugguggcucacgccuauaauuccagcaguuugggaggccaaggcgggcggaucacgaggucaggagaucgagaucauccuggcuaacauggugaaaccccgucucuacuaaaaaauacaaaaaauuagcugggcaugguggcgggcaccuguagucccagcuacucgggaggcugaggcaggagaauggggugaaccugggaagcagagcucucagugagccgagaucacgccacugcacuccagccugggcaacagagcgagacuccgucucaaaaaaaaaaaaagaaauaaagaauuacagucgguaaaaagauuacaagcuuauuauaaugccuauaaaguaaaaaucucccuuccuaacccccugcacuguggguauguaggaauauuauuccagaucacuuuauaugcauucagaaggauauauacagauuucuuuugacauaaauugggucauauuuuauucacgucuauaacuuguaguccucguuuagcaguuuauauuggacauauuuccauuucaacauacaaaacauucuaagaacugaggcugggcgugauggcucaugccuauuuauaaucccagcacuuugggaggccgaggagggcggaucaucugaggucaggaauucaagaccagccuggccaacauggugaaacuccaucucuacaaaaacacaaaaauuagcugggcaggauggcguacgccuguaauccuagcuacucagaaggcugaggcaggagaaucgcuuaaaccugggaggcagagauugcagucagccaagaucgcaccacugcacuccaaccuggggacagagcaagacuccaucucaaaaaaaauuaaaaaaaaauaaaaauaaauuagcgaggcaagguggcgcacgccuguaaucccagcuacuuggaaggcuggggcaugagaaucgcuugaacccgggaggcagcauuugcagugaggugagauuguuccacuguaccccagccugagugacagggcaagacuccaucucacaaaaagccaaaauaacaaaauaacauucuaagaacuggaaaguauuccacuauauggaaaugucaaaauuuauuaccgccuguugacggacauuacuuugguucaauuuuuucccauuacaaacccaauuaugcaaacccucaccaacacaaguugcuauaagucuuucaaauuuuugucaauuugauggggaaaaaauuugcuuuuccuuaauuaccugugagauugaauaucuuaucuuuuuuuuuugacacagagucucgcucugucacccaggcuggaguguaguggcacaaucucggcucacugcaaccuccgccuccuagguucacgccauucuccugccucagccucccgaguagcugggauuacaggcgcucgccaccacaccuggcuaauuuuuuguauuuuuuuuuuaguagagacgggguuucaccauguuaaccacgauggccuugaucuucugaccucgugauccacccgccucggccucccaaagugcugggauuacaggcaugagccaccgcgcccugccugaauaucuuuucauuaacaugggaaaacuauuucuuccgugaauuaccuguucacauuauugacauucucaauuagguugaguuuuucuuuuauuuucuacugguuugccagucauucaaguuuguuguuuaugguuucuuuagucacacaaacuuuuuucacuuuuauguuuugaauuuguucacccuccugggauacauaauuuaccuaagaaaggguuuuuucuaugccaagauuguaaaaaaauagugucuuauuuucuucuacuuuuagaguucuaaucuacuuggaauugaucuuuuuuaugcaguguaaggcacaaaucugucuuuauuacuuuccccaacugaauagccaguugccuugauaauauauaaugaacaaucuauccacuucucacuucaucuaaauuuccguucuccccuuuuuauaaaauuuugcagaggaugaaaaguuaaaggguuuacaaauauugucaauugccagugcaguggcucaugccuguaauuucaccacuuugagaggccaaggugggaugaucacuugaggccaggaguucgagaccugccuggucaacaaagcaagauccugucucuacaaaaauaaaaauaaaaaaaaaauuaguuggccgggugcgguagcucaugccuguaaccccagcacuuugggaggccaaggugggcgggucacaaugucaggaguuggagaccagcuuggccaauauggugaaaucccaucucuacuaaaaauacaaaaaauuagccaggugugguggugcaggucuguaaucccagcuacucaggaggcugaggcagcagaaucgcuugaaccugggaggcagagguugcagugagccaagaucaugccauugcacugcagccugggugacagagcaagacuccaucucgaaaaaaauacaaauaaaaaaauuagcugggccuguuggcucaugccuguagucucagcuccucggagucugaggugggaggaucgcuagagcccaggacuuugaggcugcaaugagccaugacugugucacugcccuggagccuguguggcagagcaagacuccgucuuuuuuuaaaauucuauuuuuuuuugagacggagucucgcucugucacccaggcuggagugcaguggcaugaucuuggcucaaugcaaccuccaccucuuggguucaagcaauucuccugccucagccucccaaguagcugggacuacaggcgccugccaccacaccuggcugauuuuuguauuuuuaguagagacaggguuucacccguugggcuggucucgaacuucugaccucaggugaucugcccaccuuggccucccaaagugcugggauuacaggcguaagccaccaggccuggcccuuuuuuuuaaagacagucuucgccaggugugguggcucaucccuguaaucccagcacuuugggagggcgaggcaggcggaucaccugaggucagaaguucgagaccagccuggccaacauggcgaaaccccgucucugcuaaaaauacaaaaaaauuagccagacuugguggcacuugacuguaaucccagcuacuggggaggcugaggcaggagaauugcuugagccugggaggcagagguugcagugagccaagacugcaccacuaaacuccagccuggacaauagagugagacuuugucaaaaaaacaaacgaaaaaaaauugaucacaccaucucaaaguaaguuguaggcauuacgacacuucagcaugcauuuucuaaugacauucuccuauauaaccauaaucucacaaucacaucuaagaaaaugaaccccacacuaucauacaauacacaguucauauaaaaacuuuuagucuauaauauauacuuugaauuaacagauccuaucaucacacuaaaugguacacauaagauaaccuauuauccucccgcacuagacuauucuugaggguagggaucguaagcucuauaucuaauccuagacuguaauaggcacugaauaauguuggcugaaauguuuuaaugaauaaagggaaaccaaccuuaaaaugccuuuuuuuaauuucuuuuuuuuuagugguauagacagccaucacaaaaaagaaauuacuuggucugggauauaacaagccucaaacuuuaagaagacucaugaguugaaucucuuuuuauauaugacaucaagaaaacguuuuucucaacgaauugguaacacuuuauuucaccagagaguuauucagcuccaaauuuaacaaucaauuauaacuagaaaagccuagaauucugaacuaaugguuuccucccauuaucaaguuuuuguuuuuaucuuuuacacgaauuuacuaucccaguuaguaagaacuuuuacuauaaaaguucuucaaaucauuuuuggaagcaaagaagauaaauaaaaggaaaaaaaaaaccuuauguggccaggcgcgguggcucagauacauaaaagauacguaaaaauaacuaaguuguagaaagcaauaaagauauacagagguuuuuuuuguguuuuuuuuuaaacagagguuuuuaguuuagguuuuuucugagacuaugccaccaugcccggcuaauauuuuuuaaauuuuuaaauuuuuuguagagaugugguuuugccauguugccuagacuagucuuaaacuccugagcucaagcaaucagccugccuuggccucccaaagugcugggauuacaagcgugagccacugcacccagcuacacacagguuuuuuacuaagaauauauuguagcauguggagaggggagucagguauuaggggacuccuaguaagaagccugaaaaguuggaaauaugcagcaagaagaaacaaaagaaaaaauacagcauaagacacagaguaauuauagauacaaagauggagucuuguucuguugcccaggcuggagugcaauagcgcaaucucaaucugagcucauugcaaccuccgucucccggguucaagagauucuugugccucagccucccaaguagcugagacuacaggcgcaugccaccacacccagcuaauuuuuguauuuuuaguagagacgggguuuuaccauguuggcccaagugaucugccugccucggccucacaaagugcuacgaugacaagcaugaaccaccacgccuggccgaugaaauguuaaguucaauauuuuagguccuaugaguagagaggaguuaggcagguuccuuucauggaaagccuaagcucuguuaaagaauuccucuaggagagcuacugaaggauuuucaucaaugaaguggaguaccaggcucauauucacauuuaaaagagaaccuagggccaauguucagaaacagauuuuagaaagacaagagaccaaaguauaaucucuaggaagacaaauuaugugacuagagcaguacauauacaaguuaaaacuacaguaaucgagacauaaggaacaacaaauagaucaaugaaacaauacaagcaaacagaucuauuucuggucccacauuuacaugguugauuuagcugggauuacaggcacucgccaccacaaccagcuaauuuuuguauuucuuuuuguuuuaguagagccgggguuucaccauguuggucaggcuggucucgaacuccugaccucaggugaucugccugccuuggauuccgaaaagugcugggauuacaggcaugagccaccaagccuggccuuauaugguugauuuuuuacaaaggugccaaagacguguaacaggcaaaggaaaguguuuucaacaaaugaugcuggaauaacuggaaauccauacagaaaaaaaacgaaccuggaccacuaacaccauuuuccaaaaguaauccaagauggaugauagucacuugagcccaagaguuccagauauaggcugggcacaguggcucacgccuguaaucccagcacuuugggaggccaaggcaggcagaucacaaggucaggagaucgagaccagccuggccaaaguggugaaaucccaucucuacuaaaauacaaaaaaaauaagccaggcauaguggcacaugccuguagucccagcuacucgggaggcugaggcaggggaaucacuugaaccugggagguggaggucgcagugagccgagagugcgccacugcacuccagucuggcaacagagcaagacuccaucucaaaaaaaaaaaaaaagacuuaaagaguuccagauacauaaaaaucgaucagucaggcaugguggcucacgccuguaaucccaguacuuugggaggccaaggcggguggaucacaaggucaggaguucgagaccagccugaccaacauggugaaacccugucucuacuaaaaauacaaaaauuagccaggcgugguggcaggcgccuguaaucccagcuacuugggaggcugagguaggagaaucgcuugaaccuggaaggcagagguugcagugagcugagaucgcacaauuguacuccagccugagcuacaagaagagagacacuauuaaggaaaugaacauguaaaccacacacugagagaaaacacaucugacaaagaacugguauccaggacacagaucuaauuucuacaacucugggcugggcgcaguggcucacgccaguaaucccagcacuuugggaggccaaggcgggcggaucacgaggucaggagauugagaacauccuggcuaacacggugaaaucccgucucuacuaaaaauacaaaaaauuagccgggcgugguggcaggcgccuguagucccagcuacucgggaggcugaggcaggagaauggcgugaacccaggaggcggagcuugcagugaaccaagaucaugccacugcacuccagccugggugacagagugagacuccgccucaaaaacaaacaaauaagcaaaaaaccgacuaaacccuaaggagauaccacuacauacccacuaaaauggcuaaaauuaaagacugagcaaacaacaccacauacuggugaggauguggaccaauuguuauucuaauauauuguuaauggaaguguaaaaugguacaaccacuuuggaaaauggucuggaaauuucuuaaaaagcuaaacacauaacuauguuacaguccaucaacuccacucgaguauuuacccacgaaaauuuguuucccuccaaaaaccugaagaauauucaacguaguuguaaacaaaauacauaacuuuuuauuuuauuuucuuguaauuuuuuaaaauacggagcuuuuuuuuucuuuuuucuuuuuuuuugagacggagucucgcucuguugcccaagcuggagugcaauggcgugaucucagcucacugcaaucuccaccuccuggguucaagggauucuccugccucagccucccuuguagcugggauuacaggcaccugccaccaugcccagcuacuuuuuugguauuuuuaguagagaugggguuucaccauguuggucaggcugguuucaaacuccugaccucaggugaucuacccgccucggccucccaaagugcugggauuacagacgugagccacugcgcccggccuaaaauacagaacuuccaaacacacaaugcacuaauauccaguaauaaaaaugaacacauuacugauacacuucacaauguggaugaaucucaaaaacauguaacuaaaagaaguuuuacgcaaaaauacuuugugauuccaaauauaugaaauucuagcgcaggcaaaauucauuucugguggaagaaacugguugcaucuagggguauggagccagagguugccugggaaaggcuugaggaaacugucugagguuuugguaauguuacuucuguugauauggguuuagguuacaaaaguguuuacauuuuucaauagcaggaaauauacacugcauuucauuguauaagauauuuaccuuaaagaaggaaaacaaaaauccaugagugggauaaaaagggccugaacuuaaugguggugacuggaaugaaaggcuacuaugggcaggacaaauacacaauuaucccucccuaacugagcccaggaaccaaauggauucaaauuauuuucagaugaaucuuucacugucugaauucuuuccacuuagugaaacuuggauaucaaauaguaacacagugucccucaguauaaaacacacuauuugaacccaaaaaccaaacaggauaaugugggucacuuuuaugaaguagguaaaacuggcaaaauuggcaauguaucaaaugucaaggacaucaggagagaaaaagucaagcucaccucccagguuuuugguuagggugacagugagaauaaggaugacaaugcugccaacugagauacagaaauaaaucuacugaaaaugcaaaccaguuagucaaacaaucauuuucuggaggaaaaauacauucucugguaagaaaaaaaauuuguuucuauauuuuaccuaagacacaaaacaggauucaguacagguauuaaaaauuacuggaaaauugucauaacaugcaguaucuuuaaagggaacaaauggaauccaagguguauuacacaaaauugaacuaugaguggauuaagauucagauuggcagguauggagaaauuucaaaaaauguaauuuucuuuuuuugagaccgagucucacucuguugcccaggcuggagugcaguggugcgaucucagcucacugcaaccucccaggaucaagugauccucuuaccucagccuccugaguagcugggauuacaggcgcccgccaccaugcccggcuaauuuuuguauuuuuucgaaagaauggguuucaccacguuggccaggcagguccugaacuccugaccucaggcgauccgccugccucagccucccaaaguguugggauuacaggcgugagccaccacguccagccuaaaaaaugcacuuuaaauucuaugacuuccuauccaaaguuauaguucaaauaaaaauauaccaaaaauuaaccuuaaaugucuuuuguaccaacuccucccugaauauaauuuuuuuuuuuuuuuuuuuuuuuugagauggagucucgcucugucgcccaggcuggagcguagugccacgauaucggcucacugcaaccucugccgccuggguucaagcgauucuccugccucagccuccugaguagcugggauuaaaggcgcgcgccaccacgccccacuaacuuuuguaauuuucguagagacgggguuucaccauguuggucaggcuggucucgaacuccugaccuagugauccacccgccuuggccucccaaagugcugggauuacagacgugagccacugcgccuggccuccucccugaguguugaaggcuuuuauguguuauuuaaaacguuucaaacaaacguuacuucagacguuaucuacuugucugucauccccacuaaccagaaaacuccaacaaggcagguacucugccuuuuaaaaaauccuauuaccagcgccuaguauguaacaggugcccaauaacuauuuagcggauauugacaauccuugacucaacaggaaaaaaacaagcuaaauauuuauaauugcuggcuuagcuauuagaaacgucugccucuguuccaggcuuagucucaaggaaaaacaccaaaaccaaaucuacuugcagguaguuuagaauuauucacaucagcaaacaaguuuucagaagacucaccuaacugacagggucuauuuauuucuuaagaaauaaaacaggagaacuauauauuaucugaguaaucagccacaauuacguugugauaauuucugcccuauauugggagauuuuccuaaauaaaaagccuaccuuaaagggaaauagagguggaauaaucaaucacaaaucuaaggaggauaaaaagguaaacuuaaaaaucggccgggcacgguggcucaaaccuguaaucucagcccuuuggaagggcgaggcgggcagaaagcuugagcccaggaguucgagaccagccuggucaacaaagugagacaccaucuuuauuuaaaaaaacaaaaacuugugaagccggaaguccuucucugauuuaaaauauuuugcaaacagguuuguuuccagauaagcucauacagcuuucuaaguacuguuaagcaggacuggggaguuccacucaaaaagaaaaugaguaacuguaagagggagaugugucccaggaggcgcugcaucuuuaaagccucuaagucacuaggcaggaagaaaaggcucggccuuuauaccaaucucuuggaagacacgcgggauccgcgagcgacccaggcggaagcccaggcccgagcacgagcugcgggcgcaguaaggccggccguuagcaggccgcgcacacgcggcuuucccgccuccugcaaaugggagagcccagccuuccggacuccgggccaagcccucccuucacagcccccagagcugcuuggucacucccucaccucacgagcuucauccuagcggcgccgucacccucuggguccgacagcacacagaauccuucaaccgaacacugaccgacugcaguaugaauggccggaagcgccuacuccaggggcuccggacgucaagagcgcgcggagcacu

SEQ ID NO: 192737 - RNA, 28283 nt, Homo sapiens
uuauaguuuaaagagcuuuauuaaugcaauaaauuaacuuuguacacauuuuuauauaaaaaaacagcaagugauuucagaauguuguaggccucauuagagcuuggucuccaaaaaucuguuugaaaaaagcaacauguucuucacaguguuccccuagaaaggaagagauuuaauugccaguuagauguggcaugaaaugagggacaaagaaagcaucucguaggugugucuacuggguuuuaacuuauuuuucuuuaauaaaauacauuguuuuccuaaguuuugggguuacccuaucugcuuugagagacaaauacaaaagcuaaauggaagagauucuaucuaaccuguccuuaugguaacuaaaugccgucuuacauugagcuagaaauagaccuagaaguuucauuagacagcccugauccuucccuauccuaaagaugaugucuuagguuguauaacuauuuggagaugagaaugaucaaccagggccaggugcgguggcucaaaccuguaaucccagcacuuugggaggcugaggcaggcggaucaugaggucaggaguuugagaccagccuggacaauauaguaaaaccccaucucuacuaaaaauacaaaaaucagccgggugugguggcacgcaccuguagucccaacuacucaggaggcugaggcagaagaaucgcuugaacccagcggagguugcagugaaccgagaucacaccacugcacuccagccugggcaacggagcgagacucugucucaaaaaaaaaaugagaaugaucaaccaauguauacuucauaaaacugaaaccuuaauaagccccagacccuuuaaaacccuuagccaccauuugccgucuuauuccuggcuuuaagagauauuccaagaucugcuauaagagaugggcugugccugaucuggguccuaaaugugucuugacucaaaacacaccuccucggugaguuccagagcauaauucagauucugucaguauacugaauucacucuacuacaaauaaugggccaagggcuaggugggcuguuaucaaauuguguuguuuacaaaaaugcuaacccaggguccucgcccaccagcugccagugcccucugcuacucuuugaggcuaugguuaccccaagucuuuucauugcauucucaccuggugugaaauuggggcucccucgcaaacgcugguuucgcuguucaaaaaagcggaauauuguauagaaaagcauguugucuucagucugcuuugcagcaucuaaaaauuuucgugcagaaauguugucauggccaccaaugccccggauaaaccuuaaggcagcuaacacuugguguuuggaaaggagaacuucuacuauuucaucauuugcuguugaaagucgcuagcaguaagggagagaaguccaggucagugcaaacaacaggaacagaguuaguuuccauagucuaaaaccucacacaucagaguuaccuucagcauguccagagauagcugaugagcaggaggauagaaacucucuagggauaacagcagacaagccugaaagacauuuuuagacccacuucaguuggaaagauaacgguuaaaauuuuccauuuuuaaccacaauggaaguaaaaaucuggcaaugcauaccaaagguuuggagucgcugaggacgugguacugcaggaacugaugcagcauauaaaagagguugugcuggacaaggguuuugauaacaaguucauguagguaaugcugaggacaaaaguaaaaagugaaagaacacuuccaaaucauucagcuacaacagacuagaggcuccccaaggacuggcuauucuaaccaacacaguaaaagucugucauuacaagaagugguuucgucaugcagguaaagaccccaacuugaccuuacacuucccauuccaacuaauaaugucaggagucacucagcauucugagucagggaggcagaccugucuuagcauaugagucaucuucuaagacagugacuguguuuuuuuuuuaaauuccuucuguuuuaacuugggcccagaugauuugaagguaccuguacugcaaucugaaacugguuaagagaacgaauguauuccaucagcacggcuaucacaaauuuaugaggcaucuccuagggagaaaaaaauguggucuuacaaauaccaacgaggugcaaaagaggcugcauauaacucucuauccaacccccaccuuguuuccaucuuaaaauggcccaguguucaucuuucacugguuuugcacacaucgcuccagaaccacccgucaacaauuaugcuuuaggccucagcauuagaagccaaacuaccagcucuagggccucacccaaggaaacuccagugauucuaaucacuucaagugacucuaaucacaugaagucuccucguuuucagcaacuuccuuguuuugagcauucucaguccagaagaggcggaaagcugcagcccaccuucuuuuccacaaaggcugacaggacauggguguacacaucugacugguccagcaccgccuggguccgcaccggccucuugaggagcgggcugcuucggcucugcccugcuuccaccgccugaaagaaaaaaaccacaaacuaugaucuucggcaucuuagaggaagggugcuguuuacaguucauccacaaggacugaauucuucgauguggacccaggauaugagcggaaaacacuuucucuacuuagauacaacuuuuuccugugcgcaugccuguaaucccagcuacucaggaggcugaggcaggagaaucccuugaacccaggaggcagagguugcggugagccaagaucucaccauugcacuccagccugggcaauaagaacaaaacuccgucucaaaaaaaaaaaagcaguucagauccgugcagauuaugcaauagcugugggguguagccugagaacuugcauuuccaagaaacuccagaugcugcucauguggcuggucaguggcccacacugcugagucaugacgguuuauggagcccagcagaccgugugggacggcacagaaacugccauuugggaucagaccuacugauucccacagcccagaacacccacagcaauagaguccaaaaggacucagccaucccucacgucuggcagcguaggaauggacacugucccagcaacuggcccucuucagugccugucucagaccucuuacccuuccaugaacagcuaaaggggaguggaguucuggggcuuuuguugguuuaaaaccauuuucagccuaggacuaaucagauccuggaauugaaauaauucauucuccuuguccuaaacuuuucuucuggcuucagaagauaugauguacaaguaauacagcgggaauugguggcgauaagccaugguuauuaccuugacuacaaacacgccugcuaagugcuaacacugaaucgucacuaucucaacaggauucuuucccaaaagggaagaaagguguggcaaauauaaauauuucuaauuuaauuuucuaaguccucacucuggcauaacagaaaaauauacaaaauauugcaaagcagagacugauuuuucucaucuauaacaguagaccaaggaucuacaggcaagaucaaacacagaugggaaaaacaaaaacagugaagguaugaagugagaugcagccgccagcucgugggaugcagggacccugaauuuacuacuccuccacuaucccccacuacugccaccuugcccuauggcaggcggcaaaucucagcgaccuuauucuaauauauaggaaacaauuuugcaucauaauuacuuagaaaauacccgggagggggugggggaggaggacccuuugucauacuccauguaacucaccaucgcauaacucugcucggcauccagguacuuuuuauacucaugguugaguuuaucaaaaacaguggcuaucacgggcagcgaugcucugucugacucacuuaacacuggaaaggcacaauguucacacacggaucaaaccaacuucaugucagcuucagaauuuccacacguugcuaugauaaaaacuaaucucaaaagguuaccaaugcaaaaguaccuuuaaaggacacucuacuuuaaagaccugacagcuagaugucauucgcaaccccuuucugguuacgguuaaaaaaaaaaaaaaaaaaaaaagcuauagcaggccaggcucaguggcacaugccuauaaucccagcacuuuggguaggccgaggcagaaggaucacuuaacgcugggaguuugagaccagccugggcaacaaggcaagaccccaucuauaccaaaacaaaaacaaacaccaacagcacauauugguaggggauuauuauuauuauuuuuuuuuggauacagggucuugcucugucgcccaggcuggagguacacugacacaaacggcucgcugcagccucguccucccgggcucaaggaauccucccucggcagccucuggaguagcuggggccacagguguauaccaccaaacucagcuaauuuuuuuuuuuuuuuuuuuuuuuuuuguagagacaggguuuugccauguugucguccaggcuggucucgaacuccuaggcucaggcaauccuccugcuucagccucccagagugcugggauuauaagcaugagccaccaugccuggccucaguaggggauucuuaaagaagacacauaugcagugaguggcuuggauuuugaaagaggugugugugaaggccaggggugguggcccacuccccuccugugugcccacuuucauucagaaccaucccauuuauuguucuuuucuaccaguaucucuacaaaucaucuuuccauuuagcagccuuuccuagggggucacauagccaccccucacauaaagaaugaggcugugggucacagacaagacacaacaauguagcccacaucccgauaaaaaguguugggcagcacaggccucacacuggaaucagagcaagggggaaggauucaacuuacucugugaacagacagacaggaugaccaucuugcauuccuuucucuggaggagaaaguccaugagucuuccuuugucugguaagagauuuacuaugggcucaaguuucacuuggagguuccagagguaaccuggauuuuaagaggcagcaaauaaaacaguaugaugcaaaccguaacaaaagcccaaaagugguuccccuaaacaucugcggggcggguggcagguggugauaaaaagccgcaaaguacagucaguguagcuuuuccuuccuaaccaaagcagagcugagccauucaggagcaauucaggagcgugucuaccacaggaggaugacagcccaaccaccgcacaccuggcugacucuuuuccaaguaaccucugcauucaggggcacaucaaagguguagcuccuaguccuucauuccaaacggggacuucccuagaccuagccccucuuuuaacguuuaaaauagaaaaagaugucaacacguggcaucaacuucaguccugugcuuugguuucuccuacaacagcucauuaguuuaaaagguaacuccagaggcucucaauggaacaucauaacucauccauucaucgacccauaaauguacugaucacccacacugccagcaucugguguggccuuucccaauugggaugccacaggagaaugaagugccacauaaaaaaucaucugggugacccccuuuucaguuggcccaaggcagguacagagcagcuguacaggaaaacaccagcgagaugcacaggagagaaaugacuucauuacauacauacaguggaugucacaugaggcuauggguuacagacaaggcacaacaaugcauuacauacaguggaugccuacagcaucagggcuaauucucuccucaagaguucuuaggaauuccagaggaaaggcaggaaaauacacagaggauuaaagaguaacauaggagauucucuaauaaccagccuggcgagguauuagagacacaggggcaacauggcaagacccugucucuacaaaaaaaaaauuauaggccggcugugguggcucacaccuguaaucccagcacuuugggaggcugaggugggcagaucacgaggucaggagaucgagaccauccuggccaacauggugaaaccccguaucuacuaaaaauacaaaaauuagcugggugugguggcgcaugccuguaaucccagcuacuggggaggcugaggcaggagaaucgcuuaaacccaggaguuggagguugcagugagccgagauggcaccacugcacuccagccuggugacaaagcgagauuccgucucaaaauaauuauuauuauuauuauaauaaauuaacugggcguggugaugugcgccuguaggcccagcuacuugggaggcugaagcaggaggaucgccugagcccaggagcucaaggcugcaguaagcugagauagcacuacugcacuccaggcugggugacggagcaagacccugccuuaaaaaaauaagauuucuuuaggccgggcacaguggcucaugccuguaaucccagcacuuugggaggccgaggcaggcggaucaccugagguugggaguuugagaccagccugaccaacauggaaaaaccucgucucuacuaaaaauacaaaauuagcugggcgugguggcacaugccuguaaucccagcuauucaggaggcugaggcaggagaaucgcuugaacccgggaggcggagguugcagugagccaagaucacgccauugcacuccagccugggcaacgagcaaaacuccgucucaaaaaaaaaaaaaaaaaaaaaaaagauuucucuaauaaagagauuacccaggaagagacaauuaacagacugaggaggcuuccucagcaaggccagaaagaggagcacaccucccgggcucaugcagaacagaaaagggcacggacaccggugggaaggucgaugggagaaaugagggagacacccugggguggaguccggcuuuccauccacccugggguggagucuggcuuuuccagaaugggcuuaagcaggagaauggcauucuuaguuguugcuuuaauuauuaaaaguaguauauguucuugauaaaaugcacauauaguaaaaaacguauaaagugaaaaaaaaaaaucccauucccacgcuugaaaggaggggucauuucuaagagauucaccuugaaaacgucccuggcuacaacugggauccaaagucaacaagcaccauguuguaacacgacaacuguccccgcugaccuaccuuggcuugcgcugauaaugaugucagguugaaagacaauccaagaugaagaauccacauguuauaggaaauucuaaaccaggaaaagaugaaaacaaaaagcaaacccaguuuccgcuagcacucgccccugcccaccauguacugaguccacgcuaaacgcgaggccccuggacagucagggaagcugccugcgggguggcucucggaguguuauucacagcugcccggaggaggacuucaggaccacucucugagggugaccacuugcccuguugugcacggugccacaccuuaguaaaggauacagaguuuacauggaacaggagacuggcuggucacggcagcaggaccuacaaauugagaaaacauaagugcaacgaugcagucagaaaaugcugcaaaugcugguacuuaugacacaaaagucaauacuuuuuaaugucauuacgaaauguuuauucaauuguagucaaggaagaaaugaacuguuccgucucacugaaagcacguacggggaggaagggggaaggagcuaacaauccaggaaaaucucaccaagaaaaagaaagcaugucaaggcuucaaucacugugguuuggguuauuuuuaauaaccaaagaugacucaugaucguuuacauaugcacguuaaggaacugagaaauuuacuugaaggauucaaaaucaaauacccagaucauccacggagaauguuucaaauaaauguggcuuguagcuuaauuaucuuuuuuuuucuuuaagagaggguguugcucugcuguccaggcuugagugcaguaguugaucauagcccacuauaaccacgaacuccuuggcucaagugguccuccugccucagccuucagaguagcuaggacuacaggcaugugaccaugcccuaacuuuuuuucuuuuuuuuuuuuuuuuuuuuuuuuuugugaagacaaggucuauguuaccuaggcuggucuccaacuccugggcuuaagugaucugcccaccucagccucccaacaugcugcgauuacaggcaugagccacugugcccagccacuuaauuaucuaaauaauuaguucgauuauccauugcauagaguagguccaagcacagugagcucgucugggaagcagacccccaaaaccucacaugacagggaccguuaacaaccaguuauacugcucaugagccaugcaggcagcccuacaagcuaaccaugacuccugguucuguuccaauuacccagguacaaucagaaggcagguuucaaucagcuggucagagaaagggucauugugaacagaccacccaaagguaggaaagagcccaggcagacaagcuuuggcgaagagcacucgcgcuuuggaccuaagugucaaggucugcgccgagugcacagcccucaccuuuggguggcugaccuacacacugucaggugagagcuuucauuuuuaaggccccccagaugauccuaauauguagucagauugagacccacuguucuaacaggcccaaaacaaaaagaaaaaggguggcugacucuucccaaaagugcugguuauaucuuucucaacaggcccauucaauuccugagcacgcccacccaguggcagcacagugggcaagacacacggaugcaucaagccgccagggcucacagcccagcaggaaacaaaaggagagucacuaaccucugaaaaugcuuugcagcccacacuaccuagauccccagacccucaguggauuccugauuuccuccuauugaucucugcacgggcuguuacugugaccaggccucgcaucuguucccuuaugaccagaugguuagaaccugaugccuccuaacugguccuguaccaccggaacagagcugaagguucuaagccagggguguccaauguuuuggcuucccugggccuuaagaggaagaagaagaauggucuugggccacacauaaaauacacuaacacuaacaauagcugaugagcuuaaaaaauaucauuaaaaaaaucucauaauguuuuaagaaaguuuaagaauuuguguugggcugcauucaaagcuguccugggccacauguggcccacagaccguggguuggacaggcuuguucuaaauguuuaguuuuuuucccccaauucaccagcaguuaccuucaugccaagugggcagcagacacaagacaaucacuuggcaaaaucuauucuuucaauacuaacauuauuuacaaaggaaaaggaagaagcuugaaagaacacagaaagccaaaagaccuaauugaacgucuguuaagaaccagcuccuuccuccaacugugccagaaaguaacuaagcuuuuggcugguccagcaagacagggcagucaggcugacaauggugcucuugcugaacuuucagccagagugcgauucugaacucccgggugaacgguacaaggaaauccugacugcaggcugggucaacccgcccaaugccaucggacaaagaauaaaacauuacuacuaggguuccaaaugugagccaucugacuacgucuugcacacugaaaccucagacuagccaauucugcacuccaaucuccuucaaaagagagccgggagagacugcugcgagggacaggcacagaagaaagacccugugagaacacagugagaagguggccaucugcaaagaggccugccaggagggaggccucagaagaaagcaaaccugcagacaucuugaucuugaacuucuagccuccagaacugugagaaaauaaaguucuguuuaaggaaaaaaaaaaaagagagagaguguguguugaauauucuuucaguucuaucuuaaaaucaauuacacuggaaaaaggcaaaacgaagcaaauaaaugacuucuuucccuuuuccugaauuccugaccuccacucuucugacuucccaaccccaccucuccagacagaaggaggacugauuuggguaagccuaagagccacagccgaagcacuuacugugacugucagucccaaagaaugcaauauucaucaucacugucacacggaaugugagaaagagaaaagugaucccagguuacaguaacaaaccuacagccaaaguuaauuucagcguuacagagcuaaggcaaacagaaaacguuacggguguauucaauauuaaaacauauuucaccaucaacggcuaaucaaaacuauccauucuaaagcucagggaagauaaauuauucuauuuccucccaagggagauucaucuaucuuagaaaaugcuuuuuucacaacauaauuuuagcuuauaggaucaguaguaguugcauuuuuuaaaaaacuagaacaggcugggcaugguggcucacacuuguaauccuagcacuuugggagagcgaggcaggcggaucaccugaggucaggaguucaagaccagucuggccaacauggugaaaccccaucucuaccaaaaauauaaaaauuugggccaggcgugguggcucaugccuguaaucccaccacuuugagaggccaaggugggcagaucacuugaggccagaaguucaagaccagccuggccaacauggugaaaccccaucucuacuaaaaauacaaaaaaauuagcugggcgugguggugcacgccuguaaucccagcuacuugggaggcugaggcaggagaaucacuugaaccuuaucuccucucacaaguauuuaagcgauugaauacuugguucaauugcuugaauaccucacaagcuugaaccuugugacagacagguggagguugcagugagccgagaucaugccacugcacuccagccugggcaacaaagugaggcucugucaaaaaaauaaauuuaaaaaaauauaaaaauuagcugggcacgguggcacacaccuguaauccccacuacuugggaggcugaggcaggauaaucacuugaacccaggagguggagacuguagugagccaagaucacgacacuaccuaccagccugggugacucagugagacugucucaaaacaacaacaaaacuggaacaaauggccccuggcaaaaucagacagaucugggaaucucuguuuauuccucacuccacuuuuaacgugacucccaaagaucauggugagaacacagccacauggugaaagggcagcacagacuccucuacagaacccguguuaccugugauggggaucugauagggcuggaucgaucgagcgggaagcacggggugguggaagguaacggagccgucaaacucuccccguaacuugauaucgaauauuaccgaugucugggggggaaaaagacaagacugaggccaaaaucaaucaugguuugcccaguugcuuucauuccaucccaucuugcuguuuaaaucaguuuaaaagccuguguuugcauuuccucccuacaggcuagcucuuacuugagaaggaauuugucauuaacaucacaacucucuuuuaauauuuuuaucuccucucacaaguauuuccugcauuuaugacaugcuuccuuugaugagcucacucaaagugaccuaagcagaucucugucauuucaacuggaaacauccucacgugucacagaguuagcgucaccacccucugggaggguagaggagguaagcagcuucuuuauaucagaggcccagcccacaggacccauucuaguuguccugguccacacggccucaaaaccauuaucccccagcacugucauccaugcucacaauugcaacagagaguucaaguacucguggaauggagcggauucccaccuucuuccaaggucaaaucucaagcguuaguuucugaaauaguuuugaauuaucuuuaaucaacugacacaaucacuuuuuucuaaacuacuugagacuaccaaacccauuuccaucuggaagaccaaaacucuuagcauaaaaaugcacuuucuagucuuauucagacauuuugccaauuuuuuuuuuuuuucggagacaggaucuugcuccaucacccaggcuggagugcaguggcgcgaucuccacucacugaagccccgaccuccugggcucaagccauccuccagccuuagccccacaaguagcugggacuauaggcgugcacuaccacgcccggcuaauuuuuguauuuuuuauauaggugggguuuugccaugcugcucaggcuggucucgaacuccugggcucaagcaaucuguccgccuuggccucccaaagugcugggauuacaggcgugauccaccgugcccagccaccaauuuucacaaggcuuuuaagcaaccuuaacuuugguagaaacgcagacagcuuguaccucuguauccugaugaugcacgacuaccagguuguccaccacguucagggcaaacuuucccguccuauuuaacuucaauaugugcaucuuuuuacaggcaccuucucuguaggauagaaagcaaaaaacagaucaacaagcugcaguucacauuuuaaaaucagagagagagggaaaacaaagcaugaaaucuaccgugguagaugauagaggaccaccuccgcuccugugcuguuggagguccgagaaugaugccucaagaagagaacauacagcugcccguaucuaauuagggaacaaacagacauaaaucacaucuggccauucaaaauuccuuuguucuaaauggcaucacgguuaaguaaauuauaagauauucacuuaauggaguauuuugcugccaacaaguguuuacaaagaaacaugcaguuacucaaagccuauuauaaaguuaaguggaaaagagaacacacacuaaacacagcuugaucauaauauuuuaaaagaaaaccccaaaccuaagcauagagucuaaaaugauuggaaagaaacacauguaauaguuauacuugagugauaugcuaaguucauuuucuucucuguuuuccaaguuuuguauaaugaauguauauuccuuaauaacaggaaaauauaaucacuauuuuuuuuuuucauuuuucagagacagggucucccucugucacccaggcuggaaugcaguggugcaaccacagcucacugcaaccuccaccuccuaggcuuuggcgaucuucccucaccucagccuccccaguagcuaggacuacaugcacgugccaccgugccuggcuaauuuuuaaauuuuuuuguagaaacagggucucacuauguugcccgggcuggucuugaacuccuggccucaaggcgaucccccugccuuggccuccccagucacugguauuacaggugugugccaccaugcucagccuuuucuauuuaagugccaucuaauaaauguugcugugaacaguuccugaaugcauauucuaguccagugguaaacucugugcugggccugcccagggacaaggaggagaccaaggugggagggaacagguccccaccuccacuucagccaggacugcucucacuuuaucuauugucuaaacaggaaugcuggcugggcacggcggcucaugccuauaaacccagcacuuugggaggaugaggcgggaggaucacccgagcccaggaguucaagaccagccugggcaacauggugaaacuccaucucuucagaaaauacaaaaauuauccagaugugguggcaugcgccuguagucccagcuacuugggagacuguggcaggaaaaucacuugaaccuagaaggcggagguuguggugagcugagauuguaacacugcacuccagccugggcaacagagcgacacucuccaaaaaaaauuuaaaaauaaacaggaaugccacagaagaguacguuuaaaaaaaaaggaagaagaaaugaaagaacauuauacuaacuaccauaaaguuugaaaguuugggccacuguuuuaggccacagaagaaucagaaguaacuuagaagcaaaauuuugacuauugucgaaucagauacaggcauacagggguucuuuuuuauuagucucuauuguguguuuaaaauuuucauuacaaauuuaaaaacugagauauccacuuuuucaaaugaaaauauaccuccguacugccaggcgugguggcucacgccuguaaucccaacacuuugggaggcugaggagggcagaucaagaggucaagagaccgagaccacccuggccaacauggugaaacccugucucuacuaaaaauacaaaaauuaguugggcaugguggcacgcaccuguagucccagcuacucgggaggcugaggcaggagaaucgcuugaaccugggaggcggagguugcagugagccaagaucgugccacuguacuccagccuggcaacagagcaagacuccaucacaaaaacaaacaaaaaaaaaaaguaaaagaaaauauaccucuauauauacguaauuuaguuccaugucuguuacauaaaaucuuaaucuauuuucuuauuuagaacaauuauuauuuaacugagcuuuuaaaaaaaauaaacuuggccaggcacaguggcucaugccuguaaucccagcacuuugggaagccaaggcagguggaucacuugaggucaggaguucgagaccagccuggccaacauggugaagcccugucucuaccaaaaauacaaagacuagccgggcgaggugacgcacacuuguaaucccagcuacuugggaggcugaagcagaagaaucguuugagccugggagguggaggcugcagugagccgacacugcaccacugcacuccagccuaggggacagaacaagacucugucucgaaaaaaaaaaaaaaagaagaagaaauucuaaaacaaagauacuaagaaauaaauugguucaauguucuuguuuuaucaggcuagaaagguaaaggaauuccuuagcaucacaaagcugauaaaaaucaaaaaggaaugccaaaaacacugcagguuuucuauguucacaggaccuauacacugaauacccagaacaaggggaguccuccuuauguguucuaggggucagggcaucacguggugcuuguaacacacuccuucuauuauuuauauuacugaaagcaaucacaggauggaauucucucugacacggacauacaugguagccauugcgaugucucuuucggaaaggcuggguuuaguugacuuaggcgcagcugguaauucaaucucaaauuugggcagcuucgacauagugccagccuguuuagggggaaaauguuuuaggaaaagcuuauuaaaccccuucaauguuucaucauucccuguguaaaaccaacaaggauaaacacagacuucgucuuuggauccuuuccaccgucccccauguccucucacagccugucugcccagcauagaaugaauggcuccaggagcugacggguauacagagugcccucuaguggucagagcggugacguuacggcuagaggaaccugucccuaacgugccugacacauuaggaugcuacaggaacaggggacaacuggggaaagguguuuuuuucaggggaggcuuccucuuacccuaaagugaaaaggcugcaggacauucuccaggaccgugguagacagcaagaucacggcgcucucggggcaguacauguaccaauucacauugagauuguggcucuucaagaguuucagacuccguuucucugguaauaccugaagcagaguuuaagaaacaggaucuucauuuaaaaaacggcaaacuaaucccagcacuuugggaggcuaaggugggcggaucaccugaggucaggaguucgagaccagccuggacaaaaugguaaaaccccaucucuacuaaaaauacaaaaauuagccaggcgugguggcacaugccuguaauuccagcuacucagaaggcugaggcacaagaauugcuugaaugaacccaggaggcagagguugcagugagucaagauugcaccaucacacuccagcgugagugacagagcgagauucagucucaauuaauaaauaaaucaauaacagcaaacugucagaagauccuuacagugcgcucugagaauaaaaagcagaagaaacccacuaagugaaaugaacauucucacuuguacuuauuacagcuacuacuuaaccagcccuaugcuuggugcuuuacagagccuccuaacucauuuacucuuugccacgacugagaggcaggcaucacuggcccuauuagccagaugagaaacaaggcuccaagaguggauuagggaaccugccccuuaacaaagcaauuauagccuggguaggcuguuucccuccaaaauccuuaucugugccuccacaugccugggcauguggagcacauggauacaccuaagagcaauuuacaacaaauuucuccucauccaggaaacggccaaaagaaacugacaccuccaggaccccauguguuaacucggccaccucccagaccauggcagaucugccuucugcuuggccuccaccucgacuccagucuacacugggccugggaggagcucccuucuucuagcagauguguucauaagacuccauacaaaugcaguacuuuauaauccaggcacauuuucaauguacccuaaauauuccgauauuacagaacacuguacagagcccccaagacauuaaugcucaugguacacugcacugaagaacugcugcgcaagucaggggcaggagccguaagcuucuuaagaacuauaauaauuaggaugugcuagagucuucuuucuuuuuaacuuuuuucuugaagaucugaagccaucuagguaaccuuaagguauacuuucccacugcagagaacagaaagacagacuuuuaaaugauuaccauagggaacucccccagaaagcaagccauccuucccaugcaaucacauguacaaaauucuauuucuguguguauggaauuugucuaaaguuuguuuaaaguucuccuauuggucauuacaaauuuuuuuuuuuuuugagacggaguuucacucuuguugcccaggcuggagugcaguggcacaaucucggcucaccgcaaccuccaccucccacguucaagggauucuucugccucagccucccaaguaacugggauuauaggcgcccaccaccacacccagcuaauuuuuguauuuuuauuuugagacaguagagacggcacuuaguaaagauggaguuuaauagagacgggguuucgccauggcggccaggcuggucucgaacuccugaccucagaugaucgcccaccucggccucccaaagugcuaggauuacaggcaugagccaccgugcccagccagucauuacuaagauuucgaugauggccuuacagcaaagcaccauggcauuaacacacagguguauuuucucuaaccauacauucuaaauuauaugacuuucauuaggucaacaaaauuaaaaccugaaagaacucuuaacacccucuaaauuaguuccccuuagagaucucagaagcaugcuuaauaggucaggaagcuggaacagaugaaaagaaacaggcagguacaucaaaggacacaauccacagaguggaaaggcaaccuccggauucggagaaaauacuugcaaauuguaucucuaagaagguguuaauaucagaauauauaaagaacuacaauucaacaaauaauaguaauuugauuuuaaaaauaggcacaaugacccgaauuagucauuucuccaaagaugauacacaaaguggccaaaacacacacacaaaagugcucaacaucacuaaucaacaaagagcgcaaaucaaaaccacaauuaagauggcuaguaucaaaaacaaaacaaaacaaaacagcaaguguuggugaggauauggagaaacugggacccuuguacacuuggagggauugcaaaaugguguaacugcuauggaaaacaguauagcgguucccuaaaauauucagaaacagaacuaccaucugcuccagcaaucucacucuggguauaaaucuaaaagaacugaaaacgggaucuugaagcgguaucugcauaccuguauugacagcagcacuauucacaauggccaagaggcagaagcaacccaaaugucccucaacagaugaauggauaagcaaaaugugguguauacgcucagugcgguauuaucagucuuaaaaaggaaacccuaucacaugcuauggcaugggggaaccuguaggaaauuaugguagaugaaauaagccagucacaaagggacaaauacuguauaauuucacuuauaugaaguauaaaagguaaucaaauucggccggacacaguggcucacgccuguaaucccagcacuuugggaggcugaggugaguggaucaccugaagucaggaguucaagaccagcuuggccaacauggugaaaucccaucucuaccaaaaauacaaaaauuagccaggcgugguggcgcacaccuguaaucccagcuauucaggaagcugagacaggagaaucgccugaacccaggagacagagguugcagugagcugagaucacgccacugcacuccagccugggcaacagagcaagacuccaucuuaaaaaaaaaggagucaaauucauagaaacagaaaguaaaauagagauugcuggggcugcagggaagggauaaggggaguuguuuacuggauaguuuugguuucacaagaugaaaaaaguucuggagcuauuucauaacaaugugaaugaauauacuuaacacuacugaacugaacacuuaaaaacaguuaagauaauaaauguuguauguuuuuuuaccacaguaaaaaaaauauuuuugaccacacacaguggcucaugcccauaaaucccagcacucugggaggccaaggcagaagaauggcuugaaccuaggaguucaagaccagucuaggcaacacagcaagaccucaucucuacaaaaaaaaaaaaaggaaaaaaaaauuaaguugggcgugcuggcacacaccuguaguuccagcuacucaggaagcugaggugggaggacuacgugaggcuaggaggucgaggcugcagugagccgugauugugccacuguacuccagccugggugacagagauccugucucaaaauaauuauuacaaaauaaaaaaauuuuaagaggaaguuaacaaaauacaaauggacaauauacaaaugaaaagaugcuuacuucccuaguaauguaaaaugcaaauuaaaaugucuuucggccaggcaugguggcucacgccuguaaucccagcacuuuagggggccgagauagguggauuauuugaggccagggguucaagaccagccuggccaacauggugaaaccccaccucuucuaaaaauacaaaaauuagccaggcguggugcugggcgccuguagacccagcuacuugggaggcugaggcaggagaauugcuugaacccaggagguggagguugccgugagccgagaucgcaccauugcacuccagccugggcgacggagugagacucugucucagaaaaaaaaaaaaaaaaaaaagucuuucuaccucucagguuggcaaaugucuauagacugauaauauccaguccuccuaaagguaugaaaagcagaaguuccuauauugcuagugaaaauacacaugucuagaagaaauuuggcgauacugguucagcuuuucagauguucguaccuauacugcaacucucccucuaauauaaagaaguguguacaagcauguuacugaaggguuauuuguaaucacaaaaaaauggaaaaccagccaauguccaauaacaagaaaauuuuuaaacugcaguccauccauacaguggaauacuacccagucagaauaaaauauagaaagauguccaagauacacuuuggacaaaaaaaaaaaaagcuagcugcaaaaguuuauauacaacauuccccuuuuuguuaaaaagaaguuuguauuuauuuuuaaaaauagaggaauaugcaccaaacuguucauaauaauuauuuaucgggauuauagggaacauuugcuuuccauauuacauaucuugcaauguuugaauguuuuuuguuuuaacuuuuagguucagggauagaugugaagguuuguuacauacguaaacucaugucacgggguuugugguacagauuauuucaucacccagguauuaaguccaguacccaauaguuaucuuuucugcuccucucccuccucccacccuccccugcucaaguagccccccgugucuguuguuuccuucuuugcauucauaacuuacauuuagcucccacuuagaagugagaucaugugguauuugguuuucuguuccuguguuaguuugcuaaggaugauggccuccagcuccauccauguucccacaaaagacaugaucuuguucauuuuuauggcugcauaguauuccaugguauauauguaccacauuuucuuuauccaaucugucacugaugggcauuuaggaugauuccaugucuuugccauugugaacagugcugcaaugaacauucacgugcaugugccuuuaugguagaauaauuuauauuccucugcauauuacacccaguaauggggcugcuaggucaaacaguaguucugcuuuuagcucucugaggaaucgccauacuguuuuccacaaagguugaacuaauuuacacucccagcaauagugcauaaggguucccuuuucuccacaaccuugccaguaucuguuauucuuugacuuuuuuauaauggcuaugcugacuagugugagauaguuucucauugugguuuugauuugcauuucucuaaugaucagugauguugagcucuuuuauguuuguuggucgcaugugugucuucuuuuaaaaagugucugcucauguccuuugcccacuuuuuuuuuuuugagacggagucucgcucuguugcccaggcuggagugcaguggcaccaucucagcucacuacaagcuccgccuuccagguucaagcaauucccuggccucagccucccuaguagcugggauuacaggugccugccaccaaccuggcuaauuuuuguauuuuuaauagagacaggguuucgucauguuggccaugcuggucucgaacuccugaccucaggugaucugcccaccucggucucccaaagugcugggauuacaggugugagccacuguaccuggccuuugcccacuuuuuaauguuguuguguuuuuguuuuuuuuuuugagauggggucucacugucauccaggcuggagugcagugcugugaucuuggcucacugcaaccuccugccucccaggcucaagcaauccucccacuucagccucccaaguagcugggacuacaggcgcacaccaccaugccugacuaacauuuuguauuuuuuauagagaugggauuucaucauguuggccuggcuggucucagacuccuggacucaagccauccacccaccuuggccuuccaaagagcuggaauuacaggcaugggccaccaagcccuuuuucuuuucuuuuuuuuuuuuuuaauuuauuacuugcaauuauaaaaaaaaaaaaaaagaauaaaauccccagcaagagacuaaagcugaguggccaaggcaggaguugagguuaggaguuugacaccagccugggcaacauagcaagacuucgucucuacaaaaaaguuuaaaaauuagccagggccgggcgcaguggcucacgccuguaaucccagcacuuugggaggccgaggcggguggaucaccugaggucgggaguucgagaccagucucaacauggagaaaucccgucucuacuaaaaauacaaaauuacccgggcauggugaugcaugccuguaaucccaucuacucacgaggcugagacaggagaaucgcuugaaccugggaggcggagguugcggugagccgagaucgcgccauugcacuccaccagccugggcaacaagagcgaaacuccgucucaaaaauaaaauaaaauaaaauaaaauaauaaaaagaaaaauuagccaggcauggugguacaugccuguagucccaccuacucaggagacugaggcaggaggauugcuugagcccaggaguuugagauuacagugagccaugauggugccacugcacugcagccugggcaacagagcaagacuccaucucuagaaaauguuuaaaauauauauauauauauucaguacugaauucaaaaggcugccagaaugcuaucacugaacuuuaaccaacaaacauaaaugauaaacauaauaccugguaaaauucgauuccuugaucuguuaugaagacaauuucaguugaacuaguccagcagaauccuagaauguuggcauucuuagucuaagaaaaauuuuuuaaaaauauuuuuaauuaauaagaaaaaacacauauaacucucuucaaaagcuucacaaacucugcaguuugucauucuuuaaugaacguuccccggaauguuuacuaauuaacaaaacaaauuuucuuuuaaauacaauguucccugauuuuugcccauaacucuucauucaagaaccugaauccuaauuccuucuacuaaacagaacaggagaagucuguguuuuguagaaaaguaacugaccagagcucacagacagcagcuucuaccugcaggaaucaccauacugccaacauucuuagucacccacguuauaaaaaugguuauuaaaaauguacaaaggccuaagggucuuuagugaguguugacuaaaauggguugaggacccugagacacacacccgacucgcuugagggcagacagguuugagaagggccgggcugagggucucuucacacggggccacugcagggcaggcaggacagugguggggaugcaccucuccucaccaaagaguccgcccugaacuccauugagcaaaacagucacaaaaaugcagaaagcccuaccccaaccacuagcagcuucugucagcgcccaaggugccacacugccaauuuuagcucagcucccucuagccuaguuuacuacacccagcaaaucucauuaauguggauuagaaucaacaccuaggagaagaaagaaagaguaaggacaagacaaagacaacaaauugaggaaaggaaacuucaggaaacagaaaaagaaacuccucaccagaaaccuccacuccagguggcugugaggcaucccagggcccagacccagaugugcugucagcccagugaggagaaaaagggcaagacagacgacagccccaagggcuagcacuacuggguguucaccacgcaucauccauugaacccucccccuccaaaggaacaagcuuucaaacuuagaaaacuguucagugucacaaagcaaacaccccgccugacuccaguuugggaaucaacaugagggacagucugacuucaagucugugcucccugcgaccccaaugccccgcucuccacuacauaacccagcucaacaccacugacaccagcagcugagaaagggccuggggucauaccuugcacuccuguguguauuccagcugggaauuaucagggauaaaauuacaaaaauccugaaaggaaaaacacacagacacacacaaauuuggauuaggcagcauacugccaaccuacguuggcauacuacaagacaagaaaaauaaauauuaacuuaaaaagugaccagaaaauaacugaagacaaccaaaacacaggaaagauaaaaagaccaauucggaucaucugucucaacagcagcaggcuuacgauucaauuuuuuuuaaguuaauacaaauauucaguuacaguuuaguaacuccuuucaaaaauucauuccucaagcagcugaugucagagaaauguguugcugcacuaagaggcuuccccaagacuuuaacacuuaaaacugauggaagaaacuaacagaggauucugccuguuucuaacagccuucccucuacucuacaaacggcaauggugaacauuuacacgggcuaaagugccuguaggcugcuucaacuuggaauaucugcuccuaucagaucuagcacucagaaaugagagaugaaaaggcuaauucacaaaguagccaaaaauaccucacauauucuaugcugcuaucaagcaauacaaaagacacaugaaguuccaaauuauuuuuuaacaauuuuuaagggagacugaggcgagagaaucacuugagccugagagaucgaggcugcagugagccgagaucacaucacugcacuccagccugggcaacaaaggaagacuggcucaaaaaaaaauuuuuaauuuaauuuaaaaaucaaacuaaggucauuuuuuuaacccacucaaaugucuuuuucguuuuugaaggcucuaauacaaugcaacauaacuauaccuuucacaacaguaagauaauaaaaguuuccuuuaacacugaaaauuugcgauuccuucucuuccaaauguauuucuaaugcccuuuaaugcuguauuuuaaagauaagucuuaccacagucuuugagguccucugaacagccaauaucuuauuuucuaaggaaaacuuaaugcacuucacuucuccuuugucauccauucuuuaagaagaaagauuguguuaguaguuaaauaaccgaauucuagcuacuaccauuuauugaaaaggcaaaagacacaaucuauauucaggaggcagcaaauucuagucuaaaauuaaaauuauguuucggaagccaucaguaggaccucuuuucaaacuaccaaauccaacuggaaagaacuugcugggaaacuuacaguauuauggguaacaagugauugaagaauucagaucacacacacauaucaccugagaauuguuccaacauaaauaacuauagacccgcucaggagccuucuccguaacugcuguuucucucucacagcaaagcuucuggaaagaacuaucuacuugugcaucucacagcacauucauuaugcaacccagauggcuccacuacagugucucaugaccgccucagacagauguuaaaaagugaacucagcugggcacagcggccuacaccuguaaucccagcacugugagaggaugaagcaggaggaucacaggaauucgagaccagccucagcaacacagugagaccccgucucuauuccaauacauacauuuuuuaaauuaaaaauucauuuaaaaaaaaaaaacucaagggauggauuacagaagggcccaaggaaacuuuucggggucugaacauguucauugccuugauuguggugaugguuucauggguguauacaugucaaaacucacauauugcauaauauuaaguguguacaguuuauuaugugucaacuaugccucaauaaagcugcuuuuaaaaaucuuuuuuuuuuuuuuuuugagacggagucuugcucuguugcccaggcuacagugcaguggcaugaucucggcucacugcaaccucugccucucggguucacgugauucuccugccucagcguuccgaguagcugggauuacaggcacgugccaccacaccuggcuaauuuuuguauuuuuaguagagacaggguuucaccaugcuggccaggcuggucucgaacuccugaucucaagugauccacccgccucggccucccaaagugcugggauuacaggcaugagccaccgcgcccagucuaaaaacucuuuuuaaguuaaauucaguaccuuccccccacccacaaacuucuuagagcccccaaucuagauuaucacgggcucacucguuuuccacacccaaccgacccccgggucuuacgagagacccaucuuccuaaguaucccuugauugccuaugcaaugccacucuacaccaccagagcgcugcucuucaccacacauggcucgcugauugcuacucuccauagcaucccuaacucugacaggcucccaacuaagccagccuccgugcugugaacagcaugaucuugccaaacacugacaugaucaucccacaccccaccugauaaguuucaauaagaagauaaagcucuaauuucauaggagaauauguaagguucaagcuggccccugccaguggccacaccaccaccauuuccccuucccuguggagacacccuauguaaccuucaguuacacagacccagaguuccccaaaacaccaugcucgaaccccauccauacuuuaaaaccuugcucaggccgggugcagcggcucaugccuguaauccuagcacugugggagucugaggcgggcggaucguuuugaggucaggaguucgaaaccagccuggccaacacggugaaaccccaucucuacuaaaaauacaaaaaaaauuagccgggcgugguggugggcgccucuaaucccagcuacuugggaagcugaagcaggagaaucacuugaaccugggaggcggagguugcagucagccaagaucgcaccacugcacuccacccuggggaacagagggaggcucccucucaaaaaaggacaguuucucauuaacacagaccaacaguaaaauuuuuuaagucacuacugaauugagggccuacauuauacuuucaccuucuguaagcaccaguguuacaguggccagauagcuuaucauccaaaucgagacacuucugaaagugaaaggcccugcuguugaucauuaaaccuguucaacagugcgaacugggacuaugcagucaccuuaaguauaguggaagccaugauuuucuuguauuauuacaugagaaacaaugaaucuccuccaccugccacucuggaaagaccugggcuaaagaaaugaacgcccuccucugugaacaaaccagaaaugggcacaucaucacgcugacuuguuaauuuccagugcuaggaaguggcugccccacuuuugaaguauuuggcucccaaaucaacugcuccagauauuccacucugacaagaggugcuaguaagugccacgaagacccucccuacagacaggaauuccaugugcgcacacagacuucaggccucuuagggcagaccaaaugacaaaauuauaaaaaaccauuugaauuagaaaaacaucauucuguuuacaugacaaaaugaucugaaagugucuauaccauuaccuaaaugagaugggauuccuaucaucugggccuuuaacuaccacgccaguagcuccaccagaucgaacagcaaaaaccugagagggaaaagcagcaagguuaacagccugaacucugaaaggaucuaaacucagaagccaacccgcaagcgauuauuucuguuauacaccacccuggguucaacuaaaguaacacggcacauaucaagguacagauguuuggcugcucaggugaauuuuaaaaaccaagagcagagagcgaaaaggaugccaccgugacaccgggucggguucccgaggcuccaaguucuaacaccgguucgcgcaucggcgccgcugauacgccugaaguacagucuuuucccccuuuacaaaauuucaaggaaaaugaaaaucucgacgucuaaacccuugacuacgaguguaacuaaugacaaacacaacaaaagaagccuagauaagacgggcgcgccaacaauugagacacuggccacggggccacugcauccgcgcagcuggcucggggguccagccccgaggucaccugcgaggacaccuggccgcggcugagcccacccaacaaggaaggagcgcgcgccgccucccgcgcugggacgggacgggacaggacaggaggggacgcucgggccuggucgcgcgggaccggccuuggcgcgcccacgaccccggcagggccgcgcgggggaggaagcgcgggcgcgccggaccugcuuguuggccucaucgaagaagacgcaguugacaggguucgccuucucgaacugcaccggccgcucgcacagcuccagauaguaguccuccucgcccauggcgggcgccgcgcccgcggcgggggccccgggggcggucgccagaguggagcaggaugcgcgguggagcccggcccggacuguagcggcggcugcggcugcggcucugggcccggcgcgg

SEQ ID NO: 192738 - RNA, 55119 nt, Homo sapiens
gaagggcaacacggggaccuugaagcggggucgcggcggcgccccagcccgggccagggagucccggcagcggcaccucccagaaagggcggagccgacgacgccuucuuccuuccugaccggcgcgcgcagccugcugccgcggucagcgccugcuccugcuccuccgcuccuccugcgcggggugcugaaacagcccggggaaguagagccgccuccggggagcccaaccagccgaacgccgccggcgucagcagccuugcgcggccacagcaugaccgcucgcggccuggcccuuggccuccuccugcugcuacuguguccagcgcaggugagcggucgccggccaccgggacgcccuguggggacguggcggggccgagagccggggaaggcgacgggcccagcgacggcucaggcccggguccuggggaaguuggucuggcgauggagagcucggagguuccucacuuguccuguuucugucuccggccacgcucucuuuccuguggucuggaagaggguggcagugggggcuugggugaccuguucugagcuuguuccaucuguggucaccuaauuucucuguguaggauguggcaccagaagaagggaggaaaguggguagagugggauagggacacuacuugcuuuuuaaaaaauucugcuacaugcgcacgaacuccaaaauuuaggagcucuaaccacuuuauuuccucuucucaucaccugaggauggagguggaagcagagguaaagagacacaaacuuccucaagcacccggugaaacugccuugaguacuugacauaagucagcuuggucuucuaaagagggcagguuacuuuucaucaacuccuuuuuacaccucaggacacugagacucacagggcgguauugaauuuccccuugucacuauuagccagcgacaggauggggccuggaacucgguguccugcugacuccuucugggggcuuuugcuugguuuaauagcuuugggaaagagcaccucaguauuugugugucuguaguuuccucuuuuaaaacuggaguggggcagugucacgcugugacucguuaaaccaaaucaggaugagagugccuccggggaauuguguccuugugcacauuaacgccccucacauagguguggcgucaauaggaaguggugaaucaggggagaggggguuccguggacuagaaaaaacucuccuucgacuucuauuuaguucucagaaggggauaggugauguugauccaauaauggacuaagagccaggagaagggcuccgcgggaggaucucuugagcucagcaguucaagaccagccggggcaacauggugaaacaccgucuuaaaaacauuuuguuuuucuuuucauuguugagguugaggcugcugugagcugugaucacgccgguguacuccagccugggcaacagagcaagacccugugucaaaacaaaaaagagagagaaauaaauaauagcaauuaugugccguagagaaaauguggcuauucuguuucccuagaguuuuuuaaaauuuauuuuuaaaauuuauuuauuuuagagacagguucuugcucuguugcccaggcgugggggcagugucgccaucauagcucacugcagccuggaacuccuggccucaagcaguccuuccaccuuggccucccaaagcacugggauuauugugagcaccacuccuggccccuccuagaguuuuagaucaggaccuuaaauaggcuucccuuuuuuuuggagacagagucucuguugcccagucuggaguguaguggcgcaaucucggcucacugcaaccucugccuccuggauucaagcaauucuggugccucagccucccagguagcuaggauuacaggugcccaccaccacgcccagcuaauuuuuguauuuuccguggagaugggguuucaccguguuggucaggcuggucucgaaauccugaccucuagcgauccgcccuccucuuuuggggauuacaggugugagccaccucgcccagccaggcuucacauuauuaaguagccaucucuuaaguauuuuuuaaaucucaaguacccaaggcugauggccaaugagugcuucuuuuaugacauuugggauaggucagagguuuguuguaagucucuugcaaaaaugccuggaggccuuuucaaggucuguaaaccuuaacuggaaauaauccuauuauuauuuuaaaaauuccucaugucugaaagcuuucagugcaccugaacagauugggguggagccaugaagccaaacagauugggagagagagugugucugcuuuuagaauucguaccgaugauagcagcucauuagcuucagucugagcgcuaguagaguucuaucauggaauuauggacuaguuguccuguguaagaucugaaauacauguuggggggauuuuugcuuuuucuuaauguucaauauguacagaugauguaauaacauuacuagacugccuuguuuuuaaaacccuguagucaucuaaaaacuauaugcaguuuugagacauagccuuuauuuuucccggcuguaauuuugguaagcuuuaucuugagggacuuggaacauagagaagccuggguagaaauuaagcauuaaaauggcuuuuccucagaagacugggaaugguuaaucuuuugaccugugagugauuaagaacaaccaucugaaauuggaaugacugugggaaaucuuuccccaucuuucccacuccuugacugaugcugugaucagaaauuuuacuaacauaaguaaucaaggggaaaaugagauuuuuuuaaauuugagccagugggcagagggaaaaggacucgcugaauaggccuuuguauuccuccaguguuuguuauauuacccagaacaaagaaucacucuggucaugaagacagugugcucucucuuuccuggguaacccuccacuccuaaaagggaugcaguauucuaagcauggcagauuaccuacagcggaagccuggaucagucaucucugaucucgggugccccuuucugcccuuugaccuccagcucugugaagggcaucagcucuccagucaaauugaacugcuugcuagcaaaauccugcccaucuuccagggccccauuucacaugcuacauuaucuacgacauucuuguccuguuccccuaacuagaaugccuucccucugaaguucugaaucuuuauuuaaacugcugcaacagcauuugcugccucauuaaaagaccuuggugugggucuugacucuucucuguucccaagagugaucuuggguaagccaguuauccucuggagccucaguuuccuccucuguaaaauuggauuaacugugccaacuaugcuugugaaagacaaauauuuccuaauugaacuaccgaauugcaggcuccuuaagagcaauaacuguugcucuccaauaucaucuacaaauguggccaggacacuugacuugggacucuuuuuuuuuuuuuuuuuuuugaaacagggucuugcacugucccccaggcugaaguguagugguuugauuguggcucacugaaguguugacccugggcucaagcuauccuuccaccucagccucccacguagcugggacugcaggugcaugccaccaugcccaacuaauuuuuaaauuuuuuguagacacaaggucuugcuguguugcccaagguggucuugaauuccugggcuggagauccucccaccuuggccucccaaagugcugggauuacaagcaugagccaccgugcuggcccuggaaucuuuuuuuuuuuuuuucaagaccaggucuuacuuugguugcccaggcuggagcgcaguggcacgaucuuggcucacuacagccucgaccucccgggcucaggugauucucccacaucaagccucccgaguagcugggacuauaggugugcaccaucaugcccugcuaauuuuuuguauuuuuaguagagaagggguuuugccagcuugcccaggcuggucucgaacuccugagcucaagugauaccauccaccuccgccucccaaagugcugggauuacaggugugagccaccaugccuggcccacugggauucuuugaucauaagauauuugggccuugaaauggauuuuggggagagacuuagaaacuaguggcaaucaaaauuggauuugcaguugguuucuaggugauggcagugaucagcugcggccagccagguuuuucuucaucuggacugugccucucacuuucaaauuuuuggaacauuugcuuuggcagcaaaacuuuuaaaaaaccaacucucucuggugcagguguucuguuggaggauuugagagaagcuuuaaaauuuuaucuuauuacugucccuugcuuaggucacaagaggagcucaaaauaauuucauaaacaugaauuggcuucccuagacacaacaaaggauaagaucaaaagaauuaacccauuuaaaaaaaucagucuaggcugguccuaagguaguguguuaucaauugaucaaagucaguuacagaucgaacuccuugaucuacucuuuccuccugcucacuacugcacuugacuaguccaaaacaauaaguaaguaguaaaaaaaagaaaaaaaguccgucuauacacuguaaagugcuguguaaauguucauaauuacuaucacugucuucuucauaguugauggggggaaggcuggauacauaaaaaaaugguaauacaguaagaagugcucagauaagaauaaagauaaaauguuauggagaguccauuuuugagcugagcuauggaggaugaauuaauguaucagguggacaagaggaaaacuagagaaaauagucgggagaguugccuaauuguugcccuaaacuauugaacuguucacuugaaaagggugaauuuuaugguauguaaauuacaugaguaaagcucuuaaaaaaauuugcagggugcuauauacuagauuacauaagacuagagacaaaagcuacccaaauuuugcauaguacuccauugcuaucacauccgaucuuguuuuauccucacagagccccuuuaagguagguguaaugcuguuuuuccuauuuuauagaugcagacaucaagggucaaauuugucccaaggucacauagcuaguagauggcacauugggugcuucaacugccaucuucugacuucugugcccuaguuuuuugaaauucaaggcuagauuauugguguuuagcaagcuuaauugaauggguguucagcagauauuccacuugguuaguagagcagucucauucaaggccugguuccguccccaguguggcucuuccaguaguccguaauagaucaggaauggguuuagccugcuggccugaccccugauucagucaccacacugugaacauuccauagggaaaaaacugcagacaguguauacuggcacccacuuucauaguuuuguuuuaguuuuguggcuccuaaaugucuaagacuaacuaguaauaugaccuugggugagucacauaaaaaaccagaagcuaaagggguuaucuguaaaacgaagaguuggacuagcugagcacaccuagcacucaaaauauaugacuuaaacacccacaugcaggcaggccuggugcacacacaaauuauccuuuguuauguagauacguucaugccagguuggcuauaaaacacuuccagagauuuccgucaauagaagucagaccagcccggcagccuccacccuaaaugcccugccauauuuguuuggucugccucccugacuccaaagaagcagcaggcagcuuaaucucuggacaggauucuucaugccacucccuccacuccagccuguguuguccugacuggccaggccagccucugcucucuggagaagcaaugagguagggaaguuaaccagcaagccccucuccuccaucgccucacuggagcuugagcuggguaucucuccauguuuugccauuagcuuuacccauccaggacaggggcacaaguguuggugccaagcccugcacucccagcucugguggauggccaaguccuacccugggguugaggacugucagugauacugaguaagggagucauugcuugacaacugccuagagagauacuuuaaaagauaggaaugggaggcauuauuucuacaagugaacaaguuuauauugaaggaacacuuguauaggaucaucauggaugggacaguucaucuccagugcauucuccaauucugaggauacaucacugcacaaacuggacuagaguuuaaaugguacagaagcuggggguaggggaggcaggaggacaagggggauggguggagaaugcuuaacuugguguucaaaaucauguuauuuaugagccaugugaccucagaguaucuuugagccugaguucacuuaccuguaaaauucugcugugcuacugcauagaguaucugagaaaaugaggcaugcagucgauguuugguauuuuuguuucauuuauuuauuuuacugccaugccucgagaacaauagauguucaguaaguauuugaauauguuaguuaaugcuuuaggauuuccuaaaggcaguggaauagaauucucacugaguucagagcuuuucugauaauaaugugugcuuauggagcuccugaaugggguccaauuuagcaguugcuauaguugcugagauauagcacaaggggcauuuuuuuuuuuuuuagauggagucucucucuguuacccaggcuggagugcagcggugcgaucucagcuuacugcaaccuccgccucccggguucacgccauucuccugucucagccuguagcugggacuacaggcaccugccaccaugcccggcuaauuuuuuguauuuuuaguagagacgggguuucacuguguuaggcaggauggucucgaucuccugaccucgugaucugcccaccucggccucccaaagugcugggauuacaggcaugagccacugcaccuggccuagaaggggcuuuuuuuuaaccuuuccugaacuguuccuaucguugaaagaagcuucccuauccagucauuuucuuaguaauuaaacucuagagcauguugugaaauauccauaugaucuaaccuuuaaaaauagaaacucuuuagcuguguaacuacuaaauucuggguagaagccaaaacaaucagcacuucucauuucugaacuuagauaauccaguuguacucccucagcucauugugaguuuugacaaguucugcauccaugaacaccagauguaauacaauagggaauuucaaaggaaggauuacacaccuaggcucugcccucuaggauuuuaccgucuuacaagggaguugagacaaaagugagaaaauacucuggcaacuucucccaacaucacaacuuugcaauucucauaaauuuugcuugauccuagggcaugaccaaggcagaggcaggcagguccuacuucaugugggagagaaggaaggaaggguaggcaguuagagugauagguuuggaauacuguagaaaggagagugggcagagccagagugaggugucugaagcuugucgcacaggcagugggaaggguggguuggagguuucugagcaccagaaaacuuugagcauuguuccggaagaggcaagcggcaggcaucugcaccagagacacugccggguccgagugagggcaggaggcugcacgagggagccucccugggagugagcgauagguucgcuaugggagguggguucgaaaggugccugagauuuucauuugaaacucuguugaagaggaauuggcaauagaggaggaaauacaaauagaggaaagauugguuucgucuuaagcacugaggcuguugggcagcuaguggaaagugcugcuggagagaagcuggagaucacugaagcugagagagggguuuguggauauaauuagagcaguguuucuagggaggugcaggugaagggacugagagagagaugagguuaaaaacacagaagagaaagagauggagguguggaggccccugagguggagcagcugcagaggcaggccugggggccaggaggcuggcucuccacuuucagcuguuggugagaagggagugaaggcugagcagcucccauugugcagcuguugagugcacaggugcucgugcucuugcacacggugggguuuggggagggugugaugcuacagggaggacuuucaugaugcagcugauucucuuuuauugagagucuguuucuggagucaccugcucuguuuugaauccuggcuuugccacugugaccuuggacaaguuguuuagccucagugccuucguuucugcaucuguaaaagggguauaauaacgccucccucaucaaacuguuguaggauuaauuggguuaacauauugagaggugacagcgugcuggcaguccucagagcccuugcuugcucucggcaccuccccugccugggcucccacuuugguggcauuugaggagcccuucagucccccacugcacugugggagccccuuucugggcuggccaaggccggagcccacucccucagcuugcagggagguguggagggagagacacgagcaggaaccggggcugugugcggcacuugcgggccagcuggaguuccgggugggcgugggcuuggugggccccacacucggagcagccagccagcccugcuggccccgggcaaugggggacuuagcacccgggccaguggcugcagaggguguacuggguccccccagcagugccggcccaccggcgcugcgcucgauuucucgcugggccuuggcugccuucccacggggcagggcucgggaccugcagcccgccaugccagagccucccacccccuccguggccuccugugcagccugagccuccccgacgagcgccacccccugcuccacggcgcccagucccaucgaccacccaagggcugaggaaugcaggcgcacggcgcaggacuggcaggcagcuccaccugcagccccggugcgggauccacuaggugaagccagcugggcuucugagucugguggggacguggagagucuuuauaucuagcucagggauuguaaauacaccaaucagcacccuguguuuagcucaagguuugugagugcaccaaucaacacucuguaucuagcugcucuggugaggacguggagaaccuuuaugucuagcucaaggauuguaaauacaccaaucagcacccuguguuuagcucaagguuugugagugcaccaaucgacacucuagcugcucuggugaggacguggagaaccuuuaugucuagcucaaggauuguaaauacaccaaucggcacucuguaucuagcucaagguuuguaaacacaccaaucagcacccuguguuuagcucaagguuugugagugcaccagucgacacucuguaucuagcugcucugguggggccuuggagaaccuguguguggaaacucuguaucuaacuaaucugauggggacguggagaaccuuuguaucuagcucagggauuauaaacgcaccaaucagcacccugacaaaacaggccacucggcucuaccaaucagcaggauguggguggggccagauaaaagaauaaaagcaggcugcccaagccagcauuagcaacccgcccggguccucuuccaugcuguggaagcguuguucuuucgcucuuugcaauaaaucuugcuacugcucacucuuuggguccacacugcuuuuaugagcuguaacacucaccgcgaagaucugcagcuucacuccugagcccagcgagaccacgagcccacugggaggaacgaacaacuccagacgcgcugccuuaagagcuguaacacucaccgcgaaggucugcagcuucacuccugagccagcgagaucacgaacccaccagaaggaagaaacuccgaaaacaucugaacaucagaagggacagauuccagacgcgccaccuuaagagcuguaacgcucaccgccaggguccgcggcuucauucuugaagucagugagaccaagaacccaccaauuccggacacaaugugaagagcauuuaaaauagugccuaagccuaggacaccgccagugcuuuguaagucuuuggguccugcuggcuuagguugcuucuuucggcaggaugacuuuuuuuuugagaccaguuuucacuuuguuguccaggcuggagugcagaggugcuaucucagcucacugcagccucaaccuccuggguucaagcugaucuucccagcucagccuccggaguagcugggacuaugggcaugugccacuaggcucggcuaauuuuuggcuguuguuguuuuuguuuguuuuguuuuuuuguuuguuuuuugagacaguuuagcucuuguugcccaggcuggaguguaauggcacaaucuuggcucaccacaaccuccgccucucggguucaagcaauucucuugccucagccuccuaaguagcugggauuacaggcaugcaccccccacaccuggcuaauuuuguauuuucaguagagacaggguuucuccaugucggucaggcuggucucgaacuccugaccucaggugauucaccugccucagccucccaaagugcugggauuacaggugugagccaccgugcccggccuguuguuguuguuguuuuuaagagacaggguuucacuguguugcccaggcuggucucaaacuccugggcucaagcgacccaccugccuuggcuucccaaagugcugggauuauaggcgugagccaccacuuccagccaggaugacuuuuuuuuuuuuuuuuuuuuuuuuuuuggucuucucugcugugucucuagaagaugaccuuuugagaagcaaaccugaauguugauucaagcccaaauuuccugggcucagguguuaauuuuuuaagucuuuggaaccucuuugccgaggucucaagcagguagaagacauuaauaauaauuccuuauauuugauugcguggugcucuguaguuuacugaguacuuacuauauauguacagauaggcccuuauuugaucuucacaggaaccugugagguaggcagagcuuaugagcuucauuucccagguaggaaaacuccuacgugguuacguaaccugcuccaggugugaucccaggugcaauccagcucaacaagcacacugagccucaggagcucuugggaucagaacccaggacucgaucccacuccgugccgccuucucacccaccccucuuccaccaaguggguggaaauagcacuugcuuugaaauaaguaacgaaugaucuuugugaaaaggaaccuaaacagcagugggccaucuuuauucacaucuauaguaccaagugcugaguaaggggauuuuagacuccagacacccguccuguuugucaggccagagcugcaguguguugacugcacaucugucucuugucacuccugcuccuguggguaaccagccagagugccccugaggcagagacaggccaaucccuggagaguucugcgaggucuagggaagaguucuuuguauuuaaaauuucaugugaacuucagcaguuuccucugccucuguagucagcuuuugccuuuucaaacuuuaguuagauggauaaugacuuuuacucauuaggacuuuuuuccauuaguuggaaacccagaguugcaauacguuucuuuuuuccuuagaaucaccggguuuaugggaauaacaauugggauucucuuuauauaaaaauagugguggaaucuuggcacaggguucauauguggcuuuguugaaggcuuguugucacuuccuuauuuguauaauuucccuccuuuguggccuaaacaugacuuucaaagagucaagaggaguuaaguccuaauuuuuauuuuagaacaucugaaaaaugaauucagagaaaagugauauugaugccuuggauuuccccacacauacaaaucccaaucuccugcugacuuuuucucauguuuuugggcuucagggacuguugugggauuuguauuuugauacugaaggaccaacacagacugacuuagcuucuugccugugugcaggucaugugccacugucacuggagagaauuucauguugugacuucuguucagauuuguuuuuuuuuuauggcuuucccaucaggguucuugggagccauggcugcuucuugauaucuucuguuucccuguagaacagacgauugcaggcccggggcccuggcaagcugggcccucuguggcuuucugaguccauugugaggcagaggaucaggugcguuuugggcagcagccuucagagcaaggcacugaccugaugauucacacugaccccuccccuccgcugaauuuucugacaaccuugugacucucacaugggaaaugugagugguuuuugagaaaucuuuacauaagagguuuuaaaauuuucuuuugagauugccucgguguuuuuccuuaaaguuagcacauucuuugcuuucuacuucagccucaaggacaggaaguucauucucgcucuuuacauugggguguugauguuugugguuuuguuguuuuguucuucauguuacucaugauguauugauauuaauuaaccuaaauacauauggaaauauucuuucauuacuuagagcuuauauaguuccuggugcagaugugcaaaaauagugcuuuaguaauugcuaagucacuaucuugcuuuucucucuacugugauugaguauuucuuacauggaacuauagcuuccucuuaucaacaaauaagcaggaaauagaaauuauguaaauaagcaauuuccauuaccuacuucacugacuugacaaauaggcauuuggucugcuuuaauuaauauuuuucaaaauguuaagugccuguugcuguuacuuaauuuugcagguagcauuggaaguuucugugauuguacuugagugggcacuucuuguugaaauuuaccauugagacccugguaacacugaaguuuguguugacuuucuguagguguuuucacaguccuguguuugguauggagaguguggaauugcauauggggacaagagguacaauugcgaauauucuggcccaccaaaaccauugccaaaggauggauaugacuuagugcagguaaguucauuaucuuaggcacugggaacacaaaaugcugaucacaagauccucuguaauuauuccuuaaauguuauugcaggguggagguggagaugagacuaacaggcuuaagucuuaucccggacucucaaacucuaaccuguggcauacagugcagagaaagaacaccguaacuccaaaggcuuaauuuuucaggggcugacuuuauaccucucauaaaguuucccaauagcagguugcuauuuagagacugaccuugguacuucguauguugcccuugcagcaucugcaaaauauauuagaaguuagcugguuuugauuccuagauuucaggacucaaauggacucuguugcuaaguggcuuugacguccuuguccccuggucauuucaguguuuucucuguguuccacugagagccugugaauuuuggcugcuaccaggauucugauuccuguucuuuuuuuaccauccugugauacacagggauauuagaacuggaaaaaucaugugaaaagccugguuuuagaggcuuaaaguaaucaaaagucaagucgacaugauaacagaguuccuaggcucacuuguucguuucuuuucuguuuuugagacagaaggagccuugcucuuuuauccuggcugaaggcuagagugcaguggcacaaucacggcucacuguguccucgaccuccugagcucaagcaaucucucaacucagcgucccaaguagcugggacuacaggcacaugccacaaccccuggcuaauuuuuuaaaaauuuggggagauggggcuucaccauguugccuagccuggucucaaacuccuaggcucaagcaauccacccuccucagccuuccuaaguacugggaguacaggcaugagccacaguaccuguccucacuugcugcuuucaucauaauuauuaaagguuucaacuuucccuggaauuacuaauagaaauaguaaguagcacucugguugaauugaaucaaacaaacaaaaaacccuaagaagacauaaaaugauugucaggagaggagagaaagcuuccaaauaaaaagaaaauuagaaacaucucuacuugugaauaaauaguaaauguguagccuuuuaaaauaauucuauaauaacuuugcaaauacaggaugugucuuacccuuuuguacuucaaaaggauuacaugaaugaaugugucuuaguucacugaggaauguugaccuuacucuaacuguugccuacucccgugucugugcucuuucaccugaaaggaacucuguccaggauucuucuuuggcaaugucagucucuguugugauguucggcagcuucagacacuaaaagacaaccugcagcugccucuacaguuucuguccagguagguucugcuggggaaacagaacaacugggcuguagauacuugugaacugguaaugcucagcuuuccauuuauucuuuguuuacauauuuuuauuuauuauaugucuauauuauauguauauuauauauuuauacauauauguauacauguaaaguaggugaauauauauuuauguauuaaaaauacauguauguauaauguguaugcaugcguguguguauaauagagacagagucucacucugcugcccaggcuagagugcagugguuuguggugugaucacagcucacugcagcuuaaacuuccuaggcuccagugauuguucuaccuuagccuccugaguagcuaggacuacaggcaugcacuaccaugucuagcuaauuuuauuuauguuuuucuuuauuuuuuuuuuuuuuugagacagacucuugcucugucaccgaggcuggaguacaguggcaugaucucagcuuacugcaaccuccucccggguucaagcgauucuccugccucagccuccccaguagcugggacugcaggcacaugccaccacaccuagcuaaguuuuauauuuuuaguagaggugggguuucaccauguuggccaggcuggucucaaacuccugaccucaagucaucuacccgccucagccugguuauuacaggcugggauuacaggcaugagccacugcaccuagccuaauuuuuauuuuuuucuagagaugagggucucacuauguuggccaggccuggucucaaaugauccucccaccuuagccucccagagugcuggauuauaggugugaaccacaguucccagccaguuuuuuuuuuuuuuuaaagucaguuuuuguuuuguuuuaagaaagcacucuuacaauuugucagaaauaaagagaaaaacaauaauuaccagacuugguucacuucccaguugcauucagaguugaugcuugguuuccucugcgauguucucacccugcagggugucugcacugcggccaggcuccuuucaaacuugagcugugcacuguggggaagagagguuccuagggguccugcucaggugccuggccugagacucucaucaugcaguccuuccucuccccccaugcuuugcuuugcacaucauucuugucccucccucuggugaaggguugugauagagucagguccucaguagagccggccucggggagcuguuaaaaauuuuguucugcuguagcuggcugguuuugucaaacuuaguuuuuuaucuguucuguuggcuaugacccugagcagugaaaaagggcuugguaauagauguucuucucuaggccuagccagcaauucucaaauaugcaaaagagcaagcugguaguggucuuuagaacagcagauugugguaucuuucuaaauuuuucagacuucagcacacugauaaagauguuugggaagcaaauauuaaaaagggaaaaugcuucucugcacaaauaucacugcagguggugauagggcacaaguuggcuuccagugaagaaauucugcuucuuaccaaaaguuaacaauagagaauggaaaaccaccacuaaauuguuuuuucagaacaacaaaaguugaggcuguaauugggccagcauauccuaugaaaggcuugugaacauugauggaaccaaauuggagccuuguacacucagucaaaacacauuuauuuaggauccaccguaggugaggcauuauggacauacggacauaaacauaaaaagauagccaaccuuucuccauauuaucagagguaccaaagcuugauuuauaauagcaaacaggagaaacaaccugauauuuggaaaaauauacagcugucaaaauuagugauugugggcauuaaauguaguaacauggaaaagguuugaaaacuguguaccccaagagugauuccuauuagaauaauacaauugugguuucuggcuuuguugcaguaaagcaguggggcuccugaaagaaagagagucugugcuucucugucuccuucacuagaacagagacucuugaaggccaggacacacuuuuuucauucuuugucuuacauggucacugggacugaaucggagucuaaaguaaucuugauugcaagaaugcaagucuaaugaaacagcuuuugcaaguaacaguggaccaaagggaaaagagagcucuuuuaucauguaacaagucaacauuaggagcuuaaacuuugaaccugaaggauagcaggcagcuuaugguucuugugcaguugugugcuccugaagugcaugcagccagagaacaacauugcuguucucuaucuuuacaaaccauggggauuucuccuuguguuucaggagggccuagugauuuuccggggcuugaaagaaaaccuuucaauagguuauaagaugaagauucucauaauucucauuauuuuauuuucuucuuaaucaaaacugucagcuggugcagcgcucaugucgauaaucccagcacuuuggaaggccaaggcaggaggguugcuugaguuuaggaguuugagaccauccugggcaacacagacccacaucucuacaaaaacauuuuaaaaauuagccaggugugguggugugcaccuguaguccuagcuacuugggaggcugaggugggaggauugcuugagccuaggagcucaagguuacagugagcugugaucacaccacugcacucagccugggcgacaaagugagacccuuucucaaaaaauaauaauaauugucuuccugaugcuccaaagucccuuuacucuaggucagagaauguaugucucuaaauuauaaagugcagaauucagagaagcaucucucucuuuuugaaauuauaauuggacacaauaaaugcagaaaguaauuagggcauuuuuuaaaggugugccuuuauuuuaacaugaaguuuuaaguuuagaauugcugguuuuuaauauguucucuugguaauuugucacuuuacaguaaguuuaaaauauucuuugucuauuuaaaaucguucuugcuggcccuauuaugugugagaucaugcagaauauaauuuacuuuuccuuuagauguccauccuguuuuuauaaccuacugaaccuguuuugugagcugacauguagcccucgacagagucaguuuuugaauguuacagcuacugaagauuauguugauccuguuacaaaccagacgaaaacaaaugugaaagaguuacaauacuacgucggacagaguuuugccaaugguaaguaaacuuuuaauuauuccucuuuuacagcuggcaucaggacagcagagcaaauuguuccuuuuaguuguccugucaacucuggaaaaucacaauuuucaguuccauuggccaggaaauaagaguuguugcuuugcuuguauccuaggacuugaacugcaacgaauauaaaaaucuccuuaaagcgcuugcuuuaacucccccuaacuuuaacuucccacauggaaaauuuuaguaugugcaaguuugcauccauacacuucaguaaccauuggaucuuugacucuaacagacaugaguuguguaaugucauaaauuacugcaagacugagaagauagaacuguuaauaguuggcagagaagaggucaugacuugcaagaaucagaucaccauaaaggaaagucagcaggucuaacagauagcagaaaugaucccccagcauugaccaacauacaacauuuaauuauaaugacaaaguaaaaagguaacaaaaaaauuccauagaaaaaaggucucauucacaaaagcaacaaaaaauaaggcacuuaggaauccaaaagaugugacauacaaggcaaccugacugaauggagagaggucauuuuguccagaaacagaagccugcauguauggaaaguggauguguaacacgugugucauuacaaaucauugagagaaaaggugggcuaguugauaaaugagaugagaaaauagauuauauuuaucuaauuuuaauuuuuacagaaaauaaaaaaaucaauuguguagauuaaaaaucccaauuggaaaguuuuagaaguaaauauggaaagauuucuagacaggagaggaaaagcagaaaccauaagaaaaauauuuaugaauauaaacaacuguuaucuagagcagacagcgaaaugcaaauuugaacaguaaacuaccauuucacaccucaucagcuuggcacaaauuaaaaaguuggucaauuucaacugugggugaaaaugugaagcaauaggaauacuaauguacuccaccacuuacaaccauaauuugguacaaucguuucaaaacuacuugaaaaacaacuuugcaguacguaguaaguugaagcuaacccuccucccagaaauuucacuuauagaugccugccuuagagaaacucuaaaugcauauaaaccuggagacccauauaagaacacccacuguaacacuauugugauugugaaaaauugaagaccucaagaacgagaagacaagacacagacugggagaaaguauuugcaaaagacauguuaguaaggacuguuauucaaaauauacaaauaacuccuaaaacucaauaagaaagcaaacagcccaauugaaaaauggacaaaacaaccugaacagauaccucaccaaagaaggcauacagugguaaauaaguacaugagaagagaugcucaacauuaugucauuagagaauuacaaauuaaaacaacgagauaccacuacacaucuauuagaauggcaaaaauucaagacgcuuucaacaccaaaugcuggcaaugagcucucauucauugauggugggaguacaaaacgguacagccaccuuggaagauaauuuagcgguuucuuacaaaacuaaucauacuccuugguauuuacccaaaugaguuaaaaaugugucuaccccaaaaccugcacguggauauuuguagcagcuuuguccauaagugccaaaacuuguaagccaccaagauuucucucaguaggugaauggguaaauaaacugcuacauccacacaguggaauauuauuuggugcuaaaaagccaugaaaauucagugcuaucaagccaugaaaguacauggaugaaccuuaaauccuauuacuaagcaaagccaaucugaaaagacuacucacuaugauuccacuauaugacguucuacaaaaggcaaaaccguggagacaguaaaaagucagugauugccauggguuaggagagaggaaggcauaaguagagcacagaagauuuuuagguggugaaaauacucuauaugauacuauaauggugguuacauguuuauaugacauuuugaaacaaaaguacuacauacuuaaaacaaguacacaaacaugcaugggaaggauaaacaucaaauucaggauuguguuuaccuuagggaaggggcuacugucagggagggguaauuggggagcuucaacugaaucuauagaguguguguguguguguaaguauuuuauuuuuuggaagagacgggccucacuguguuggugaggcuggucuugaacuccuggccuuaagugauccuccugccucggccugccaaaguguugggacuguaggugugagccaccacaccuggccuauagugcauuauuauuuuuauuuaguuuuuaaauuaugccauagccaguuguucugaauagugcaguacuacaaaacagagucaaggucucaugcugucacccaggcuggaauacagugaugcaaucauggcucacugcagccucaaccuccuagguucaaguagucccccuggguaguuggaaccacaggcauaugcuaccacaccuagcuaauuaaaaacaaauuuuuuuuuguagagauagggucuugcuuuuuugcccaggcuggccucaaacuccuggccucaggagaucuucccacagugcugggauuacaggugugagucacugcaccuggccgaguccauuauuuuuuuaauguugaggcaaauguugugaaaugguaugacugauaguuaacuggguaaugaggaaaugagaauuguauuauucuccauguguuuuguaugcuugaaacauaaaauaaaaccugaaaaccaaauggugagcuggaagauacgagggaauuacucagaaaacagcauacagauacaaagaccuauaaaucauuaaagaaaugacauauaacaugagaagcuccagagaguuggggagagacaauaauaaucaaagggauaaugaggauuuuccagaguggauaagggaugaacccugagaacuuagagaaaauucagcauacaaaaaucaguuguauuucuguacacuugcaauggacaaucucaaagugaaaauaaaacaauuccauuuacuuuaguaugggaaauacuuaggaguaacuauaacagaaggcaaaacacuuuaaagaacagccgggugcaguggcucacaccuguaauccaagcacuuuggaaggccgaggcaggcagaucacaaggucaagagauugagaucauccuggccaacauggugaaaccccaucucuacuaaaaauauaaaaauuagcugggcgugguggcgcucgcuuguaaugccagcuacuugggaggcugaggcaugagaaucacuugaaccugggacgcggugguugcaggagcugaaauugugccacugcacuccagccuggcugacagagcgagacuccaucucaaaaaaagaaaaacagaaaaaacacacuaaagaacauuauucagcgaaauuaacgaggaucuaaauaaauggaaagacauuccauguuuaucaaucaaaagacuuaauauuguuuagauaucaguauucuccaaauuguuuuauagauucagggcaaucucuguuauaaucccaacugacuucuuuguggaaauugacaagcugauucugaaauucacauagaaguuugagggacuuagaauaguaaaacaacccugaaaaaagaacaaaauaggaagacucacacuucucaguuucaaaacuaagcaauggaaaucaagacagugguacuggaauaaagauagacauauagaucaauggaauauaacugagaauaaauaauauaucuauggucaacugauuuuugacaagggugccagggccauucaaugagaaaagaauacucuucaucaaauggugcugcaauaacuggauacacacaugcaaaaauaaauaaauaauaaugaaauugggcccuacuucacaccauauguuaaagaaauuaacucaaaguggaucgaagaccuaaauguaagagcuaaaaacuauaaaacaauaaaacauagggauuaauuugcauggccucauauuuggcacuugauucuuaaauaugacaccaaaaacaagagcaauaacagaagaaaagauuaauuggacuucauuaaaauaaaaaaguuuguauuucagaggacgccaucaagaaaagacaagaaggccgggcacagugacucacaccuguuaucccagcaguucggguggcugaggcaggaggauugcuugagcccgggaguucaagaccagccugggugacaaagugagacccugugucuacaaaaaauaauuagccaggcaugguggcauguaccuguggucccagccacaugguuaucugaggcaggaagauugcuugagccuaaggaggcugcacuaaguaccucgcacuccagccugggugacagagugagacucugucucaaaaaaaaggacaagaauauauuugcaaauuguauauuugauaagggacuuguaucuagaauacauaaagaacucuuggccgggcgcuguggcucaugccuguaaucccagcacuuuggggggccaaggcggguggaucaccugaggucaggaguucgagaccagccuggccaacauggugaaacccugucucuacuaaaauagaaaaauuagccagguguggugaugugcgccuguaaucccagcuacucaggaggcugaggcaggagaauugcuucagccugggaaguggagguugcagugagcugagaucacaccauuggacuccagccugagggacagagacuccaucuccaaaaaaaaaaaaaaaaaacucuuacuacucaaugauaaauaaauaacccaauuuaaaauggcaaaagaucugaauagaguagacauuucucuaaggaagauauacaaaugaccaacaagcacaugagagaugcucaauacuaugagucaucagggaaauacaaaucaaaaccacaaugagauaccacuucacacccaccaggauggcuagaaucaaagucacauaacaagaaguguugacaaggcuguggaaaauaggaaccuuuauuaaaaagaaauccaaaaaccaaaaacagcugggcacaguggcucaugccuauaauccagcacuucggacggccaaggcagguggaucaccuuagcucaggaguuugagaccagccugggcagcauggugaaacuccaucucuacaaaaacuuagcuggguaugguggugcacaucuguagucccagcuacuugagaggcugaagugggaggaucacuugagccugaggggcagagguugccagugagcugagaucacaccacugcacuccaaucugugugacagagugagaccccacuuuggaaaacaguuuggcaguuccugaaacaaacauagaacuaccauaugacccaucaguuccacucacaagacgaaaguauaggucaacacaaaaacuuauacacaaaugcuucuagcagcauuacugauaauagccaaacuguggaaacaacucagauauuuaucaccugauauauggauaaacaaaacauauguccuugcaaugaaauguuguucggccguaaaaagaaaugaaguauugauacaugccacaauaugcaugaaccuugagaacauuaugcuaaaugaaagaagccggucaugaaagaccacauauuauaugauuggauuuaugugaacugucugaaauagucagauaaauagagacaguucagugguugcuuagggcuuagggaaguagggagguaguugugcauagcuagaauacaggauuucuuuugaggugaugaaaauguuauaaaauugacuauggugauaguugcauauaucuaugaauaugcuaaacuccauuaaauuauauaguuuaaggggguaaauuguaaauuacauguaauuauauuguaaauuauauagcgccaccacaccuggcuaauuuuuuuuuauuuuuuuauuuuuuguagagacgggguuuugccauauugcccaggcuggucuggaccuccugagcucuggcaguccacccaccagggccucccaaauuacugggauuaaaggugugcauaaccaccccuggcccaaagacaaauaucuuaaaagcaaauagagacaagacacaaaucaccuuaagacaaugauaauuggagauuuucuuaccagccaugauagagccuggaaggcaauggaauaaucuguugagaauucugagggagaugacugucacccuaguuaaccugucuuuccagaacaaggguaaaacaaaaugaauguguaagcaucuccuugaagauuagggaaagaagauccugggaaguuucuagcaagcagagacugguaaaugagaaucgacaguacaggacccauuccagcuauuuucuuagguguaauacacugauacuauccuuauauaauguguuguguguauguguaagaaaauaaaauccaaaaagauaacaguauuagggguuuuuuuuguuuuuuuuuuuuguuuuuuugugauggagucuugcucugucacccacgcuggagugcaguggcgcaaucuuggcucacuucaagcucugccucccggguucaugccauucucccgccucagccucccgaguagcugggacuacaggcguccgccaccacgcccggcuaauuuuuuguauuuucaguagagaugggguuucacuguguuagccagguuggucuccaucuccugaccuggugguccgcccaccucggccucccagagugcuggaauuacaggugugagccaccgugcccggccaacaguauuagguuuauugacacgugaccucugcucuaaaaccaguuuuccaaguaaguuccauaauucucuggcuguguagcuuccugcggcagagguuuucuggaaccagcuuuguuaacugaagaaguacugaggcucuuagcugcgucuuccugggccuugguauacucuucuauauaguggggauuugacuucuccaagcuguugugagagcuaugagauaacgugugccuuucccuuuccugucuguuuuuuacuuuuaaguuacuuggaaucgggccuccauauuauuugcagggugauaagccaauuuaaagggaaucucuguucgugcccuuaguuaguguuugcuguccagcauuccagcauggugcauauggaguucguguuucccuucaagaggccuuuuguaagaucuugccucgugaauuacagcaagcaucuugucuccuuuuuccuuuggguuuccucuucuagcaauguacaaugccugccgggauguggaggcccccucaaguaaugacaaggcccugggacuccugugugggaaggacgcugacgccuguaaugccaccaacuggauugaauacauguucaauaaggacaauggacaggcaccuuuuaccaucacuccuguguuuucagguagguauaaagauuccaaguuugguguguuuaugauauuguuuuaaagccaaggaacuggcugggcacaguggcucaccagugcuuggggagacugaggcaagagaauugcuuaagaccaggaguuccagaccagccugggcaauguagugaggccccaucucuaugaaagaauuaaacauuagccaggugugguggcaugcaucuguagucccagcuacuugggaggcugaggcaggaggauugcguggguccaggaguucaaggcugcagugaguuacgaucaucccauuguacuccaaccuuggugagggcaaagcccugucucuccaugaaugaaugaaugaaucuuaguugaggaagcauaaucuacaauaggaagauaaacacauucagguaacuaguucauaguuucucccaguaagagagguaacugguacauuuauccugcuguggcuaauuuagggggugcugggagugggaauggaggaggaaaugaauugccuucaggcauugcugucauaauugaaagaauaagcaguuaaaaagggggugggaggcagcuuuucuagagcucugcuauaguauuagcuccugagaauggagaugggacaugauugaaggguugccuugguaugugguguacuuggaggauuccucuaucagugacaaaccccuacgcgcaaguuuauugagguaacuuaaaauuccauaggacgaagcagcaaaacauaauuuaauuaaacuaaaaccuccaauucuuuuucuucuuucaguuguuuuauguauuucagugggcuuuucuuugaguuuaaguauaauacaaaauuuuggauguuuuuaauugagauuuguacucaacacaauuccuuucuguagauuuuccaguccaugggauggagcccaugaacaaugccaccaaaggcugugacgagucuguggaugaggucacagcaccauguagcugccaagacugcucuauugucuguggccccaagccccagcccccaccuccuccugcucccuggacgauccuuggcuuggacgccauguaugucaucauguggaucaccuacauggcguuuuugcuuguguuuuuuggagcauuuuuugcaguguggugcuacagguaagcaguuuuguuugucauccagggcaaaaagagcaaaauugcccacuggcacuuugagcuuucauuugucagagcuugguuacuuaggacaagaaacaaauaccuccaugaauaccauugcauggauuauuguguccuacagcuauucuauaguaaaccaucaaaguucuguuuaacacugcaacaucugaaaugaauuuuacugauuuauucaaaaugaugugugauuuaaagcacugugcauuagccacugauucuuuuuuuuuuuggagacugagucucacucuugucgcccaggcugaagugcaguggugugaucucagcucacugcaaccuccaccucccagguuuaagcaauuccccugcaucagccuccugaguagcugggauuacaggcauccgccaccaugccugcaugccugacuaauuuuuguauuuuuaguagagacgggguuucaccguguuggccaggcugaucuccaacuccugaccucaggugaucugcccgccuuggccucccagagugcugggauuacaggaguaagccaccgugcccagccggccacucauucuuuagaaagucagagucaaggccaggcucaguggcucacaccuguaaucccagcacuuuaggaggccaaggcaggagaaucaugaggucaggaguccauugcaaacagcccuggcgacagugcgagacugugucucaccaaaaaaaaaaaaaaaaaaaaaaaagucagagucaaaugagcgaaaucagauucaaaucuaauuaaauggaguacuauaguccuuuuagauauuugcaucuuaauuuaggacaguacuuuuuuuacuuuuuauuuugaaauaauuguagacuuaaccaaaaaguugcaaaaugguagaauuuauguguauccuuaacccaguuuccccgaugauacaacuuacauaacucauaguacaucuagaacuagaaauaccauuugacccagccaucccauuacuggguauauacccaaaggauuauaaaucaugcugcuauaaagacacaugcacacguauguuuauagcggcacuauucacaauagcaaagacuuggaaccaaccuaaauguccaacaacgauagacuggauuaagaaaauguggcacauacacaccauggaauacucugcagccauaaaaaaugaugaguucauguccuuuguagggacuuggaugaaacuggaaaccaucauucucagcaaaauaucgcaaggacaaaaaaccaaacaccgcauguucucacucauaggugggaauugaacaaugagaacacauggacacaggaaggggaacgucacacaccggggacuguuguggggugggggccugggggagggauagcauuaggagauauaccuaaugcuaaaugacgaguuaauggguacaacacaucaacauggcacacguacacauacguaacaaaccugcacguugugcacaugcacccuaaaacuuaaaguauaauaauaauuaaaaaaaaaacucauaguacaaugaucaaaaccacgaccaugccauuauuauuacauuauuauuagcuaaaccagagaucuuaaucagauuucaccagcuuuuucucuaaugcccuucccuguuucaaggucccauauuacauuuuuguguuuuaugaguccccucuaaucugugacagaaaguuccucagucuuuccuuuucuggccuuaacacucuugaugauacuggucagguauuuuguagcauguccuuccauuuggcuuuaucugguauuuucucaugaugagauugaaauaagguguuuugacaaguacaucacagaagucauguuaugucuuucucggugcaucaugucagggaucccugauguugaugcgucucuuuccuggugauguuaaccuugaucacuugcucaaggugaugucugcuggcuaucuccacugugaaguuacugcuuuucccuucguaauugauaaauaucuugggggaagaugcuuugagacuauacuaauauuuuguuccuccugaaacucaaccacugauuuuagcauucauuguugggucuugucugcaacaguuauaacuaagguguuugccugauagugauuuuuuucucuuucccucucuuccucugcauuuacuaacuggacuucuguacagaaagcuaucccuucucccucauuuauuuacucaguuauuuacaucauggacuuuuaauucuguggguuguauccaacacugucauuuaucuuguuacucaaaguuuuccacuuugggccauugggagugccuucuggcuggcuucuguguucuuacauacaccucccauccccagcuuuaucuuacauauucccugucccugcccugcaaggagcucugguuccuuuuauuggagaaugguauguagaaacgaagaucugggcacuagguaugcucauugcugcuggaaagaguagcauguuuuuguuuguuuguuuguuuuuuugagauggagucuugcucugucaccaggcuggaaugcaguggcgcgaucucagcucacugcaaccaccgccucccugguucaagcaguucuccugccucagccucccaaggcacgugccaccacacccagcuaaccuuuuuguauuuuuaguagagacaggguuucaccauguuggccagguuggucucgaucucuugaccucgugaucccgcccaccuuggccucccaaagugcuggguuuacaggcgugagccaccgcgccuagcccaguaguguguuuuuaaaggaccuaaaaguuuuaaauaaaaugagggccacaaggugaaauuauccuuuauuaauuguucucuuaacaucuucuuaaauuuucuccugagacuggugagcagagggacccagagcaaggggacuuaggggaaagaaggcaguaauuagggaggaggaggccaggaggaggaagaaagcauuucaugggauuacaggaaugucccaaaaacaaccucacugugaugaaguccacuaaugcuauuucuucacuucuguuuuucagaaaacgguauuuugucuccgaguacacucccaucgauagcaauauagcuuuuucuguuaaugcaagugacaaagguaggcauauuuguccaugaauaaaaggguucagaugaugcugucugucaugagagcauucguuuccucagugggguugcagcagugggugagguggugugccagugccgaggacacggcugcgaccaaggcagacaugguccuugccuuuguggcccuaccaucuagucaggguggcacagcagaaccaaguaauuaaucauagcuggggaggcgcgaaagcagcaggacaagagugggaauagcagggcaggguugaaccucacccuucagaggcuccugugucggcaucuccucuguggggugggaauagcgcucauugagggcagccaacaaagguggcuuugcugagcagauagguagcugagggcaggggucucauauguguccccaggugggcuugauuccugccaugagauagcaacuaaugcuuucccuguuccgacuuucaggaacggcuuggcucuuaaccuccaccuucccuuccucucccguucuuccaggagaggcguccugcugugacccugucagcgcagcauuugagggcugcuugaggcggcuguucacacgcugggggucuuucugcguccgaaacccuggcugugucauuuucuucucgcuggucuucauuacugcguguucgucaggccugguguuuguccgggucacaaccaauccaguugaccucuggucagcccccagcagccaggcucgccuggaaaaagaguacuuugaccagcacuuugggccuuucuuccggacggagcagcucaucauccgggccccucucacugacaaacacauuuaccagccauacccuucgggagcugauguacccuuuggaccuccgcuugacauacagauacugcaccagguaaccugcuguuugaagaaauaagucacucuagaugaccuugugguuugcuggcuuuuacauguugacuacugcuagauggggauuuggggcugaaugucaugguauaucuugaaaaucuuagcguauaauggcaaagcugccuuuaaguuagguuucaagaaagugaaugauguugaacuuaauggaauauuuauuguugcucacuuuuguauuuacuucagauaguagaccuugccuuuuucuugaaauugagaugagcagagaaagaagacuucaguggcguuucucuauugaggcaggauauauuuauuaggaagucaccuuaggaauuugugaaauguuuucuguugguaacugaaaguaauaugcaaggacccagaggcaugaagcccuuacugcuguccugggggcugaggaaggagcugccagauuaccaucccugauccaaccuguaggaaugaacuuaucacucacugccugaacaugggcacccagccuguuuuuggugagaggcgcauuuggggcaagauccaucccauugcuccuagaaaggcauguaaaccuucccauugucccugucacacuugccuuggagaacuguaccugugcauaaacuguaccggcuucuuuuuuaaugaauguauaaucacaugguuuuuccuuuaaacauugcucaugucuacaagaaagucugcaaucuugaaaagcauuaaaauggucccaagacuugaaucuuuucucuacccagugacugucuguugcuuuuuccagcuuguugcugaaggugaacagcauagucauuuaccuccaagaucaucuucucuguuaggaaauaaggggacauauauaaauggcuguagugcagagcaaggcaggagguuauguguuacuauugagaggagggucagggagaccaggagucccccuccacucuccccucuggccugcuggccaccacuggagaacgguggaggggagaugguuguguguccuauguugauagcuguucuggucaugguguucccccuaccccucgccgccucuguggacgccucuaacuaguuugcuguuagagugggccuguggccugaccaguuuucuuacuguauugcaucuuaauucucucccucaucuuaggaaguauuuuccccaaauacucuuugucuucugacccucagggcaaugcugauuaaucaagaucugagagaaaugugacguguuucuggguuugcuuauuuuuaaaaucuucuuucagguucuugacuuacaaauagccaucgaaaacauuacugccucuuaugacaaugagacugugacacuucaagacaucugcuuggccccucuuucaccguauaacacgaacugcaccauuuugaguguguuaaauuacuuccagaacagccauuccgugcuggaccacaagaaaggggacgacuucuuuguguaugccgauuaccacacgcacuuucuguacugcguacgguaaguggcaagagacaaucauugguagacaccauucuugggucugacuuaggguacaugggcaaaagcuuguuuuaugagcauaacccagaggugagcaaacaacaagaccuugcccugugaaguuuacaucaucuuuuuuuuuuuuuuuugagacagggucucgcucugucgcccaggcuggagugcaguggcgcaaucuuggcucacuguaaccuccggcucccaaguucaagcgauucucauaccucagccuccugaguagcuaggacuacaggugugugccaccacgcccagcuaauuuuuguauuuucaguagagaugggguuucgccauguuggccaggcuggucucaaucuccugaccucaggcgauccgcccaccucggccucccaaagugcugggauuacaggcgugagcuuccaugcccagcuggaagcuuacaucuuaauggagggagacgguugaugaacacauaacaugugcuaucgugccagcuagagauuagugcuaugaggagaaaaauaaggcuggacagaguggggggugcauugcuuaagcguggagaugugcacaaagggagaggaaaggacagcugggcacaucacagggaugagaguucccggcagaaccagcagcaagugcagagcccuggcaggaagcucucguggugugugauugaggagugcagcugccucucacccuuuaccucgugccugggucgcuaacacagugucauguaucacaccccccacaagauuuaaagauagaagagccuuuggugccuuuuguucugucucagauauauagcccaguccccuguagugccccagcuauuugggaggcagccucccucugaggaguugaggcaguauaggucugcagcuccgcagcuuuagauuggagggcccugcagcugcuucccuuaggaggcaugucuagcugggcagggugcguuuauaauugggaauagucaccccaggaagcggugcuuuggugaccuguaggggaaucuuaaggcuucucccaguaggggaagaguagcaugaugccggaugggccuacucucccugaaugcuagggaccuggccuagggacauuuguucagccaguugagcaaccacaguggcuauuucuucagcaugggaacagagaaauuauuccuuuuugccuuuaaggacacugcucagccgacuacuucucaagagcuaaggacucucacuucugguucuaaagaacuuugaccuugaguucuguuuguuuguuacuggaguaagacuuuuuaugcaguugggcuauauuuacucuguuucaagaauaucaccccuaaaaacaugaguuauacucaugaaaacacaauagcuuaugcuccauacccuaaaccggcauucuccacaggguagacggugcagacgagccauggguaauuugaagaaacaaaaaacauuuaauguuacauaauuuuuauaauuggacaaccauuuaauguuacauaaauuuuauaguuuacucucuguggcacaagauaaaagucaacaaaaaugaugggggacagaggugcgugagccuuguguuuccucaaagcggacgugguucccaccaguguggaagcgguacagggaguggcaggcuccugguggcagggaccugaauugguuuguaguuaugcuugugcgcguccucauaaccccagucucgcccuagcgcuguccccuuuccucucccuccagcuuuuccuggacuuuuucaccugaggguccugcaguaauggcagguggccugcccagaaccaugcccuuaccugcuucuucuccccauuuuguuuaaaggcagugacagcuaccaguuacucaggcuugaggcuuuaucccugaauucugccucgcccucgccuuccucaugggguucuuacgggucugagccucuggaugcucucucagauuucugcuguggaugaagggacucagcugcucgcugcaggucaccugaccucccucaugccgucacccauccacucugacgggugggucauaugcagaagcuucucagcaccuggccaaguuguagcugauggucuguccgaaaaugcugguucacucuccacuggccaacugucugucugcacugcacugccaguugccucuugccugcgccauugcgcuaacaucuccacuuacuguuccaccugcuuccuguuucuuugccguuuccagaccuuccacuuugccacgcaagcuaucuuuguaaaacagcucaugacauuucuuucccggaaaucucuaauuguuccccagugccuccagaauaaaaauccaaacuacuuaacuggcacugaguccuuuuauuuugcauuugucuguccauuacucuucccagacuggcccccuccuucaggagcccccuuggugggcaccccaugcucuaggacaggacaucuuuucuuugaauuauuauuauuuuuuuuuuagagaugggaucuugcuauguuguccaggcuggacucaaacuccuggguuauagccauccuucugccucagcuuccugaguacuugagauuaggcgugccaccauacccggcauacaggacuugccaaaccaccaucuugcucucauucccucucacuguucucucucccucccuuuuuccucccacaguuguaauugugugagacacccuuuuguccucccucuuuggugaaaucccccucauccucggagcucugggucuguacagucucuuccucuuggcuauaauuuugccuuuuaguguuugcucccuccucugugccugcauagcgccaugcaccaugugccauugauggcacugggcuguauuugccugccucuugcccagugauucugagcucccaaaggugagugcugagcuguauuacucaacugagaaaccucagggcccauguuguccuuagaauacagccagccucaucaaauguucacuguguaaauguuuaggucccugaugucuugaggcccuucuaacugggagguguuuucuaaacuuuuuggcagggcuccugccucucugaaugauacaaguuugcuccaugacccuugucuggguacguuugguggaccaguguucccguggcuuguguugggaggcuaugaugguaaguaagagaagcuuugacuuuuccuuuuagauaaagucaucucgguuuugucauuagcaucaagugguaauuaugaagauuucauaaauugggcaguuuuguuaauuucuuaccucuugaaucccagaauaguaucuccuuuggcuuuggguuuggguuucauuccagauuuaaaagaaguggauuggguuagccauuuuuaggucacacaugccuuugagaagcugucgaaggcuaaguaccuuuccccagaauaaugcaauugcaaaccucugcauuguuguucagcuugaaggucaugggccuccgaaguucauuuauagacccucuagggagcucauggaccucagguaagagccucugugauagagaaaagauaguaugugagguauguggaaaaagaaacaaaguugauggauuuuuuuucuucuaagccagucaguugaguauuuggacacucuuacagugugaagagcagcugguuugcucuuuccugguuccuguagcacuuuagaaccaauuguacuugacaaaaugaggugauuauucaugugacaccuuuggcaucuuaagccaaauuacaggcucaacagguuuugcccaaccaguuaagaauccagauagguuuucuucuccucacuugguggcaggggagaaguugcaaucuguauuuaaaauuuacugugcaucagagaggaaaaugccauuucuaauuguuggagaagggauggugucagcaacugacuagccauaggggaaacaauugacuuugaucucugacuuguucauuucaccaaaauaaauuccagauggauaaaagauugaaauguaagaacugggccaggcgugguggcucacgccuguaaucccagcacuuucggaggccgaggcggguggaucacaaggucaggagaucgagaccauccuggcuaacacagugaaacccuaucucugcuaaaaauauucuuuaaaaaauuagcugggugugguggcaggugccuguggucccagcuacucgggaggcugaggcaggagaguggugugaacccgggaggcagagcuugcagugagccaagaucaagucacugcacuccagccugggcgacagagugagacuccaucucaaaaaaaaaaaaaaaaaaaagaaauguaagaacuggaagaaaauucaggaggcauuuuuaaaaauaauuuuuaaguggaaaagauauuucuaagcaagacacaaaacucagaagcccgaaaaggaaagacugaugaaguugaguacauguucauuuguggagaacaaacauacaguuaaaaaaacaaaacugggccgagaguuauucaugccuguaaucccagcaauuugggaggcagaggcgagcacaucacuugagcuaggaguuugagaccagccugagcaacauggagaaaccccgucucugcaaaaaauacaaaaauuagcugggcaugguggugcaugcuuguagucccagcuacucgggaggcugaggugggaggaucacuugagcccaggagguugaggcugcaguaagcgagauugcaccacauuccagccugggugacagagcgagaccuugccagaaaaaaaaaaaaacuggacaaaaauauuaguaugcauggcagucagcauuuucuuaauaaauaaagaucucaucucagccuggccaaaaugugaaacccugucucuacugaaaauacaaaaaaaauuagccacacgugguggugugugccuguagucccagcuacucgggagacugaggcaggagaaucacuugaauccuggagguggaguuugcagugagccaagaucauuccauugcacuccagccugggcgacaagagcaagacuccgucuuaaaaaaaaaaaaaaaaguugugaaaaaaagaucaacaaccugaaagaaaagugggugaggucaugugaaagauaacaaaagaagaaauacaaaaaaaaaagguuuuuauuuuauuuuucagagacagagucuugcucuguuguccaggcuggagugcgguggugugaucucggcucacugcaaccccugccucccagguucgagcaauucuucugccuccaccuccugaguagcugggauuacaggcauguaucaccaggcccagcuaauuucuuguauuuuuaguagagacacgguuuugccuuguugcccagacuggucuugaacuccugaccuaaggugauccacccaccuuggccucccaaagugcugggaucauaggcaugagccaccacgcccagccucaguaaauauuuucuugacuaaaguaaugaaaagggaggccaaggcaggaggauugcuugagccugagaagucaaggcuucaguaaaccaugauugugccacugcacuccagccagggcaacagagugagauccugucucuaaaaaagaagaaaaaaaggaaugaaaaauaguuaagcuucuuuggaaggcaguuugggagaauuuaucaaaauuggaaauauacauaguuuuugauucauugauuaugcuuuaagaauugauucuagccaggugcaguggcucaugccuauaaucccagcacuuugggagggcaaagcaggaggauugcuugagcccaguaguucaaguccagccugggcaacaugacaaaaucccaucucuacauaaauacaaaaauuagccagcaaugguggugcacaccuuuagucccagcuacugggaggcugaggcaggaggauuaauugaguucggguggucaaggccacaaaaagccgcgauugcaccacuguacuucagccugggcaacagaacaagacacugucccccugucaggcccccaccccaaaaaaagaaaaaagauuuauuucuacaaguauguguuuuacacauuaaaauauuuauaggcuauuuauaguaacuuuguaauagaaaaaauugcaaaacuacucaucaguugggggggauuggcuaaaguauaccagaaaauacuguaggaaaagaauaaggaaacucuuuauggagcagucuccaagauacaaaauuuuaaaauguaaugugcagaauaguauuuuacuguuugugugguuaagagggaaaggggaagaaucuguguguuugcuuguguguguguggaguggcucuggaaagauucgcagauggucacaguauggggaggagaacuaagacaaugaaacagauguuggagaaggagagaauuuucgauaaacacuuuucuguucuguuugaaauuguuaacaugcauguacuguauccuuuaaaaaaaaaaaaaaaaagaguuacucuuccugaaugauaaccaugccuaccucagauaaaaaauccuuuuuauucauuaacugaaguacauaaagacuauuucagcaaacucuuguuuaauucuuagagcccagagauacaguccauagcuccagugagaaaucuguguugugauuuuuccccugguaugugucuaauuuucugcaugcuuguaaucugcuuuuugaugucacauuuuuccuuucuagaucaaaacuacaauaacgccacugcccuugugauuaccuucccugucaauaauuacuauaaugauacagagaagcuccagagggcccaggccugggaaaaagagugagucacucaugggugugagcagacuguccuugcauugugggaagcuagacacuugcggcaagcacuuaaacuucauuuucuaaauuaaccaauggcagaucugaguuacguaguuuuguucacuugguacuaaugaugcuaagaagaaacuguaaacacauuuaccuuugagcaggugcuuuaaacagcucucccuccacaggaaugcaaaagugugcaaaaaaagguuccuugcauuguuuuuacuuauuucauuuauuuuuugagacuggguucacuuuugcccaggcuggggugcagugacugaaucucagcucacugcagccucaaccuccuaggcucaagugauccucccaccucagccuccugaguagcugagacuacacgugcaugccaucacacccagcuaauuuuuguauuuguuuguagaaacaggguuuugccauggugcccaggcuggucuugaccuacuaaccucaggugauucacccuccucggccucccaaagugccgggauuacaggugugagccacugcacccagccaccugcauuguuuucuaacagcaaaacuugggagcaugcugaauguauuuaauaaggaaugaauacaauagaauauugugcugucauaaaagacagugaaguaaaugguccaugauguauauuuguauaaauauauauuguuuaugcugcuguccaugcuuagaaaaaaauaucaagcaaaugaccucagaaauuaacuguguuugugaccucuagagaaugggaagagaggacuuaggaggccagguugcacuuuaugcccuccaguacuuuuaaaaaauuguuuuacugagauaugguauauguaucaugcaguucacccacuuaaaguauacaguucaggcugggaauggugguucacacuuguagucccagcacuuugggaggcccagacgagaggcucacuugaggccgggaguucaagaccagccuaggcaauguuugcaugucucuaaaaaaaagaaaaaagagaauuuaaaaagaaaaaaaagcguacaauucaguagcuuuacuauauucacguguaugugcagccaucaccacagucaauuuuaggaacauuuucauuacuccacaauaaaacucuguacccuuuaacuaacacccuccaucuuuucauccuccuauccacagcccuaggcaaccacuaaaauacugucucuggagauuuuccuauucuggacuuuuaugugcauagaauaauauguggacuuuuuugucuggcuaucauugaacauaauauucucaagguucauucauguuguggcauguaucaguacuccauuccuuuucauuccauuguauggauauaccacauugugugcauuuaucaacugacaaacacuugggcuguuuccauuuuggcuauuaugaauaaugcugcuaugaacacuugaguacaaguucuuguggaugugaguuuucauuucuuuuggguacauaccuaguaguagaauugcugagucauaggguaaguccaccuugaauaguuugaagaacugccagacuguuuuccaaaguggcuauagcgcuuuacgucaccaccagcaguccaugaaacuuccaauucguucgcauccucgucagcacuuuuuauuaucugacuuugugauucuagcuaucuucaugggugugaagugguaucucauugugguuuugauuuaguagacugaaugcauuucuuuuuuuuuuuuuuuuuuuuuuuuuuuuugagacagagucuugcugugucauccaggcuggagugcaguggcaugaucucagcucgcugcagccucugccuuccagguucaagugauucucgugccucagccucccaaguagcugggauuacaggcaccuuccaccacgccuggcuaauuuuuguauuuuuaguagagacgggcuuucaccauguuggccaggcuagucucgaacucuugaccucaggugaucugccagccucagccucccaaagugcuggaauuacaggcauaagccauugagcccagcccuaaacuuacuuuaauucagcauguauggaaccuuagcuguaaucugauagucuccaguguggaagacccuaaugcaguggcugggcauggugccugucaucccagcacuuagggauguggaggcaggaggaaugccuugaggccaggaguuugagaccagcuugcacaacauggcaaagaccccaucucuacaaaaaauuuuuaaaauuagccaggcauggggauacgucucuguaguaccagcuacucaagaggcuaaggcaggaggaucccuuaagcugaggaguucgaggcugcagugagcuguaauagugccacuguacuccagccgaggcaacagagagagacucuauuucaaaacaggaacaaaagcaaacaaaggauccuaaugcaggauaaagguuaagaaaacauggccuuugagccgggcacaguggcucacgccuguaaucccagcgcuuuggggaggcugaggcagguggaucacuugaggucaggaguuugagacuagccuggccaacauggugaaacccugucucuacuaaaaauaccaaaauuagccgggccugguggcgcacgccuggagucccagcuacucaggaggcuggggcaggagaagcacucaaacccgggagguggagcuuggagugagcugagauugcgccauugcacuucagccugggcgacagagcgagaaucagucucaaaaccaaaaaaaagaaaacguggccuuuguaucgugaaaguuagggagaaguuucuuacuuagcugucaguuaguuuaacuaaaaauauaacauuuugcuuaccuuuuagguuuauuaauuuugugaaaaacuacaagaaucccaaucugaccauuuccuucacugcugaacgaaguauugaagaugaacuaaaucgugaaagugacagugaugucuucaccguuguaauuagcuaugccaucauguuucuauauauuucccuagccuuggggcacaugaaaagcugucgcaggcuucugguaagccgggggggggugguguauguucuagagguuaacagcagugcacaguguaacgucauauuuuugccucuuuauucuuauuccauuauguuuaaaacugccauaaauucccccauguuuuaauuguauguaacguuucuguugccuacaucuauuuucuucauuccaacuuuuugguuuaucuuaaaguuuauuucacauaauccaguuuuuucuuauuuguccaguccaucaccuaagaaugcaaacucauaacauguguugcccgagcagaccuagaaauguuuacaaguccucucugaaacacagaauuguacauucaacucuagguuuaauacagcccuguaaaguaaaaaggaggaccuuuuaguaacaagugggacagacaacccuguaacuaauuggugauugugucugucgccucucucagguggauucgaaggucucacuaggcaucgcgggcaucuugaucgugcugagcucgguggcuugcuccuugggugucuucagcuacauuggguugcccuugacccucauugugauugaagucaucccguuccuggugcuggcuguuggaguggacaacaucuucauucuggugcaggccuaccagguauacuuccauauucucacagggcucagcaucuguucaaguuucagggacugugaauggcuccugggcuccgcauucgugagugugaccugugaggguguuuuguuuccuuucccuguguggcucaucggucgucuugacuugcuguggacaucuuaggaccaagaauuucaccccucuuuuugguuguugaaauaguagauauaaaguaagaauuguguuuuaaauuguaucuuuaaauagugucuuuuaauaguaucuuuucauuuuaaauaguaucauguguacaagaagggcuaacacacuuuuggaaaagauuuuggguacgacugcuguuaaaaugauguucagcauaguauagaauguuagauucauuuugcccaaaggugccacuaaaaaggcaaaaggucaacacgugucccgcugcuguagaagguggucucagucguccuguagacccgacgugggcggagacucagugcacgugagagugauguucacugguccaguccccugccgccuguguuccgaguguuuuccugauaauguggcuggcucagcuuucccuuuaguuucucacuugguaccuagcucuguagugcagaaauacucugagaacauuggagucccccaccgaaguuuauaugcuuagaagacacugcuaaucgucuacuaaucauuuauuuuuacccuugaguuaacacaaggcagcaagaaauggcguuguuauugagaaauuuuaaugucgcauaauuuuuuuuuuuuuuuuuuaagagagaugaacgucuucaaggggaaacccuggaucagcagcugggcaggguccuaggagaaguggcucccaguauguuccugucauccuuuucugagacuguagcauuuuucuuagguaauuaugcuuucaauccuaccaguccuguagucugcugagccuggagaaagaaggagcuggcuaccugaacaugucccuuuguguugcuuccuuuuuuuuuuuuucuuuuuuuuuuuuuucucugagacggagucucacucugccacccaggcuggagugcaguggugcaaucucggcucacugcagccuccgccucccggguucaagcgauuuuccugccucagccucccaaauagcugggauuaaaggcacguaccaccaugcccaguuaauuuuuugcauuuuuaauagagaugggguuucaccauguuggccaggcuggucucgaacuccugaccucaggugauguaccugccucggccucccaaagugcugagauuacaggcgugagcccccgugcccagcccguguugucuccuuuuuuuaagcuuuguucugcacugggaaaguaucacuggaccacagaaaaauuggcagcaguaacuuaggugugauuuugcaaguggcuuccuucucauuuaacugucaggacagcauugauguugggguucagggugaaagagaccuagaguucgucuugccacuuuccccuuuuaguagccacugggaauguugauaguugaaaauggcauccuugaguagccacugaauccuucuccacaugacacucuaagcagcagcucccaaauccacaggcacucgcuuacaagauguuugccguuguuuucaaaggcagucuuucucuucugugcacacaacucauuggggaagcagccuuguuaaugaccagaagcucuugacucaccacauuacaaggagccagaauaagcuggaacaaagucagcacuucuguguuucuuucacauagagaaucaucaaauagacccacuaguggggcugucugccccaugucugaaguguaguaagagcaaagugacucuguccacuauaggggaggcuggacuggaaucacucaguccaaagaagaccauccacgggccacaaacugcaaugccuacauggcugggaggucagcuuaaucagggccauuguaaggucauuguaggugguagucuuucaccacagauacacugcuagcuuguuauucuucaucuccacaaagccaugugcuuuugaaaccuguagcccuguaguuccuuuugacaaacacaggugcagaaaaaaaaaaaaaaaagaaaaaacuuucuuuuuuucacuacuauuauaagaaaaccagugcaagugugaugauaauagcagcagagacugugccucaagguuggagugaccuugggacaguaggagugaguagggauuguggcaccccaacugcacguguccuaucuaaaaagacaguuauguguguggccaacccagugcuacaaggucuguguuguuguuguuguuuuucuuccaagcaaagcugugaaucuagauuuuuguguaaaaugccauuguuaaauauuggcaacuuauaaaaaaaaguuuuuuaaucuuaagauggguugauacagugugggcuaaacaggaaccaucugauucaugggcugccaguuugcaguuuccaagucuuacccucaugccuuugauccucacucgauuguagauuaccucuuaacuaaacugggaggcuaguaguguugauguaauaaauggaaaauacuguccauuucuuacagugaagcacagaaaguacuauaagaaauggccuguauuagugguucucaaauuuuaaugugugugaauuugcugugaaccugaguauaguagaauugggguugaauuccugucauaacuaggauggggcuucccaaauggucuggugcugagugugcuuugaaaagcacuggcuuaucaccuccugucccacuucugguguaauguccagccgcagcaugccuucucaugcguuuggccugugcuggcuccuuguaucuguacaugcacaugaacauaagaccugcagagagcccccggcuguaaacagaagugacgcagagcccuucucuccccgacaggagcauuguccgugaugccagccgugcacaccuucucucucuuugcgggauuggcagucuucauugacuuucuucugcagauuaccuguuucgugagucucuugggguuagacauuaaacgucaagagguaaguuggugccaggauuauagucuauuuaauuugagucuagaaucuagaggaagcagcuagcggguauaaccuuuguuucccucuguccccucagaaaaaucggcuagacaucuuuugcugugucagaggugcugaagauggaacaagcguccaggccucagagagcuguuuguuucgcuucuucaaaaacuccuauucuccacuucugcuaaaggacuggaugagaccaauugugguaugcgcuuaucugugguuuuucucuuuccucucacugaaacagauuaucacaugccuucuaagaagccagacagccugggaaggagauucuuaaagcuguuaaaauguaucuaaaaaaaaagcaaaagcaaauguggaacaguagauaaaauguuuuuccugugagcuuuuaucaguccauauaaacaagaguuuuaaguuuuuuauuuugaaauaguuucagauucacagaaaguugcaaagaaacuuuuauuuuuccucuuaauaaugaggaaauagaagccaagagaggugaagugguuugccccaagucacucagcccguaaguggcagagucaggauuugcacccaggaauuuggacuccuggugcuguggucucacccacugcccuguacucccuauuagccugucauuuaagcuuuuccauuuuaaaaaauccugcuuuuugugugugcuuaagauuuuauuucuggucguaagcuuauuuacuaagcagucucugucuuaugauucauuuguuguuccagauagcaauauuuguggguguucugucauucagcaucgcaguccugaacaaaguagauauuggauuggaucagucucuuucgaugccagauguaagaugacuuccuuuuuuuuuuuuuuuuaacuucuuuagcugaugaugaauacauuuuucaaaacaugcacguagguguuucaagcaagugccugcuucuaacugcaaauggugacaggguuuccaggguuaggagaacugucgcagugcacugcuggugugggcugucuggcauucugacugagccccucugggcacagcugcagaacacgaauaacuagucuuaugagguuacuuuaugagaugcucuccugauuguggggcuagcaggaggagcacccuggggcccuggggggaagacuggugguguuaggaaucaugaguccagcuggaggcaucucagccaggaaccuccuggcacccucuuauucuccaugauccucgccuugcuuaguuacuaucagaguguucacacucucuccuauucuuuuaucuuucuuucaggacuccuacaugguggauuauuucaaauccaucagucaguaccugcaugcggguccgccuguguacuuuguccuggaggaagggcacgacuacacuucuuccaaggggcagaacauggugugcggcggcaugggcugcaacaaugauucccuggugcagcagauauuuaacgcggcgcagcuggacaacuagucaguaccaccuugucuuguacuucagaagcagcggaggaggcucucagccaggcagucagcucaggccugaaaugucucacugaaaauagacuuucuuggaaaaguuguuuuuaugcaaaauguauguuaaaucuggcuuuaccuuaaaaaaccuuugaaaggacuaauuuaccaccuaauacuuugaaggcuuuuuucauuaagugcucauguaguuuuucuuuugacuguuagcaguauaaaacguagaaaaggaaguuagguuuuaagaaaaaguacugaaacuaaagacuuccucccuguggagcaggucaguaacccugucuguccucucuaguacccgaauaggcuucgcccccucguccuggaucgacgauuauuucgacugggugaagccacagucgucuugcugucgaguggacaauaucacugaccaguucugcaaugcuucagguaccuucuccuuuaccaaaucuuuccuguuuugcugaaaaauuuucaaauuaucauuuaaaaaucauuugcaucgugccucaguuuauaccuauuuguauaucaaagcugggucucccugugucaucauuccuuuccucagucauucauucugaaauugucauguuguuccuggcucagacagccacccucggggcugcaagcugaacaagguccacauguucggagugugguuuccacauaagguuucucauccuguucuaacuccagcgauugccucucaggauugguaucuggccuuagcuucucagaggagggcuuuucuuuaucacuuuacccugugguuuuguaggagcgucgagguugcccuggaauuuucuuaauaaaaacauagaagccccgggcucugaccagucaaggccauacuugaaggaggagaucuacuucagggcagaaaaugaugcauaguaugccuaagaugaaaaugguauuucagauucauuaaacugugaaagugacauguggcugaagcuuuuagauaaggggaaagauuaucccucacuaguaaggaaaguaaucgauagagaagaaaguaaugccccucacugucaguauuuuaaaauguuuuacaaaaaaucuggagaccuauucuucuaacaguccucccugcaugucuccgccagugguugacccugccugcguucgcugcaggccucugacuccggaaggcaaacagaggccucaggggggagacuucaugagauuccugcccauguuccuuucggauaacccuaaccccaaguguggcaaaggguaagugcugcugccauugcagauaagcauccacugcaacuuuaauuugcaguagaaaacuaggagaggacugggcuaagacaguugcaugggaacgucucuucuccgccccacccuguccugguccuuugguggaagcaggaaaaccgaaaacaccuuuuuaagaaaaugccucauaguguucaacugauucugucuuagcgugggcauucacaucucaugcucucucuguguccuggcccccugggcaugagaaugaacgcagauuccugugcacauuccaagcggggcugagggagaggacggccugcugguaauccaggccugaaggaacuuggccuguucacuuguacugauggcagcuggggcgugaucuuagcuuuaguaacauuaucccacauuaagguugcgauucuuuuagccucgucaugcuccuugccagcccauccauguauaggguuaugggcuaucucacucccccauccagccaggcagccaguuacccacggaagccagauauauggcccaaaaauagugaugaugaccggaagucucuggccuugauuuggaagcuuugggagguggaagaugaguauccccauguauguuagguaaacccugaacuuagguuuuucauaagaacauacaucugaccagagucauaucagugaaucauuuauaucaugcaugugcuuugagaccuauucgagguaucaugggaugacuccuccuaaaaguuaaguagaaaugaaucuugcagcuugauuuacucacugacuggaugcuuuggccuacguaaaauaaguugaaguagauucaguuuuucugaaggcaguagccaccguuccuggggagccuccagggugccagcgucaugccaggcacucccugacauuauuccauuucucaucacgcagccuaugaguagguggugguauacccauuuacagaagaggagacuggggcucagagguggucauuuugcucgggguuacaugaccaguaaguggcagggcugagguuguucccagggcccuugcccuuuccugcuuccuauuacacaacaggacugaguaaacccuguaccuuugauuauacaugaaaccagguggagaaacagcagcuauguaccaaagaacccagagcaaucgagaaaagcccaucuggccaggcgaaguggcucacaccuguaaucccaguacuuuuggaggccgaggugggcggaucaccugagaucaccucaggaguucaagacuagccaggccaacauggcaaaacccugucucuacuaaaaaaauacaaaaguuaguugagcgugguggcaggugccuguaaucccagcuauucgggaggcugaggcagggagaauugcuugaacccgggagguggagguugcagugagccgagaucacgccacugcacuccagccugggcuacagagcaagacucugucucaaaauaaaaaaaaaaagaagccagucugggagagaacaagcuaaaccuuugguguucccuuaucugggggccuucuucaucccugaaauguacagcugggucugaccucugaguccagggucaggugauuuugcuuagccucaagugcucagauucugcugauauuuugcaagaccuggacucucuugacacccaggauucuuuccucaggggacaugcugccuauaguucugcaguuaacauccuccuuggccauggcaccagggucggagccacguacuucaugaccuaccacaccgugcugcagaccucugcugacuuuauugacgcucugaagaaagcccgacuuauagccaguaaugucaccgaaaccaugggcauuaacggcagugccuaccgaguauuuccuuacagguaaagccugcccuuuuucaaugggguuuacccagcaaagggccuacacugggugggaguggggaggguucccuuggcaagaugcugauuuucagguuggguucuggccccugcuccauucugagcacagggcaguauaucaaaggaaaugggugcugggcaaaggaguucagaaucuaaagucucugugaaggccugagggcuagagacgcaaaacuugaucucugcgccacugcacagcugcaagagacacacacuggaaaauggcuuaaggcagggggcgcuuggagagcaggcggcucagagcagggcccggcccacauucuuggccaacaaugaaccagaaucccuaacugcugguuauuugggaugcugccuguauguagacuuuuuauauuguuagggguuuuuuuucccaggaagaaaaguauuauguaugaacuacugaauuuagaaacuguagaaagguaggagaaacaagugauuuauuuuuccugccuccccaugaucucgcuuaaagcaggaaggccuggauuuguuuggaagaaguuaagagccgguuagcucuggcagaaaauaaaugaaagcauguuuuccucaggccuugcacggaccccgcugagccugagguagugucucaggauagaucaggauucuuuguuuuuuuguguuuuuucagaaugcuguggaaugcucucuguaaaugucuauaaaauagcauagauugggcuuauaaacagaaacuuuaucaaaaauauacauuuugcaucacugcugggcccuucucuggguggucaguggccaugagaggucaagugaguugcuuucggugagucuuguagacagccagcaagguuuucugcaagggauguuucccaaaggagucugaccacuuggcaguggugacaggaugaacacgcaguguucgggagugagagcgagcuuuaaugaggccuccccucuccccuccaguguguuuuaugucuucuacgaacaguaccugaccaucauugacgacacuaucuucaaccucggugugucccugggcgcgauauuucuggugaccaugguccuccugggcugugagcucuggucugcagucaucaugugugccaccaucgccauggucuuggucaacauguuuggaguuauguggcucuggggcaucagucugaacgcuguauccuuggucaaccuggugauggugaguccucauacagucucaguuugucccuagcuccuguuucacuugggggaauuggcugucuuagauuccauguaaacccuaaagauggaguaagauaccaagucuggcgcuugcucuuggcacacauggagaggcaggaugagugcuggaggagugcuggaugguggugggacagggcauagagggagcgagcauugaguuggacaucugggagcauaggcacauuacaggcaauuucuguucaauuuuuucucuugucccauuccuugcggcuauacuaguauaccugauggugccucugaccauggaaaugugauuuccuggccuaguucugggcuagucugccuguaauuuguuauucuuuagagauugcacaagccuguagccugaugacagcaggauguucacuuuuuacuuagaaaauugcaccccgccccaggagcucuccgaccagugccuuuugccuccuaugugguuaucagguacuuuuaaucauuaaagaugagagcacuugagaagguauucauggaaaauagaacaguguauccguacucucagauaugagcccugcuucagauaggggagcacugagguccaagaaaagaaguugugacaaugcgccagcucggugcggguggggugaccuuaacggguuccagcaauuucuccuggucaacacaaacgugccacagaaaaccaggcuuuuggcuguguguagagagggccccaaaaaguuccugguacaguaagauuggugugauggaggccuuguaaguccaaugggaugcuuggccuccucuagcacccagggugcccuggguaauuagcacccauccucagaacgggguggcugccuagggucuucaacaggaagagagccauccuaaaggaagugcuuuauuucagagcuguggcaucuccguggaguucugcagccacauaaccagagcguucacggugagcaugaaaggcagccgcguggagcgcgcggaagaggcacuugcccacaugggcagcuccgugaguacccugagcagggccacgccggcagagucgcaccacaaaguaauccuccucagugacugaagagucuggauccuguacuuacaaagcagcuucuaaggauugcaagcuuucaggcaauucaugaauuagcugccacaucguggacagaacggacguucuguggaacuguaccuguugguacggcuccuuuuuagguggcagugugcugaagcaggaaaauaacagacaaguuaaacaugagacagcuggcagucuuucccauuuaaaaugcaggggagcccgggccagaacccagcgugugaugugcgguuggugccuggagagucgucuugguucaacucuacacccuggcuuagccuaucucuuuaccacuguagaaaauaccugguaaagaguaaaaacuaaaacuuuguuucguaacacuuuuaaauauuuaaguuuucaccugagaauauaaagaaagauaaucaauugggagacacgaugcagugucugugcagaauacacagcuuuuaacuuggucauaccucucccccaggaucauaaggcagcaaauaguguuagguaguagaugaugcuaccuggguucaguucccauugcuuugaaccuugaauauuaagaaauccccauaagggcuggccacgguggcucaugccuauaaccccagcacuuugggaggccaaggcuggcggaccacuugcggccagggguucgagaccauggccaacauggugaaaccccaucucuacuaaaaacacaaaaauuagccaggcaugguggcgugcaccuguuuaaucccagcuacucaggaggcuggggcaggagaaucacuugaaccugggagaaauccuuguaaggaaguguuuuuguucaauuacagguugguaaaagugguuucuaacacaguaucucuucuuuuagguguucaguggaaucacacuuacaaaauuuggagggauugugguguuggcuuuugccaaaucucaaauuuuccagauauucuacuucaggauguauuuggccauggucuuacugggagccacucacggauuaauauuucucccugucuuacucaguuacauagguaagaguucucaucuuaaaaggguggcacaauagaaggacauuacugaaagggaauucuauccugaggcauucuuuucaaguauuugaacucauacuaauggucauuugauaaugauaaaugauacugaguaaaaaaauuucuucuaaaagaaaaaacccauccaggggauucaugauggugcagacuacuuuauuaggaaguugucgauguuuuuucuggaggccugaucugucugcuucacaaaggccuggagccaguccuugaauggaucugagugucagcaggcagggcagcuccucccugccacugagaugaaggaguccaucuggcagccagcucucacaccagcagugcugcagaacagcuuuuuaugucccucauggauuucccguuucuuagcaaagugcuugcugccuuucuucaucucgagacuguccuugauccuuuuacuucuauggccacuucaccuugcacaaaaaugacccacgguugaaagaacaauacugauuugcuucauuuauagcuuugucacuaaauugaagcacugaaguagaagauuaagaaaaugaggggcuuuuuaucaucuccgggggauagaaaguaguucuauuacaaucuaauauacuaguuccuuuuaagaaaaaaaaaaaaaaaaagagaugagcacuuuggaaggcugagacaggagaaucguuugagaccagccuaggcaacauagugaggccuccaucucuacaaaaauaaaauuagccaggugaaguggugugcgucugcagucccaccuacuuguuaggcugaggcaggaagcuugcuugagcccagaagggugggcuuaggaugcagugagucguguucauaccacugcacugcagccugaggaagaaagcaaagagcccaucuccaaaagagagggagagagauguggucucacucuguuguccaggcuggucucaagcaauucuccugccucagucuuccaaagugggauuacaggcgugagccacuaugcccagccaacuagcucccuuucuccugcagaaauaagaaaaagucucucucucucauagggccaucaguaaauaaagccaaaaguugugccacugaagagcgauacaaaggaacagagcgcgaacggcuucuaaauuucuagcccucucgcagggcauccugacugaacugugucuaagggucggucgguuuaccacuggacgggugcugcaucggcaaggccaaguugaacaccggauggugccaaccaucgguuguuuggcagcagcuuugaacguagcgccugugaacucaggaaugcacaguugacuugggaagcaguauuacuagaucuggaggcaaccacaggacacuaaacuucucccagccucuucaggaaagaaaccucauucuuuggcaagcaggaggugacacuagauggcugugaaugugauccgcucacugacacucuguaaaggccaaucaaugcacugucugucucuccuuuuaggaguaagccaucccacaaguucuauaccauauuuuuagugacaguugagguuguagauacacuuuauaacauuuuauaguuuaaagagcuuuauuaaugcaauaaauuaacuuuguacacauuuuuauauaaaaaaacagcaagugauuucagaauguuguaggccucauuagagcuuggucuccaaaaaucuguuugaaaaaagcaacauguucuucacaguguuccccuagaaaggaagagauuuaauugccaguuagauguggcaugaaaugagggacaaagaaagcaucucguaggugugucuacuggguuuuaacuuauuuuucuuuaauaaaauacauuguuuuccuaa

SEQ ID NO: 192739 - RNA, 26886 nt, Homo sapiens
uuaagccauagaagaauauuuauugacauggaaaauguuaacaauauacuucuauaugaaauauguaggcuacaaaacaguauauacaguuuaauaccauuuuuauggaaagaaaaauaaccauauauacaaaaucaugcauaagaaaaaaauaauauaaggauguacauaccaaauauuaauaauaauggcuaucucuggauaguggaaucagagggauuauguaauuuucccgauaaauuuuccuguccuccaaacagcauccgcuucauacuauuauuucuugguuguaauuaguuugauauaauucucuucagaaaggcucuguuucacuauauauaccucaaagcauacuuuugaugcagcuucugcaauucccaucuaaaaaguagauaacacuugcucuuauauucuggcauaugaagacuauuuguaauuaacacacuauaaaauaugucaaagcaggccaggcaugguggcucacaccuguaauuccaaaaccuuggcaggaagaucgauugaggccaggagcucaagacgagccugggcaacauagaaagacccuaucuuuacaaaaaaaacuuuaaaaauuagccagguguaauagcacaugccugucuguaaucccagcuacuuggcaggcuggaaggucaaggcugcagugagccaugaucaugccacugcacuccagccuaggugacagagcaagaacucaucucuaaaaaaaaauuuuuaaauaaagcaaaauaugccacagcauagaucugauuguagaaaauuauuauauggagaacugaaaaaucuccuaaucaagacaaaaauuuuaaauagaggaaaaaaauacuaucuaucauuaguucaaguuuccauuaagaguagagugugaaguagcuccaaguucagagcuggagaauuuugcaucucucccucuuaccagccaauugacuuuagguaaagaauacuagaguuuuuuaguuaguaaaauauaguuaauaauucuguauaaaggagcaaaaguaaguuucucauuguuuccuaucucccuucauagguuugacauguugaaauugugaaauuauuuaauguuaauaguuuuuaacuucuuuaauuauguaaaauaauuaauuuuuaaauuauuuuaacaguuaaaacacaaagcauacuuuucauggaaccaaguguuccaaacacaaaaaggucauucucugauggcuccugauaacauacaacauaaaauauaguuauaacaaauauaauuuagaauuuauauuucagaauccauccugguguaaagcuauuuacuauaaccuuacuaaaaauaccaacgguaaggauguuggaucuuuuaaagguaaaacaucagagaaaagagaaaaagaccuguuuguccaauucucugugcuuuccaugcucuagcaccaucccaaaguugccuccuaacuucuguucccucccugggaagggaaguccaggcaaaucugugaucaguuaauaacuuuuaacaauuguuugccauuacaucugaaagugaacaguuaaucacuuauuguuauaucucaaagguaaauuucacuaucuaaaugccuagagguaacuggaagaugaaagauacauaaagguuugaugaauagaggggaaaaaaugggggggaggguuguuucuguuuuuccaaugaaaagguuugcuccuucucucugcaaaaucuuggaacugagaaagccgucuggagugcagauggaaagcaugcaucaaauugauguaacuacacaacauacuccugcccuacaccagguucauucugccaccucuaucccacucuacgaaugucccauuugccacagccuaacuucuaucauaguucuaauuccucagugaagaucacaagaaagguacuuccagguuguuaaaagaaacgagaauguuacaccaacacauuucugggguggaaggagacuacugacacuccauauuuauugcuuacauuacaagaauuaaacaaaaaaagcagacuagaaaaucacuuucuguaauuucacaaucaccaauuugcaacagaaacugaagcauaauauuuaugcuaacaaauauguuggaugaauuaucaccucagcacauaacugcagauggauacuccuggauuuucacuuaauccauuacucaaugaugaacacuauaaaaugaaaggugacauacuuaugaacuaaaaucacaagaagaaacucuccaagaucaaucuuaaaugagcuccuauuccaauaagccauaaagagcaguaaaaggcaauauucauuuaacaguacaagaaucucgaugacaagaaaucagguauuuauauuccucuagagacauuucuucuccaccuaacaaaggcacuugacauguacugaaauggacaguuaauucagguacugcccugggcaacuguuaccuugcuaaaauuagaugaaguggugauuaaguucaaauuaguucucccaaauaagccugaaacacacaugaauagaucauaaguucucuauuuuuggcagaugauauaaccaagaagaaaagcuaauguugguauccaugcugaacuggcugacuuaagcagucaaggauacucucucugcacaauauauuccuugaugacuauggaauguauauauaauuauaggcaaauuaaccuuuccuauaguuucagguauuaauguucauuccucuucuugucuuuucuuacuuuuuuguucuuucccaaagccuuagaugacuccuccugaaaaagacacaaaucagugcagcaucucuccauuuacauaaagaugaaaucuucaaucuaaucacuuagaauauauuuacacauauauauuccacauauauucauacauauauguauguauguauauauguuacagugaggguauaaucacuuuuauaugugucauuucuguguuuuaaaggguacuuucacuuauaggcuaauauuuuuuaaacaaucaagaauaaucaaggaaaccuuauuuaucuaguggauuuauguuugaauaauuucaaaauuauuucaucuauugccccacuuucccaaggcaguaaaauuuaaauaaggcagauaugaacauaccuaaaauauaaaacaaaauaaacucaaaguauaaaggaagaaagcaucuaaagguaugccagugaagggggagauguuuugacacuaacagagaauuucagaauuuucuagauguuuaaagaacaucuagucugaugugauaucagcuacaaccacucuggggcucaauuuuagggauggaaccuaguuggucuuaaaagguuuuucuaauuauaaaauucuaugaaccuaugaaaucaaggugcgaagggaugaaguggucuguccuaugaaaucaaggugcgaagggauuaagugaucgguccaaagucacgugacuggccagacacacuguuuagagucuaggucuccagguucugaguccaaagguuuuaccaauucaccacucacauucugauucauucuuaauuuucugucuuuuuaaaaaauucccaggcagugaugagaaauucucuagauguaguacgaagagccacuuacaggugaauuuguguaguucuuuuccacuaguauguuucuggcacaguuguugauauguuuaaagcgaucugguccuagcagaaucccuccauaccagcgugauacuaccaccaugacauucuucacauucaaaaucuguuauuuuuuggaagcauaauuagauacauagacagacauguauaaauaugaguuuuaaaaaaggagaaugaaauaacccauguauaaaauugcacauaaaauuucccagugacuuuaaugguagagccauaugagugaguaggcacugagugagauuacuaacaauucagggagugaaauggaagaacagaagggaaucuggaaaaccaucacuguguuucacaauguccucaaacucccagauuuggggcaacuggacagagugaaggggagaccaugcaaguaggauucuagcaccuggugacuucaaccagaacagcuaaguuuaggcagcauuuuaccacuaggccaaauaacaacaaaaaaaacccugcuucugaacaaagcuacaggggcugcacgaggcaucaauaucccuggugcuauuaguaagguuucaucaguugagaucuagaucagucucacucugucacccaggcuacagugcaguggcacaaucuuggcucacugcaaccucugccuccugggcucaagugauccucccaccccagccucccaaguagcugggaccuacaggugcaugcaccaccaugcccagcuaauuuuuguguuuuuuuaguagagacaggguuucaccauguugcccaggcugguuucgaacuccugggcucaagugaucuccccgccucagcuucccaaagugcuaggguuacaggugugagccaccauaccuggccgucuucaucaguuugacauuugucaaaugcugcccuuaaugugaagcccaccaguuuacaggccugacccacaaacacaguuacuauucaagggaaaggccuuguuagaaaauaaaccuucacauacaagagcagaaaaaaccagguaacuaccuuaggaaaaaaauaauccaauccuaaaauuaaugaacaauaaaugaucaccagacagaugaagaaaauccagcagcaugaaagagaaaggacaagauaaacaaacaaaaauggaccaggaaaaauuuuuuuaggggugagaacaucuuaaaaaagaaacucuaauuaauauaaucagagaaauuuuagaagauauuggagccauaaaacagaacaggauauucuuaaaaaggaaaaacagaaaacaagaaagaacucuuaaaaauuaaauauauggcugcuaaacaaaauuucaaauucaacagaaauuuuggacaacagucaagaaaaugucucagaauauaaagacaaugagauggacaacucaauuuaaaaaaaaaaaauucuggaucuauccagaaguuccaauauccaacuaaccggaguuccauaaagaaagaauagaaaaaauaaagagaaggaaauugucaaaaaaacaaaguguuuucccaaaguugaagacaaucuucuauugucuaugucuugaaagcauagcacuucuuauuaauuauuugcuuucugucccacauccacugguuaaaauuuucauucaaucaauauuuuaacaucaacuacuaauuaaaucaaauauaucuuauguuacauaguucaacugacuuagcuauuacuaaauggagcucuguuuuguugagaaauuuuauggcuuguacagaacaggauugauaguuuaacuuacaccuaccuccaugagaugaagaagacgcccaccagcugcuguuuccccaucauccucacaauccuguaagaaggucuguuuauccucacaauauauucugcaaauacauguaagaguauuacacuuugaaacuaaaauauuauaauaaaacuuauuccucaacauuugugaucauuuugauuacuuccaaaaucagcauauucauuuuuuuaaauccuuccugaaauauguauuauauuagauauauuuucacugacgguuuacuauccaguauguuugccuuuuuauauacuugggaaagcuaggaaucaaaggcaucuccuuuauaucagaaauguugcuauuaugggaaggugaauuuauccaugugacauuccccuuacuucauuuaaccuugaaguaacaagagcaaucauugaaaaacauuuauugagaauauacuguauaaaagcaacagguacuaagacauauuauaaaggaaguaaguggcaugcaucugucuucaaagagccuuaagauguagugaaacaaaaagcauauaaaaaaaagaugaaggcaacaaaaccaacauaagguaauauuuuauacuuuccucucaucuuauuccagccaucaagcauuucucuauuuucuucuaagaauguaaagauuuaaauuuuccucuggaugguuacuaauauuagagacaaaucgugguauuuuuauccauuuaaacuagaaagcuauaucugaaauaauaauguaggccuacaauacaguaaaauaagcuuggcaaauaagugcuagagagagaaaaaaaaaauagugucaguuacaguaugccaucugguggauuucuuagggcccuaccaaugguaucauguggaacuggguaaauguaguaaagacauccucccagcucuggccauaaaaagcuguaaacuuuuaauguaaauacuaaaagcuauaaaagcucaucuacacaccuaagucaguuauguuaccuuacagcagucacauucauucauucacucauccuuccuucccuucauccauccauccacucaauaaauauuuacugaccaucuacuaugaacauuaaaguuaaaauacuaugaguacuuuuuucuuuuuuuacauagcuuagauacaagauuguugaagcuguagccacagccauagaggagugaaauaaagaaaacaaaugaaauuggauuaucaaauucagcuccaucacuuaacuaugggaucuugaaaaagcuaaccuuuuuacagugcuagaauugcuaacuaauaagaguuaauuuacauaaaguuuuggcacagaguaggcacucaaaaaacauguagaauaaaugaacauuacaauuuuuacagcccauuuuaaugacugagaguagucuaauuccucauuuuccuauugaaggccauaacugcuuaagaaaacauuaaaauucuauccagugauacucuauuaagaggggaauuacauaacaaauaauuguuuguaaguuuuggcacuuaaagagaugugaaauuaguaauauuaagaacucaccuacucaaaaugaugaauuuuugaguuucaguuucagauagccuagauucuacaaauagucucaaucacauuuuaaauuuacaccaagucccuguguucugauuuauuuuaggccuaaacuauguacuuuuaaagucuuacaaauuugcguauuuuuucaaaugcccuucaucucuucacuuacaaaucagcaaagaugcauauaaaaaccugaauucucaaaacugaaacucauguaguaaaagaaauacucuuaauucacugcuuacaggagcauaaauugguuuuaaaaacauuugggcucacaccuguaaauccuaacacuuugggaggccaagguuggcagaucacuugaacucaggaguuugaggccagccugggcaacauggcagaacccugucacuacaaaaaaauacaaaaauuaugccgggcaugguggcucgcaccuacagucccaguuaacgugggaggcugaggugggaggauugcuugggccaagaucacgccccuguacuccagccugggcaacaggguuuuugagacccugucucaaaaaccaaaccaaaauaaaacaaaaccuuugcaagaaauuuggcuauauaucaagaguuucaaaauuguucacacuuuuugauaauucuacuucuaagaauucuuucuuccuuuuauuauauucccauuucauuucaaaaaagaaucucaagcaaccagaaccuauccugaggaaauaaccuaaaaaguauacaaagauguucccuggaccacucuuuauaauggugaaaaacaugaaaaacuaaaaggaaaugguuaauuguaguauggcaucucaaauauuuuacagccauuaaacaguauuuaucaagcaguuauaacaauaugaaaaagugcuuuuguuuaauuaagaaaaaaacaggauacaaggguaaauaaagcauugggaaaaauuaaacuuugcagagaaaaaaaugaaacaaaaaacaaaauauugucaguuacauuugauggcagaaaaugccagauuuuucccuucaauucuuuuuuaucuuuucugcaguuuccaaauauuccaugucuauuacuauuacaauggaaaaaauacacaauaguuauuauuuucuaaaaucaugcaucauuucccucuauuuuuaacaaacugaguauacuaaagcuugugaugauuacucaccuguaggcauagauguuguggguggcacuagcuauuuucuuauucucauacaauuuggaaagaaccauuuucaccuuaaaaacagcaauaauauaaauaaguaugcuuuuuauauuugcucuguaaauaaaugcuagaaaaauaccuugaagcaugcuguauuaaaauaaauagucacuuaaagagucuacuauacucugaaaaagucauuuccaaaguuuccuucucauuuuaggggcagagacugguacucauaauugguauaaaaaugacagaccugguauuuuugagcacuaauuaucaacaaauauuucgguacuacuaugucaaagggaaaguuuguuccccauguagggaauuuuaaauguaucauauaaaacuucuaaaaacuagcucugaaauuuaccaaauguauacauccaauguagcagguguacaauagugguauguuccaaauguuauaaaaccacaucuuucucugggagucaaguaagguucauagaggaggucacaugagccaggucuuauaaguggcaguucuccugcaucaaaaggaaagauggggcaggaagaagacauuccacacagagaauagggcuauaugcaaaauacagggacugggugaccaaauuuagcaaauaaaaguacaggacauccaguuaaauuugaauuucagauaaacgacaaguaauuuuucuacuauaaguacaucccaugcaauaauguuuaccugaaauucaaauuuaacuagguauucuguauuuuaucuggcaaccuuagugggaacaaaaaagagaaaaguucaggaagcuuuacacagcuuaacuuagaguaugaaugagaugacagaagaugugucaugaaugauaagcuagggccauauuacaaaggaucuguguaauaaguuuagaucuucccuuguagacauuggaaaucagcaaagauuacaugugugaagguggauaagagagagaacagaaugacacauggucagauuuuucagggauguuguaauggcaagaaguauggaagaaauauugguggcagggaagacugagcuagaguuggggacaccaauuuggaucacaaauugugcaaucuucuguuuaucauuuuauaaucuuucagguucucaaauucugaucaauaaaauagacaaugaccucuaaaacuuguuucagcucucacaaauuauaaugcuauaaaucuaagugacugugaucagaaacagaaagaggauccagaauaaacagauucagaauuagaaugucucaggaggacccugggaagaagaugugacuaagggccagggacaaaauaggauuccugagagaaaagaccagaagucugcaccaaaaguuaugaucuugaccacaagucaacgcagaaaagaacuuccucuuucagagagugaaacagccugguacaaagagcuguaucccugaagcccagggcuuuaaagagcuucaagaguaggguagcugcaaagaccaaaggaagagacucaugccuaaaaccugcaguaaaugagacauuuuuaaaaauguaacuuuacagguaguauugaaauugccucguacaucaauaauguaagcugagcuacauuauagaagcaaggaagaagaaaaggauucugcugaaaggagaaugagaaaggcaaagaccuaggaauaguuuauggcugaaaccucucccauuuauaucccuggguggaaauauggucaccuaagaucaagaagcacaaaggaaaguaagucagguagggaggacuugguuuagccagucuguccacuguccccuuuguugaauaauaacagaggaauggacuuaguuucacagaacucccauucgacaggacaaauaauucuuuuugacaagguauuaagcaucauaauuuucucuaauaacacaauggguauuucuuauuuaaagauucauuagaggguuaaccccuaaucagaguuuagauacaauuuugaaagcagugacaggccuggcuagguggcuuaugccuguaaucccaauaccuuggauugggagggcuggaggcaggagggcugauugaguccagauugagaccagccugggcaacauggugagacaccaucacaaaaaaaaagaaagaaagcagagacaaacagaaacaaaacaaaucuuccgugauucacaguaauuugggaguagaaaaaugaacaaauaauuuuuaucuuauaugaaaauaaaacauaaaaguaaaaacaaggggauuauugcaaaaucauuuaccugaauuauuuuaguaaucaucaaagugagcuagacaaaggaacuuuaccuguuugggacaaaccacuggagccaagugugccugaaaaguacuucuucggucuguaauaggaaugccaugaucaaucggagguaauucuucuacuucuacuucuagaaauguaaaagaaacuuuauuuuuuaaaaagccuuacauucaaauacugaaaaaaaugaaaugggggggcagcugggaaagaaauguaaauuacauggcaaaucaacuaaaauaaccauuaaucgcuaucuaccaaaauuaaauuuaaauuauaauuuuaaguaaaaaguuucuaacuauauuguacauaagauuaaaauacuugauuuauaaaugauuuccaccugccaagguuacccaggggaagcaguggguugggacuaaucuugaacugcugcagucaguaguguaaguugguacaauaucuaauauauaauuuuuaagaguguaaaggaguccugaaaccaaagauuuauagcugcuaauauaaaauuuauuuaucaguuucacuguuguuagaccucugaguugggaaaacuaugaauuuauauucuuuauauuguguagcuauaauauaaugccuucugcuaaugaaacuguuucuacuucauaugauggaauuaaauacaucaauaauacauccaauugguauuccuuaaagagcaucaugauuuccaguuauuauaccucuuaaaacaaguuuaaggaucauggcugggcgugguggcucacgccugcaaucccaacccuuugggaggccgagggaguggaucaccugaguucaggaguuugagaccagccuggccaacauggugaaacccccgucucuacuaaaauacaaaaauuagcugggcaugguggcgugugccuguaauuccagcuacucgggaggcugaggcaggaaaauugcuugaaccugggaggcggagguugcagugagccgaguuugugccauugaacuccagccugggcaacagagcaagacuccaucuccaaaaaaaaaaaaaaaaaaaagaaucacuaauuaacccucaauucuguugagagacuuaaucguccuggcuacuacuaccugccucacuuaggaugaaaaguuauucaagacaagaaaguagguuuauguaagauguuuuacaccuucccucugauacuguucuuuuccugaauugauuuugacugcuguacuaacauaguaauaagucaaauacaguauuagggucaauaugaacuacugaccaauugauaguauuuauuuaugaguaugauuuuuauccuuuuucuuuucaugguagauccuguuuucaaaagauaucauaugucaaauccacacacaaauaaaugauuaaaaugggagcuacuuaggcuagagcauaaaugagagcccuggaugcuccccacucuuucauuuccucuuuguucccuucuacuaguccuggacaccauucaaaagccuuaaaacucagagcaccuuuuaaaagcuacuguguaaugacacaggaaaccccucaccuucaaacagaaugaauauucccccuggucuaccauguuuuccuaagaggcuuagggaaacuaacaauaacauucaaaauuuuaaaauauuaaaaugaaacauaauaucacagcaaccuauuuuuauguugaauacuacucgauuacgaaacaaauuuguuuaaacgaaaacuaggccgggcgugguggcucacgccuauaauaaucccagcacucugggaggaugagguggguaggucauuugaggucagccuggccaacauggcgaaacccaaucucuacuaaaaauacaaaaauuagacaggcaugguggcaugugccaguaaucccagauacguaggaggcugaggcaggagaaucacugaacuugggaggcaagguugcauugaacugagaucgugccacugcacuccagcccgggcaacagagcaagacucuaucucaaaaaaacaaacaaacaaacaaaaacugaacucaagcugggcacaauggugcaugcuuguagucccagcuacucggaggcugagguagaaggaucacuugagcccaggaguucaaggucaacuugggcaacacagcgagaccuugucucucaaaaaaaaccucuuaaaggcauuuuacuagcuuuaauuuccagggcugcacuuucaguuaauauauuuguauuugugagcacagacuaaaauuuaauccugaaacaucaggaaacagcuaaggauuucaauacagaaauauaaaaacaugauguuaacuaaaaacguuaauagccuuucuuaguuucaauuucuuccaucacuaaaucaaaacucuagaaaguagggggaaaagaguaaauuuccauuuuuuccuugccauucugauaagacuuggcaaacaccaaaauugccaacaggcaggaaaaaauuaaucuuaucugcaaauuaauaacuccuuccuaaaacuggagaaaauuaguaaauuucucuaucaucucaaagaacaauacauaauacuaccaacccacucuccucaaaagaaauuaguuaguaacauuauaccuguccgaguuucacugauaucaaaauccaaugcuuuaagcgaacuuuccggcugacaugcuaaaaugagaucaucuucacauucaacaucuuccucuucaguuuucuucuuuacaucugggccuaugugaauaugagacacaauuacuuuaugacgcagguaagaaacgaugcuuuuuaaaaaaaaaucacugggucuuggguucuaaauaccacucuucaacgaaaggaaccagcacucagcccguaggagaacugguugauuccugaguuggagcaaggaaacuacaagaugaaccuggaaccucauguggauccacaaacugggaaaugcucaaaaagagauggggcuuauaaaaagaacacaggaguuaaccugaaggggcucuuaaaggucaaagcuagaacaauuugagcaacaaaaaaauaugauaggauggcauuuuaacccauggacugaaauaauauacaugaguccauacugauauaaauaauaaacagauaaauaaauacauaaaugggaagagacaucccuuccucauaauagaauuccaauuacuaaaugaggaaggaaugaagaaaauagaaaaucaucaucaggcaaacaccacaguaauaaauauuguugacaaguuccauggauagauacuaaaauuaguggcagaaaguuuaaggagaaacaggauauuagcauagcuucaaaguaucucccucaagcuacaaagagaaagacagugacugcaaugguuaaucuuacaugucaacuugucuaggccacaguacccauauauuuguuuacuuuuguuugacacagagucucauuccgucacccaagcuggagugcaguggcaccaucucagcucgcugcaaccuccgccucccagguucaagugauucuccugccucagccucccaaguagcugcaauuacaggugcguaccaccacgccuggcuaauucuuuuuuuuuuuuuuuuuuuuuuugagccggagucucgcucugucgcccaggcuggagugcaguggcgcgaucucggcucacugcaggcuccgccucccggguucacgccauucuccugccucagccucccgaguagcugggacuacaggcacccgccaccgcgcccggcuaauuuuuuguauuuuuaguacagacgggguuucaucguguuagccagaaugguuucgaucuccugaccucgugauccgcccgccucggccucccaacgugcuggguaauucuuguauuuuuaguagagacgggguuucaccauguuggccaggcugguccugaacuccugaccuuaggugauccacccaccucggccucccaaagugcugggauuauaggugcaagccacugugcccagccucaauacccauauauuugguuaaacacuauuuuagauuuuucucugaagguauuuuuuggaugagauuaacaauuaagucaguugaauuugaguaaagcagacugucuuccauaugggccucauccaaucagcugauggccuuaacauuaaaagacugaccuccccagaagaggacauuuuuccagcagaccaucuuuguuuucaaaccgcaacauucauucuucccuggguccccagccugccagccuauccugcaaauuuuggacuugccaccuuccacaacuguauaagccaauuucuuaaaauauauuucucucucuuuguguguggguacauacacacauguauauacacacauauauucaauugguucuguuucucuggagaacccugacuacagcauuuacaguggagacauuuggcgaacaccaccguaaccgagacaucaagguaaauaucaccaauaauaaggcauaugauacaauaggcacagugacucacaccuguaauccaagcacuuugggagaucaaggcaggaggaucacuugagcuuaggaguuugagaucagccugggcaacauagggagaccucgucuguagaaaaaauuuuaaaaguagcugggaguacaccaccacucccagcuacuaaucucacuccaaucaugagaaaacaauggacaaacccaaauugaggggcauucuacaaaauaacuaucaguagucuucauaagugucaagguuauaagucaaggaaacacugaacaacuguuuacagacuaaaggagaguaaagagaaacaacaauggaaagcaauguagaauccuagacaagacccuagacagaaugggacagcccaagguuucauaacauuuucagaauggcacacaauuuaaaacuuaugaauuauuucuggaaauuuccauuuaauauuuucagacaacaggugaccacagguaacugaaaccauggaaagccaaaucucagaugaggaggaauacuguaauacaaaaucaaagaggcuaaaccuuauagaaauaaauaacuauaauuacaugagcaauuaaacuuuucagagaaacuuguauuuuauaauauacaaaccauaaaccagaauacagauuuucacauuaaauuucaacuagaguaucuacauaaaaauguaguuauuauaaguuaaaagaguauugauaguauuuuucaauccuaccugguucugucaucugagauuuuuguauaagaacaucucuuauuuucuccacccacagguaaagaauacuuucaccgauauucugacuaaacaaaauucaggggaaaaaaaaaauuguuauuucaaaaaucaucuucucaaauucaagaagauacagacauuugcaauccaagacauuauaaacaaucuaaccauuucuuuuuuaaaauaauuuauaaaaaccugggguuuaucaacauuugugucugaguaguuaauacagguuauagcaacguuaaaaauuccaguugacuccaaaauuaacauggcuuacuuuaaaauaagcagaagagcuguaaccaaagaggggaauaaacauuuccaaacuagauggauuaaagaaauauaaaugugacuuaguuucuguaaguggauacaaucuuucaguaucgaugucugaucacugcuugcuuuuuuaaaguuuuuuaagaauuucaaaccccuuauuugguacacuuaucauuuaguauacuuaucucaacaagaaagaauguaaagcauaugggaaacuccuucagggagucaauuuacaagaccuaaaagacaauucaacaauuuuauauucauaucuuguuucugacaaaacauucuauugccuaaauugauucauuuugguuccaaaugauguuugguugccucagguaacuaaauccaucucaaaggaucacugagaaaaagaaugugucacagguuuuaaagucauguccauaguuauguuaaaugaugguagcagcaauaaaauaaaggcccaagugucugcucuuuagaaaaagacacuaauuguaguaaguaugguauguguuuaaagauaucaccacacuacuauauagcaacaccucaccuccuuccucuaaaaguuucccuugaaaccauuaucucucuuuaucacuacucaucagcacccaccaaaacuuucgaaacaagagacagaagaaaacaacauuguuuuuaaauaauucuauacccucaaauccuccccaucacacccacaauuccuaguacuaaaacuaaauacuuguauugguugauauaacaguaaagcuauucacuaaaaugcacuaagcugugugaaguuaaacuaaucacuugaucugaguuucugucaccuaauuuucaauauuauaagcuggaugagaagauuuuugaaauaagaacaucccagagccgggcgugguguaaucaaaacacuuuggugggccggggugggcagaucacuugagcucaagaguucgagaccagccugggcaacuuggcaaaaccccaucucuacaaaaaaaauacaaaaauuagccagaugugguggugcgugccuguaauaccagcuacucaggaagcugaggugggaggauugcuugaaccugggagguggagguugcagugaguggagaucgugccacugcacuccagccugggcaacagaaaaagaccccuucucaaaacaaaaacaaaaacaaaacaaaaaaaaacaggccagauguggcagcucacaccuguaaucucagcaccguaggaggauagcuuaaaaccaagaguuugagaccagccugagcaacaaagcgagacuccguuucuguaagaaauuaaaaaacuuagccaggcacaguggugugugccuguaaucucagcuacuuaggaggcugaggugggaggaucacuugaaccuggaaguuuggaggcugaagugagcuaugauugcaccacugcacuccagccugggcgacacagcaagacuucaucucaaaaaaauaaaaaaauaaaauuuuuaaagaacaaaaaaaugauagcugcuaguuuaaugcuuacaauauuauccccuuuuuacagaugagaaaacagacacaaagagaugacacuauuuaaaaaacugacuccaaaagccugacugaaacagccuuaaccucagcucgacuaaacuuuauaugggcccauuccugacucuaggcccuuaccucccuuuucuuagagcauuuucuucagaaaacuugucauuguaaauuccuucuccaucucuuugagauauauguaaaucuuuuuacagaaaacuuuaauugguuuuacaacccaggaaaugucuuucucaaggaccuggaaaccaucccuuugaaacacagcaucaaagaagacacugcccuuaucuuccagucucugugggagaauaggaggcuaacuucaacggguaccuauuaguaaacacagauggccuacucacaaagagaaauauuugcaaacucaacaauaacucaauaugcccaacacacccgauuaacugccccacauaauaucuuucaguauuuuuccacuagcucauccuggcccuuaaaaacccuucugccuuuuguuucagaggaguugaguucacacuuaguucuggccuccuuccccuauugcagcggccuugaauacagucuuccuugucuguuugacuuuauccaguguaauuuuugauucaagaagccucacucaccaacauuaaaaccuaacaugccaugauacaucgaaaugugaagagauguagaaaauuucaaaaauuauuuucucagauuucuaaauuaaauauugcuauaauagagcaucacaaagucaaauacuauaaaaaacuuguaauccuuuucauuuucucuuaaacaguaucauauucuaaguauuuuaaguguauuuacuuuuuguuuuaucaaaaguuauuuucauuuauucaaaauauucacaugcaaaauauuuaaauaaaaauuaaggacugggcacaguagcauaugccuguaauuucaacauuuugauaugcagagacagauagaucacuugaggccaggaauuucagacaagucugggcaacguagcaagaccccuucuuuacaaaaaaauacaaaaauuagccagugguggcacaccuauaaacccagauacucaggaggcuaaggugggaggaucacuugggcccaggaggucaaggcuacagugaaccaugaucaugccacugcacuccagccuggguaacagagauagaccccaccucagaaaaaaaaaaaaguagguacaacaacuaaauauacaucuaauuaaucaccaaauccuagcuuuuauauauauauauacacacacauauauauacacauauauauacacauauauauacacauauauauacacauauauauacacacauauauauacacuuauauaauacacauauauauacacacacacacacauauauauauauauauauauuuuuuuuuuuuuugagacagaguuuugcucuuguugcccaggcuggagugcaauggcacgaucucagcucaccgcaaccucugccucccggguucaggcgauucuccugccucagccucccaaguagcugggauuacagguaugcaccaccacauucagcuaauuuuguagagaugggguuucuccauauuggucaggcugguuucgaacuccugaccucaggugauccgccugccucagccucccaaagugcugggauuacaggcaugagccacugcgccuggccaauauauuuuuaaguauuucuuuaacugaccuucuucuccauucauauucuuuuugccuuaauaaaggccuccacuauaucccuccugaguuacugacugcucuucuaaagagccccuucccuucuucacaggcuuacuuuuuauauauuuauuuuugagacagagucucacucuaucacccagacuggagugaagugacugaaccucgaccuccuggacuccagugauccuuccaccucagucuuccaaguagcugggauuacaggcacgccccaucacacccaguuaauuuuuauguuuuuaauuucuauagagauggggaaggucucacuauguugcccaggcuggucucaaacuucuagcuucaagcaauccucccacauaggcuucccaaaaugcugggauuacagacaaaagcuaccacaccuggcccauguuuaauuuuuaaaaaccuguauuucccccuugcugcccucugcuggaauuauauggaaaauaugauuaaaaguugucacaaaaggccaggcgugguggcucacgccuguaaucccagcacuuugggaggccgaggcaggcggaucacuugaggucagaaguucaagaccagccuggccaaaaugcugaaaccccgucucuacuaaaaauacaaaaauuagccaggcguaguggugcacaccuguaaucccagcuacucaggaggcugagguacaagaauugcuugaaccugggaggcggagguugcagugagcugaaauugcaccacugcacuccagccugggcaacagagcaagacucggucucagaaaaaaaaaaaaaaaaaaaaaugcugucacacaaaaguuuuaaaaauaaagccaggugugguguaugugccuguagucccagcuacucaggaggcugagaggcaggaggaucacuugaggcuugagcacaggaguucaaggccagcuugggcaacacagugaaguccuauuuaaaaaaaaaaaaaguuggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaggcagagcuugcagugagccgagauugcgccacugcaguccgcaguccggccugggcgacagagcgagacuccgucucaaaaaaaaaaaaaaaaaaaaaaaaaaguuuuaaaaguaagauguguauuucuauuuagacuacaugugugaaaauaauaccacuggaccaagguuauucgagcgcauuaaauaaacaagaccccauauuccaccauuagaacaaacuauauuguaaucucugacacuucguaaguuucaaauagcucaagugaacuaguuaaagagaaaaggaaaguugcguccugugggaagguaucuuuuaguaaaaggaggacuuuugggauaggggauaggcaggugaagagccacuucuaaguguaugacauuguacauggguaagaaaaaacgcuaacugaugaaugugauuaacaugauggaagcaguguggaaagauuuucaaggaggaggaaguggucaauaccaccaaaaguuagguaagagcugaaaaauggccacuagaugaacaauucugguguuaauggugaacaaauccacaguauacugaucuuauucuacugggggaucgggggggcagauaaauuggcaaauaugagaggauuauagaaagaaguuuguugggggcacaaaaguuggaguggccaguaauguuagggagagauaucagaaaacauuuaauuaaugaaauacuuauacuuccgccaaggaugacggaaucacuaaauggggacccaaggaagaccauacuugcucuaggcaggaauaagcagaauggauuccacaacaacucaccauuuucuaauuaaguauuuugggaggaaaagaaaccuggccuggaucccagggacacaaagagggacugucacuguaccaaauggaguggccaccuagaacauauaauacaguccuuacuagauccuggauuacaguaaaacugauauuccagaacauuauuuguuuuacuaaauuauuucauuaaaauuaaucuaaaucauagauauuuccucucuagacaacugcauuagcccccuaacugaugucccacaucuacucuugcuaccuuccaaacacuacuucaaacagaaaauagaaugaucuuuuuuaaaugaaaauauuaucauggccaggcacaguggcuuaaaccuguaucucugcaccuugggaggccaaggcaggagaacugcuugaggccaggaguuugagaccagccuggacaacaaaccaaggcuccaucaguacaaaaaaauaauuuuuaaaaaaauuagcugaaggcagagcaugguagcucacaccuguaaucccagcacuuugggaggccaagguggguggaucauuuaaggucaggaguucgagaccagccuggccaacauggugaaacuccgccucuacuaaaaauacaaacauuggcugugcgugguggcgggcgccuguagucccaucuacucaggaggcugaggcuggagaacugcuugaaccugaggggcagggguugcagugagccaagaucaugccacugcacuccagccugggcaacagagugagcuuccaucucaaaaaaauuuuaaaaaaaauuuuaauuaaaaaaauuaaaauuagcugggcacgguggcacguaucuauagucccagcuacccgggagacugaggugggagaaauuacuugagccugggaugucaagacugcagugagucacuacugugccacugcacuccagccugggcaagagagcaagaaccugucucaaaaaaaagaaaaucuuaucauggcacccuacuacuuaaaacccuucucugcuuccagcuauucuuaguauaaagacagaaucuucaacauaaccuacaaaacucugcaggaucugucuugucuaccucuccagguccuuuuccuaccauauucccuccaucucauccugucucuuaccacugcauaucaccauuacuguuuccuguaaugugccaagcuccccaacaccaagcccugugcuguggccucucacuggaauuaucauccccuaauuaacuccacuuuuaagucaaacaagccaucccucaccuccgagacuaugucaggucuuguuucaaacucaauuaguuuugcauaucuuccuuucauagaacuuaccacagcuauuguuauauucauuuuuacaauauuauaaguaauaucucugccacaccauaaauucuaacugccaugaaaaagggcacuucuguucaugcuagccauaccugcacccaggaucuaguacagugccugccauguaauauuuauugaaugaaggaaugaaugaagaauauagcccaucaauagauucugagucuuauggccuaauacaagggaaauuaccauucaaaguacauagacauuuaagaaauaauuaugcuuaggauucuguaaucaauuucauucuacauagccuaugaaaauaccaaaucaagagcaguaucucugaauuuacuuugacaaguuggcuaaguguuuuuguuuuuuucauuaagauccuuuuagcaaauaacuuuuuuuuaauuuauugagauugagaugggggucucacuguauuucccaggcuagucucaaacuccuggguucaagcaauccucccaucucaaccuccugaauagcugggauuacaagccuaugccuaaguguuuuuuacaguuguuagcucuaaauauuacuguauuuuuguaucuaaguagaagcuaucaaauguauauauaaaauuauauaacuaaccuuucgaggucucuucaagugaguccuuuuuguuaaagcagaaguagcuuuaaaaaguuuagagagguucuaacaaaggguucacagguucaacaaaagcccacaauacaaucacuaacagaauuauuuuaaaaaaucgccugucacuuacauauauauuuccucaaggcuauuugauaaauccgcacguucuugcccuuuaagccaaggagcacuaagauuaaauaaaacaauuaagaagauuauucaaggauuauguuuauaccucaaauuacagauuacaucacaaauaaauuuuuuuggcuuuaaaaaauuauuuucauaaauggucuuauauuuguauaaaucuauauaguugcaaaaugcuuucauuagcauuaauucauucagccuucccaagaaaccaugacaaaaacaaaacccacaccaaaauuacccuguuuuaaugguuuaaaaauuggccaggcgugguggcucaugccuguaaucccagcacuuugggaggccgaggcgggcagaucacgaggucaggagaucaagaccauccuggcuaacauggcgaaaccccgucucuacuaaaaauacaaaaaauuagcugggugugguggcgggcaccuguagucccagcuauuugggaggcugaggcaggaaaauggugugaacccgggaggcggagcuugcaguuagucaagcacgccacugcacuccagccuaggagacagagcaggacucugucucaaaaaaaaaaaaaaauuucuuaaaaggacauuuauguuuauaagaauucuauaucuaucauuugcaauaaauaaaaauaaaaauuuacagaaccauuauuaacaguaagcauuaaugccaugguuuuaaaauaugugcacaaaaaaaacuaauagguacaaauucuaguaauugaguuuguuuguuuuuuaaggcuaauuaagugaagcagugggagugaagaagaaacaaagaaaucuaaccaguugugaucaauuacugguuauaaaccaaucacuggucuacaaucagaccggccuaguaacugagauuuuuaugcaauucuguucccaaggguuuauacauauuacuaggugauggggccaagguagaugaaauaucacuugcaucaacaggucauggcucauaaagauuaagcucgggcugcuaagaagaugguucgucaacaucaacggggaaaggggcagggagaaacaccagaagcaucauaaguaacuccuggaaggcaggcagucuuacagguacaucaaggaacuguggcuaggucaggagaucuagguuaggaguaacucuaagggccaagguugcuagauuacuaggcuaaagaggaagguuuccuuccucaucucuaaagacaauucuguaccuacuucaccucuacgaaccuugugauucucuuuuauacuaaguggcauauuuuauuguuuuauagaauuuaauuuuuauuuaaaugcucuauaccaaacccaaaagguauuuuuaauuucuauauacauguuaauaagaaagguauuuuauguaaacgcaaaguacaguauaaacaucuuucagaauagaaucuuuuuauagcaauauaaacguagaaauacagcuuacuucaacugguagauagguggagcuguaccuggguauucauucggcagcaucaccuacaaugcagguucaaaaacaucuguuuacacuucaucaagguucaaaaguaaccauauuuauaaagcuagcaacuggacaaaaaaggcaaggaggacagagaugaaaggaaaaggaaaacugaaauauggacauuauacccugaccccaaguggaugaaguggcauuauaauauuuucuggguacuuuucagaagaaauacuacaaaaauccuaggaaacaccauuaacuauaugaaauagcuaacauauaauagagaaccauacauacuucuuuucaaaucaguauuauaaaaacaaacacuggcaaaaacuguuuugcauccuuuauguugaaaguacauacaagcagucaucaaagauuaagcacuaagaaaagccauagcugaccuuuucauuuauuuuauccuaacuacaacugaucauugaucauugauucucaauuaauaaagaaaugacugucuccucuacgagucaucuacauuacuaaccucucuuuccuuuuaaauguuagccaucuuuccagguuuggacccucuccuaccagaugaagagaauaaugaagggaagcaaaacuacagucucucaaggguacauuaacacuuuuaaaugauuaaaagcauuggauuagaaagacuggaacuaucaauuaauguaugauuugaaagugaucugagauguaacugcccauguguuuaaucauugagaaaagccaagaacaaagauaauuuagaaaacaacacaaucauuagaauacagaagucaacaauauaguucauacuguaacugaaagauggcugcaaggaagggggaaaaaguaccugcaagcaaaguguccauuuggggucaucuauaucgucgcuaauucuaauacaaaauauuuuggcacagucaucaaugacacaccacuccucgccauaaauggcugccauugcuucaauuuccucauucugaaagaaauugauuuuuuaaaagucaacaaauguacacaucuuaaaauccuauucuuacuacuuuauaagguauucaaauucaacauuaccagaguagaucaaaaauuccuagaugagccucaccaggccaagaguuucuuaagagcaggucaccauguucugcucucugggugguugcuaggcgcuacugcaaugacuggagccagccuugcuacugcauuacugugcuuuuggccacuauugagucaaaauauaauauauaugcacucccauacuuuguagugaccauucacacgugaaaagauaaaccuaucuucucuguuccaccuucucuuuuuuaacagguaaucuccaccccugacucccacccccaauagcucugccccacauuaucuguguacuccugcugggugucucacugguuccuucguauuaaauuuuguguuggggggagguggggaggggguacacaaggacuagaugggugggugguugcuugguaaucaaacccuuaaaacguuucauaaauuauucuuugggcuugggguuaaaaaagaaaaauaacuggaggaccuaaagggaaaagaugggaagcaaaguauccauucgacuucguagcauuucauuuuguacucacagcccuguaggaaaagacuuaugaucgcccacgugaacaaggcacagggaaagcucgaugccaaggaccagaaggagugagauucggugggcucucgggaccugcagggucugggcuauugccauuuugcaaagggggaaacccgaauucuuaagugauuuguccaagaugacucggcggcggcaggguggggaucgaaaccccgguuuuugccuucggcccagagcugcuuagucgcguguuaaugguugacgaggacaccguccgagacaggccgagaccgcggccgccgaggagccgccggccuaagagcgcucggccgacgggaagcgccgggaaaauggaacgcgguggagcaaauggcguggccagugcuggcggaacccggggcggccccaggcggagggccccucggcugaggaggacuggcauggcgaggcgagccggagccgagccuggagagacagcaccccgccggggccucaccugccucuggucgcucccugcgucccccucagccauguggccccuggaccugcccugcagccgccgccugccagguccggagcgcgggggcggggcgcugcggcugcgagccgagagcuggcugcggcgcggcccgacccggaaccac

SEQ ID NO: 192740 - RNA, 74395 nt, Homo sapiens
gagaggccggcgucucucccccaguuugccguucacccggagcgcucgggacuugccgauaguggugacggcggcaacaugucuguggcuuucgcggccccgaggcagcgaggcaagggggagaucacucccgcugcgauucagaaggugaaaccgcgcgggguugcggaugccaggcccuuaccgccucugggagagacagacgcggggggaagggccgggcccggagucgaccgggccgaggcggaggcgggccugcugggaaucagcaguguuugggaacacggacugcuggcugugccugaguggguggcggaagagggugaaccgguuuuucucggagucuuucacgcauuuacgcguuuuucuacagacacaaaagcccaaacagccgccgccugauuucucuagggauggggcggcguucgggcugcggggcgcgugcgcccggcggcggccgcucagggaagggcgugugucggaccggcggccccgcgcguugcuccggaguuacuuuggcgucgccccgccccgcgugccgcggcugcuucgugcggaccccaccgcgggucgcggcaggcagaggggaagucggugcgcuggucgccgcccugcaaacucagccgaguuugggagcucgcaggaggacuuggggaacgcuggagggaaccuuaguauagaguuugaggagcgggcaaggaagguccccauggacucugggguuguccccagagccucuucuucccuucugcaucgccgccuauucauuuauucugcagcaaauauuuauugagcgccuauuuuaggcgcugaggcuacuguggugagucaugguccuugccuuccuggagcuuacagucuaaugguggagacugucgugaccaguuaauguaagucgugauaaauacacagggagcugccuccuuuuuaaaggauagagcugcugcagucgcugcuguguuacugccagucggaacacaaagguucuuuauuguccucuaccccuuguugccugcaagcaaggcagcauucuaaauuuuacugaccuagacuuucagaaguugcugcuguauuuagcaguuuacuuuaaauauuuuuguuuuguuuuaugcuguguagcaaagaucaaaauagaaaaaaaggucaaguuuuaguaccacucagaccacguagauuaugcuaaucgguuucuguuuacugucagguucuucguaguguggcuuuugacauuugcccaacuguugcuuuauuuuaugaacaaacgggcuuggcagugccuggaaaugcagugcuuucauauagugcucugaguuaagucugcagccuggcaaacagcuccaaguacgcacucacgcaaaacugcguuucuggagggcucaccuuuuuuauuuuuguacacaggaaaaguccagaguuuuucuuuuuuuuuuauaguuucuguuacauaagucugaagauauuuaucauggauaaugauuaauucggaggaugcugaucaauuauuuuccauucucagcugaacagaaaaaugggcucuaaauuaauugccuuauucuacaaugggagagauugauauuagaugugagacagauauuuuaauggugaaguucaauaguuugaggaauauacuggagauaauaaguugugaaaucauuagguugaggacuggauucgugcuuuuuaaggacuuuuuuuggucauccaaugguucuauuuaagaaauaacugcauuuauuagcagaucauguuagugguuuuuuuuuucccccaguaagugaagauuaugauucacgugcauaaaaaagugacaguuaauguuaaauggauguuccuuuuauuuagauugcgugauuaugguauugugcuaauacuuuugaauacugguaggguggggcagguucuggaggagcauauccugagucccuugaucuuacagcugaaucagccccugaaaacuuaagugacuugcucaaaauggcaaaacuggcacugaaacuaacuggccuuuuaauugcuacaaucaguacucuuucuucagcuccacuuuacuuagaugaauuauuuaacccucaaagccaagauugcuuggaauguuaaaagaugauagaaugauaaaucgguauguuuuuccucuuaaacuuuugagacagcauaauuaugaaguaaacucauaaagucuguaacaaauauacaugcauagaaauuauuauguuuaauuauuaucucauaauuggagagucacaaaaccaugcuguuauaaaacuuggaaacuaaccagcuaccucaucaagacuccugggcugaaguuuucauguauuuauuucauucuggagaaggacagaauuuuucuuuacuguuccaaagcauuagaaugaugaaaaaccaacucggacucuuaacuuuuagucuuaauuggcuaaagcuucuauuacagauagcagagguaauuaaauguuugauauaaaagaauucagauuuucccuucugggcuuguuuauucagagggagaauaauuggaauauuaaaacauuauugauuaaacacgauaucauuccaaagguguaaaaguaagauuuuuuugcggugagcugucauauauauuaaaaggacccaaggggauucaauuucuguauagaugaaacauuucuagaaaucugaagggaaaaaacucaguuauugaaaagauuguccguaugaacugugcauggcauauuuuuacaagagauuuaaacaguacguaaugaaauuuuaugcaagagagcugcugauacacuaauguugcuuuaaauuauauuuguuauuaaaaugaauuuuaaaauaauuuguaacagcggguagcaacauuaacaaagucauuuuaaggaaauuuuguuuuuuuuguguuuccauguuugcuuaaugauuuaugauaguaaugauuguuugcaggggacaguauuuuguuaagggauacgcuuuagaguucuuguacaagcaguauuuacuaaugcccucccuuucugaauuuucuaguuuuuuauuuuacuugaugcacuaguuuuaugcuaaaccuuuucuaauucuguuucagauguuggaugacaauaaccaucuuauucaguguauaauggacucucagaauaaaggaaagaccucagaguguucucaguaagauugauaagaaacuuuuuuuuuauucaguuuuuuguauugguuaauuuuuuacuuuuuacuaacagcuuuauugagauauaauucacauaccauacaauucaccuauuuuaauguguacaauucaauguuuuuuaguauauucauagaguugugcugguauuacgugagucaguuuuacagcaucuuuaacauccccaaaagacacuggguauccuuuggcagucacuaucccccaccccucaacccgugacaaccacuaaucuacucucugugugaauuugccuguugugacauuucauauaaauggauugauauacuauguggucgguuuugacucacauuuuucacuuaguguaauacuuccgagguucauccauguugaaccauguuucaguaccucauuccuuuuuauaggcaaguauuuuuuuccguuaugcagcuguaccacauuuuauuuauccaucggugauggccauuuguguuguuuguacuuuugacuaauuuugaauaauacugcuaugaacauuuguguacaagcuuuuguaugacuuguuaauuuauaaaagaaaacuuucuuugggaggagauuggguaucacuucguuucuuauacuucuuacccugcauuauacaauaaugacuucaaauauauguauagucuuaucugugggaaaguuagaucuucauuuauauaggguauugaguugcauccauguauguggugaaaacaaagcuuauaucuaauaaauagagaacugauugucauucauaagggccaaacuuucuuacuuugaagugauguaucugaaguaaauaauaugcccuaauagaaucugaugugguagaauaaguugaauauauuaucaaaaguaauuagaauagaacagcacuguccauuagaaauauaaaugggagccacaugugugauuuuaaauuuucuaguagacacaguaaaugaguaaaaagcagaugacauuaguauuaguaauacauuuuauuuaaccuauuauuuccaaaauaguaucauuucaauauacaauuagcauaaagauauugagauauauugcauucuuuucuuuguuguucuaaaucuuggaaaccuauuguguaucuugcuuuaauaacacaucucauuuuggauuagccauauuuuacuguguguaguggcugcuauauuggucaacacagcuguagaauacaguugacccuugguagccauggugaaucgauuccaggacuccccauggauaccaaagucccagaugcccgugucccugauauaaaaugguguaggauuugcauaucaccuacucacguccuccuguaaacuuuaaauauucucuagauugcucauaauaccuaauacaauguaaauacuuguuauacuauauuguuuagggaauaauaagaaaaaagccuacauguucaguaacaaccauccauuuuuuuuuuucagaauauuuucaaugcaugguugguuaaaggauguggaaucuguggauacugagggcugacuauuuuauucucacccuuguuuugggaugcaucugucuuuccuagagacuucacugguguauccucaggcagauaauucccaccaaccuuggcccuugcuuuguuugguuuucacauuguauuggucucuugcugucauuugauuuacccucuauuuaauuccaaguuuccauuacuuuuuccccuuuguuuaaaaguauuuuuaaauguaaaaagucauauaugguuaucauaaaaaaaauuauaaaguauaaguuuguggagauaagucaccuuuuacaugccacugucuuaucuccuuccccuccauagggguaacugcuucuagugcuuuaguauguauccuuccaaacauuuuucuguguauuuacauauaugcauucauauuuaugcauacacguuuauagauauuguuguuuuuaauauuuauguagguucaguuuuagaaauggaauuacuggguuaaagaccauacuaaguugccaaauuagccagcaaaaagauuguauugguuugcuuucucccagccagguuuuuagaguccuagcuuucagcuaccccugugagcaguagauauuagacaucuuuaaaauauuuuugcauauccaguugcugaaaaguggugucuuaaagaacuuuuuguuuuggccaggcacgaugguucaugccugaaaucccagcacuuugggaggcugaggugggaggauugcuuugacgacaugaguuugagaacagccugggcaacagugauaacuguuucuacuuaacgccgccaacaagaaaaaacaaaaagccuuuuuguuuugaaauaauuucacacuuacaaaaauguuucaaagauaguacaaagaauuccuguaugugcugcauugaauuuuucaaacgauuacauagcccacuugguuuuuuauucauuucucccccauauuguuuuuuagaaacauuugagaguaauugcagauaugaaucccucuuacuuuuaauaaccucaguguguauuuccuaaaaacaagcacauauucuuaaauuaccagaguauaauuguuaaaaucaagaaugcaauacuauuaucuaauauuuagggcuuuuuugaauuuugccaguuguccuauuagugcauauuuucugguccaggguccaguacaggaucugguguuguauuugucuugucuccuaaguauacuuuaaucugggggucuuuuaaaaauauuccaugauuuugacauuauugaauaguauagaccaguaguuuuguggaaugucccucauuuaggauaugacugguguuucccaugauuaaauucacacuauacacuuuuagcagaaguaccacugacgugauauuguguccuucacagugcauccucaguagccauauguuaguaguuugucccaauauuggugauaacuuugaugacuuaguuaaggugguaucuuaacuaaggugguaucauaacuuuaugguuuguucaccauaaaguugcuauuucuuguaauucauauguaucuaauaccuugaggcacauuuacauuguuucucaucauacuucaacacacuaauuuuagcauccacuaaaaauccaaugauuugccuaaaauaguuaucacuuuaagugguuaccaaaugaugacuaaaucuaucauuccuuuuacuuuuacuuaaguccuacugugaggaagaaauuuguucuuuuccuauuccuucauucuucacuuauuuaucucuaaauggacuuaaacauuauuacuguauucucuagguuauaaucucuuacuuuauuauuuauuuucuuuaauucuuccagaucuggccagugggagccccucaagcuggcuucuugauaugucuucauuauuuuuugaacauuuacuuauuuucuuauaccacaaaauguucuaggcucauccugguuuuuuuuuccugugcagguggguagucacccguuucuccaagcccugguucuuuuuuuggagaaugauguuuagaaacuaagaucugagugcuagguuaucuuacuguucaaucucuuguauguuuugcauuuuauaugauuguuuccauuacauauauuauugcuuagaugaaucuugugcauauauuugagaauguucuuuaaaaaauuaacuagcugaucuacuucuuugguuuaacuguggauaguaaggagaucaauuccucaagucagccauggaauguuaaagcuuagaggcacuuauuagaauacaaucaugcgcuaccuaaugcucuuuuggucaacaauagaccgaaagauuauaauaccauauuuguacuauaauacccauaagauuauaauaccaucuuccuacugcaccuuuucuauuuggauaauuguagauaaacaaauacuuaccauucaguucaguacagccaacaguauucaguauaguaaaaggcuuuucagguuuguagccuaggagcaauaagcuauacuguauagccuagguguguaguaagcuauaccaucuagguuugugugaguacucuugaugauguuugcacaacaacgaugaaaucaccuaacaacacauuuaucagaauguauccccauuguuaagugaugaauaacugaaauuauuuuugccuuugguuuuuaagaacuccacacagagccaaggguaguauaugucacggauaguguauguuuaggucuagaaccaacugagucagcaaaauuuucaacuuuuucagauauauauauaugaucauuucccucauucucuacauauuggauuagaucucauuuucucacauauacuuggugaacaauuuaagcaaauagggcuuaaacugacuuagggagaaucuuaaauucugccguuuuugguggauuuaauuuuauucuuuuguucuucagauauucuuucuuucucaaguugucaguauugguuugugaauaaagagaaaaacaacuccuccucucgaccuuaacagguguucuuguuucucauuguaggagaagcaaaaggaaaauaaagagaaacguuaauacaugacagccaucugggaauugauacuccaauuuuaaauuaacaacuccuuaagaugugauaacuuugccugaaacuguguuuuuuuuuaaauuaaaaauaacuauguauuuuaugaaagcaguaugugcaaauuagaaaacaaaaauguguaaaaauaagagaaugaauaccauauucuuacuacccaaagacuuuucagugguaguaccuuuguguauguugcuuuaucaacgcucucugcagacacacacaaauucaaauauuacacucaugagucaguggucugaaucacuuguggagcgcaugugccuggaccaucuuccuuuaaauucugguaacacacgugagaauguguuacugauucacugugauguuuaauuugagcauuuucuaaaucaaccuauguuugcuuaaaucauuucuuauuuuuugcauuuuagggugaguccaaacuauuccagaguugcauaaauuucaaacaacaaaaaaaauuagugucgaucauucaucguaauuuaaaagaguuguuuaaaucuguaguuuggaagauaacuuuuauucuauaaagugcauucccguugucuaauaaauauucauagcuucuagguaagguuuauuuuauaaaaugaaauuacuuccagcuuaauuuuguaauuaugucaacaaauagaguguccauuuuacuuuauucaaaguaauugaugaguuacucuuaguggccucugugggaggugaacuggcucuuuuaauagguuaauaaucaugaguauuugagaauauuugucauauuuaccaggacaguaccaucaucaaaaauaaaauacuaaauauauuuuauaacagcccuuagcuuauauacuccuuuuuuuccucauaucaacauauacucuuuuuuuuuguuuuguuuuucaagacauaaucucacucuuuugcccaggcuggagugcaagugguaugauaauggcucacugcagccucaaccuccuguucucaagugauccucccaccuuagccuccuaaguagcagggacuacaggugcgugccaccaugcucagcuaauuuuucacuuuuucguagggauagggucucacuuuguugcccaggcuugucuugaacuccuaggcuuaagcgauccuccugccucagccucccaaagugcugggauuacaggugugagccacugugcccagcacaacauauacuguuuuaggaauaaaacauuaagaaaguaaacuguuucagugagaaacguaacuauauauagaauaaaaauauucaaaguuucugaggaaaauauauuuaauaucauuuuuauuaucauuucaauauugucaccugaguccagauucuccuagaguauuugcugauugcuuuuuaggugaccuauauacaaaguuauaaaauaauaugaguauuuacuacuuuuuuguuaauguucaucuuugaaccuugagucaucuuagaauauguuuaauugggcugaguguggugacucacgccuguaaucccagcacuuugagaggccgaggcgggcagaucaccugagaucaggaguucaagaccagccuggccaacauggugaaaccccaucucuacuaaaaguacaaaaauuggcuggacguggugguggauaccuguaaucccaacugcuugggaggcugaggcaggagaaucacuugaaccugggaggcggagauuacaagugagccaagaucgcaccacugcacuccagccuagcugacagugagauucugucucaaaagaaaaaagaauauacuuauuugaugaaugcuauaaaauaaugcaauuuuacagaaaauaaacauacugaaguuagaaaaggccaauuaaaauuuuuuuuuuuuuuuuuuuuuuuuuugagacggagucucgcucugucgcccaggccggacugcggacugaaaauuuuucauuuuuaccuaccuccuuauacgagggaaaaugauuuggagguauuagggcaauuggagaaauuugaaugaguucuguggauuaaauaguaaugauauaucaauguuaauuuccccaugaugguuguccuguuauaugagggaauagccuuguuuuggaaagccaguacugaaguauuaggaguaauguauuacugacucacaaaugguuuuggaaaaaagugagugcauauguaugucuguguguguugguguguguauuuagagaugauaggaaaaaugugguaaaauacuaaucauuagagaaucugggagaaaaaauauacaagacuuugcuauugaaacuuuucuguaaguuuaaaauuauuucacaauuaaaaauugaaaagauuugacaguugagagaagguugggcaaaugucuuaaaaugaaacuacuucauaaaagauccuggguuuauagauuuuaaaacugcaggcaacuucaguguccugcuuuaacuccauuauuuuacauaugagaccuuaagaguguggcagauuagauguaauaguaguuucacacuggcuuugucaaguacuaaucaacaugauacuaaaauuuuuucuuaaagggucaugaauaaaccacaucuguuaguaugguuuggucagugguccucagaaaaucucaugucgugcaaccauacuaauacucaagcaaaggaaaacuugaaggccuagacugaaacagguuauguguucuaauuaaaaauggcugguugguuuuuuaaaaaauggcaagauauggaacacuauauuuuaaguuccuuccuagaucucuacagaauaaugaaauaguuccagcuaguggucccuguuagugcugcuugaagaauuucaacaacacaauuaaccauuauguauaauuuaguacaauauaauuauuacuuuguccauuuaguguaaaguucacuaucaaagauguaucaugucucauugggcaacauaguguccaugugacgcaaagcauuaaaagcauggccuuguuugugaaagcguuauuuuaaggucagcaagaaauaguguuuuuuccuuucuuauuaaaaaaaaaaaagcugugaaaccuguuguuuguaacaggagaaaaauaaguagcaaagaauaugcuaggauucggcuggguacaguggcucacgccuguaaucccagcacuuugagagucugaggcuggcugauugcuugagcucaggaguuugagagcagccugggcaacauggugaaacccugucuauuaaaaaugcaaaauuuagcaccguguggugguaugugccugugggcccagcuacuugggaggcugaggugggaggauugcuugagcccaggagaucaaggcugcagugagccaugauuacgccacugcacgcuccagccugggugacagagugagaccuugucucaaaaaaacaaacaaaaccaaaaacgaacaaaagaaaaacucggauuccuuuuauggugucuauuuuagaaaaugaauuaauuuggaaucugaauuagagaacuuuagcugaaaaaacuuauuuuuauuauuuuaauuuguauuuagcauuuuuaguaaaugaaauauuuaagaaagccuaacaauuugaugcagguuuuaaguuuguacucauggggcuuguauggcugcacugagacaaaacacuagugauuggaucacugcuaauuuuaauauggcuuugucaguuaauuuguuaaaauugugaagagaagcuuagcuaaacuaauucauagguaagauuacaauaagcauguuuaaccacguaaugcugauaaugaauuugcuuuauuuucuuaaaguuaaucuugaguguuguugguguuauaacauuucuuccaucuuuuguuuuagcauaucucuuuuuuucuguaguuggagauugccuauucauugccuucucuauaugcuguguccugauagauggguaguauaaacacagugggccuaaguuguuggucauugcuacaguagugaaaaggaaaaaaaggugugguucccaccuccuuuccuaaauuuuagcagaacauauugacuguacuuggguuugagguuuuuagcaaaaugaaaauggcagaaggaaagggauaagcauauuucuuuuuuuucuuuuugagauggagucucacucuguugcccaggcuggagugcaguggcaugaucucggcucacugcaaccuuugccuccuggguucaggcaguuguccugccucagccuccugaguagcuggaauuacaggcgugugccaccaugcccagcuaauuuuuguauuuuuaggagagacggggguuucaccguguuggccaggcuggucuugaacuccugaccucaagugaucugcccaccuugggcuccuaaagggcugggauuacaggugugagccacugugcccagcugagauaagcacauuucacuggauuccuuuauuuaguucuuuuuaaaaaaacucaguguacuaguaugggccuauuacauaugucaguuauuccaucuacuagcuaugcaaucauguacaaguuaucaaccucucuaaacauuaguuucucaucuguaaaauggagaaaagagcuccugccucguaguauugguuuguggauugaaacauauaugcauauaaaaaauuauaacacuauuuagcauacauggcaagaucucugagcucauuauauuuaaauauuuauuauuuggaacuuuugcaguguaggaaaaauugaagugcuauugauguucggguaacaaauuuuuaaugaaacuuuagaaaugauuauagugcuguuuguacuuaggcagguaggaagaaaauuauuuuuuaauacugauacuuguuuuguuuuaauagguaucagcagauguugcacacaaacuugguauaccuugcuacaauagcagauucuaaucaaaauaugcagucucuuuuaccagcaguaaguaucuuuaaaaucaugugaaguagacaaucuuuauaguuacauaugguauggcacauuuuuguugaaugauuuuuaaguuuuguuuaguaaauccugcuuuacucugagaacaugaaaguauucuauguuaucuaaaagcuuuguuuugcuuuuauauuuaauuugaauucaccuaaaauugauucugucccugagaagguuauauucguuuaccuguuuaccuaccuaccuauuuuaauuuuuaauugcacaaguaauuuguuaaucugaaauguuucacagcaagucccagacaucuuacaguuugaccaguaaauacuguauuuccauaugcaucucugucagacaggacuauucucauacccaacuaaguuaaccauaauuucuuucugucuuacaauauucaauuuauuuucaauuuuuauccguuaucuaaaacaaaccuaaauguuuuacacgugaucuuagccaaaaggccgagcagcgauuaaaaacucuaaauuuuuaaacaguuguuugccucagaauccaaacaagguacacguagugcauugguugauaugugucuuagucucuuuuaaucuguaucauuuuaucuuuuuaaaucuucauuuauuuguuaaaggaacugggucauauauuguguagaauuuuuaacauucugcauuuggcuaauuguauucucaugguccuuuaacguguuccuuuguuucucuuauuucauguaaacugguaauuagagaggcuuaauuagugagguuuagauuuuugguaagaguauuuuguuggcggugcuuuguauuucccauaauaucagaucaggaagaacauguuugguuguuccauuuuuaguaauguuaagauugaucaauggguauacuugauaccagccugaucaauccauuauaaaguucccugucuaccuaucacuuaaugguuuuaauggucauugaugcuuguggaccagauccuguauuucacuuugggaucacagaauggugaauuucuaauucuauaaucccucuugcauuuauuagcuguaauuauuuuaaaaagauaaacuuccuuucauuaaauauuugguuauccugaaacuagagaguccccauaggaaagucaugauaaaugcuugauucugucccuuuaucaauuuucagaaugaguuggucucuagcaaccuguguagguuaccauuuuaauauuuuuguuuuuauuaucugaauuuaauacauuuuuggauuuuuaauguuuaaaucccuugcagucauucuuuguuauguugaaauuuuguuucucugaucaauggaagccucuucauuuggcuccuguguuccucugacaugacucaaguauuucauagcuucuuuguuuuugugauuugcuguaugcuacuuuauauaaaacauauaacaauguaaugguaccaaaacuaacacuaacaauaagaugcuugucccuaagauacaucccacuggggauauuuuaaucaguauauuuaguuuugaaguugaaauaguucuucauguggcaguugucaucaacuugacuaccagcuagguagaauuuauuuucgugaauaaugugaggaauagguucaguuucauuuguuuccauguggaugguuuuuugucccauuauuauuucuuggaaaaacaagauauuuugucaugcaaucuauguuguaucagguguccguuuauaugugggucugugucugaucuguuuauaucguuuccuuggucuguuuuuaugaauuccacucucuuguuauacuuaaucuuauuccuuuuuuuuuuuuccaagaauaucuuggcuguugguucuuugcauuuccauauacacuuaaacaucaguaugucagguuauauacacauauacguaauccuguagggauuuucauucagauuaccuugacuguaaaucaauuugggaagacuugauaucuuuacaaaauugaguuuuccaaaucgugagcauugcauauauuuucauuuauuuaguucuuuaaugucugucaaugaaguuuuaugauuuuucccuguagaugguuugcacaucucucauugggcuuauugcuagauauuuaauacuuuauauuuuuugaggccauuuuaaaucgaaucuuugucuuuuaaguuuuauuuucuagcugcauuugcuguuuacauggaaaugcaauuaauuugaaucucacauucuuguucagcucuugcuucugaguuuuucuguagaugcuuucaguuuucuguauucaugaucauaucauuugugaauaaucaguuuuguuucuuucuugucaauccuuacaccuuuuauuucuuuuucuugccuuacuucucuggcuaugaccuccauuacauuccugaauagaaguggugauagaggacauccuugucuuguuccugaucucaaagggaaagcuuucacuguuugaccauuaaguaugauguuugcuguaguguuucauagauaacuugucagauuaaggaagcuccuuucuguuucugaugugcuaaguaaaaauuuauauguugaauggauguuaaauuuuaucaaguacuuuuauugcaucgaaugagaugauuauaagacuuuuucuucuuuaaucuguuaaugugguaaaauauacugauauacuuuuaaugcucagucagucuugcauucuuguaauuaaccuacuuguugaugacccacuuggucaugauguuuuuaaagaaauugcgauauucaguuuguuaaaauuuugguuaggauuuuugcaucuuuguuugugagugugauugaccuguaauuuuucuuucuuauaaugccuucgucugguuuuuauuuugaggcuaugcuagcuuuauaaaaggagcuggagaauuuucuacuuuuucuuauccagaagaauuuacauaauauuucuauuucuuuguuaaaugauugguacaauucuuuagaaaagccaucugaaucugaaguuuucuuugcaaggaaguuuuuauuuacuuacuucuuuaauuguuauaggacaauuucuauauuuuauaaauugccuauuuugguaaguugugguuuuuagcauuuuaauaaauuugaacauuaauuagcaugaaaauaaaguaaaagcucuugaaauaaucuuauuuuccuaaugucaacacugucuguagugauaauuuucuuuuuaaugucauuauuugugacuucugcuuugaaauauuuuuugaucauucuugccagauguuuauuauggguuuuuuaagucuuuucaaagaaucaacuuuugguuuugauugugcucuguugcagcauuuuucaaaccuuuuggucucagaacccuguuacauucuuaaaaauuacugaggacuuaaaagaacuugauguagguuauauuguuaauauaaauuauaaauuuuucucaguugugaaauuaaaacaaaucuaaaaaauuuguuaaaaauaauaaacuuauugcauguuaauauaaauaacauucuuuaaaggaaaaauaacuaucuuugugagaugaauggcaucauguuacguuuuugcaaguuucuguuaaaugucuggcuuaauagaagacacuauauuuucacaucuacuucugcauucagucuauuguaguaucuuguuucgguuguagcagaaaaugcagucucacacagacauguaguuagaaaggggaagaauauuuuaauagccuuuucagauuuuuggggauaaccuuguuugauauuacagcagaacucaguaaguuuuuuuuuuuuuuuaagguuaguugugguguggaaucuuaaauuguaucauuacauuuuucuuacucugguacauuuaagcccauuggucuuuauuacacuuugaauagauuuuuacucauguauaauuuuauaacaucaugcuuuggugauuuggaaaguauaaguuuacugaguuaaacaguucuuccaaacauuaacauuuuucugugugauaccaaagacuacauugguuaaaaucaccucuaaucucaucagaaaagugccuaaguauggggaugcugucaagcucaaggucguagauaaguuugcacauuccaaguucuugcuuggaaauucaaaugugaucuuggcaacaaauguuauuaguugauuuucuugcucacuauguuuguuuuugagaaaaugucugccaaauacccaugccuagauaaauacaguuaacaauuguucuuucaaguaaaaaugguauucagugaaaacggugccuaguucagcuggcaacucaaucacaaacugcuuuuucuugauuauuuuacuuugugacagauaauguuuauuauuuucccauuuugucacugaauauuuauuuacaagacauggagaauuuacaaaauaauuuuuacugcuucaucaagcacauuuuuaacugaaacuaucuuuuucuuucuucaacugcaaguguguggcagccaguaauacauugacuaauaauaguuugaugucauugccuugauucauaaugagguuccagcaauuauauccacuauugcuuuuguaccaucauuauaaaugugcacuuagcauaaaaggcaaacaucaucuuauggaaauaguuuugcccuugggcaccucauguauguuuuuguuuaugauuaauuucugaucuuuaugauuuucucccuuuuacuuucuuuugguauauuuuuuucuguucuucugaguuuuagaugaaugccucuuucaucaauuuucaccuuucuaaggaugcauuuaaaauggacauaaguuuuccucuaaucauaguucugauauguaguauauucauauuuauuuaauuccaaauauuuucuaauuuucauaauuauuuuuuaaugcauugguugauaaaaauacauuucuuaauuuccaaacauggauauuuuauuuucuugauuucuggcuuuauugcauugugguuaaauaacauuuuacgauuugaguucuuuggaauuccuugagauuuguuucaagguccagcauauggucaguuuuuacagauguuucauguguauuuaaaaaaaauauguauuguuuagccacugagagcagaguucuauauaugucuauuagguuaggucaaguguguuaaucuuguuugaauccucuguagccuuaaugauuguuguuuuuuuagucuuuccaauguuuuguuuguuuguucuaucgauuacugagagauguauguuuaaaauguacaagucaaauuguggacugacugauuuuccuuuuagcucuuuuaagguuuuuuuuuuuuuuuuuuuuuuuuuugagacggagucucgcucuguugcccaggcuggagugcaguggugugaucucggcucacugcaagcuccuccucuuggguucacaccauucuucuacuucagccucccuaguagcugggacuacaggcgcccgccacuacgccuggcuaauuuuuuguauuuuuaacagagaagggguuucaccuugucagccaggauggucucgaucuccugaccucgugauccgucugccuuggccucccaaagugcugcgcgccgccugcaacaucauugugaauuaucccuucuuaucuuuaguaaugcuuuuaaagucuacuuuaucugauauuagcauagcuaaauaagcuuucuuugguguuugcaugguauuauccuccuuucuguuuucuuguguuagagauaacgauauuaugaguaggauguagauuuuuuuuuuuuuuuuuaacucagucuagcaaucaaagugcugggauuacaggugugagccacugugcccggccaauaauuaauuuguuuuuuauuauuccuuuuuuuucuuucuaguugggaaaucuuacauauuuacuauucuuuuagugguuacuguauagauuauaauauacaucccaaucaaaggaccauaaaauacuucauuucuguuccuucccucaaugaccuuuucguuguuguuguaauguauuuuaagucucuauauguuuccacaagugguuguuauuacugucuuuuuuuugaagucaguguucauuagaucauccacauaguuacuuaccauuucugaugcuuucuguuccuccuuucauuuaugaccuucuagcuuagaucacuuuuuuuuucaccuccuaaagaacauuccuuaguauuuccuuuagcacugcuuugcuggugagacauaccuucaguauuuuuguuuuguuuuggucugggucugaaaaugccuuuauuucaccaucauucuuuuuuuuuuccucuggagacaguguuucacuccgucacccaggccagagcauaggggcaugaucauagcucacugcagcuucgaacuuuugggcucaagaaaucuuccugccauagccuccugagaagcuaggaccacaggcauacaccaucaugccuggcugauuuuuguauuuuuuggagaaauggggucuuauaucgcccgggcuagucuuaaacuccuggccucgagugauucuccugccuuggccucccaaaguucugggauuguaggcaugagccaccacaccuggcucaccaugauucuuagaagauauuuuccaaggacagauacuagguuaguuguuguuuacuuagcacauuacauuuauccuugcguuguuuucugucuuguaucuauugaaaauucagauaucaauguaauuguugauauuuugaacauaaucugcuuauuugacugcauuuaagaguuuugcuuugucuaggauuuuuagugguuuuaguauguuuagguguggauuucuguuuucuuaaauuuauuuuuucucacacuguaguuagauauuggaagauuucuuucuaauuaucuugcuuggugccuguugggauuucugacaucuguagguucaugucuuucaucaguuuugggaguuuucagucauuaucucuucaagcaaauaauucuuccauaagacuccaguuaaacuuagacuagaccuuguaacuguaucuuuauguuucuuaaucccuucagacuuuuccaaccauuuaucauucuaaguauauuuuuuucugaccaguuuuccaguucauuuuucacugggccuaaucuguuauaccuaucccuugaguuccuaauauauauuuuucuauuucuagaauuucuauaaguucuuuuuuagaucugcucuggcauuuuaaaaauauuuucugcucuuugcugagaggauguuacuaacuauaguuugagauacuugagucugaaaaaacuauuauguuuuaggaugauuuuacuuaaguuuucuagaaugggguuuuucacuucauuucaguugaauggggugggaauuagaaauguguucauaauuauauauaaguuuaacuuucaguuuuuucccaugucaucucaagagaagaauuauuuauuuauaguucuauuucguguguuuggaacuggccaagaucgagcacuagcuagaaucuaaaagucaagaaucuaaacacugagaauaaaaggagaaaaauaacuucuaaugccagugcacuaacacuuaggcauuuuacuucuuaguuucagccuugugucuuuuuucuuaaugccaaagcauuauaacuuuauaagggaacuacucuucaccuuacacauauuuuaacagacuuguuuucuuaauuuuaagccaggagacagcaaauagcaaaaaugggagaaguuguucuauaagcagacauauauacaugcaguguuaccugacagccaagauggcauagaaauagacauaaaauuuauaaaaagcugacaauucaaaaugugcacuacucuggcuccauuuaguguagauagauagggcccuaucuugguaaaccuugcaggcaucauuuaaauguugguucucaguugguguuuacuuucugaaacaacaaacuauugacauacuuauuuucauaauuaggaaccauuuuuaauuuauuuuuauagguuuguggguacaagugcaguuuuguuacguggauuucuugugugguggugaaggcugagcuuuuaguguacccauuacccccaguaaggaacacuguacccaauaggucauuuuucaauccucauccccuccccgcaccuaggaacaauuuuaccaguagaaagugugacuauuuuuuuguguaugcagauuuuuccuucucaaacauacuuugaagaaauggcauuucuauguuuuaauuucauauuaguuacuguuaauuuauuuuuuaucaucugcuaguauuagcauauacaaagugguaggcaccauuuguuuagaaaagaauuaugagagaacaauuucauucaagaaaaguuuuuauucauuaauguuucuuugagaaaaacuuggggagaaaauaguucuuucuauugugguaguucauuuuaaggcucacagucugaaaauauuucuguauaaucaaacauuuuuaagcuagaaagaaccuagauaaucauauagucuaguguuucuuagccuuggcuacacauuagaauuauguggaaaacuuuaaaaaacuuccaguaacuuaaaucgaucugggcugagggcccugucacaguauuucuuucuuuuucuuuuuuuuuuuuuuuuuuuacuuugguaggucuuuguggcagaccugucacaguauuucaaaagcuucuuagguaauucuaauguacaguuaaguauaaagaaccuuaaauuuaucugccuuucaaauggauuauccaaugacauuuugagaauuucagaaaaauauucugaaaaaaauuccuguuccuguggugucagcuucauuugauacuguuuaacaugaaugauuuuuauaauaugagaaagauaauacuuauuauauauuuuauuagaaugcuguaaaacaguucaugguguccaacauguaaagguacucagugaauauuggcgaugaugacgauaauaaagauauagguacacauuggaggauaucaauggaaaggggcauuagauucuggaguauuugaaguagaacuaacaggauucaguuacugaguagauauaaaguguagaagagaguguuuggagacucaacugauggugaugccauccacuaaguugaguacauaaaagcaugucuucauuuuaaaaggcugaaagcugauuggaauuccuuaucuuguuuuuacuuaauucauugugaguacugcguuugaaauauccccaguuuagccaaauauacuucgugaauuuuaaauuuauuuaaauauauacuuaaaauuuuuguaaguaucuuuacaaagauaucuguacaaaaaauaaaagucugaccuguuaaauaaaaauugauugaggcuauguagucuuacauuuuauauauuguuugaaauuaaguugcauuuuuuuugguaacaucauauuugacauucugagcagagcccuuggguagcaugugauuagcuguuucuuccacacgcuuuaguaaagaugauaauauuagucuucagguucagcaacuguccuggcaaagcaucuguuaagguacuucucugacuaacauuuggucuuacagaguuuccuuuuuacaggugugauucaaguaaggugaaggaacacaugcuuagagcuguggaacauuuugaagauuagcagguuguauuacauuuguaacauuuacuaaauuuuuagcauagguaacuuuguuaugguuagaacaccaaggacuacaaaaagccauacaaaaaccuacugucacuucugucuucuaccugcuuuuuaugcaauaaaagccaauauaaauauauaccuugcuguuuucuacacaaguagaacuugccguguacccuguucuguaccuuguuuuuuaauuacaguaaaaaaaagaaagcaucuauauucucauuuaaaguuauagaaauaacuuuucuuaaaauuucguauuuuaauaauguuuucaguguuugauaaacaggauaauguugucuuauuucagggguccccaaacccuaggccauggacugauacgggucuguggccuguuaggaaccgggcugcaaagcaggagguuagcagcaggugagagagcauuaccgccugagcucugccuucuuucagaucaguggcagcauuagauucucaggaaggugaacccuauugugaacugugcaugcaagggaucuaaguugcaugcuccuuaugauaaucuaaugccugaugaucugagguggaacaguuuuaucccgaaaucaucccucgccugccccucccaccauccggccaccaucaguggaaaaauugccuucuacaaaaucagucccuggugccaaaaagguuggggaccacuggucuuuuugguaagcaugauaauacuauuuucuccuuugaaacuuauucuuuagcuuccaugauaguuaucuuuuucucucucuggcugcgcagcucgucgucuuuaccacgcccauuaaaugcugcuacuccauucuugaacauuuucucguuauaugcacucuuccugggagauuuuauccauacucauggauuccuauauucuugacuucagguguuccaucuaaacauugaugguugccaaauacagaucuuuuuuaugaguaugagccaugaauccagcuuccaauagacauacccauuuggacauuccacaggccucucaaaacaauauggacaaaacucauuucuccucaguucccccucuguuguucccugcuguaaaaagggggaaaaaguucacagccaguauuuucauauuuucugucucaagcaaguaguauuaaaaacacuuaguucucuuagucagaagcuugguggucaucucagaguucuucccuuucuuucaccugccauagcuugguguccaaguguuuuucuuucacugguaccuagcauggugcugcacaauuaaaggugucuaguuaaaacauuuugauauuuaaaaacaggaagcaagacugugggugaaaugucucugaaguguuuauuuuugugaguuuuaguacaaauuaagacaucaguaucuuucugauauugaggugaggaaggcuguguugagaauaaaaagcaaaagagaaaacuauaaagaaaaauaauugauuccuuuaagaauguauaacaaaacuuuuuauauaccaaaaaauucuauaauugaaagacaacucaauaguuauuuuacaguauaaccugcuguuuuagaaauacuuuguauucagaguacauuugaaacagcagaagaugugauuacuucugccguuaaggauuauggaaaguuccacaaaggcaguauuccuguauuucauagauaauuugucuaugggggcacauuuuucugaauugauacuauacggagcauuuuaccaacaucauugccuaccuucuuuuucaaauaucuuaggaaaaaaaaucauguuuacuguuugcuggacaguauauauaaaauucagaagacuaauugaguccagauagguaaagagauuggauauaucuuacugugaagaacagaaaugugugugugugugugugugugugugugugcacaaauuuccagaacuauauuaaaaucagcgaaaguaacuugcaaaaaugcuagggaacugaaagacugucccuuugacauuagggaugacuccaugguuuucagaagggcaacuggaaagauggaauuaccgucacugaaacuacggauaaggcggcuugagggugaagggaaauaucagagauuucaugucugauagacuucaaauggagaugugaagguggaguaggcaauuuugauaauuaaaaaacaugaaaguuggcagaaugauacugccuccugauuuaauucucaaaguguucauacugcacaaucauuuuucauucaacaaauauuuaucgaguaccucuauuugcuacuagaugauugggggcuccaguaauaagcaaauauaaucaugggcgcaguccuuaaagaacuuaaaccuguaauggggaagacauaccuuaaaucauuacacaaacacauuugaaauuacagccguaguaaguguuaugaaggaagaauaucugaaaauguuggagcagacaguggggaccuuauaauucuggugcucagggaaaaagugacaugagguguaauucacaugcaauagaauucauucauuuuaaguauauagauagauuaguuuugacaaauccacguaaucaccacuauaaucaagauaacaauguuuauccccaagagguuuuccaaauaucccuuuucugcccauuuuuaaauuaaguucuguguauguagacugaaaaaaagggcuuaaaauuuuaaaaugaucauauauauauauauauauauauauggauuuguaggcauucuuuauauauucuggaacaagucuuuuguuggcuauauauauugcagauaucuucucccaguuugaaaauugucuuuuuauucucuguggugucugaugaacaguuucuaauuuaaaugaaguccaacuugccaauauuuugaagggauaauucuguauccuguuaaagaaauauuuuccugugucauagucaugauaauaugaagauacauguauauuuucuuguauaaguuaguuuauucaugauccauugcaaauuaaauuuguauauaaucugagauaggacucaaguuucuucuuuucgccaugugauaguuaguugauccagcaccauuuauuggaaagaucauucuuuaacgauuagauguaaguuguuucguugugacaguauauguggguuguuucuuaauucucuguucuguuggucuguuugucugucguuguauuaauuaugucuuauuuauuguagcuugugauaaaucuuuguauauucuaguguucuuccccaagauuuuccuggccauucuggguccuuugcauuuucaugcaaaguuuagaauuggcuugugagucugcaaaaagucuguggaauuuuuauugggauugcauggaaucuugaggucaacaucagggaauuugauuauccucuacaauauuauuaauaaaucuuccagucaacaaagauggcauauccuuccauuuugugaacucuuucucucaacaguauuucaguguagagguauugcacauuuguuagauuuauuccuaguguuuugaguuuuuuuggaugcuauuaugccaucaguuuuuaaauuucacuuucuaauuguuuuuuggaaauauauagaaauauaguugaucuuuauauauugaccuuaguuauuauauucacuuauucuaaugguuuauuauagguucucuuggguuuucuaugcacuuaauuaugucaucagcaaauaaugacaauuguaagucuucuuuuuaaaucauuauuucuuuuuacuuuguuuucuauuuucuuuuagucuuuauaccauugauuuguguugguuuauuuauuuuguugaauagaaauggugauguauauucuugucuuauuccugaauucaaggggaaagaauccaguauuucauuaguaagaugacauuggcuguaaaauuuuuguuuuaagagugcuccuuuuauucuuaguuucugaaagauuuuauugugaguagguauugaauuucauuaaauucuuuucuuuaucuguugagaugauuauauggauuuuacuuugaugauuuggugaauuacacugauuaauuuucaaaaguuaaaucaacuuacauuccuguaauaaauuucauugguuauaauguauuaucuuuuuaauaagucuggauuugauuugcuaaaauuuuguuuaacauuuuugugucuguguucaugagagauguuuugaccugucauuuuccuuauguccuugucagguuuugguaguuucauaaagaauugggaacugaugcccuucuuuuuguuuucuggaacaaaaaauuggugugagguauuauuuauucuuaaugguuuagaagaauucucuauugaagguaucugagucaggagauuacuucagggaaaauuuuaaaugauggauucaguuucucuaauaaauagaggauuguuucaguuuucuauuuccugugucaguuucuauaagcuauguuuuucaaagaaguuguccauuuuaccuaaauuauuaaauacauuaucauaaaguuguucuuaauaucucauuuuccuuuuacugcccauauuaauauccccuuauuuuccuuuuacuguccauagcauauguacugaugcccccccuuuuaauuuuucuaaaauuggaauuucugucuuuucuugauuauuucugcuaaggguuauuaauuauuaauauucucaaacagccagcuuuuggcuuaauuuucucuuaaugcuuuuuauuucauugaguuuuguucuuguuuacauuauuuccuccuuuguacuacuuuggguuugauuugccaucuuuagcuacugaaaauaaaggaugauaguguuauuuuucaacuuuccuucuuguaaauaugcauuuuaaagcuauaaaugguccuguaagcauagcuuaaacugcaucucacaaauuuugauauuacauuuucauuaccaauuaaaaauauuuuaaaauuuccauugugauuucuucuuuuaugaauaauuuuguuacugauuucuuauuauuauuauuuuuuucuuuuuggagauggagucucgcucugucgcccaggcugaagugcaguggcauggucggcucacugccagcuccaccucccggguucacaccauuguccugccucagccuccugaguagcugggacuacaggcgcccgccaccacgccuggcuaauuuuuuguauuuuuaguagaggcaggguuucaccuuguuagccaggauggucucgaucuccugaccucgugauccacccgccuuggccucccaaagugcugggauuacaggcaugaaccaccgcacccggccuacugauuucuaauuuaauuccacugugcccggccuacugauuucuaauuuaauuccacugugcucagaaaauauauuuuauaugauuucaaucuuuugauauuuauugacuugcuuuauggcccaguaugugauucaguucagucaacauuccuugaguacuugagaacaauguguauugaacaguuauuggauucuguaaauacaaauuaggucaaacaaauugguuacuaguaaugucaaaauuuuuuuauauucauaggguuuuuuuucuucuauacauuacugagagaaguaucuuaaaaucuccaacuguuauuuuggauuauucuguuuuuccuuuuaguucugucaacuuuuacuuuauaaauuuuugaagcaguguugugagauguauacacauuuaugauuguuaaacauuccuguugaacuuuuaucguaauaaagcaucucuguuuaucccuaauaauuuaagccagcuauucaguauuaacguagcaacaucaucauacuuuuaauuaguauuugcaugauaucuuuuuccauuuuuuucuuuuaauauaucuguucccuugacuuuaaaguaguuguguuguacacagaauauaguuguguguuuugaaauccaaucuaauguauuuguuauuuaauuggaaugauggguccauuuacauuuaauguagaacaugauauaguaggauuugugucuuacaaggcagguauuuuuuuucuauuuguuccuuucuuuaaucaagcauaauuuuuucuauuugauuuuacauauaauuuuacaguguacaucuuuaauaugugugcauguauuuuuaaguaguugcccuagagauuaaaauauucuucauuaaaauauuaaaauauuaguuuaucagguugucuaaauuuauacuuuuaacacuuguugaaaaauacaagaaccuuauaacgguuuaauuucauuuaucucgcugucuuuuucuuuuuuuagacagucuugcucuguugcccaggguggaguguaguggugugaucuuagcucacugcaaccuccguuuccugugcucaagcaacucuccugucucagccucucgaguuagcugggauuacaggugcccgccaccaugccugcuaauuuuuguauuuuuaguacagauuggguuucaucauguuggccaggcuagccucgaucuccuggccucaagggauucccccaccucggccuuccaaagugcuaggauuacaggcaugacccaccucacccggccuaaccuagucuuuugugugucuuguccuauacuuucuuuuucuacauuuguuuaaaccaguagagucauuauuacuguuauuuuaaauguuaauauguauuuauccacauauacuuuuccauuccucuuaacuaacuccucuaguucuaugcuuccauguggggccauuuucuuuuagcuugauauauuuuguucucuuauaacaaguguuuucuuaacuuuuguucaucuaaacuuauuuuuauuucaucuucauguuagaagguauuuuuuucuuaguguggaauucugggcugguugguugauuuucuuuuuuuuuugucuuagcacuuuacagaugucauuuugucaucuucauuuucuauuauuucugaugaaaaauuaguuguuaguuuuauugcuguucccuuccaggugauaugucuuauuuucacugacugcuuuuaagauuuuuucugacuuuaguuuuuaauacuuugauauaucuggguucaauucauuacuucauuaaaucucuguuuugcuguuucuaaacuaaugauuucuuaauuucagugauuauauuuuccuuuucuggaauugucauuugacuuucuuacagaauuacagggcuuugcugaaauucuccgucuguccuguguuuguuuauuuauuuauuuauuuuuugagacggagucucgcucuguggcccaggcuggagugcaguggcacgaucucggcucacugcagccuucgccuccugaguucuagcaauucuccugucucagccucucuaauagcugggccuacaggugcacgccaccaugucuggcuaauuuuuuguauuuuuaguagagacaggguuucaccguguuagccaggauggucucgaucuccugaccucgugauccaccugccucagccucccaaagugcugggauuacaggcgugggccaccguguccagccuuauuuauuucuugaacauaccaaucacaguuauuuuaagucuuuaguaacuccauaaucuguuuuuuuuuuuuuugagacaaaguuuugcucugucucccaggcuggagugcagugaugcgaucucagcucacugcagccuccaccucccaggugcaagcgauucucguuucucagccucccaaguaucagggacuacaggcacgugccacugcgccuggcugauuuuuuuuuuuuuuuuuuuuuuuuuuuuuuuuuuugguauuuuuaguagagacagaguuucaccauguuggccaggcaggucuugagcuucuggcuucgagugaucugccugccuuggccucccaaagugcuaggauuacaggcaugagccaccacaucuggccuggaacuccaaaaucugaaugacuuaggugucuuuuuaaauuuucuguuauuucucuugguuguccauucuuuuuuuaauugagauacaguuuauauaagauuuaccauuuuaaccauuuuaaaguacagaauucagugguuuuuaguauauucacaauuauguaagcaucauaacuaucuaauuucagaauguuuucacuacccuaauaaagugaaaacuguuggcagucaaucucaauucucccccucuccccauccccuggcaacagcaaaucuacuuucugucucucugaauuugccuagucuggacauuucuuaugaauagaaucauacaauuuauguggccuuuuguguccaucuucuuucacuuggcauaauguuuucaagguucauccauguuguagcauguauaaguauuucuucuuuguggcugaauaauauuccguuguauucauaugccacguuuuguuuauccauucaucaguagguggacauuugaguuuuuuccaguuuuuaacuauuaugaauaaugccacugugaacauuuguguagaaauuuugcgugaauguguguuuucaauucuuuuuaguauguaccaggaauggaguugcuagaucauaugguaacuguuuaaguucuugaggaacugucaaacuguuuuccacaguggcuguacccuuuuacauuuccaccagcauauaugagaguugcaauuucuauacauuguucacaacacuuguuauuuuucuggacuuuuaauuuuuauguuauugcagcuaucaaaguggguguuggucauuuauuuuuguuuuuuagaaagccuugcaauuuuuaagaguguuagaccuugugguugaacaauuauagaagcucuaguuuguguuacuuugcuccaaagagaauuaaguuuuccuuugguaugugaaguacuaggagguuaccuugaaucuauuaaagguugguuauaagacuuuuuagggcugaucuauuucaauuucgaccuuacucuuaaggaguagcuggcccuucuguagucucaacagagaguuggaguuauuuaugaaggcuccucuaacuugguggggccuacacuccagucuuugucuccauaucagugagcagcagcuggaaucucugcugagcucuuuagccuccuaccugcuauuucgacuaguuuucuugaauguuuccccucuugugguccuuucucucuggaaauuuauucuuuaguuuccagcucuuugauagucaaaaauucugacucuuuuuuuuccuuaguccaauuggacugcacuuucuacuugagcuguauuucccuguuacucagcaaacucaaggaaaaagccaagauaauuguggagcuggucuuauaugcuuccguucuuucaggaguuguagccccuucuguuccucuuuguguaagucacucuuuaguggcuucaaacaguuuuuacuuuuugucuagauuuuaugaguuuuauuuagcugaggguuaguuugauacaaguuauucuagcauggugguaacaguaaugauguuuuauuaguugaauuacaagaaaaugaccucacuauuaagagugagaacaugaauuuuuaacagaaaauuuggacaagaauagaggaaggaggauuucuguuuucagacagaagaggguuaagguagccagguuugaaggaugauaaauaaggaugauuaaaaguuagauaauaugacucaaauuaguguuuuuuguuuguuuuuuuguuuguuuuggugaaaacugaacaagguuuuuaaguguuuaaagaauacaaguuggagaaauaauaugagaauuuaagagaaaauaagagcauucaucuggauuuaguugugaagaaauuaaaauucugauuuuaaaaugugugcuauuagaguagacuuguuuauuucuguaaauguuagugauuauuaacuguuuggagguuugaguauuuaaaugugauggccaaauaacaauguguaucuauuaagugugccaaagagaauuguguucacaaaauggaaaggcauacaguaacuggccauuuuuaaauguaggaggaagagaacaacugauaauacaggaauggacauuacauuuagaacaucgaaguaaagaauaaugccucccucuccuccuacaagauuaaaaaugggggauuggagcgaaacuaaccguuugcuuucuccaccaaaauaucccuaagaagggacccagguguggcagaccaccucauaucuguuuuuccuuuugcccuuuugugaacucugaagguuagucagugguuuucuucaaaauugcauuaggaaauuugccaagggcauccuuuugaggcagcugucucuguacccuuggaggccaucaguaauguuuccaaucuauagcaguagucggcacaaaaauguugaacuguugucuucauguuuuaaaacauuccucugcugccacuauccuccaccccgaaauaguguaaaauauggcacauuuugggacuuagaguccuuucaucauuuuuuguuacuguacauuuuuagguaaaauccaucauuaauaaguguauccaauacaucaauaaugaaaggacauuuaauuuuuuucacauaauuuagauaauaauagacacauuagaaaugcuuaauauauaaauaaaugagaauuuuuuguauagaauguuaacauuuuaauuuucacuacugagauuuuauaaaguaaauaugcuuuaaaguuuuggggguuauuaacuauguucaugaugaaaaugcauuagaagaauucgaaaugcauuuguguuuuuguucuuacugcaauuuaguaacauaagcaacucuuuuacccuaugcaucuuucguauauuagucuguuucucuuguuuuacuaaacugucuucuuucagccacccacacagaauaugccuauggguccuggagggaugaaucagagcggcccucccccaccuccacgcucucacaacaugccuucagauggaaugguagguggggguccuccugcaccgcacaugcagaaccagaugaacggccagaugccugguaaguuuuucuccucuaagacauuaacaccagaguugcuuagcaacugaaacgacaugggggcucaagggauacuagauuguugaugacaaaacugcuuugaaugcccccgaguacaagcucucuuagaguuuguuagcuacagagcuacgugaccuguauucaguguuuaucaggcugcccuugggcuuugauguagcugacacacaccauuccucugaugaacagaacuggcuaaauuuagucugucugaaacugcaauacaguuggcuuuagaagcuuuuuggaaaaaaaggcguugcaccauggcuuaagaauuaaagucuguuuaaaaaagauauuauaacauuucccugaguuuuuauuuacuuaaauauugauugaucucagaaacaguaucacugggaaaaacacauggggaaagaaaacagucucugaagugcugguguauuuaguauuuccuuauugauauugaagcugaaucuaaauuuuuuuaauacauagguuuauagcauaacauaaauauuggaauugauuuuaaagcaaaaauuaaaggcugaaaaauaauguaaacuuccuuacauuauuuauacacugagccauucucuuuucuauuugucaauuuuaaguguagggucacuagguugauauguuuuaagacauuggaugcugauuuaguuaccuuuggcugguuugaaauuuuaaucauacaaguaucuuuacacuauuuuguuuuuguaacaguagcaucaacccauggccguaauuuuugguagaauauuaucuacauuagguaucagaauauuuuuaccuucuaagacaaaaguuauuuucauugauaaagaagacauuauacaacuagcaguaauggaaauaaaauaacagaacaauuauuaaaauuaguaauuggcaucuuuaggauacuguuuucuguagccgauuguguugauugauagcauugguguccaaggaugaugggugcaguaaggaaacaagagagcacagagcaaaagagguaagguagccuggcuuauagaagauugaggugugacugaucauauaggagggcagugguguuucaguggcugucuccuauuuccugcuaaggcuugcaacauauauggcacacauccaguauggagguaggaauaaagacaucacugcuuuucaguuuguagucauauuguagucaagagaaagcuucuugccaaguccacauuuaguucaccaggacacacuguuuuuagaacuggaaagguagugauagugcagguuagcuaguuaggaguuuugugacuuuuuaugaugguacuuugaauuaggauuuugacuuaaauucucuguguaacauugaagccuaaggccaaagaagcauuugagcagcaguacaguuaugguuaacaugacauuuugguuuuguguaaggccuucugaaguauauucuuuuauaagcuaguuauuaucaaccacuuaugaccuggguuguucagaauacuauagagcuuccgaaacaauaguuaagaauuucuccaggccaggcgcgguggcucacgccuguaaucccagcacuuugggaggccaaggcggguggaucacgaggucaagagauugagaccauccuggccaacaugaugaaaucccgucucuacuaaaaauacaaaaaauuagcuggacgugguauugcacgucuguaaucccagcuacucaggaggcugaggcaggagaaucacuugaacccaggaggcggagguugcagugagccgaaaucacgccacugcaccccagccuggcgacagagugagacuccaucaaaaaaaaaaaacaaaaaaaaaaaaaacagaaagaauuucuccuaacaauaguuacggaguuacaguuaaguguaggagaaauuggaaggccaguaacuuauauuuucuuuauuuguuccuuauagcauuuagccaaccuguuuaugcacacaaauuugcaucuuggcuguuuccuauuucaguuugguuuuuaauguauauuucauuauguagacucaguuuuagagcuacuuauguucucauugaucugggucaaaucacuacucagucucagguucccuuuuuuaaaaauuacuauuuuuuucuuuuugagacagaguuuugcucuugucgccuagguuggggugcaguggcacaaucucggcucacugcaaccucugccucccggguucaagcgauucuccugccucauccucccgaguagcugggauuacaggcgcacaccaccacaccuggcuaauuuucguauuuuuaauagagaugggguuucaccauguuggccaggcuggucucaaauuccugacaucaggugauccacccgcuucagccucccaaagugcugggauugcaggcaugagccaccgaguccagccuaaaaaauuaauugauuuuuuaaaagcuagguaauacaugccuaugggaccaaaaucaaaggauaccaaaggaugccuagccgccaccucuccagacaguucuagagaggcauugguuucuaguuguccuucaagagauauucucucgcugggcaugguggcucaagccuguaaucccagcacuuugggaggcugagguggguggaucaguugaggucaggaguucaagaccagccugaccagugagguuaaaccucaucucuacuaaaaauacaaaauuagcuggcgugguggcacacacuuguaaucccagcuacuugggaagcugagacaggagaaucgcuugaacccgggaaguggagguugcaguaaaccaagauugcaccauugcacucuagccugggcaacaagaaugagacuccgucucaaaaaaaaaaaaaagagagagagauuuucucuauauaaaauaaugcauguguauuuccuuuauuuuuacucuuuuuuuuuaaaguacaaaugauagcacucauuaaauacuauuauguaucuuuucuuucucaaagauauaucuuggagaccauuauuuuauuccauauguaaauagaugccuuauucuuuuuggucucuaucauguucuuuuuuacaaguuuaauuuauucgaacauuuaggauggaaacauaggcuucuagucuuuuguuauuaugaauuauacugucaugaauuugcuguaaaaauauauauacacauauauauguguucugugugucaauacgcaugcacacaaaaauuuguauaucucuagcauaaauuccuggaacugaaauugcuggguuaaagguauauauauuuuaaaauuugacaguuagugccaaauugcuuuguguaaaaauaguaauauccaucaguucugcauuuaugaauuucacauccauggauuuaaccaacaguggauugaaaauacuuggaaaaacaaauugugacuguauugaacauguacauacuuuuuuuuucuugucauuauucccuaaacaacacaguauagugacuauguacauagcauuuacauuguguuaggcaguacauguaauguagagaugauuuaaaguauaugagaggauguacauagguuauguggaaauacugugucauuuuaugucagggacaugagcauuuacggauuuugaaaucugugggugguucuggaaccaaucucccacagauacugagggacaacuacuuuauuugaauuguuguuugucaucacaaauuuccucaagcuugaucccacccuugauuccacaagcuugauuccccaugaaauauaaguaagauuucuguuccuucaacaauggaugaaagugcuucuuucuucacaauauaguuagaucgaacuuuugauuuuugagaaucugagaggugaaaguucggucucauaguuuuaauuugccuuccuauuuuaagugaagcaaucaaucuuuuaauguugaugaaccuuuuuguaguuuuugugugaacuagucauucccucauuauguccuuugcccauucuuuuacuggugguggucuuuuacuuacuucauauguuaaguaauuaauuuggucugggucugcgaucuaucuuauaaauaauauuuucuuauuuaccuuuuuauuauuuaauuuugaguuuuuuaugucgugcaaauuuuuaaauuuuguauagucuaauuuaucaauguuuuauggcucaggguuuucuggcauacuuaagaagguccuuccauuauuauuuuuaaaauucuccuuuuugaaauucuuuuaugguuucuucuuuuuaaauguuuaaguuuucuauucaucuagaauuaguuaguggaacaaaugagauagugauccaacuuguuuuuuccagauggcuccccaguugucacaauaccauuuacugaauuaguuuucuauugcucacuaauacuuaauauuacugugauuauuuacucagcuauguauuugggucuacuuuuagacucuguucuguucaaucgaucuguuagucuauucauuuauguucauaguuaauuacuccaaccuuaugauauguuuugcucuuuuaugaagaagcuaguccuuccuucuuuuucagagugcuccugacuucaaaagcaucaauuucuuaauccaaaaaugggaauaacuacuucacaguauuugcugucuuuuccuauaaaccauuuacuuugcuaucgauuaauuauuguuugguauuacuauaauaaugcaaaaaaaaaauuauuuccagguacuuuuguauggaccaucuguuuaacuuucauauuuugcuucugaucauuuuucuucaaagggccuaaccauaugccuaugcagggaccuggacccaaucaacucaauaugacaaacaguuccaugaauaugccuucaaguagccauggauccaugggagguuacaaccauucugugccaucaucacagagcaugccaguacagaaucagaugacaaugagucagggacaaccaaugggaaacuauggucccagaccaaauaugaguaugcagccaaaccaagguaacuaagcuuuauguccuucuugacuagagugcucuauuagccuuugaaaaguaaaaugauuguugucagguucuuagcugguucauaaaaauaaaaguuuaaagugagugacagucaugcccauaaaaaggagauguugaguuugaagcuaguuuaaaucucuuugcucaauguagcuuuuuaagcuuauuuauuuuuaugucuuuuggacaguuuguuugagguucuguauuguugagaauuguuuuuuaaagccagucaaugaagaaccaaacauuugguuuagcuagaaaguugagaaaauaaacaccugcuccuucauuuuacuuauuaaggauguauuaauuuauaugaauuccccuugauuuauauggauguuuucugaugcuguguuucagcauuaaaagguaauucuaaaauaauuugccauuagaauguucaguggaggugcugcuguacuugucuuagagugguguaaguccauuaaaguuuauuaccaaucucagaaugaaauuguaccauguuucucuuuuaaguauucugugaauaauaacuaaaagccaguaaguggcgcucuguucugcuaauugacuguuaaaacauuuggcuuauuuccagguuaaugcuauuucaguuacaaaauguaaugaaguuaagacuguaagauagaauuaaauguauuuggaauaaaauuuucuagauuuugauuuauaaaauaaacagagcacuaaaauguacccagauaaaagaaguuaguguuaaucuguugauaauuccuuaugaugaaauaauauaauuuuaaaauaauacagauuuuuaauaauuuucaugagauauacugaaagcaaaaggagauaauagaaaaaauugccaaucauuguagcuucacaaaacuggcacuugcuacauuuuuuucccccaaaguuacuuaaugcuuaugguagaauuauuuuuuuguuuuuauuaggucaauuaaaaguccaaacaacagcaagauccagucagugcuagaucagaagggaguucauguguuucucuauacaguuugguuaccaggagagagaacaggaaaauugaugauucugacagcaacuccauuaaugauggcacacuucuuaacuucuuagaaaccuauaguuaagaaaagguauggugugcacaaaaaauggauguugcugcagcaugguuugauaugacauaauaagauucgaagaaaaaaauaaugcauauagcaaugugcauauugacuuuuuggagaaaaguauugagguguuuuuagaaauuuuuuguucuuagggaccaacuuuuauuuuuaaaaaugucguauuuuguaaguauguguaggucuuccuuuuacuauaguacaguaguuauaucacuuuuugccuuguucucauaguuauaaauuucuucuuuuuuauuuuuauuuuuuguauuuuguuaaaagaauagaaacaaugucuugguauguugcccaggcuggucuugaacaccugggcuuaagugaucaccugccuuggccucccaaaguccugggauuacaggcaugagccacugcaccuggucaguuuaugaacuucuuaauagaaaauaggcuguacagaaaugaccagguagagaucugaagagauuaaagacaauuuucaaaaagaaaauaugguuaaaaucauugaggaaauuuuuauuuguuuauuuauuuauuuauuuauuuugagacggcgucuggcucuguugcccaggcuggagugcaguggcacaaucucugcucucugcaagcuccgccucccggguucacaccauucuccugccucagccucccaaguagcugggaguacaggcacccaccacuacgcccggcuaauuuuuuuuuuguauuuuuaguagagacaggguuucaccggaaaucuuuauuguuuuaaaaaucucuuuaggacaaauaaaaaacuucauuuaaauuuugauauuucagaaucaaaagaacacaaaauuacaguuaccaaaaaagaaaguuauacaguguucuggcagcaccuaguuuuuuaaucauaugaguuucuuauaaaagcauuuuaauuauauguuaccuuuuaauaaagaaguucauggugaguuuuauuaaugaauuuuuuuacuagaugcuagaggaugauugaagaguuuuauuaaugaaguuuuaauauucauuucauuauaaaacauuuucuuaguuuuuauaaaaauaagcugcauauuuuacauugaaaguuuuucuguuuauuauuauuuauuuuuauuuguuuuaauucagcaacuaagcuaguauugcaaaauguuuuucucuguguucucuuagagggucuauugcuuccaggugagcacuuuagcacaaauuuuuuuuuuuuuuugagguggagucucacuuuuugucgcccaggcuggagugcagaagugcagucucggcucacugcugcuuccgccuccuggguucaagcaauucuucugccucagccuuccuaggggcugggaugacaggugccugccaucacgcccagcuaauuuuuguauuuuaguagagacauguuggccagguuggucuugaacuccugaccucaagccauccauccaccucagccucccgaaguguugggauuacaggcgcaagccacugcgcugggcccaauuuuuauguuaauuuguuucuuaaacugcuggcaaaauguugcuuaaguauaauagucaauccaacauauauuuucccauguuauugucacuguuacccagauaaaguuuauuuuuuugucauuuugaaccuuaagagaaagaucuggcugggcguuggugcccuugcuuguaaccucaacacuuugggaggcugaaaugggaggaucacuugaccccaggaguugaagaccagccugggcaagauggcaagacuugcauuuuuuacaaaaagaaaugugaaaauuagcugggcgugguagcuugugccugcagucccagcuacuuggagguggaggcaggagguucacuugagcacaggacuucgaggcuguagugaguuugcuggugucacugcacuccagcuugggugacagagcaagaccgucucuaaaaaaacaaaaagaguaacuccaguuuucagaguaaaccaccaucuuccuacauaaacuuauuugcauauagagcauaaacuucacuagaauucaacaagcucuauaaaagcaggaaguguguucucugcuguaucccaggugccuagaaaaaugccugaggauggacacacaaaaucuuauuuauuucuuucauuucuucaguaaaaagcaaguguuauaugaucaccugucugaaaaauguuuauuuaaucaacaaguacauucaguguaugaaaaggcaaauuguguagaagggauuucugaagauguuauauuggacagauaccuguguauuuuucauuaucaggcauuaguaauuauagcuuuccacauuuaacagaauuuuacuaauuauauauucaaauauaaagaauuuuacaaauugcagugcuuguguuaaagaauauguuuuguaaguuccauguguguaauucuucagauuuggauaugucuuggcccccuguagcuuacuguaugugggaccuuugacuaaauuacuuaauuucucuaaguaagauuaagugaaaugaugcauguaaaaauccugacuugguaaucauuugcauaauuuuuauaaaaucaguuggcuaaucaucaagcuuuuuuaaaaaggugaacacaaaaacauuugagauugguuuaucagcuacugucuuauuuuagccacagcaucuaauuuauuucuggguguuuuaauaguauuaagaaaguguugauucacguggcuaaguugcaaaugacaauaucuucaaaacacugugcuuucugucaguguacucuuugguuagacugacccagaggcuugacaugaaaguagaaggagauuuuucuuucaguaccuaaacuguucacauucguuauauaaguaugaagggcaaagagcauguauugccacagcugagauuguuuucucuuauuauuaucuuauuaucucuuacuauuacacaauggauuauuaagagauagacgaaaaggaggugcuugagauaggccuagcauuuacuuuuacauauguauuuuuacaugguaguuuauuuccuuuaccuccgcuauucguauauauagaucuuucucauuuuuuaaauggcaacauucuuuguauggauguauuauaauacaacaaagccauuuucacuuuugauagaugugucuagucuuuuacaaauacuucuggaaaaaaugucuuuguagcuaugucuuugauuacuuguacaagauuuuuguaggauaaauucuagaaauagaauuauuaaaauauaugaauacuugaacuacuugagagacauugccaaauuguuuucaauaaagguugcaugaggccacauucacauuccuacagcauauaaaaugcuuacuuuacuacauacccagugacagucuuccuauuugcuaaauauauagcggaaaacuguaaacuuaauuucuucaauuauuagucagguugcauaacuuuguauguuuauuugcuguuugcauguuuucuaugaauugccuguucaugucauauauucugugguuugucuguuauugaaggaguuguuuauagguuaagucuguuugccuuaugugaauuucacauguaaaaacauuuuguuaguuuuaagagguaggaauuuaaccuuuauuuguuguuguuuuuugagacggagucucacucugucgccucacucugaggcuggagugcaguggcaugaucucgguucacugcaagcucugccuccuggguucaugccauucuccugccucagugucccagguagcugggacuacaggugcccgccaccaugcccggcuaauuuuuuuuguauuuuugguagagacgggguuucaccguguuagccaggauggucucaaucuccugaccuugugaucugcccgccuuggccucccaaagugcugggauuacagacaggcaugagccaccacgcccggcuggaauuuaacuuuuuaaaauaguuuguuuuagugauaggauucugaaaugguaauauucaugaaaaaaugugauuuuucccaauuauaucagaacuuugacccagcauuugcuaaguuaugguauuaauagauuuacuaauuacuaguaaaauacuuuggaagguucagcaugcuuauuagacuauuaaaaggccugagaagauuuuuauuaaagaaacugauuugauuucaguuaacaugaguauauuaccauggagcuuuucuucuucuucuuuuuuuuuuuuuuuuuuuuuuuggcauauuacuuuccaaagguaacagcuaauauucaguaaguaccuguuagugccaggcgcuaacagaaacaaaacuaucaaaauccuuugcaugucuucuuuaauucucacauccuugagguaguagguaagguacuauuacuaucauucugugcaugaggaaacagacauccuauggaaauacaggcaggccuugcuguaugcaauucugauauacaugaauaucaguuacugcaguuaagcuaaauaacaccuguucccccagcaccaccauuugaauuucaguuaccauagcacauuaagaguaauuguauaaaguaugaacucuuagcugcucuuucuucagucuacaaaucacuacauaaauaacagaugccugucaugauaagugauggauguuacuuuuagauuuugucagugauuggucacugugcaucugucaguucaugcacauacagcaaagcuuguuguuguguugcuuccuuggcucccagcaguaaaccuauaugagauuuuacaaaccuggauaauugaaagagggacuuggccaacauagauaaaagugcaacaaagaaaugaaaaaugauaaugcuagaaaugaaacccaaauucaguguaaauggaguacugaagaaauugcugacuguggaaaugcugacauugcugccauuucagagaaucuggauaugcacugcaggugcuuaaagaaggagaacucauugauacaaaugagagaaguaguugugaugaaaaggaugaaaaugucccagaggaagcaagacuggcaaaauauuucacauuaaagaaauucuuggaaauauuucacaacuuugaaaguguaaaggauaaaauguuggaugccaauccaaacuuagaaaggagugugacaauuugcuaagccguggaaaagagacuuacucuaaaucgucauauauaccauuaggagaagggaacuacuuuuuaaauuauucuugacaggauuuuuacaaagaagugaaacacuuuaauucucaguguuucuuuuuuuuuccuuuuuuuuucuacuucuuuuuuuuuuuuuuuuuuuugagacggagucuuccucugucacccaggcuggagugcaguggugcaaucuuggcucauugcaaccuccacuucccagguucaaguguuucgauucuccugccucagcuucccgaguagcugggauuacaggcacaugcuaccauguccagcacauuuuuauauuuuuaguagagaugggguuucacuauauuggccaggcuggucuugaacuccugaccucaagugauccacccaccuaggccucccaaaguacugggaguacauacaggcgugagccacugcaucuggccaauucucaauguuucuaauguuuaaaauuacagugaauuaaauauuuucucauuucccuauguauuuuuaacugacaguaauagaguuuucaguguuuugaccaaaauuuuaaaggccauggaauaauuaugauuuuuuucccuacugauuauuaagaucguuuugcaugauuucugcuugcauggucauugauauggucugauccuacuaugcaaagugaacacuauaagguuuuauagacacuuugggaaaugcuaguaaguuccuaacaauaugaauguuauaagguuaaaagcuacucauuuaucuuaaggauucagauacaaauaugucagaugauauguguuaugaagagaaauaugcaaaguaaaaggaaaaagaaaaauaagcauguaugccauuuuaggguggugagcagauaccuagaaaaagaauguggcacaggcagauggaacagcaaguaugcacuggagcauacuugguguguuugaaguauagcaaggagacccgucgaacuggagcggagugagugaaagugggaagucauaagaaauaagguccaagagauaguugaaggcuaggccuugaaagucuuucaguccauaaggauuuuagauuuuauucuguggaaggagauauacugcuggaaaguuuugagcacuggaauaacaugaucugaauauaugguuuucaaaaaaugccuuugggcagcuauauagaaaaugggcuguaauugggcaagggugaaauagggagaccuguuaagaggcucuuguuguauuuaagagaugaucguggcuuuaaauaguaugauagcuauggagguaaucagaaguagucaauugugggauauuuaccauguauuuugaagguagagcggauuugcugacugaucaaauguggaggacaaaugcaaaguuuguguuguccucuccuugaacagucacuauguguuguguuccucucacagaugugugauaauacacacaggguauauugcugaccaggggaguuucccuuagccuuaguguucagaguuuuuauugggacuguauuauguagauuugauuaaucgcuuguccaugugguugaucucagucuccaaucucgauccuuuaccccccugcuuggcccaaaacccccauccaggaugaaaggagcuacaggaaaucccaauuaaguaaauuuacuaaauuuuucugauuuuuuucugauuuuaguaaucaguaaauauuucugauuauuaaaauaacugauguuaaauuugaaaaaucuuggccaggugugguggcucaugcuuguaaucccagcacuuugggaugccgagguggguggaucaccugaggucaggaguuugagaccaaccuggccaacauaaugaaacccugucucuacuaaaaauacaaaaauuagccggacgugguggugugcaacugcagucucagcuucucggguggcugaggcaggagaaucgcuugaaccugggaggcggagguugcagucagccgagauuguaccaugcacuccagccugggugacagagcaagacuccgucucaaaaaaaaaaaaaaucuaaaaaaauaugaaaagcauacaacauaaaauaaaaaacacgucuuacuucacuauauuuuaaauuauuaggcaaauucacuuaaguauaguagccuauacuuagaauccuuuaagcaguacuacuuauaauuacauaauuuuaaaaaauauguguuuaauuauuuuucuuuagacucugaguucuaugaagugaagaacugugucuuauucuguucacugcuuuauccuauuuguugacugauuagcuagauagguauccucuugcuguaaguguccccugagggacaaaacugcccacaguugagaauaaccagcuugaagaaaugguuaguaugaauaacuguguguaaagauggucugugucacuaaagaaacaaaugacaauaacaaaauuguuauugauauuauuuuuaauaccuuuuaaaacuuuuaugagauuuuuucuaaaguucuaauguuaugaaagauuuuguaucuuuuaaugagcuguuguucucuuuacuugcuagaaucauguuuccauuuuuucauugguugcuggaaacucagcuaaauuugugcuuggcugcagugaccuuacugaacugggcuagucauccuacauuuucuuacuugcucuuguucuuuuauccuugauauuguaucuaaacaucuuauuaacuacuaaaaauucuugauguggacagguguauaauuuagguaaguaaagaauccuauucuuuuuaagcagcuauuuaagcagauaguaaguuagcuaauugaguuuuuuggaauacagggauucuugcaaauaaauuauuagaaauaacuccaaauaagagcuauaauuggguuagagauuaaaugguuaaggaacaaauaguaaaauguaagcaguaaaugaugaaauaugaaugugaaaauaggccugaggaggguauuaucuauggaguuucauggucuuaagauagguggggugaagaaauuucuuauauuuuaagguuuuuauauuacagugauagagauauauuauacagaacucuuuucaugggagauaguggcaugggaaaaguacaauuugaauuuggagaggaaguacacauagugauuaagagcacgggcuuuggaccauuuaguagcuaugcuacuuuagagccuuucguagcaguacagcuuuggguaagguccuugauguuugugagccuuaaaauguuguugucugugaagaagucgauaauaauacuacccguuucauagggcuuuggggaagagaaauaauacagguaaagcuauuagcuuagugccuggcuaauaauaaguguucauuaaauguuagcugucauuuuaaacaauauuauuuaaaauaauuuguagauuaaugauacaauuuuuauaaaauuuuaguguauugguuuguaucugaggaugugaaauacauguguauauguaugaauguucuauauauauagaauauuuguaaaauuacauuauucagaauugacagauuaaaacaauguuuuccuuauaguuaaguauuuaaaaauuauuuuuuucagucuaccuaauugugugucacuauagacagugacagugcucaucacaucucuauauuaccauggcuccuagccugggguguuguaccuaauaaguacucaauaaauuugauccuugacuuacucuucaaaagaaaauucuuuuuuuuuuuuuuugaccacugacuuaagauaaaauuaaguauuaaccaucucauuggagaaaagaaugccaauaauauaaaauaugguaauuugggagguuuuuacauguguuuaaaauaaaggauguuauuuucauagaauaucuauuagaauauaaaacucaaaaugggaagaaauaaugugcuaaugauaaguguuuguuauaugcccuugcaaaacacuugcaaaaauauauucuagguaauuaagacaucaguagggucuuugcauauguauuaucacgcuuuguagugcgucuuaacaucaaaauuguuuauguaaaagaugaagaauaaccuuaaagucuguaguaauguaugauaccauuguuugcagaaaaugguuguagaagaugcauuuuauaaugcuauuucacucugcaguacaaauuuuuagaacauauuuugggguaaccuuuugaguuugcuucucuuaguuucauuaguaucucaagagauaauauacauugccaguguagcauaauuucauuauccuaagaaggaaaauaauauacuuccuaaacaaucagaauugaagucauagucauaauuuuuuuuuucuuuaauggauaaggcuucgaggaaaauuaugaaauguauugugcuuuaguaguguuagcugacugcauucucucugugguuuaggcuugaucaugaaugauguugggauccucugagggagagaagugacaguaaaagaaggguaguaauugagcucuuugggauuggaacugcucacagucccaaaagauaaagcacaaguggcauggucuuuucuaucuagggcuuaagcuacaauuacuuugcuuuccuuuagagcaagguuuaguguuuuguuauguaucuuuuuggauuuuuuuuucuuuuggcuauugugguuuugcuuucuuuuuguuucuaauauuauagguuuuaguuauauaguuaccuucuguuaagacaagaggucuuuagacaguguuggagaagaaaaggcaaaaccuucauuuacugaaaaugaauuacauaaauguccgaucagguuaccuauuaaauuaugaauguuaguguuuaauaguuuaguauaugcaacauauauuugaaaauuauaacugcuauuaaacuaguguuuuggaacuuuuuuguugcaaauuauuugcuucggaacuacugaauuuguuucguguuuuguuuuguuuugguuuuugaggcagaguuucacacuugucgcccaggcuggggugcaguuacaugaucucagcuuacugcaaccucugccucccggguucaagugauucuccugccucagccuccccaauagcugggauuacaggugugcaccaccaugccuggcuaauuuuuguacauuuuaguagaguugggguuucaccauguuggccaggcuggucucgaacuccugaccucaggugauccacccaccuuagccucccaaagugcugggauuacaggugugagccaccacuccuggcuuacgaauuuguuauagcuuauguuuuaauagaggcaaugaaaaauagaacaaacaugugcuucaaaauaaaauuugagguuugucuuauucucaguuuuuaucuauuagcuguguaaucuugauuuuuagauuccuuggcuaaaaaaauugagaauuaggguccuuaccucugguaauuguuaggaguuuguaggaaaugacugugaaaccauguaacuggcaguguuguaggguaccuucaguauuaaguucucuucgccucuacucucacccagccaguuugucucuacuaagacuguauuuccuuguugaaagaaaggucccagaguuuuugagaggcuuacauucacauuuaugagaauaaaauugaaaaggaggaaaaaagaaacagaagcacggaaggcaaauaggagaaaaacaguuaucucugauaaaguacuccuucagauaaaacaguucuucugauuggaaaugugaagucuuucugcuuacaucauugcugcuguuguaagucaguaauauauuugaagaggugggcuuguuuuguuuuuaauuguuuguuaaguaauuuaauagugaacuuuuggcucauuugggcaguuucaucugugaaaccuuuccaggcugucuaguacuuugccuuuuguacuuaaauuuucuccaugucacucaagggggaggaggaguauguagcuauauaagcagcaaguugggaaaagacucauccauacuucugagacaguaauguuauaauggcaaaaugaugaguuccccauaccguaacuuggcccaguaaaccucucaggagcugcuuaacauuguuagauggcaaugugggacuuuauggccauuguuuauuguuuccugugauacauuuuuacuguugccagugugauacuauagcagugguaguuuggcuaccccaguauugcucacuuuggaaacucuguaguucagauuucuuagccuacagcuuguugcaugucucugccuguuuuuagaggugugagagucuuuauguaauguaugugucuuuuaacauauuaagcaguauagccauuugauuugaaggaggccuuuuuagguuauaaaucuuguaguugggaaagggaaagaagacuuuuuaagauuuuguccuaaauuaaagcuuaugaaauuauauucgguguuuguauaguuuuccugucuaccauuauauaaugagugaguauugaaaaagagaacaaaguaaaaaucuagagauuugguuucuuuuccuuaguuugaccacuguuuugcugugugauuuuguaaaguuuacuuuugguauauuuuccaguguagcauaaggaugauaucuucucaagaaagaugguauagauaaauauuagauaguguguaauggaaaauacacacauucaggauguucauauauuauaugcauuuuauuuuaaaaaaugacuaagaaucaucuuccaguggauuucaaguuaaccaccauggauugguuauuuucuuuuguuugcacauuauuuuaggcaugugaauuuuaauucaaagacuuauuuuuauuauuugaaaucaguuuuuacugcauuuaauuauauauuuuugggacuauaugauaaaagauuaucuuauuucucuugagauguuaaaguuauauacaaaaaauuauguguauaauguugugucuuguuucagguccaaugaugcaucagcagccuccuucucagcaauacaauaugccacagggaggcggacagcauuaccaaggacagcagccaccuaugggaaugaugggucaaguuaaccaaggcaaucauaugaugggucagagacagauuccucccuauagaccuccucaacaggguaagauuccauuuggaaaauuugcuacuuaauguaauugaaaggcuuuaaauuuuaaugaccuuuuaaucuagacaaagucagggcguuuucuuuuuuuuuuuuuuuuuuuuuuuuuuugacaaaagguaggguucuaguaaguacaaaggggucacgaagaagauaggaacuucuuaucuguuauuuucuggaauaaguuauaccauacaauuuuauaucgaaagcucacuaauucacagcagaaaauacuguuuuguuuuugaaaaguuauaaagggucaggaauaaacccaauuuuacuucacagcacuguaguaucaaaauuaaaaggaaauaaauuugcuacuaguuugaaccuauuuuuaagaaguuagcauuuguuuuucugaguugguauuuuuugauacugcauguauggucuuaacauugauuuuaguaaaugugguauguggagcugcuguguauguaugcauauguauaugaauagcuaaaaguaucugaaaugccaaauuaugagaugggaaucuauaguugagaaauaaucuuucauaauaucaaauuagaaagaaagccuuugaugacauagagaacacauuauuuauaucuugacugguugugguuuuucaggcccaccacagcaguacucaggccaggaagacuauuacggggaccaauacagucaugguggacaagguccuccagaaggcaugaaccagcaauauuacccugaugguaaucucuccugauguuaacuuucccauuuucuaucccugccuaauauuaauguagagaguuauuuaaaacauuucagugaggacgaagaaacuaacaauuuguuuccucuaaauuuugaaacacuucaguacucuaaaguaccaaugauagcauuaguuuauaaucuaauucaaaguauauuuuagguguuccauuaguaccaucaggaaucacagucugucauuggaauccuuauguaaaaggaucuuuuuguaauauguuuaggguuguuugauuucagccaaagcuuauguuuauugauuuacuuuuuuuuaauaagagcuucauuaagauauaauucaccugccauaaaguucacccauuaguugacuuguauuaauuguacaaauacauagaguauauaguucucaaguuauuuuuccaagucucaucauuuuaauuaauguuucauacuucucaacaaacuaagguuuacauuagugcuugccuuugagaaaaauuugggagacuaaauuauauccauaauauagccauauagagauugaguagaaugggaaaggcaauuuggaaauaagauuuuuaguuaggguuuuuuguuuuuuguuuuuuuguagaaaguggcuugugaaaaauugguuaguaagaugcacuguacuucaggaaaauuugaauagcaauaauccaagcauacaaguagguuuucacaguacaguuucaucaauuuuucuguaugcuugaaaauuuuauaauacaguguagaagaaaaaauaauucagaaauacauuacaaaaugauguggguuguuaggguuugccaaaagccuuauucauguauaugauccuuugauguaaauauaaauuacugaacagagaaacuaagaaacuuaaagcuaaaguauuagcagccauugacuagcagcccauguaagcuagcaagaagauacaauuuaggauauuugaaaaaacaucucaccugucauuuuuuguuaauacauaaaacauaaagguacauuuguacuuaaggacauugguuuuuguuuuguuuuuucuuuucauauguaaacaugguauuaagauuuuuuuaaauuaaaaacuuuaguaagauuguuguagacucuacguauuuuaaagacgugaaaucuacuuuguuaaauuauauguauuaagaagucugcugaaaauaaaugauuguuucuauuuuuuaauuuuuaauuacauuuuaaagaauuaaauuugacauuguuguuuugauccuggguaucucuugaaaugugacauguguauuguuauaaccuuucuguucaaaauauauugguuuguuauuuuguaaauaucaaaacauuaagguuacuuuaauucauuuuauuaguggauuuuaauuugaaggguaucauuuuugcauagguguauauuacuuuauaucugacauuuacauagaguauucuauuuaugucgacaauuaauauuuguaaacaacauuggcucuuuucucucauguccggauauuuauguuaguaaauauauagauuaggaauuggcaaacuuuuucuguaaagggccagauaauaaauacuuuagucuuugugggccauaugguuuuggucucagcuacugaacucuuauuguagcaugaaagcagcuauggacaauacugaaaugaauaggcaugacuguauuccaauaaaauuuuauuuacaaaaacuugccacuggccauauuaagacugcaggccauaguuugccaacccuucauguagguauuuaugagguggcuugggaacauuagaauacuagagcacugaguauaauguucauuuguaauuuuauuccuguguccuuaauuaggcauuuuuguaaaauugaguuuagauuuuagguaacuaaaagguuauuuccuacauuuucuuagugaaacuuuaaaaaaaagagugagaguauuuuucacuagaguccaauuaucucgcagguaaaauuuauugugcuuuaaaacuaaagauauacucugucaacacaauauuaauuuuaugaagauguauguuuaugauacuugaaauauuuucuaaagauuuccaaaauggcagcauuaagauauauaauuuugcaucugaagauacuuugagauacuuaacuuuaugcaaguaaauguuagaacuugaaaauuuuucaguuucuuucaggggaaaaacuuauggaacucuuuuauauuuugcauuguuuuuagcauaugcuguggaauuggagaccagcagaacagguguuugacaaaauaugauaauugcuuccuuuguucauucuaauuuaauuuagguuauuuacaugugaaagacuuuuauucucuuuguuuuuuuaaaugggagauaguuuuuuuucccucaaugaggauuaucagauuuaagacaauaaguguaauguuucuaaaacuacugcuuuuugcuuuuaaaaaaauuugcacguuaucucaauaugaaaacaaucacauugguaaaucuuuggcuaaugcaauugaaauuauuuuuuauguuccauuucuuuuucuuuuuuuucaauuuuaucugaaaguuuaaauauuuuuaggguuuucacucaguggccauuaacguuucuuccugucucuugucgaauugauguaggucauaaugauuacgguuaucagcaaccgucguauccugaacaaggcuacgauaggccuuaugaggauuccucacaacauuacuacgaaggagguaucuauauaccuucacacacauacacauauauauccccuucuacaggaaugaaaauucuugcauaagacaacuucuacccaugcaaagcucuuguagaauacuaguugcuggcuuucuugaaaguugcagggagcccaaaacaaucaaaauaauuuccuuacaaauauuuaaaauguauaaccaugacuugccauuucuaacaauaauaaaaagacuaaaacauuaaagauaauuuuuuccucaguggaaauuuucuauuugaacauaaauccaucaaacuuuuuuuucucguguguguuuacauauguauaauuuuacauauaaguauagugccuuuaggaaacagcuugcugaucucguguagcuagugugugcucuuguagcugucuuuaauuuugucuuuuuuauuuuauuuagcauagucaugaucuuaugacugugauguuccaguaaauguaaugcucguauggcagagacgcugaaaaugcugcaguucaaccuugcaaaauuggcuuuaacugcaguuuguuuggccgaaauccuucuguuugguuugaguuuuuucuuuguuuuguuaacuucuaaaaaucaauauggcauuucauuuuguucuuguguuguuggcuaugcaucuuagagggaaaaaaguuacuuaagcagacuucucaguuuuuuuuccucuucuccaauuauccuguaggaaauucacaguauggccaacagcaagaugcauaccagggaccaccuccacaacagggauauccaccccagcagcagcaguacccagggcagcaagguuacccaggacagcagcagggcuacgguaaagcuuuguacaguguauuuuuaucaccaaaaaaaugugcugauuguuuuaaaauauggaaguggauauuuaauacuuauuuuuacaagaauuaucacuugaaaauucaguuuuagacuagucuacuguuaaaauguugguuuaaaauguugcucuuagauaaacuaguaauccauuuaaaaagaacaacaaacuggagaugguucaugaccaaagguaauguguggagucauuuaaaagacaagaaaaaugaauuaucagauguauuugucaugccuagcccugugugugcugggaaaacugaugauuggguaauuauugaccauauguauauaaucugcuuagcaaauuuauuuugaaaaacuaguggccaauacaguuuuuuuuaagacauacugauuuuuuuuuuuuuugaguacaaaugagaucuauucagaaugcauaaagaaaauguuuuugucauucccuaaauagcaauauacguauccaucgggaugaauuauugcagcuguguaucauacagaauuugggggaaguguagcaauauuuuccuauuauauacucacuuauaauaccugcuaccuggauaucugacuuuaacuucuuagauagggaguggggaaugacgaggaccugauauuucagucuuaacucucaggcuacuauaaccacuuuagauacaacucuguugaaagaaaaguagcugcuuaugaauacugacuccuucucuuccuaacagggucucuuucacgucgguaauaucuuauuauuuuuauucauugacuuaagcucugccauugcuguggacaucuuugucuaccugugauagcaaaucuuagaacucaggucagacugaaauucucuugcccccucagcauacguguugaaacucagucagauauugggagucagguauuuuucuaaaaaugucaaguucugauuuccagauucuagaugugacuuuagaaauauuccauggauuuuuuuucuuucauaaaggaacuuucuugcccuucccaaauggccuuuucauuuugugacuacuuaguauuuauacuuugaauaaauacaauauucugguuuuauugccuuuggaugaaaacagauguaaugcagcuaaaucagguaaauucauugacuuaagauaaauaccuucaaugguaagagagggugaaagaaagcuuaauuuuuguugaaguauuauaguuaaaugcuguuuuguuagacaucaggaauccuaagagaaauuucuauuuuguuuauccauaggcuuguguuguccaaaaaaaacuuuauuuccacuagaaauaaaguuuuaauaauugaauauauaauaaauaauaggcugauauaauuuauuuaagcuugaaaacuuguucucuuuugacacuuuucucugaaaucaguguuuuuauggcagguuuugaauggcuacgauagaaaacauuuaagugucaaagcuuuucagcuuaugcuuuuuuuuuuuuuuuggacggaguuucacucuuguugccuaaccuggagugcaguggugcgaucucugcucacugcaaccucugcuucccggguucaagcgauucuccugucaaccucccgaguagcugggauuacagucgcaugcuaccauacccggcuaauuuuuguacuuuuaguagagaugggguuucaucauauuggucaggcuggucucaaacuccugaccucaggugauccucccaccucagccucccagagugcugggauuacaggcguaagccacugcgccaagcccaacuaguagaguuuauaaaacagacauauuguuuagcaagccaagucagucccuugccaucucuggaauuuguaaucauuuuuauggguaaaguauuaaaggugauuaauucucagugugacuuuugaaucaaguuuuuucacauguaaccuguggguuuucauguuuuuaguuucuguuuuaaaauauuuugguaacaaauuugucaaugcauaguauagacauauacuuuuggugauugcaaauauaaaucuagagucauacaguuguaaauaucguuuauuccuccacuuuauucagaaguuauuucaguauuuuucuuugaaucugccucuugcuuucucuuuuuccucuugcuugugcugguuaacgcuaucagacguauugauuaauuuucuuaucaucauggaguuaaccugcuuuacaacucccugagucuuuuuuacccauuuugaaauauauuuuguaauggcuagggcauaguacgauaauuauagugaaguaacauuacaguauuuuuacucuuauuauuaccauccagauuuauuucagaaagcauuugaggaaaucaagguaccaaacuaucuuuuuuuagcuuagauagaaaaauacaguaacaucucuguaguucacauccuucccugaguucuagggacuuaccuuuuuauguggguuuuuguuguguacauuauuuucagguccuucacagggugguccagguccucaguauccuaacuacccacagggacaaggucagcaguauggaggauauagaccaacacagccuggaccaccacagccaccccagcagaggccuuauggauaugaccagguaaguaguuugaccggcugcagaauugccacauuguuucuucacucucgauuaggugaacuuuuuuuuaaaauuuauuuaacuugaagccucauguuucccucaugagggaauguuuaugguacauuuguuaacaaaaaguguaucacuuuugagauucaugcuguuuaauaacacaguugaucauaguuacucuaucauauaaaacauggccuuaucauaagacaacaacauauauauucugucucucucucucccccucuugcucuguggucuuuacccucaggcauacuuuguuuacugagguaaaguauagauagagaguuuaucauauuuaccauuuuugaguguacauacaguucaacguuaauaaauucauuugguucccccuccgugaucccuucucaucccuuuucuucccaaccucugguaaccuuagugauuucugugauccucccugauguuuauugcugagacuuugccuuaaccuacugagauguggaguccaucuguguugaugcuuucaugagcacuccacuucacuccagcauauccacuacacuuccuucacacccauaauaucccaucucuuuaaauuaaaacuuuccgcccucuguugccuccuuccacacacguaacuauuauuucaacuguuauuucuccccugucauucuucuuucagauauguagaaguguaucucauccuaggaugacuguauucccuugaacccaguguucauuuaacugccuuauuuuugucauuaaacuccucagacuuguaccacagucaucguuuuaugaauguacucauauauacucugaauuauuauggaaaugauuuauuauuauggcaguuccuuuaggcugguuucagguuugucugcacuuuucagugaagguggucugguuuguucaccacuuaagcuaucuaaaauaaguuauuuuuuaacaaggaacugucuuuaauaugcaguuuaggcuuucagggccaacaucaguaucugguuugaggaaaaacucagaugcagugguaacuagaauuugaggcaugagcaguucuuugaucagcccucucucaugccuacaacccucuuguauugacacuucuuauuuaaggcaaaggagauacaaaaagcauaagaacagauaaguaauauuuuucaaaaauauccucaaacaaaacaaaaggaucaguuggagguuuuauuaaguuuuagaagugaaauaagucguggcuagugaguauuuaaaggcaggauuccugagcagauaaaauuuaggcucauuguaaucugcagguaaacuuuuuaaaaagugagauucuguccauguauuccaucacucaacaaauauuuauucuccauguguuugauacugcaguagguccuacggagguaaaauagucaaccagcugucuugaucuuccuugaccucacuuuagcuauuggcacauuuuccuuuuucauuuuuagauggucuucuuuaguuucuauauuucugaaacauuuuguuccucucgcguuuacauugauucauucuuuauuguuuuuauugguuuuccuuuuuauuuuacccuaauaucaauucuugacucuguauuuuuuuuucuagccucugaaucauacugcccucuauuuucaguauucuuagcucuuacuucucaacccaguuucagcuccuuuuuauccaaauguacagaacaucucuugucuuuggauucccucagcuuuagcauguuguagacuaaacugaucauuuuccuuucuaagucaauauauuuccaaaucuccuaaacuucaagccauucauuaagcaaauguuuauugagcaaccauuauaugccaagugccaugcuaagauugggaacauauugggaaauaagauagacguggacucagucuuuaugaacuuaaguguagauggcauacagguggguaaacauaugauaugauacagugugauaaguacuuagauaaggaaagcuaagauuuauguggaaggagcuucuaacucagaucuugagaaauauuccuucggaaauauuauauauaagugugaaguaccaaggaugagccaauauuagccagguagauguggaugaugaaagaagagcauucacaaagggacuaguguuaaaccguguguaguucaguaaagcagaagcauggggaagaagagacaagacuggagagagguguuggaguuagcuuaggaaggcucuuacaagccguauuaggggacuugaacuuuauccugacaucaguguggagcuugaaaagcaguguauauaaaguguguagcaguggcuagcacuugguagcuaugauagauacaugauuuacuucuuuuaucaucauaauuauuccacucucuaaaguucucaggaauuugggacuauacuguguggauaaagacucaugguguuugaguaguugccaaccacuucuccuuccccacuagaaaagaauaugagggggggaccauuuuagcuauuuuagugccaguaguguuucuacauuaaccuaauguuuaaccuuaucuuuagcccccacccaaagaccuauugaucucuuuauuuuaggaaaaauaguucguucacgucuugaugguugaggcaauggaaaacuaacgaagauucugaaacccaauacuaacauaauuauaguuguaguuuaggcagaugaaucuuacagcaauaugcaagauaaaaggggagaaauuaaaaggguggaaauuguuaggauacuuccccaucgguccuugcuauccaguaaacagugguuccauucuuccuguuccucagguuaaaaaucuagagucaucuuugacuccccucuuugcaaagcagacauccaauuagcaaaccccuucaccucuuccuucaaaauauaucuaauaucuagccauuuuucacagucuccuuucacccaagucaaaagucacaacuagcacucaucuggacuguugcaauauauccuccuuuuugcuuuucuugauuuuaucgugccuccucuacaagauacucugcacaugggacccagaguaauguuuuaaagacauuagucaccucucugcuuacaacccugugguguuuuaaguaaaagccauaugauauacuggccuacaaggccauauaggacuugugcucccaccuccuaugcuacccuccuugugccugcauauuuauaucccaaccacucgcugcccucauucacucugcuucagucacacuggccuauuugcuguuccuuacaugcaucaagugaguuucuaccugagaaucuuuguauuugcugccccuuuuucugccugaaugccugcagugccuccaaccucacuuuauuaaaaucucugcuuaaaugucaucacgucguaucagagaguccuucacugaccaccuaaguaagacauaacacccuccauugcaucacucuuuuucccuacccuuuucauaguuuuuugaacagcuuaauugaaguauaauuuauauaccauuaaacugcauguaauaaaaguguacaguuugaucuuuuuugacacguauauacacaccugugaaaccaucagcagaaucgaaguaaugggguaucuaucaugcccagaaguuuucccugugccccuuugaaaucccuccacuugcaucccuucuccagacauuguuacugaucuuuuaacuaaacuguggauuaguuuacauuuuccaaaauuguauagaaauugaauaauauaguauguucugguuuuuaucuggcuucuuuuacucagcauaauuguuuugauacuuauguuguuugugccaguaauuguuuauugcuaaguaguguuccauuauauggcuauuuguuuguccauugagaugggacauuuggguuuacagacacaguacuaugaacauucauggacaagucccuggggacauuuuucuuggguaaauaccuaggaguggaaugguuggaucauaugauagguauauauuuaauucaacaaacugccagaauguuuuccgaaguaguuguaccauuguauauuccuaucauuuuacauucuuaccagcaguguaugauuucacccauauccuugcuaacucauugccaauauuugguaugaaucagucuuuuaaauuuuauuuauucuaauaggugugcuauaacacuucaugacuuuaauuugaguaucccuaaggacaaaugauguugaccaucuucucucacuuauuugcuaccuauauuucuucuuuucaggagugucuguuuaaaucuuuugcucauuuuuaaauuggaggcucuuuauuuuuuuuauuauugaguauuaagaggccuuuguauauccuagauacaaguccuuaaucagguaucauuugcacauauuuucauccugucuguuuuuucauucuauaaauagugucuuucaaagacaggagagucuaaauuuugaugaagcuuaguuuaucaguuuuuucuuuauggauuaugcuuuugggaucauguguaagaaaucuuuaccuaacugaaggucacaaagauuuucuccuguacuuucuucuagaaguuauauaauuuuagaguuuacauuuaagucuaugauucauuuugaguugauuuuuauguauggugugaaguaugaaauaaaguuugcauggcuuuuuuucuuucugaugcauagcuaauuuucucagagucauuuguugaaaagacuuuuuuuuuuuuuuuuuuuuuuuuuuuuuuuuuagaugagucucgcucugucaccaccaggcuggugugcaguggcgcgaucucagcucacugcaaccaccgccuuccggguucaagcgauucuccugccuuagccucaugaguaacgaggacuacaggugugcgcuaccaugcccagcuaauuuuaauuauuuauuuauuuauuuuuauuuguauuuuuaguugagacaggguuucaccuuguuggcuaggauggucuugaucuccugaccucgugauccgccugcuucggccuccuagagugcugggauuacaggcgugagccaccgugcccagccaaaaacucucuuuuaccuacuggauugucguuuuaccuuugcaaaaaaucaguuguccauaaacaugugucuguuucugaacucuauucuguuccauugaucuguuuauguaucuuuaugccaguaccacacugucuucauuaguauaguuuuauaaguuuuauaguuuuaaaauaaguuuuauaaucagguaguauuaguuuuugaacuuuguucuuuuuauacaaaguuguuuggcacuguaaguucuuuggauuccauauaaauuuuagaaucagcuugucaguuuguacguaaaagcuuacuaggaguuucauuguaauugccaugaauuuauagauuaauuuggggagaacugacaguauuauuuagucuuccaaccuaugaacauggcauaugucccuuaaaauuuuuuuuaacagugucauauaauuuucacuauauaggucuuacauuuauuuuucuaaguauuuuauguguuuugaugcuauuguaaauuuuuuaaaauuuuaguuuccaguuauuaguugcuaguauauacaaauacagcuuauuuuuguguauugauauuuuaucaaaacuauaacuuuacuaaaaucacaucuaguaguguuuuuguagauuucauugaauauucaaacauagaaaucauguugucugugaauaaagacagucuccuuccuuuucaaucugaaugcucccccauguuccuuccccacccuccugcuugccucaacuagaaacuccaauaccauguuaaauaaaaauggugagaguagacaucuuuugucuuguuccugaucuuagagagaaaguugucauuuuucauccuuauauaagauguucauguaggguuuuuuguagauguccuuuaucagguguuauauuucuaguuugcugagaauuuuuauugggaaugaauguugaauuuugucacaugauuuuuccuuaucuauugagggaauuaugguuuuccuucuuuaguuugcuaauuuuugaauuacauuguuugaguuucaaaugugaaccaacuucauaccugggauaaaaucuauuuggucaugauauauauccuuuuuauauauuggguugauuagcuaaaauuuuguuaagaauuucugcaucugcaucgcuugaguccaggaguucaagaccagucugggcaacaaagcaagaccccccaccucuauaaaaaucuagccagucaugguggcauaugccuguagucccagucaguuguguccugacauaacagugguucaacuuagguuuuuugacuucacaaugcugugaaaagugauguguauuuaguagaaauucuacuuccaguaacuguacaaucauucuguuuuauauuuucagugcaguguuuaauaaauuacaugagguaugcaaaacuuaggauauuuucagcuuacaguggguuaauugggacauaaccccauggcaagucaaggaacaucuguguuuucaugacaaauuuuggaaucuguuuuuuuuuuuucuuguaacauguuugucugguuuuguuacugagguagcacugguuucauagagugaguugggaagaauuuccucccuucagaaaauuggcauuauucuuucuaaaauguuuggugcaaaguuaccagugaagccaucuggguuuguaguuuuuuuugugagaaauuuuuaaauuauaaauuuaauuuaugaaauauaggggguauucagguuaucuauuuuuuucuugaguaaauguuuuguguguuuuucauuggaguuguccauuuuaucuguguuguugaauaauuucuuuaucaucgcucaauaucuccauaaucuguagugauauuaccucucucauuucugauauuaauaauuugugucuucucucuuuguccucauuuaucuggcuaguuuuaaucuaccuauucauuuuucucaaaaagcagcucgauuuuauuuauugccuuuugcccauuugcuuuucuguuucuuugauuucugcccagaacuuuauuauuucuuuuuuucugcuuacuuggguuuuauuuguucuuauuuuuccaguuucuuaagauugaaguuguagucccauugauuuaagaacugucuuucuuucuaauauagauguuucuuucuaaguauucuuaaacugcaucugaugcuguuauuuuuaaucaguucaaaauacauccugguuucacuuuuuauuucuuuuuugacccacaacacaucagaagugugcaauuucauuuucaaauauuuggagauuuucaaaucuuucugaugaauuuacuccuuuaccauuaucaaauaacugucuuuaucccugccaauauuuuuugcucugaaaucuaguuugucuaguaucaauacugcaauaccacuuuucuuuugauuaguauuagaauaauaauuuuucauccuuuaacauauuuguuuuuauauuuaaauuauauuucaaguagacagcauauguagucagucggaucuugcuuuuuuuaaauccagccugccaauugcugccuuuaaauugggguuuuugacauguuuagugugauuauggauaugauuaaguauaucaucuuuauuuuuucuauuugucacaucugguuuuuguucuccuuuuccucuuuuucugccuuccuuugauuuuucuccucuuuuuaacaaaaacagcuuuauugagauauaaaucacauaucauacaagucaccauucuaaaguauaccauucagugguuuuuaagcauauucaaaaagguagacugggggugguggcucacgccuauaauuacagcacuuugggaagcuaaggcaggaggauugcuugagcccaggaguugaagaccaaccugggcaacaaagcgagacccccaccucuacaaaaaacuagccaggcaugauggcaugugccuguagucccagcucuucaggaggcugaggcagaagauugcaugaacccaggaggucgaggcugcaguaaguugugauugugucacuauacuccaggcugagugacagagcuaauauccuguccccccaaaaaagugcagccaucaccacccucuaauuuuaaaacauuuucaccagccugauaaacuguauaccuauuagcagucacuccucauuccccuuuaacuacucagccuuaaauacuuaaauacucauucuguaauuucguuuucaaauauuuggagauuuuccagcaacaguaguuuacuuucuaucucuauagauuugccuauucaguacauuuaagauaaauggaaucauacaauauguggaguuuugugacugguguuuuguuuuuuuuacuuaaaauaauauuuucaagguucgucuguguagcguguaucagugucuucaagugauaguaugccuauacauaguguaagaaccuuaagguagucugcuuuucuucucuuuguguuauuguuacaaauuuuacuucuguauacguuauaaaccccacaguguauugaauuuauuuuugucuaaaaaaaucaguuaaagauacuuaaauaauaaggaaaaaaaaauuuuuaaauugacccauguaguuaccguuuuugguacucuucauuauuuauguauggauucauauuacuaugugguaucauuuuuguuugccugaaggauguuaacauuucuugaaaugcagguguacugguaauaaucagcuuuuguaugucugaaaaaaauguuuauuuugccuuuauuuuugaaagauauuuucucuggguauagaauucuagguggacaguuuguuuuuguuuucuuuccauacuuuaaagaugcuccacucuuuucuuccuuacauuguuuccaaggagacauuugcugucauuuaucuuuguucuuuuguaguuaauaugucuuuuuucucuguuuuuaagauuuucccuuuaucaaauuguuugauugaagaaauuucucucuugcccaaauuguuuugagcaauuugaugagagcaugcauugguguugauuucuucauguuucuuaugcuuggaguuuguugaguguuaucucagacuuugucauuuucaucucuacaaguuugguuuaggucuuuuuaauaucuuccgugucuguccuuaauuguuuugaacauauggaauacaaauauaauucuuuuaauauccucuucugccaacucuaauaaucuaugucauuuuagggucaguuuuaaucaguuuuuuuucucuguccuuugugugcgugauaaucuuugauuggauuccagacauugugaauuuuauguugggugaugaagauauauguauaccuagagauauucuuaagcuuugcuuugggauucaguuuaauaaguuacaaacaguuugaacuuucugaaauugcuuuuaagauauucuaggcaggacaaagagcaguguuuaguccugggcuaaauacucaucacugauaagguaagagccuuuuggguguuuugcccaaugcccuuugaauuguaaggcuuuuuacucugacuggugggaauaagcacugauucuguuccuaugugacaaacaaguauuguuuccccuaauccuuuuggguguuucuugccucagcccuggguauuuuccucacacauuugcauaucuguacuaugcugaauaggaggaggguuccucugcacaucuccacaguugucucuuuaggcagaucuuucuuguaggguacucuguccuguuaacucuagcuaccuuuuucucuccagacucuaagccuuaucuccuuaagucagaacaucuggcagacucagccucaguuccccuucgugcacugcagacuggaaacucucaagguaguuagcugugguagucagagggcuggccucauuuguuuaccaugucucagggaucauuguccuuuguuggcucuguccuguguguccugaauaugauuaucauaugcuuuguguaguuuuuuuuuuuuuuauuguuucaggcugccagauaaauccaucuugaauagaaacaugcauuaauuuuucaacauaacauuucucuucauuugacagauuauuuuguuacuguuuauugucauauucuucuuccccaagaauguaaccucuuuaaaagcaucgcuuugucuguuuuuauuacuguugagucucugucaccuaguagagcacagcacauaaucaguaaauauuggugaauaaaguauaaacaacugaguaaauaaggccacuacuuucuagauuugaaugcgugaucacaagaccagaguuaagaggaaaccccuaaaauguugugaaggaauaauguuaagauuuuaaacugauuagguaaauagaaugaaggaaagaaauguaaagauuuugguauugcucagauuucuaccuuaggaacucuucucauucaauauacucucccuaggcauucucauuuauucacaaggucucaguucaccaugcuguugacucccaaaucucuauuuauagucucaaucucucuucuggaaauuagaugccuacucgacagcucugcuuagauguaucauagguauuaauucagcagaaacaaaauaaauuuauaauuuuuucuaccaaaacuuuucuguguucuuuaucaaagagagggguacuaucaccaagcuagauugccaagugccuguuugguauuuaagugucccugcuuuuccucccuugucuaauaaaugacaaauguuauugaucuuccuuuuugaaaagcuuuugaacccauucauuucuuucuaaccuacacccuuaucuuaguuuagaccauguucaucuccugucuucaucgcaguaggaucuuccauacugucuucuuucccauuaaaauucuuuauacuguagucagaggaauuuuuuuuaaaaauugaagagcaaagagagagaaggugaggcuuagaguguucaagugauuuacucaagaugacagaauucaggaguggugaagcugcaugacuacugcugagugcugaaagcccaugcucuguucacuguaccaugcugccacccauacuguuaaugaguacuugaguaguucacagagcauuuucauguuuuucuucuugaauaacuuuuuaaaauagagauuauaauuacccuugucagaugauaaaauugaaacucagggagguuaagcaacuugcccaaggauaagaagcuguuaaguggugacguuagcacuagaaauugguuucuggcuccaaaagccguacuuuuaauccuuaaugccaccuuggaauuuguuaaugguugcagauacacagccuaccuuuuuaggcaugauugugguuuuguuugguccuagcauugugaucaaguaugggccaaguuacuuagacucucagugccuccauuucuucuucuauaaaauggagguaauauuuacuauauauagauggacacaaagcauuuaauacaauaugugacacaaacugagguauuauuaucaggguauauuauuagcuucuacuccucauuauugcguauucuuucuucccacuucccuaagcauucuguguuuuauccuccaugccuuuguuucagcuauuucuucuauuugaauugcccccuuuucuuuucuucuuuucugcuauucagaucuuacuguuuucucaaggcucccacauucuugggaauauuuuucuaauuaauuuaggcuguguuaaccuuuuccuuucugaacucucuuaaguuugcuaagacuuagagaacuuaucuguuuuguaauuauaccuuaauuucugagucuucucuguuuuccacauuuuugaugaugaugaguauuuguuccauaaguguucacaguugcuuggauauaauuuauuugguauacauuauugaccuggucucuuucaaguaguucauaauacaguagauaaauuauagcuuauauacuaugguacagugguucuuaaccucucuucugcuuucacaucauuuauauuugcaacucacuuucaucauuagcaucucauuuuauacauugacuaggggagcauuucccuccaucauugagagucacugauuuauaauucuaaaaagcgcuuucucauguccucuccuauuuaagcaucauaacaaacagaugagguacaggaauuaauguagccauuaacagaagggaaauugugauccagagauauauauguuacucucccacugaugauugaagaaaccgagucucacagagguuuuuuuagacucaaauaagaaguuagcaauagaguuggaacuuaaacucagauuuaguauuuagacaaucuaacaauggaauaauaagcuccaguaugcuaaccaauaacuuucuuauuuuaaaccuuuuauuauguuuauuuuaaacacauauagaaaagagaguaauauagugaaccccuguguacccaucacccaacuucaucaguuuaucaacauuuugccaauguuguuuuaucuaccccucuacacuauuuuuuucagaguauuuuagagcaaaucuuagaugugauaucauuuuacucauaaauccuucaagaugaucauugauuuaaauuuagcugaauauaacuauguaaaacacacuaguguaaaaucccuaaucucuuuuuuuuuuuuuuuuuuuuuuuuuuugagacagaguugcucuguugcucaagcuagagugcagugcaaccuccgccuucuggguucaugcaauucucuugccucagccucccaaguagcugggauuacagaugugcgccaccacgcccagcuaauuuuuguauuuuuaguaaagacgggguuucaccauguuagucaggcuggucucgaacuccugaccucaagugaaucacccgccuuggccucccaaagugcugggauuacaggugugagucaccaugccuggcccauaaaaucccuaauucuguuuaauucauuauuccaucauauauauggugacauucaacacauuaucauguguauuuacuucuguggaaauguagauuuuuaggguaccauuucuuaugguagagaaguauuucaagucuagaauguuuuugaguuauauuguugugacguggagagagaguuguuuagccaaaggaaacaguuaacuaauuauaugcuuccagugagucaugcuuuuugaaaauuagugcuuuuaugaacaucuguuuuaaacacauuuaagaaauuuguaauaaaauacauauuucauaguaugucuuucuuuuuuucuaccuucuguuuuagaggaaaagauguugcuuaucuucuccaaaaguuaaccugaacagauguauacuggacauuguuuacccccacucacagaauugugcugcuucaucaugucccuucgugcugcuucaucaugucccuuuugucuauauucccuuucugucucauccugucauccugagggucuucaagucuaccuuauuaagaaaacaaaacagacaacacaaaacagcuuuccuugauuuuaugucccuguggccugucuaaauaccucugcugaacuuuguugaccucagggaaaggcucaauuauuuugguauggauagaagguucuuuaccuuuuaugucccacauaccuuuccauuuucacuugccacuuauugcaaauacccuugauguucauuuguaauaauuauaacaagcuaaacacucacaaaguugucacacuagcauaugauuuacacccuaauauauauauuacaucagaguuuagaacuagaacuucucacucaaugccugcucaauucauucaacaaaauucacuaaacauuuaaguucccacucugacaaguauuauucuaggcucauuugcuaaucccuagcauauuuuggacuaugaaauucauuugcaauugaauauaauaucagaagaaauuacagggugauacuguauaccuaacgauauaaaaaaauuuuguuuauuguagguacggcugcuuuuuugugguaugacaguguuagaaaugauucguuuguaaucuucuuugccuguuauggucaaacuauuaucuaauuauauuuuuaaauuuaucuuuuagggacaguauggaaauuaccagcagugaaaaaguacuuacauuccaguagccaguaucuauuagcagccauauugucaccucagcacuguggacaccucccugugaagagauccuuccauuccaucuaguuuuuggaaaaaccuuguggauaaguggcuguuucaucaguaagcagccuuugugguuuaguuauaaaaggcuuuaguagcucaaaaauacucuugauuucacauuucuacucuagauggcaacauuggacagaaaaugcaaugacauaaccaauuuguaaugauuuuggaacuguguuucaaauggacuguuacagacugaaaggugugaacagcuuuguauguuuaugaaggguaagggaauuuaauacuuuuccacagauuuuuuuguaaggggaagagggaaauguacacuuuuuacagcagcaauauuuuguauauuauguuuauuucauguggugaauaugcaaggcgguacacuacgcacuggacagcaucagaaauccucuguuaauguggacuggaacaugguagaugcuugauuguuuuggucucaaaauggugugcuauaaagauaaaggugaggggaagacaaagcacaccauauguccacuguucuguucucauagaggaaauucaaaucccuuuuaucuauuagauaaucaagggcacugugauacaguuuugaguaaaaagacauuuuuuaaaagccuuccaguuuuguggauuaaaccuuuuuauaaagaucauuuauaauacuguuuuaaaaugugaggcaauaagaauuacuuuguguuggaucugaggaggcuuugguaaaacaguuucaucuaaaugaaagugguaauccucuucuaaaauagcaauaacugaaaaugaaaguguuaauuuuaccuuguuugaguuaucagggaacuuaguaaguaauaucaaagcauuuuauaaaugauaucaaagaagagucaacauugauccagucauuuuauuuuguaauauugagggauaauugguuauuaaacugaauaguucaggagacuuuacaaaccuuuguuucaacuuucuuaucuggaaauaauaucauuuauaaagggacacuuuuauguuuuucccuuuuuuauguugguugauauaacacaaagagauauuuaggaaaaugcuuauugaugagguuuauucuaucuguuuuuaaagcaccgagguugcauucuagauaaccuuguuuauuagcauggcauauuuuaaucauuauuugagacuguccugugccugauuauuuuagcuaaauucagggagauugcguggggcaggaaagcaugcauugaaaaauuucuaaccacgguuauuuaagcauaaucugaaaacaucuagcccaaagguaaguugcuauuuucaucacaguugccuaugcccagggaauaagauguauucuuuauaauugaauugguuuuucccacgucuaacuggaaacaaaacagaaggggcgucauaaauuugaauaagcagaacauacuguucucaacauacuguaaucaaaaggaggaauuucagugggucucuguguguguaugagagagagaguguguguuuguguguuucaaggucagaacagguuuuuuuguuuuuguuuuuuguucuuuguuuuuuuuuuugagauggagucuugcucuugucgcccaggcuggagugcaguggcgcaaucucagcucacugcaaccuccgccucccagguucaagcaguucuccugccucagccuccugaguagcugggaugacaggcacccgccaccacacccagcuaauuuuuguacuuuuaguagagacgagguuucgccauguuggccaggcuggucucgaacuccugaccucaggugauccacccgccucggccuuccaaagugcugggauuacaggcgugagccaccgugccuggccagaauagguuuuuucuuucaacuugaucaguagaaaauggacaucaaguuugaacagauaaaucauggacagccuuauugugauugaaaugcuuguagguucugugccaauuuuccaccacuguguacuuuguugcuauuuaaaacuguaucaacucuaacggaagaauaaauuauuugugauuuuaa

SEQ ID NO: 192741 - RNA, 57266 nt, Homo sapiens
gugauuucugaugaaacuggauuggaauaauuuucaugaucuuuguauauuuauauauauauauuuuuaaauuuugcauuugacuuaaagugccaugagaaaauuugcauacugcaaggugguccuagccaccuccuugauuuggguacucuuggauauguuccugcugcuuuacuucagugaaugcaacaaaugugaugaaaaaaaggagagaggacuuccugcuggagauggugagugacauuuuauaauagagcuguuuuaacuacuauaucacugguuuuuacuaacuaauuuggauaauauaaaauuuuaacuuuuuuagauuaacuguagucugugacuuccugugggagauaugaggaucauauugauaguucuccaauggguucauccagcaguuaaaagcaugaaaguaucauauauagaauugcugaauucgauuuuuguguucaauauuuaguguaguuaauuuccuguaaguuacuuuauguuacuaaauaauguggguaucucauaguugggauaucaaaauuguacagaagauuagucuaaugccaaaaugcugaguggagcauuaaaauugcauuauaagguaucaaaagagauuacuccuccccucccaucucauuccuaaggggaagaaauuuuuauagauagaugugaucuguagaaguuguuguuguuguuguuaauguuuuagauagcugcaguuagcacuuuuagggagaacuuuuuugaaaagauugggugauagaauagaggcugcagugagaucauugcaauaucuaguauggaaaggaaauaaauauacaaauauaaaggagggagguaauagguaguacugauauuuuuggcagaggacauuggaaaauucaguuuuaaacuccuuuuauucaacaaacaaauguugccauuuuuuaaaaaauucuuuuuuuuuuuuuuuguuuuuaaccauaaugaaaaugacugcauugcaagagucaguaauccaguuguucugggcucugaacucugugauuaguuauagaauacauggcuauacagcaguucuacuauuuuuagaaauuauauacaaauaauuacucuuuaaacauguuuucuuuaagcauauagccacauuuaaauuuuuuauacuuuuaugaugagaagggccuuuggucccccaaaauuuacaauagaaaaaaaauauugauuuguauuguuaacuguaccaacuuaacuuuaauuguuauaugugggcuuacauaacugguucuauuuauaucuucuugggaaaucugccuaaaauuaggcuuaguugcuagcacugaauuccaguaaugccuaggcuaauuccuaacuuaaauuuucacuuuuuccaaauguuuuaauacauuuuucauccaaagucagccuauuaguuugcauaauauuuacuuuauagcucugcuguugaguaucuuuguugggugacaaaauguugccaccuuaacuguugcuagaacuguauucauacugucuauguuuaaaucaaagaacagguauuacgauucaucagucagaaacuugaguauucuuuucccaaauagaauggaauaaauuuccccucacccuaccuuaauucauugccauuuauaauaagcucaugguguucuaucuuaaauguaaagacuugacagugagaaagaauaggcucuauagcauguguagauucacuugaauuuuuuuugacuuuuauaugugcugggcaagguacuaggugcuguugauacacagcugaacaaaaaaauaagacaaaauuccucccuucagggaacucacagucuaauggaauagaaauaacaauaguaaauaucagcguaauaaauaucacuuuaggaaugugcacaagaguagaaaggaaggaaugccuuggggugucugagaagcugcaauaaggaaguauguuccagcuuaguaucagcuugagcagguguuuguuaggagaggagaagaccuuccaagcaaaggaaagaaggaugugcaagauuagcaagugagaacgaguugauaggagaacaagagcacaggagguggcagaggccaugucacacaaggccuuuuauggcaugcuagggguuuuggacuucaucuguagacagcggcauggcgcugaagcacuuuaaacaagggaguaaggccugaucggaccuggacuucuggaagaaugcuuugguggucauguaacugguggacuggaagaggacgaggcagguagcagauaccagucugagacuguugugagaguuuggaaaagagcuuggaacagacacuaaaaugacacuggagauggagaggaaauaaauauguaugaaaagcauuuaaguaguggaguuuacauaaccuggggggccaucgaauguagggaauaagagaaagagaaaagucuaagguggcuuucaugucuccaugguuggacgaauugaugcuccuuagaagaggagcagcuuugaugaaaagguggaugcaugaaguugaguuuggaauuuuuuuuuucauuuuucuuauuuauuuauucaugaaugagauggaaugucgcucugucaccaaggcuggagugcaguggcacaaucucggcucacugcugccucugccuccugaauucaagcaauucuccugccucagccucuugaguaccugcaguuacaggcgcacgccaccacacccaguuaauuuuuguauuuuagcagagaugggguuucaccauguugccagguuguucucgaacuccugaccucaggugauccaccugccucagccucccaaagggcugggauuacaggugugaacaaccgcacccaaccugaguuuggaauauuuaacuuugaggaacugguagcgauguucugcaguagagaauggucgagauggagaaaauagaugguaguuuaagucuuuucuguaccugaggcugugcaugguauguguagaguuggaagacacagacucccuguuggagagccccuccuggagggucacugaaggaagagaaggcuucccaggaagucagaguggaaugaaaagccccaaggaguaggucauagaagcccagccaaggguggcauuugcucagagguuuuaccuaaaauaaaguguuucugauaguuugguauggggcuucuugugacccuggcaagugucauuucagggaaugguaacuguggaagucaguggauucuggauucaauauacuggagaaacaguagggauguggcuguucuuuaggaagcuucagcaugaagggaagcauguaguauacgguaguuacaagagagaaauggagccgaaguugguuuucuauguauuuauuauuauuuauguauguucaggaagagguuuaaacuauaggggaaaggaggaauacuugaaagaacaaauucucagcagaugagacagugggguaucagaaacgugaaaaggauucuccucaaagagcauccacagguuauuauaguuuugacaaccacuaguggcauaaguuucaaagaaaaagacuggguuuuguacaaaaguacaagcuaaaggagcaaaagucugaaaguaacggagguaugagauggccuccuugccucuggaggaaaggagaacgaaucauucucccagaaacaguugugagguuaaauggacucuggaggagagcuagacuucaguuaagucuguagauggagccuguguauuguggagaccagacaguggagaggcuuuacaacagccugggggugucaggguguucaggggacagacugagaaggaccuccaagcgugagggaagggcugagccguaggcuggaggggaaguacauagcuaaggggagauaaucuuugaggucccugguagucuuaagggaagaaaugauuaggggaagagcacaguugaugcuaauaagcaacaguuugaaaaaucugcuuugauaugaaguuucagugcaguaggugcugagaggucuuaagucuuuucagagcccagagguuguuaagguucugcuagugacaaauuucuguggugcauuugaagagauguuuacuaaagaggaucagggagagggaauggguaauggcaccaaggaugccaacuuucuaguggaauuagcauguacauuaugugaccucaaaguuucucuuuuuuuuuuuuuuuuuaaagacagagucuuacucugucacccaggcuggagugcaauggcgugaucucagcucacugcaaccuccgucuccuggguucaagcgauucuccugucccagccucccgaguugcugggauuacaggcacccgccaccaugcccagcuaauuuuuguauuuuuaguagagacggaguuucaccauguugaccaggcuggucucaaacuccugaccucaggugaucugccuguuucagccucccaaagugcugggauuacaggagugagcugcugugccuggcaucaaagucucucuuaauagaacacauagggccuccuggaucuuuguuuuaaaacaaacaaccaaaacaaaacaacaaaaagcauugagcaguauuacacuccagagugacuuuuucauauuggaaguaccuaauuucugaacguucugcuuuacagcucugauuucggugaaauuuagcaaauuuuacugucucugcugugaaaaaaguuuuccuagguuugaauagaauggauugaugucauugugauaaugcugaagacuuccuguaacauuguuguugauaugcuguacuuaagaguuuucuaagauucuucuauuuacuuguuacuugccugcuucaaggaauagugagucuuuggugacuccagagggguuuguuuuuucugagucguucucuuaagucuauacuuguauuuuauaccugaggcuaucugaaaauagcagaguucugcugcugcuagaguuagauugggcucccuugaaagaauacggguaguggggguuauggccuaggaauauuuuuacacucuucugcuuuccagaauuagcccauuuauccacuuuauggauuuggguguuauauagaguguucaguauuuuuaaagaugcaguuucaaguaguaauugauucuucaugucaguacugcauuuucagaucauuaaaauauuaaugauuuaacuuuucauguacuuaugcuggaauuauuucaacuguugaacauuaggaagccuuggagaacaugguuuauggaaaaaacuuacaaugauaaaaaacuuuaaaauauuacuaguaaaggcuauaauaacuuuauaacaaauuuuuaaguguugauuuuuauauaugcagcgcagguaaauugaacaugaaauuggaaauugacaaggauguugaaguagcagaaaguuaccagugaguuaagguauagaugauauuuugauguuuaaaaaaucagauaguguacugcauuuuauugcaucuuacauaccuuuguuuauagaauauucuguauaccaccguaaaagugauaacauuccaguuaccauugugagccacauuccaauuucagaaauguuaaaauauaguaggaaacauuuugaaauagugaauauagugcauaaggacaguaaaaauguuaauuguguaguaagaucagaaaauaguuugggagaaaugauuuuagccuuuuauuaguauauuuaccccaaaaagaagucauauaacuuuagucuacuuuccugagagaaacacacauaagaaauuugaaaaauauccuuaaaguguauucaaaggcaugccagugguuuguguauguuaaucuuauuugggggcuuucagagugaaccuguaguuuucuugguaauuaccuuuucuaaaacaugauacuuaucuacagugucauguaaaugaaacuuaacugaaguauauaauaaaauauguuuguucucacauaauacuuuggaauaacaccuuugucccucccuugucaaagugauuugauucuuagaaaugagcugcauguagaauuuuaugcaaagauauuuucuuuaguucaugaaaugacauccaaacucauuucaguuucuuucuaauaaaauuuucacagaaccuacuuuuaauacacauagaagacuggcaguagagaacauggaaaguuuauacuuaccaucuuuuuaguugcuuucuaaugcuauaaaugcauuaauaguaacauauauucacuaaccacaugcauuucauccaaacucguuugccaagaaaauuaguuuaauaguccauuuaauucuguaggauauuguauuuucuuauuaauaauuagaguauuguggugcauucucuaaaucauucaguagacauguaacuuuugauuaaugauaauuuuaaauguggcucugaaauuucauauguaacaguagguuagaguacauaaugcaggcacuauguuagauuuucagauuaauaaauaucaggugaugaaaugugcaaaauagugcaucagcaggauuguauaugcuguacauuuuugccugauucuuuaagaucucaaaaccaacuuuaagcuucugguuauauaauuucauguguaauaagcaauuaaguuuauauuuuguaguauuuauaguaauaauuucuccaguccuccuuaaugccccccuccaccauggaaauucucaaacagaaacaaaaguagagagaauagaaaaucauggcugggagcgguggcucacaccuguaaucccagcacuuugggaggccaaggugggcagaucaccugaggucagaaguucaagaccagccuggccaacauggugaaaccccauuucuacugaaaauacaaaaauuagccagauaugguggcgcgugucuguaauaccagcuacuggagaggcugagacaggacaauucgcuugaaucugggagacaaagguugcagugagccaagauugcaccacugcacucuaguuugggugacagagcgagacucugucuuaaaaaaaaaaaucaaaaaaaaaaaauuaaacucucauguauccaucaucuggcuucaagaguugucaacucauggcuaguuuuguggcauggauaccucuuucucuuugucucccucagaccuguuuuguuuguuguugaagaagaaauugagguauuucucuuuuccaguuuccugcagucuggauuugcaucccuuuaauggugcaugccaugucccuuugucccguauauuuccuguaaauuaggucuagaggcuugaucagguugaggaucuuuuucccccuaguaaaaacacagaugguauauguauauguuaauacucuucauuuaaaaacugagcagcaugaaaacguuucuauuuugauuuuucuauaaagcauuuuauacuaaaauagagcauggguaacagaaggauauuuauaaucagggccacuagaugucucccaccuacucuuuauguuaucugugccauccacaaaagauuuuugucaccuucagaacucugccgguuccuuuugaccacugauguaccaaucucaaaaucuguugguuguucuuuacuuucagagacuggcaaguagaaaugacuauacgaguuuaacaguauuugauuuuuaaagcuuuaaaggcugauuuuauauggaguauuacacuucuguacuuauaguuuuuacuacacuuguugaugauuuuugucauugagaauuuuuaaaaacucuaccaacucucauauuuaaggagcuuacuuacugggcaaacauuaggcaggacuuguuuuuaaaaacuauguuacuugaguuuccuauaauuuuuaaaguaauuuucuacuauuuuaauguuccacauaaaaucccaauuuauccugagaacaggggaaaacuaaugcacacuuuuuucaucaucauuuucugaaaucuauuuuuaaauucuggacgugguugaggacacagugaauaguuucauauccugcagcucugguauugguagguggcuuuguaccacuggcugaaacaaucacccuaaagucagcuuuaccagcucguccuguucuuguacagaugaagccugacugaagagagauggcuuuucugcugccuugaugccacuauuuuuuguuuagaaauguuuugaggaugccuaaaaaacaaucuacaagagaauaaaacuuuagauuuuaaaauaaguaaugcauaaaauauauuuucaucccauuuuugaccucaccucauucuuuagccaucccuuauagaugagaaguuuaacauagcaccuuccaaauuuaauauaucccagaaccuguuuuucuuggacauuuauuaacgucucaaaaacauaaggaagaaaguuugggaagugcugaucaggcacauugcucuuuuuaugucuguaucaagagauaacauuacuuuugaugagaauucuuguucuaaugggagggguacauaagacagguuugacaaucauuauaaugagagauagcaauugguuagagacauaagaacccugaaugaaauaaugugauagucaagacuaguaaauaaccacuauagagagauucagaaaagcuacagggaagagaagccauuuuaguugggcaugggaaggcaaauagggauuugguguugcagcgauggaagccgugaggggaugugagcaaaggcauggaagcaggagaaugugaggcacguuggaaggaaggcaguggguggcuguuugacugcaagaugaaguacugugggaugggaggaaaaggucuagcaggugauaguuuuggaaaauuagguucaauuccccauuacagagguuggacucuaggaggccauaagaauaacaaugaaggcugcacuuuaaggagaucaguguggcaguaguuuuugaguugggagccaacaccaugcagugacucaggugaguggggcaaggugacgaagucuugagucaggacacugguguggagguagaggacaagacagccccuugaaaggguuaacagccuaggagagggugggcucagaaaggguucugguuguugagggcacaguucaaacacaaauguuauuaaauagaaucaugaaucaaucaauugcuaugaaauuaauguuaguuaaguuucuuccuauucuuaguucuagagccaguacaaaagccucaugaagguccuggagaaauggggaaaccagucgucauuccuaaagaggaucaagaaaagaugaaagagauguuuaaaaucaaucaguucaauuuaauggcaagugagaugauugcacucaacagaucuuuaccagauguuagguuagaaggguaaguacuuacugugguccugauaguaugugaaugaaaaguauauucugaauuuucaguaaauugcacuugagugcugauuguucuuaaggcaaauguuauaucacuauguuacuacuuaccccacuuagaaaauaauuaaaugcugauagaaauaauaucucaagcuucuacugauuauuagcacuauguauuucaggcauuggaagauaauuauuuaucuuaauggauuagaaggggauuuuaaacuuuauuauuaccaaaauacucacauacucaacuuuuuacaaaaagauuuaaguuguauguaacuugaaacagugaaauacacagucguaaguauacagcucacugaauuuuuugcuauguauacaccuguguaaccaucagccaaaucaagacauagaaugaucccaucaccccugaaagucuccuuauguuuuuuguagucauuacuuacauccccagaggcagccguuauauugaccucucuaaacauagauuaguuuugucucuuuuugaacuuuuuaugauggauccacaccauuuuuugugccuuuaagauucauauuguugcauguaucagaauuuuauucuuuucuacugcaaauagugauuuguaauaugaauaugccauuguuuauuuauacauugauagaccuuuggauuauuucuacuuuuugaccccuauaaauaaagcuauugugacauucuuguucaugucuuuuggaggacuuaagugcccauuaccguaugcuauguacuagagaaaggaauagguuaugcauuuauauagcauuagcaugugcuaccaaauauuuucccaaaauguuuauaccaauuuacacuccuaucagcaauauauuaguuagaugucuaguugcuccauaagaagaagguaauacaagguacuagaguaccauaggcccaguuaaaagcaagcaaacuauacagaaaauagguagaguaagugaacauguacauucugugcugaggcccccuaaacuccuugcucucauugaugcuggcagccaagcuugccuccuccagagaagagacuggaagaucuuucucaucagaauuggauaggccuagagagaaggguaaguaccuagugugguccugauaguauaugaaugaaaaguaugugcugaauuuccaacaaauugcacuuuagugcugauugacuugggaaaguuuccaacuuaauggcacagccugaucacccuuauggaaacucauagucauugaguccuacucauguguuuaggccucauauucagccucuuggucuuccauucuuaauaacaaauagguaagcaaggaauacuagacaucucaggaaacccucaacaaacagagaaaagcaacuuugaggaaacaaaaacuauuaagguagaacacauaaagagaaauaacuaauaaccucaacaaaauagagaauauauuacaaccauaaaaugagaauaggauauuauucaaaagauacacugagagaaccagaaagagcuuuugaaaauaaagaaaaaugcaccaaagagauggacaacaguaaaauuauaugaacauugaaauaacaaucaagaaauccaauauuuuaauaauaggagucucaaaaagaauuuuaaaaauagggaagagaaaauuuauccacaaaauuuuccauaacugaacugcacaaauuuucaaauugaaagagcccaccaacuuuuugggacaauagaugaaaauagacuguacuccaagacauugugacuuucagaacacugaggauuucaacccccaggggggaaaaaagaccuuuuacagguuucuuaagaggcgaaagaaggucacaaucaaaagguuauuaaucagaaugccuucagacuucucagcaacucuagaaacaaaggagcaaaauucuaaaggaaaauaauuuccaaucuaaaaucuuauauucagccaaacuugcaauaaagugcacagguuaaauaaggauauuuuuggacaugcaagaucucaaaacauugaacucccaagcauccauucucaggaaguuacuagagauaggacgcuaccauuuaaaaccuugguuuuaaauaaaccaaggacaagagagacauagaauguaaaaaacaggagauucagcuuguguaagaaauggugagaaugaccagaaggugaugaagggagagccugagugagaguugcacaggcagaggcgaccagcccagauggagccagugagaaaauuccagaagagacuucaaaaagauaccauugaaguuacaccugauauggcugaaugucuagaguagauuuagacaauugauaggaaguuugggauugaaauacauagaaaaccauaguaagaaaaaaauuaaaugagcauuaccuucagggaaaacuuuaaaaaaauuguucagagaaaacaaaaguaaucauaguuuacuacuacauggcuuagccaugaauaagucauaauaagguaacuguugaauauugugcauguaaaaauuaaaccaaggagaugaagaguaucucuuuaucuggcaaguugauuaaguggagaucagucaagagaagcuuaauuuguaaagauuuuucacaaaccauuugcuuuccugaaaauuuaaacauuguugaagaaaacuauagacucuccacagucuacaguuaaaaugaugccuguauuauaaacaaccuuacauuuacuucaagagccucaaucaacuauuauuguuucugguagaauuguuuuugucauuuuaauaaccccccuaaguauaucaccacucuuaacacauuuuauuaaauauuuaugucuuuuugucuuuaugugguuuuugaagauacuuuuauuaaugagugccuuuuaagugcauuguaagucaccaguuuuuggacauugaacagcuuuaugauauuaggaauaguguugaaauggugugauacaaaugcuugugcaccaaguuucacacuugaagacucuucagacuugacgaaguccacuuuugugaaagcugccaauacacaguccuucuggccaacugcugggucucugugggacugggcugccuaggagguagcgcagagucacuacuaccacugaguagccuuuuuauaucuucacucuaucucuggacugauaaccuuuuuuaaaaaaaaaaaguuuuagaagacuuuuuauuauggaaaauuucaaauguauacaaaaauagagauaauaauguaaugaacccucuuguauuuaccacccagcuucaacaauuccuaacaguuuugucuuacgaauucuuauacccucugagauguccgucaacaaucuuugccuccugguauugacaccucuuuguagucuccaucuugcacuaagauuggucugugugagcaauagaacauggugcaaguaaaauggaguaucuccuucaauauuauguuaucaaauaugcuguggcuuucauguuggucuuuuacucuugcugugaucauuugcucugggauaagccccuggacacaauaggugcagcccuaugucgacacccgugugguuuauggcuuuuugugaacaaccaaagaaguaagauuagaagcauauucuccagccccaagcaaagacaaaacauuucuaaauauuucaauauguagcucugaaagauaaggacucauagaaaagaaaaauaaaaaugauuauaccauuuucaccccuaaaaauaacauaaacaaugauacuuucauaucauaaaauacccaguuaauauuccaacuucccuaguuaugacauauauauuucuuuuuuuauagcguaggugucaggaucaaaauugcagcugguggauauucucuuaagucucuuuuagucuguagguuccuucucuguuuuuuuuccuuacaguuuauuauuugaagaauccagguagaaugccuuacaucuuuucucagccuacauuuugcugacugcaucacuguggugucauuugaacauguucuucaguucccuguccugugaauugguaguuagaccuaaaggcauaucguaccaauauccuuaaagucaaguaaauugugugguugugguauuaaaggugugagaucuggcccauaauaugcauuguuauuauggacagguucauuacauguuucauuugucuacuuucccuuuuuguagcuccuguuagcuaggcauuaagugcacuaaggaagaaaauauguuaucaaaguugaugaugugaaugcugcauaucaaaacuugugaaauguagcuaauuccaugcuuaggugauaauauauaccuuuaaaugcauaugacuuuuuuaaaaagaagauggaaaguuacugaacuaaccaucuuaagaaauuagaaaaggaacacauuaaagagaauaaguagaaggaagaguggaaacuuaaaacuuggaaacuuaggaaauaaaaacguacaguagaggaacagcaaagucaaaaguucaugggaaaaaaugauuaaaaaaugauaaaauugacuaaucaagaaaauaagagagucacaaauccauaaaagguggcgucauuacagauccagaccuuaaaagauaauauaucacaaagaugagaaauuauaaaguagaauacaaacaucgaguauagaggcucaacaaagcugaaaguucuuuggaaaaaaaucaacaaaaucaaaaaacgcucuccuaaauagcagauaaugguaugaaaaagacagcaucccuacacaucuugcagacguuugaaagauuauauguagauuauaugagguuuuuuaaaauagucaaacucguagaggcaggguguagaauaguaguugccaggguccgguggcaggggagaaaugaggagaugcugauuagugggcauaaaguuucaguuaugcaagaugaauaaggacuagauaccugcuauacaguauugugccuguagauaacaaugcugcauuguacccuuaaaaaccuauuaaaaagguagaucucaugguaaguguucuuaccacaaugacguaaagauaagauuauaagugaauauuauaaaaucccaauuuuuuaaaauuuagaugaaauuaguaguuccuagaaaaauauaacuuaguaaaauugacaucagagaaaagaaaguauaaguucuauagcuauuaaguagaauuaauuauuuaaaagcauuacacacagccgggcgcacugacucacgccuguaaucccagcacuaugggaggccgaggugggcggaucaugaggucaggagaucaagaccauccuagcuaacauggugaaacccugucucuacuaaaacuacaaaaaauuagccaggcgugguggcacgcaccuguagucccagcuacucaggaggcugaggcagaagaauggcaugagccggggaggcggagcuuguagugagcccagaucacaccacugcacuccagccugagcaacagagagagaccaucucgaagaaaaaaaaaaaucuuuacacacagacauucacacaguuagacauaaacacagacuuccaggcauagauggcuuugccaaugaaaaugaagcaacauaucaaacuuauuucaugaaaucagcaugaucuugauaugaaaaucugacaagguuauuacaacaaagaaauauuacagaccaguagucucgauacagaugcagauuuauaagugaaauccagcaauauauagaauaaaugauacauuaaaaauaaauugguuuauuccagacaugugaaguugguuuaggauuugaagaucauuuagauucaccacauuuauaggaaaacaggcgauaaguuaugugaucauuucauuagauacaggaaaaacauuugauaaaauuugucacugucaugauaaaaccccuuagcaaacuagaauagaagggaacuucuuuaaucugacaaaagauuucuagaaaaacaaaacccucccagcaaauaucuauauuuaauaauaauguuguaagcuuucccuuugagaucuggaacaugacacagaugccuguuaacaccacuucuguucagugucuuacuggaggucuuagccaguguaaggaggcaagcaaaagaacucacuguuaugaggacuggaagagaggaauuaaaauuuauuaaaauuuauuacuuuaagaaguucauuaaaauuuuauuauuugcaguugacaugauuguguauaacaaaaauccaaaagaauuagaggauuagaauaaaaaaguguuuagagaccggucacggugacucacaccuguaacccuagcacuuugggcaccugaagcaggaagauugcuugaguccaggaauucaagaccagccugagcaacauugaugagaccccaucucuacaaaaaaauuaaauaacuagcuggacacaguggugcaugccuauagucccagcugcucaggaggcugaggcagaaggauaacuugagcucaggaguucgagauugcagugagccaugauuacaccacacugcacuccagccucggugacagugugagacucugccucaaaaaaaaagaaaaaaaauauucaguaagguugaagguuuuaaggucuauauuaaaaagaaaaauacguuacauuucuauauguuguuuucuuacaaaagcuagaaaauaaaacaauuuuaaauauuacuuauaauguagucugaaaauaucaaauauccaagaaaggcucuucagaguaaauucuaaagcaaagaaaaauuaaauaccuaaauaaauggagaacuaucccacauucauggggucagacuccuuaauauuauaaagauguugguucuuucuacauucauuaguagguuugaugcagugccaaucauaaccacguauacauguguaauuugacaaguugauucucaaaugugacuggaaaugcaaagaccuggaagagcuagacauucuuauagaauuauuaagauuucuuagaaaacuguaauaauuaagauaaugugguaucguugcaaggauagacaagcagaucaguggaacacaauagcgaguucaugaccaguucuguacauacuugaacacuugguuuaggacaacgguggcacuauguggcaguaggagaaggaugaucuucuaaaaaaugaacaaaugaaugacgcugggucaacuugauauaauucaagacaaaacugaaacugcaucuuuaccucacaucauacagaaaaaucaauuuuauauguauuaccugaaauaaaugugaaggcaaaccagcaaagcccuaaaagaucacauaggagaaaauaucuuuaugaucuugggguaggaaaggacuuuguuuuagguguauuuguacuagauggcuggacuuuuuuuuucuuuuaaaugacagccuaccauuuauuuauuuaauuuuuugcuucucucgugcucauguucauaggcagccuaccauugaagggacucucacucuguauauacacacauauauauuuuugagagacagggucuugcucuguugcccagacuggagugcaguggcacagucacagcugacugcagccucaaccuccugggcucaaacaaucauccgaccucagccucccgaguaacaaggacuacagguacacaccacuacacucggcuaauuuuuuaaacguuuuguagagaugggggucucacgccacguugcccaggcugggacuuuguauuuuaaauuuaaucuuugguuuuuaauagaugacuuuuguguauauuaugacuugaucuacauguauuaugacuugauauauuugaacuucuuuuagguugaaccauaugaaauugauauucaaccacuuuugaccuacgaaaaugacaauuucauaaaguuugacuuaauaaaucuugcuuucuguuuaguaucuuuuucauuuuuuuccuccuuuccugcuuuucuaauugauacaguuucaacugguaaaguuuuaguauucauguuuuucugucucuugguuuggaagccguacacuuuuccuuuauuaguaagaccuagguauauuguaauugucaagguguagauuuaucuuuauguaucuacauguucagugcacauaguauacuuuugaugugagcacugauauuauucuucaauugugggacauuccuagcuguaaucucaaauacugcugcuucacuauuuccuccaaucuguucuuuuggagcuacuuauaugcauauacuagagcuucucaaucuauacucuuauuuuuucucuguuuguuccuuuucaaauugucucuagguaaauuucucauuaauaucuugauaguggcaaaguccaagucuggcucugccauuuacuggcuaugugguuuaggacaaguugucugacuuuucuauaccucagguccuuaucucuaagauaaagagaauuacaagggugguugugaggauuuguaaagugcuuugcacacuuccuggaaucuaggauacagagaaggccucuguucaaggagugagcuccaggucccuguuugauucucaggagaagcugacuccaaagggacuuuuccaucucuacuuuuuuuucuuuauuuuucuacucauuuccugacuuccaaagcagauucacaaugaaaugccaagugguaaauauuagaugguauuuucuucagccucagcuaugcuggacagagguaguuagcugcuuuccauuccugcuccccgagguggaaggaagaauggugugggauggcccuuggagugcagcuuuuucaccaccuuuuggaacccagagaaaccuugcuuauguucuaagacaugggcuuaacugguguguagcuggcugugcccagaucuuccugucugccaauaacuucuacugccuuguacagucucuaagagcauguuuccugaaggaaacuggagggaagaaugacauuauuacacuguucagaagaguuaaauagaaguaacagucccugaauaacuuuucuaaugugugaucuuagggaaggaaguguaagacagauuccaaaucaucuaguaagccaaauccauccuauauaguuagucuuagauauuuaaaaaguaauuuuaauagcauuuauugaaugcuuuauuauauaccaguguuauacacauugucauauucaaacaguugggcaaaguaguaguaaugugcucaguuuacaaauggggaaacuuggacuuagggaaauuaaaugauuuguccaaaguauaguuaguaagugacgcaagugaaauuugaaccuaggucucagggacaaaauaugugcucugaaucacuaugcuuugcccuuaguuuuaugguuagaucuuaguugaucuucucugaaugagaguguacagaggagaaauuuuguaacauugccaaacacugccuggcagguagccagacaucuuaugagauauugaguugucauugauaaaugcuagugacagaugaaauuuaaugggagaaaaagaauacauugaaaaucauagcuugaagggacauggaggagagcauuggauuauacaugcauagucaccuugauguggaaauuucuugaaaauucuuuucuuggcucuucuuucauacuauaguucuugacauauauauggaugauugaugagcaguauaaguuuuaucauaauuugcagauuuaacuuguaguucuguuacuuacuagcugcuaucaugagcaaucuacuuuauuuaagccucaguuuccucaucuguaaaauuuggagaguaauuccucugucuuaggguuguuauaagcauacaugggauaacauauuuaaaccucuuaaugcaguuucaggaauuuaauaaaaagucaggaggacccuuucaggccagugcccugggauaggauaaauagaguaggacuuuuuuagagauggagucucacuuuguugcccaggcuggucucaaacucuugggcucaagugauccucuugccacagccuugcaaagugcuggauugcagacaugagccccugcauccagccagaguaggacuauaacaauugaaaaauauuaguaauaguaaauaccaagcgacuucuguaguucuguauuucugaauuguuagguacagucauguguuauuuaaugacugagguauguucugagaaauaggucauuagacaauuuugucauuguguaaacauuauagagugcacuuacacaaaccuagaugguacagccuacuacacaccuaggcuauaugguauagccuauuacucccagucuauuaaccugcauaguauauuucucuacugaauacuguaggcaauuguaguacaauaguguuuguguaucuaaacauagaaaagauacaguauaaauaugguauaaaagaugaaaaauuguacaccuguauagggcacuuaccaugaauggagcuugcagaaguggaacuugcucugggugaguaagugagugcugagugaaugugaaggccuaagacauuacuguauacacuacuguagacuuuaucaacacuguacacuuaggcucuucuaaauguauuuugcagauuaaguaauuacgcuaguauguugaugguggcuacagugacacuaggccauagguauuuuucaguuccauuauaaugauaugggacuacugucauauauguggucuguuguugugggggugcuauugaagcucagcggggugaaugcccuggguauccaccacauuccacuggcaaccgcacaguaugagggagaggaaaacaaauggaagcacacuggaaccggggagggaaguuucuuccuccugcauugucccugcagcaccuucuaccuacagagcuuaggcaugccucaugcauacugcaaaggagaaaagcuuauaggggccaguuuguauguauauauuucaauagaaaguuaagacucuucccuuucuuccuaaccuauaccuugcuguuaaaccuguauguaacuuuuagaaauuagcauaaacuggcggagugcaguggcucacgccuguaaucccagcauuuugggaggccgaggugggcagaucacgaggucagaagauugagaccguccuggcuaacacggugaaaccccgucucuaguaaaaauacaaaaaauuagucgggcgugguggcaggcaccuguaggaccagcuacuggggaggcugaggcaggagaauggcgugaacccgggagguggagcuugcagugagcugagaucacgccacugcacuccagccugagcgacagagcgagacuccgucucaaaaaaaaaaaaaaaaaaaaaaaaaaaagcucguuuucauaacugaggauaaaagucucacuugggcaaguguggaagaaagcugcuuccugaacauggccuguggccuuucugcucauccucagcucuguguucuaugaacccaucccccuacccacuucaaaccccaaaacacaaaaggacaggugguuucuugauuggaaaagcuuagcuagaaugcuaaagggcucuuugguucuucucaagugccuuguggcucuuccagguuagggguguguguuuguguguguuuguaccuguucugagguuaauuaugguuguuuaauauuuucucuauguuuccucauuugcuuugagagaauauuaauuuaugaauuuguuauggucucugauuaaccauuugauuuaaaaaauuauuuccuuuuuaucaucuguucuucuggauccuaauauugcuucucucucugauucuuccauccaguuucuuucuauuguucuuauaaucuuacaaucuuacuuccuuuccauacaguuuuagaauuuuauucuuuaacauauuauacaaguaguaaauuuggguuaucacuucucuucugcagaaccugcugucuccacauuuuucugucuuccuuucuguuuccuagccauagacauggcuaacaguaccauuuguaucuguacaucuuucaugcaucacuugauuuuauuauuuuauuuuauuuugguaagguagcagcuauauagccaccuuggcuguuuccugcuucccaauucuacaauaauaauaaguaggauucacuugggaaaagagauuguauguguggcauaauaagauucagcuaaguaauggaagaaacucuuuuucugacccccuuuuacccauacauaggccauuccugacuucagagucuuauuccaggagucugugcaucaggcauuccagauacagcuugcucagcuaugauguaccugaaacuaguacuaauuauauacauaaauauucuagccaccauuuauaacagaguuuugaugggaaacuauuuucagaaguauuauuaggacugcugaggacacaucuuuucccccucuagccuagucuuuugggccacaccucuuuagccuagacuuaggaggagggagcugcagacaggguggcaggcugugugggccuucuuguggugguuagagugaacauagggagcaagcagugaaguggaaaugaggcuguggauuuucuggaucaguggguagagggaagguuacuguuaguaggagacggagaccauccugugaaaggggucuugggaauggugaagagggagagaggggcugcaguggaauauaucgaaggacagggacagcuacuuguuucuccuugucuccuggcagaaagaaaggacaagggcugauggggccccuacgaugacuucuuucaacccuuuuaccuugucaucuuuuuacccuucgcuuuuccuuuucuuccaacugccaacuggcagcccuaggguagaguguucgauaagaaguuacuucaacagcuucagaagaggagucuugcuuguguuuucuucauuuccuccccauccuucccuuuucccacucccacugacaggcgauuacaguugagacuggggaguggaaaguuugaggagcuugagagagagcagggaauaaaggaagaaagaggaggguggagcaacuguuagaaucggggauaccugggagauaauuauauaugcacuguuuaggggggcuuauguucuaaagcacaucccuugaucucagguuaccugccgcuguuacuguucucugauaggcuguuaucuaguaauuucaucuagcuaacaagguugaaagaagagaccauguugccuaacaaagugcuggaaacauacaauuauuauguggauuuugugugcauaucuuuugaguguguuugguauuucugauuauugcaugcucaggcauaaauagucuuuagugaacgagauacauguugauauuuaauuauggcgguggccccaucaagaguuggaacagcagggcaugggcuguggagucuucagucagguucuguugccuccucgcuaucccugcccuguuucucaucugugaaauguggcuccaagcauccgucuuauagaaugacuaggaagaguaagagccugguacacgauagguacucacuaaauauuucucuucuuuuguggaagguauauuuuuguuuagauuauuaaacuacguaaacuccagugguucuaauucuuugucuaauagggucuuugaaauacauucaguuuugggcagauaauauagcuuuauuucauucuccauuaaaaugaaucaccugaaaacauucaucaggaggaaguaccuaauuuuaagaauauaaaugacaucuuugaaauaauuuuaaucuaaauauaucacuuuaaauaggugcuauuuauuaaacacauaacauuaaccaagacuuaaaugaaaagguaccaaggaucccaccacuagagcaaacugcuuuuauuguucuaucacccuucuaguccagauuccuuuauuaugcaaucuuaacagucacuuuuuauaaaggcauuugcuuugucucuagguguaaaacaaagguguauccagauaaucuuccuacaacaaguguggugauuguuuuccacaaugaggcuuggagcacacuucugcgaacuguccauagugucauuaaucgcucaccaagacacaugauagaagaaauuguucuaguagaugaugccagugaaagagguaaauuuuaaauuuuaaugccaauaauuugcuacaccuuuugucacuaacgguuaaaacuaguugcuauaauuuuuaaccuaauaauuuuauacaaaauucuaauuuaucccaaaaauauggcauuuggauucauucacauauguaaaaaaguacacccuugugaaacuuaaaauauuacuuuaauuaguaauuaauuuaauuuguguguugcaucuuaaucuuguuucaaaaagaaauaaugcucuauaacauaaacuauuaugcaggacagugaaaaaacucucaucauuuuguuaggauuuucucugugggaagcugcaggacugagucaguagagagagacuggauucugcuuacauccaugaauggagaaauguaguuccauguuuaguaggaaauaucucugacagcaaaauggagcuuuagcugggugaaccuuuguucuccagauuuuucuuagguuucccuauuuucuccauuucuaaguuucaggaaugaucuauagcuaggugcauaaaaggauuaggaaggaugaaaaggugggauguaauaugacucucauaguaaaucucuacagacucuugcccacguccuucuaggagucucagaauuuuucacaaggcuaaaaucucccaaacuauuucaugaaauacucuuugggaaaggacauauuaauuaaugguggcuuggucaauauuauuuauucugaauccuuacuagagauuucacacuacagaguaccauauagaaaaggcucugcuuaguccaucaguaaagaaacuugcuuaacuuagauacccaguauuuccuaauuuucuuauucauagcucaucuguuuaggaaucauuggugucauguguuccaccaauguuccuguguucgcaugagaaaaauuuagagcuacagaaaauaauuuccuacuucuuuucuuccuucaucagccuuaaaugaucuaccauuuuaaccucuuuugcuaguaucuucaacuuucuugccuauucucccauugcaucugcuaugauuuaguuaaguaucauacuuucuccuuccuguguccacacugaauacaugcauuuaaccgaaauuaaguuuauucacaucaaauaucaauuauuuggaguaauuaauacaauaaaaacaauuuaaaucuuauugcuuugccaguuuauacaguugcacaugaagaaaaggauaaauccuaccuuuuaaaguaauuuauaucuuaccuuuuuaaucaaauuaaagagauacuuuauaaucacacaagacauuuaaauaguauaauacauuauauaauuacaugucagaaggaaugagagcaguuaagaauaccacacguaaagaaauaauuguugacaacagaaguauaaaccuuauguggauaaucuauuugcuaggacuuaaucccucuguaagaaaauuaaccuaaguuaauauaaggaggaauauauacaaacauuuauccugcaaaugacuugugcuugguuuacuuacgugucaauauuugcuagauuaaauauauucuuccagaagagauacuuaaccugagauaaaaugaauuauuuuuucauuuccuccuuuguuuuucucucucguucugugaaugcccaagaaggcuguguagaauaauaaguuuuuguagaauauggccuaauuuaaaaggugcagggucccacaacaagugacagagaaacucaccuauagcaguucucucuuuccuuucccucaugcagcccucacccaacaccccaaucuguguacaucugugagaggaaacuggugugagcagaugucuaccucacugcuccaccugaggcuuagucucuaggcaggguccuggagugccgcuccagagucccugcucaggggucugauucuccuuuaucuuccugccuuggaagccucaaauauccggguuaccauuuccgguaucugggagacaguagaucuuuguuuuugugguuauaauuugcagucuugcuuuccagguugagaaucaucuaauguauuuuucuuuggcuccauuguuuaagucguaauuguuagacccagaaaccagagcaagcuguuugcuuuuauguaacucuuuacaucugcuuuuuuuccuauucaugagacacaucuaaggcaccaucauuucucaccuggauauggaaauagacuaacuagucaaacuaauguccccacauacucuuacccccucccaucuguucaccauggugccuccagagugagcuuuuuuaaagcaugcaaauuugaucauuucgcuuccaugcuuaaaaccccuccacuaaggccuguaugaccuggccccaccuggcaucuccagucacaucuugaaccauucccauacuucuucccucuguccaguuuucuucuuucaguuuguuaaagaauaucauccuucuuccuaucucagggccuucaauuguacugauuuuguucccucucccuggaacauuguucucuagggaacauuuaucuccaccaucuccccagcacuguuaacauugaaucauccaucagaguucagcucagaugugauguauuuagagaggccuuucuugaccucuccagaccugucacaucccucugaaaacaucucauaacacucuacuccucugcagcucuaaccaggguuugaauuacuugucuguuuaauagauaccuucccccaguagacuguauacuuugucaggucuauuugcucaccauuaucucuucaguucccacagugccuguuauauaacaacagucuagaauuauauaaugaaugggugaaagaauaauguacacugguauauuuaaucuucacauuuacuucuucucugugcaaacuuccuaauuggguuguguagcauagauagugugcccauggccucugaauacuugauuucaaguuaaccugcugaguaacucuauuuauuaaagaaguaugaaguaggugcuauaauuauuccuguuuuauugaugaggaaaaugaggcuuagcaugguagaggaguauccaaacccuguauaaauccagagccugaccucuuaauugcuguguaccucacuucugauugcuucuggugcaacuuuacuguuacaggaucuguaauaaagucagaauuuggacgaaucccuaguuuaugucagaaguuauguaauuuucaucucagaaaguuaucuuaagacuuagaauuuauguaauguuucuaaucugagaagacuauuauuuuuucauuuuauacaaaaagcagagguuuauauuuaguagagguuaggaguuagauuuauuagauucugaauucuuuauucuucccuuuauucuucucuacuacuccuuagaguuuuggcuaauauuucucagacauugaugugaauagugaaauuuuuuccugauguucacacucucugacaaccucacacucugagaaaugcauagggauccauuuauaggccaauaguuauaaagguguccuaagaagauucucccuuguuuuuagauguaauaguagcuucuaacuauaaucucuuaacucauggcuucauuuuuguaaaaugagacuuggauaauuccuaaucccccacccaucccugaguccauaauucuguaucgacugaaaagaagacaccuauauccuaauguaauugugugaaagcaacaaagaugucaaacaaagaugccaagaaaauuuguggaagagcaaauuuugugaguuacccgaccacagaaucaugcauuuuuuuuuuuaauuuuguucauaaacaagacaguauagcuuucaaagacauaugggacuuggggauuagauugcuuuaguucugaagaaacguuuuaaacuaauauuuuuggaaaaacuuguugggagacgcauuguuuaugacacauccagucuugauugaucuaagguacuaaaauauaucuuauacccuacugcaugaaauucuaucaaauucuggauacaaaguauuuuaaauuugugcuugaucaggugcuuccacagaccugaauuguucucucuauagaguucccuucuaggauucucuuguuguagauaaaaagaugggcuuuaaagucaggcagaccuggguuugaaucuuggauccaucccuuaagcuguaucaccuuaaucaaauucauguaauaugcugagccuuagauuuucauuucuaaauuaugcauaauaacuucauagggucauugugagcauuaaaugagauaaaauauauaaugagacuagcauuacauauguuagcauuaugcuaaacagacacaaaauguuaacaguuacuacaaaauguugcucuucucugggauuggcacuacccuuaccuuuuuacucagaaucaauuuagauccuucugacccuaagacuugguucauaaaaucacagugauaucuuucagauaacuuuuuagcucaaauauuagaaaauauauuagcagaaaugggaaagaucaguguuuugguguagugggacacauaggccuuucucuuuuacagcuuuuuauaucccugauuauuucauuauugagucauuuugucuuguugagucaaauaggcaagaauuguuuuacucccauuugucuuuuccaccucacuauguaggaagccuuuuggaucucuacuuuuaguauuuaauuaauagauaugaggauaaucucucuagggguuccaguaguuccaucucaaauauuuucuucccuagagagauuauccucauacuuauuguauggugacuaguuggaaaggcauuuggccauauuaccaccaauagcagaguucucuagcauaaauucuguaaaccaaccugaucggaaaaauguuuucucuuugcuuugaggaaguugcaccuuuucugcuuuuuaaagucaguugugaacuuuggagguaagguuuaucuuauccuauaugcuugccuguguccugaggagcauaaccucuuaucugaacucuccaggauagcuauugauuucauacacccacauacucucccuuuccccuuuugcccacuuuuucucuuuucuucuucaauugcccuuuccuuuuuaaacuuuuuuucuuacaccuaauugucaguuuaaggaucucuauuuggccuugcaguuaacaguccagcauuucuuuuccaagugugaccccacuuucugcccccugauuaaaaaaaaaaaaaaaaaaaaaguauagucaaagaccaugguaaucaacaagacaauuuguuugugcuucugaggaaauuucacaauuuucugaacucuacagcuauuacauauucugugucuucucucuguugaggucuggauuuaaugcuuucuuuguauugcugauccuuaagcaugauuagagaaagaauugagucuaacagaguuacuuagcgaaacauaggagcauuccuauccuugguuaagucugagcacaaaggcauucuccuaauucugcauauaauaaaauagaggcagcuguaguccauucucuuggggaauauaaaggcuuccuuuagcagaauggguuuaugagucagggagccucacugagaguguucaguaaggguauguugaauaaauuuuccaaaucaaaauuacuuucaucugaauagugccaggccacacugguuugcauguuuucuuuuguucauuuuccagacuuuuugaaaaggccuuuagagaguuaugugaaaaaacuaaaaguaccaguucauguaauucgaauggaacaacguucuggauugaucagagcuagauuaaaaggagcugcugugucuaaaggccaagugaucaccuuccuggaugcccauugugaguguacagugggauggcuggagccucucuuggccaggaucaaacaugacagguaauuuucuggugucuguaaguuugcuuuuaguacauuuguccuaaacuauauggugaguugccaaauucuauauuuuuuaaauaaauauaaaaguaauuuccucccaaguuugcuuuaaaauauccgugaagaggacucuaaaggaaauauccagaagaccacauucugaagccuggcaggaauguuugcaaacuguuguacuaaugaggagugauuaggaagcaugucauuggaauguauacuauaugcuguguucaccaagcuggagcagaacagauagauggugaacucagggaagacagcauaaaacccuucacuuguccuugcacucuaaagcuaaugcuggagcaggcagauccucucagcuuguagugcagcaagaaguagaagagaauggagagaagcacauuguguccugaaaugcuuaauuuuguauggaaagcaccauaaucuuagauaauacaggaagaacagugguguaaugaacaccugugguuauaguuuuucauguuacacauuuuucaaagaacucccuauuucuggcuuaguucuugugcaucaggagagaaccugacuucagucugcuagaccuauguugguugaauuucugcuugucauuguaauuugagguagagacuguccauguuuagauuuuaguggagugaacuuuuacuagucaaguggaacacggugggagcuaaagccacagcaucuauucuguuugauagcaaaugcuggaucuauauuuuuucccuuucaaagaugaauaaauaggaaaacucagcauugggccaaucaaugggaaaguagagcagcuuuagaaaagagaacauugcccugaagaaucaaaagaauaggauaucuguaaauuauuuucuuuaaauaauagaugacguuuuagggaauauuugcucgccugaagauaacacacaacccauagagagaaagcaaggugaggugaugacagaaguauggaagggagucagcugaaauagcaaccacagugacuuccaguuugggcugcaugguggauucgauauucugaauaacuuuuccaacugaaaaagcuggauaaaagacaaaacaaauuuuaaaugcaucauugaguuggcacaaaaggaagaaauuugcaaaucucgaaaagaagugagagcaaaugugcaguccaaacacuaaagccagcuuucgcugguaggguuucugcugaacuuuggggucacuaagcuucugccuugagagacaaauaagauggaaggauaggagacaaaaaccuagguccugccucaggugagaagguuaauagcaaacaccuguauaaagcugggcucuugaaaucuguaucuuaguauaaagcaagaaugaaaaauuaaucccaccacaucagagaaaacuugccugucucaaccuugguaugcaguggcagaggggaaacaaaucuccccuaagaauuuguaaacaauauagaaaaagaggaaacgaaccaaacucuuuuuaugaggcugguauaacugugauaugaaaaccagaaaaguacuacaaggaaaauuacagugcaaaucuguucaugaaugcuaguacaaaaaucucacaauaccagcaaacuaaaccagcaauauacacacacacacgugcacguaugcguguaaaaaacauaucaugauaucaugacugcuugguuuagcguaauauuacaaaaacuaauucguuuaauacaucccauuaauguauuuuuaaaacugugauuacaaacuuauuaaacaccucugaucacucccauagauaaugaaaaaggguucacugaaauuuaacaugaauuuauuguuagaaaauacuuagcaaacuauuauacaguggaaguuuacuaauccaagaaaggauggcuuaaaaaaaaaaaaaaagccuuugcaagcagaaaucauguuaauggagaaauguuggaagcauuuuuuaaaaagauguggaagaagauguuaaugcccucaaucaccaguuaguauuauuagaagucuuucuuagguuuugcaguacuacaguaaauaaagaacauuuauuuauuggaaaaaggaaaagcauuguugucaauuguguauguguuugugaagaaaacgaaucuauacauaaaauaauagaaacaauaagaauuuagcaauguugccaaacacgagauuacuauagaaaaguucaggcuagagcaguggcucacgccuguaaucccagcucuuugggagaccgaggugggcagaucacuugaacccaggaguucgagaccagucuggccaacauggcgaaaccccagcucuacuaaaaauacaaaaaauuaggcagucgugguggugcaugccuauagucccaacuacuugggaggcugagucgggaggaucgcuugaacucaggaagucaaggcugcaaugagccaagagugcaccauugcccucuagccugggcaacaggagugagacuccaucuccaaacaaaagaaugaaaaguuuauuucacaccaacaaggaauacuuagaaaauauaaugcaaaaagaaaagauaccauucguaauagcaauggcagucauagacuacacauaggaauauguuuaucaaaagauuuacugaaauucacgaaaaaaucuugagagagaaauggauaggaaagucaauaucauaagaguaucaauucuacccaaauucauauauaaauucagugcauuuccaauugaaaucuccacagaauuuucuuugagagacuguacaggccgauucuagcauugauacggaacuguaaaaagaaaaaaaauaguugggaugcuucugaagaagaaucagaucuaagggggcuugccuuacuaggcgucaagacuuauuuuaaagcuguguuaauuauggcagugguauauugaugcaggaauucacaaauagacuagugaaacaggguagggucuagaaaccagcucauuuuuguauguaaucuugauuuaugacagagcagucacucauaguuacagcagaagaaaaagggaccauuacauaaauagugguggaacaacugguuauccauagaagaaauaaaugaaguuggauacuuacuguauaucauaguuaaaaucagucccuugaagauuaaagucuuaaauauaaaaaacaaaaaaaaaauuuuuuuaauuaguugagugugguguuaugugaucccagccguggucccagcuacucaggaagcugaggugggaagaucacuugaggaggucgaggcugcaguggccccugauugcacuacugcauuccagccuggguggugacagaguagugauacccuguuucaagggaaaaaauaaaaaauaaaaacacuuacuauacaauuguucuguaguuggcauuaaacaggaauguuuugaaagauuucuuaacuugcuuuuaugacaucaggagaacaguggugugucccaucaucgaugugaucagugaugauacuuuugaguacauggcaggcucugauaugaccuaugguggguucaacuggaagcucaauuuucgcugguauccuguuccccaaagagaaauggacagaaggaaaggugaucggacucuuccugucagguaauuaauuugucagacauuuugccuaaaguguuauuggcagaagguuguggagcuuugggaaucauaucaaauggauaaguguauuuugagaaacgugaagcauucguauaccuuaugguaguuaacagccaucuuucacauaugugaguguuuuaaagaaggauuucuccucuaauaaaauuagaaauuuuugcuuauucuauaaaucuagugcacaugagaaaugaugacaugcguguuuuuucauuccuuuaugaacauuuugcaaaugcgucagaucuguacuuuaauucaguuauuaaggauaauaauacuuagcuuaauuaauugugucaguaugugaagauacuaccuaaaacuggguccuugcauuaaaauguacaauuuuaaauucagacuuguaccaucuggaugacaguuauugacugguaaaguuagaaaagcuuguguaaaacauaaaaauagcuagaauugacacaaaauauaaaaaaauucauuaauccauuuauucucugauuuuuuuucucuacuuggucauauauagauuuuuuuuucaggauggaauaaaaaucuucaugcucuuuuuagaacaugaaauugagaccuuugagcucuucugagccauccuagaauuuagccccauuguaccgaccugcuacuucuguauuaagaguuccuucagaaccaggcuucagcuuuucuguuuuugggccuccugcgucugccuucccuugaauucaaguucaguucuggcaacacugaagagauuuuccacugacugugugcuuuuuuccuuagccugaguucuuaguaguaguagugcaagggacuuuucuucucuuuagcuguuagugcaauucacuaucuaaaucagggguuccuaaacauuucaaaaaugacaaaauuuuuugaaaaucuggugaaagcuaugggucuucucuaauggagaaaaaugcacauguacaugcagaagauuuagcacacaaaaaacucaggucaagaaaacccuguauuaaaugauaauucugaauuuuggcuguuucuuuuaaauccuuuucucauucuuuuuuucuucuaaaaucaaaauaaguccaaaccuuuuuuggaaacaacuguuuccucuggaaaggcaaugaguacauuuuaggguucaucuuaaaauauaaucuucgugguaucuuuggucccuguaacuuauuuuuuucuccugguuggaguuuacuuuuucuccauacuuguucuuuauaaaaaucaaaugggcugauauucauuuauuuaaaucuuccuucauuucuuaauaauuucucugcuuaauuucacauguucccacucccuuugcauaccugagcccuauuuugaugaauuagacuccucuuuugcagaaaauauaccacacagucaggaaggaacauauugauuuuauucuauauuuugucuccucuccuuaaagauuucuaguggguauuaggaaaagaccucacuguuuccauccaguuuaucuuauguauuuauacuauuugccacccuuuagaacauggcaugguaacucuaaccucaaucuacuugguuaauauagucaacugccuugaaguugcuaggaucuguggagugggugcacagucagauggagaggauugugaggaacagcuuuaauuuaaggaguuugagaucuaaacucaguuaggaccugagggccaagaaagauagaaaguacucuuaggacugugacagagagggaugucugggcagaagcaugacacagcaagucuagcagucagcaugaccauggugcaggucaugugugaagaccaaauaacacagcauaaaacacagaaagccccuggggcguaugaaaguuuaugaagagugugagaauaaguacuuacucaguaguuauaaauaguuaugaaacagcuuuuaaaaacaaaaacugauugauuguaaauuuuaaauugcuaaugguauagcauuauugaauuucaggacaccuaccauggcaggaggccuuuuuucaauagacagagauuacuuucaggaaauuggaacauaugaugcuggaauggauauuuggggaggagaaaaccuagaaauuuccuuuaggguaaguucccuuaaaaaaauuuaaucuuuuauuuaacuucaaguauagaugugcauugauuauucauguaucucuacauaaaaaauaaaaauugaauuuaauacaaguuuaauguaacuucagagccuucaguccauaaaaaggacugauaguaaggguucauuauaaacuauugaagcaaauaauuuaguuaccuuugaaguucagcuauaaaacuuacacaagauucccuaguuguuuuuaauuuuuauuauuuucaaggaaguaauuuaagcucuaaaagcuaauauauaguuuggauaugcuacuuugcugcuuuacucucaaaaacauaaauuucacauuuaaacauaaauuucacauuuuguaauaugcuuuuuauuuuagugugaaaauuuuuuuuauauaaaaccuagucacuuuaccagcuuuauauuuuucaauaaaaaugcgaaagaauucuaaaaugacucuaaauuaauuuaacccagucuacauauaaagucuuugcauuucauguucacuagaaucaacauaucguuuaaauggcauugcauauuuuugcaaauaaccaacuuuagacacauagcuuauuauaguggaaaucacacugacguguacuguaaucugaaccagcgagcucacuuuguucccagugaaucgcuuugccuucuugucaaagagaggguuggacucaauaucaccuuggagauccuauccagcucuaacacuuauaauccugggaaaacuugaagguaggaacacugaauauuuaacaaaaucagaacuuuccaaaauguuauuuuaauuauaaagaguuaugagauuuuuaacuugguggggggaauguauuuugaaagaaacagaaggauuucauuaaauuaaggauguaagcccauacuugaucaucuuucuucugccccuuuuuuuguuuuuauuguucuaacaaagacaacaaaacaugcuuuuacugucucacugaagaacuuacaauggaucuaguugagauuccuagguucuguuucauguacaagccgugacgcagguuuggagaggggugaacagaugagcaucuggcugguuacuccauggucagguuuuguuuggugguuguuuuuaaccaugagccacauuaauaaauacauuauacauucugcacacacaaaacauaaaauuuaaacauuuuaugaaacaguauguccuuguuaacaaguacagguugcaauucaucaauuugaauuuaugauucucuuagguauaauggccugcaguuagaaaaauacugcucuagaucccauaucuuuucuguauuuagccuuuaaccuauguuuucuuuauuuuaaucuucaacuuuugguuugaucagaacccaaauuagagaaauguuucucuugaggaagcacuggcuuuguaaccuaaccauacagccggagcccaucaugugccccugauuuugcgaaauuccaacuguggaacccaauagaugucaauacuuuuuuaaaaacuaucaaugucauauauggucuuugcuguuauuuucagauuugguaguauggagguacuuuggaagcuuuuuaccaguaacuacaauauguuccauuuaaguuuaaacaaaagccaaaccccuauuuaauugaaaagaaaaauacuaugggaaaacuaaggugaacauuuccugauuacucagcuacauguuacauggucaucucugcuguuuucagauuuggcaguguggaggaacuuuggaaauuguuacaugcucacauguuggacauguguuucggaaagcuacaccuuacacguuuccaggaggcacagggcagauuaucaauaaaaauaacagacgacuugcagaaguguggauggaugaauucaagaauuucuucuauauaauuucuccagguuagcguuguuuugcauuagaaauacaaggcuguaccuuuguugacccugauccuggaggagaaguaagaagguuagaagugaagcuuugagcagaggugaacaccugccucauaaggucauuguaaggaaugaaugaaaucacacacaguauagaaagugcuuggcagaaugccuagaauaauauauaauuaacaguaauaaauuauccaggucaguguugcuagcccagguuuugcagauguucuauuuuuuuuaaaaccuaacugcaacauuuaguauuuauuccugugaaguuucaucuuguuaaauuuucagccauuuuucuagcuuauaugacuuuuucuugauucuuggaguuuucauucaacauaacaaaaccacuguuuuugcagugggucaugaacguucucuauaagcaggcccucaaugcugucauaggaggcuuucgucaaguaucacaaggccacugagagcccaaaacgugccacagggccuucuuuccggaaacuuugcuauucagaguuuuguaggaacaguuguuccaucagcuauaagucggccugacauuguuacuaguccauccuuauuuuuuaguuacugcaagacugucaaguggcagggugcacaguucagugaguugugugagagaagccugacugcaaacaauugcucuguuuaauauuugagcaaaauagaccuugauuuuuuuguuugugccuuaacauauauugaaguuuacugaucccauaucacuuauauuucauucucacauaaaugucauuuuucucugaaaaauuaaaacacauuuuaauguauuuuccuugcuuuauacuuuugguggauucauggugucuccacuuguauagucacauaucacccagcugauaccacuguucugauucaucuggcuuauuagauucaauauauaaacauguguuaccuaaaacaacacuaauaauucagagucaauuauuucuuucaacagguguuacaaagguagauuauggagauauaucgucaagaguuggucuaagacacaaacuacaaugcaaaccuuuuuccugguaccuagagaauauauauccugauucucaaauuccacgucacuauuucucauugggagagguaagaaauauauauauauauauucuaugugguuauuauguucuuacuuuuuuauuaaaaaaaaauaggaguuaguuaaacuuccaauaaggaaaguaccuucauguuaacauuuaacuucucuugcuuccuuccuccuucuuaccacguaagucuaaacuauauucuuuuuuucccauuccuccucccugaaaguugauuuccacugaguugaugcgccuggagauaagcuguguacuguggggucuguuuuucccuauucugucuauagugauguguuuccuaaacagacugcaccaucugcaauuguggaucuguaaaaucuguauauauauuaaaaaaaaaaagacuucuuugcaggucuuugugaacuuguaauuauaagauggcuuuuagaaaaaaauaugaagccaaguagggaaagaaauccaaccuuuuugugauagaaaucaauagaaggacaauauuuccuuuuauaagucacagcagcaaaugaugauauguguagacagggccacaagcaggccuaccccaggauuaaaucucaggaaaaguggccucccacucugaagaagguugucacuucuucaguccuuucauucauucaacaaauauuugaguaccucuaguauaugacaaguacuguuuuaaguacuaggaauacagcaauaaguaaagcagagauccugcucuuguugaucuuacaguccaugaguaagacagauuaugaaaggcacacaauaugucagguggugguaagggcagaagggauagagaaugacugacaagugagcguggguaguaguacuguuuuauguaaggaaguugaaagaguacggaaguugaaagaguccugucaaggugauuuugagcagagaucugaagaaagugaaugagcaggucauacgaguuuuuagggaaagaguauucugggcacagggaagaacaaguauaaagguuucuaagaugacaauguacuuagcgcguuccagaaacagcagggagaccaguugucuggaauagagugaacaagguggagaguaguagaagauaaggucaaagacaaagugagggucaaaucauauaaagcuuuuagguuauagugagaacuuugcauuuugcauuuuauucugaaucaaauggaagcuaucgaaagauaccagcaaacuuccacuagaaaaggaucacauuguaugcuauguggagaaaaacuauauggaaacaggaguagagcugguguauuguugaagagaguaaaggauuaugucugguuucuaucaagcuugagacacugacuguaaaguugccauuacugagaugggaaaaccuacaggaagagcagaugcucaagggaaucaacaguaguuugggacacaucaaauuugagauccaagugaagauaugaauaggucuuuacauuuaagaauauucacuuugggggagagguugugauagagauguuaacuuagguugucagcauauaggaugguuuuuaaagccacaaaacuguaugaggucaccugaggaggagaaaauguuaaguaugagagagaagaccgaggacaaugccagagggaaugccacaguuuagaaaucauggagaugagaaggaaucagcaaaaaagauugagaaggaguaggcagugaaauaggagaaccuagagaguggugucgccaagacuaagggaaagacguguuucaggaaagaggaagugaucagcuguaucgaauacugcagagaaauugaggaagaugaguacuuagaauugguuauugcauuuggcuagggacauguuaucaguagccuaucucacaguguugagagaguuccccauggauguuguuaaaaacucuguuuugaagagagaauggaagaagcaacauagaugaauguguacaagucuugcaaggaauuuucuuguaaaagagagaagauaaauaggugguagcuggaggagaauaugggcuuaaagggguuuuuauuucuuuauuaagauaaaacugugcugauaugagcaacccaaaagagaaaauuuaaagaugcaaaagaaagagccaacuuaacacccauuagaauggccacuaucaaaaaaacagagaaugacacauguuggcaaggauacugaaaaauuggaacccuugugcauuguuggugugaauguaaaaugguacaacugcuauuuaaaaauaguauggagguuucucaaaaaaugcucaaaaaagagaacuacgauauuauccagcaauuccaccucaggguauguauccaaaggaaaugaacgcagggucugaagaguuacuuuuacuuacauguuuauaacagcacuauucacaauagccaagaaguagaagcacuccacguguccguucauucuggcccagcuagcaaugcuuaggcauuguccaaaauugggucaguucaaaguaaaaaacuccuccuucuugguucuaaagacaagcuacagagugacugcuauaaaucgugauacaacguacaauggaauauuuuucagucuuaaaaaggaaggaaauucugauacaugcuacaacauggaugaaccuugaggaccuuauguuaagcauaauacgacagucaccaaaagagaaaugcuguaugauucuccuuauauaaggcagcuagaauagucaaacucauagaaacagaaaguagaauggugguuaccagggcugagggaagggccuaaagaagaguuacuucaugggcauagaguuucacauuugcaagaugaaaaaguucuggagauuuguuucacaacagccugaauauacuuaacacuacuaaacuguacacuugaaaacaguuuagaugguaaauuuuauguuauguguuucugcaccagaauaaaaagaaagaagggaucuguuguuaugggugucauguauuuggguggauaggaggugaaaucuguacacaaguagaggguguugggugggggugggaagaagagaggucaucucuuaucauggggaggaagguagaggaaugggaacaagugcagggcagcuguagguuuggagguggaaacuggcaguuugugguggaagugugaggaccuucucuucugguggcuuguuuccucaguugaacacaagauuaugggcugagagugaagaagguguuggugagggggaauuggggaaagagaaaaggauguaaaauagaaauguaagauaagggaaagcaaguagaucacugaaggaagccagaugguggagaguuggugaagccaucuggccugguguuuucuucagugccagggcaggcacagacuuacgcauuuauccuaacaguuacuaaggcuacuucaggauugacuugagcucccuaccucugaaccuuguugugauuuaaggaauuuguuuucaaacaagugagggcuacauugaguuucuugagccuuucauucucacugaugccucauuaaugggaauguguuuuccuuugcugugaccucguacuggucaaagaaggcccagggugaguggugcgccagggaaagauuucuagcagucacucugcagcuugucuuuagaaccaaaaaugaggaguuuuuuguuuuuguuuuguuuuuuuugagcugacccaauuuuggacaaugccuaggcauuguuagcugggccagaguucgggcgugugacaaagaaacacuugucugcuccaugguagaugacugccaaggcaagcuugcgucuuaccugccucuugccagcuggcuucugggcaagucgcagcguuuacccucuguggccugcuuguuaucgccuuauuaacuuaacagcuggccuuaagccuuguacgcccuuaauaccaggccacauccuacagguuaaaagugucauuucuagauuggaggucauucuuaagaguacccaccauagugcagcccagggaucuuaugcuucugaucacagcuucacccaugugagccuuccuuugcuagcaacaguaauuuagccuuucauagaucucuucucaugcuucaaggguccagggaaaccugaaaucauaggauuuuucagcagaaagggaaaucagaaaauguaaauaugacuaggguaauagauauaauuuagggcaucuggcuucagcuaacgcugacguucguaguuccuguaggaccugaacaaauguguuucauugugguaucugauaguuguuaacucaggagcugaguauucuaaacaacaaaaaguaaacaaucuagaccuuuacugguuuagucaguuuuaggggcugaccaauugcuuuuccaggcagaucuaauaauccuaacauuuacugagcauguacuuuaugucaagcacaaaucugaaugcuugaugaauauuaaagcacaacacuauaggauugugcuguuauuuccacuucacagauaaguaaacugagacacaaauaaaugguuuaaaaaacacggcuaaacucacaaccaucugguuugagagccugugcuguuaaccccuaauguccguauucuuucucaaaucuaaccaguauuucccuugcagcagagaguagaaaagugaauccagauucacuaaugcuagauuauaaaaaugguuuaacaaagcucuuacauuguccacccuaauggagauacugauucuggaggagacuaauaguagaaacaaagaaacuuaagcucuaaccucuugccugguuuuccaagaaugggugcauucacaauuauuuucaauuccuaaugucaaaaauaguaguuuuaaaguggcagucagguacagcuaaguugcuacuuccaaagggggguugaagaguugcugggucuguggauaaaggaaagaaaaccaacgguuacugugugccugcuauguaucugucccugcuagagccucuguauguauuaucucauuuagagcacuuaacaaaccugagagagagagagauuuaucccugcuuuaccaaugagaaaggguucuuauagcaguguuuuuaauucuguguuguaaauaauauugauaucugauguccccaaggugcucaauuagaaaggcgaagugcuggggagaaggagguagauuuugaggucaaauauguuugggcaauacuauuuuacaucuuacauccaucuguaccaccauuccccgguccuaccaauagucaugauauauuaaaaggcuuugagaaguccuucaacaaagaaaccuauuuaaauuuauuuaacuaguauuucccaaacauaucugaucauaaaacaccuuuuuuauuggggcaccuugcaagaugcuguucuucagauugugguuuuuggaaucacagucuuagaguaaauaaccugcccaaggucucauggcuagucaggaaugaagcaccaucugcauguccccacaaucuaaacucucaccccuacagacacuuugaaaguguggauauucacacacuguaagucagacacugcugugauucaaguagaaaaguuuguuucuaacagcuccucacccuuuaugauacucucaguuuguacaucguuucuagauuguuuuggcuugauucaguggcgugccuggccacguaaggaaagaugaguuaaucagccauaaacaauuccuaugaagaggaccauuaacccacugaucuuuccccuugaaauaacuuagaucuccuaggauuuacacuguuucagaaaguacaaaccaaacuugggcacuuuccacgugacuuucauaggguggccaauggugugagaacuuggguuuauuagcauguugugcaacuuuucccaucguuggcaaguagcuccucacaaaugguggaagauuuucuccuaugugucagcaucuagaccugcacaucugacgugucggcuacacugaauuuaauuaaaauuaggccacgccuggugacucacaccuguaauggcagcacuuugggaagccgagguggguggaucacuugagaucaggaguucgagaccagccuggccaacaugccgaaaccccaucucuacuaaaaauaugaaaaauuagcugagugugguggcccgcaucuguagucccagcuacucgggaggcugaggcgcgagaauugcuugaaccuuggggguagagguugcagugagccaagauugugccacugcauuccagccugggugacagagcaagagacugucugaaaauauaaaauaaaauaaaauaaaugaaaauaaauguaauuaaaaguaaauagaauuuaaagccugguucuucagucacaauagccacauuugaagugcucaauagccacacaugacuaguggcugcuaccauauuagcacaaauauagacauuuccaucaucucagaaaguucuacuggauggugcuggagacauuaacaacugcuguuuuaaaacagccaacacggccaggcgccgguggcucacgccuguaaucccagcacuuugggaggccgagguggguggaucaugacgucaggauuucaagaccagccuggccaagauggugaaauccugucucuacaaaaaaaaauaaaaaauaaauuagccgggcaugguggcaggcgccuguaaucccagcuacuugggaggcugaggcagagaauugcuugaacccgggaggcagagguugcagugagccgaugucgcaccauugcacugcagccugggcgacagagugagacucugucucaaaaauaaaauaaauaaaauaaaauaagccaacacaggagguuacccaucugucucuguaucauguacugcuacccugucauuucacucauuucuccuucccagguccuaaguugaaguggucauauuugccuugucaaaucuauuguuuucaaaucuuauaacuaauguaugcccccucuaauucucucuacucugaaauaauuuggaauuaucauaacauaauucauagggauguaucauaucaaauucccaagccauccugucaguagauaccuuccuacuugguuaaggagaauaucaggaccauauugauauucaggaguaucuacuucaaccaagaaaagcucccuucuuuucccauaucaaaucugccuuuuauuuaaggguuccugauaauuuagaaucucaguugcuguuagauguccugaugacuacugaauauguuaccaaacaaggcucacuucuugcuuuucucuuuccaggauagucaagaggugacuugaaaggagugaacuaaaggaauugguaguguaauaagaccacugagcaguuagcuguagacuguguguacaccaagaaaugggauaaaauccucugaagagugggagacuccagaaagaaucuagcccauuuguuccuuaaacuucaaaauaccccuuaucagaagguucucacucuuuuuagaaguccaacaaauaagacauuugccuagaacauccuuaagagcuaguccucaauucuugaauguauuuucucuuccuucuauauuuuccaaauucugcuguuuuaaaauuuuuucaaaugucagauuuugaauaaccaacccaaauaccuauuuucaucccaguauaaacuugaaacaaguauguguugucacccuuucuacccuccacaucucauuagaaagcugguaauugguuauauagucuuaaagcuauauggaauuacaauuuugaacauuugauucagcaucccuagaaaauguuuguuccucauuuucccuuucuccaaaggcucuucaaacuuaacucccggcaaacaaaccuauuaggugguccucucccuccuagaauccuagaggacaaaacuuaccccauagucaaccuaauuuuccauguccuugaggaaaacaucuuacacaccccauagaugagguaguccacauguaucacuacacagaaaagaauguucucugaaaacucuauauucucuagccaggcgguauauagagggacccaccuggagagcagaugucccuucagcuacaaagaagccacauauuuguugagccaaacagaauccucuguccucuaaugugaaauucacuuagggacucuaacaucauagcugugcucuuucagaaguguaaucuccaguuucuccccuuuacaucagaggagugccuccaggcgccaccaggagccugaaucugggucucugaccaugccacccaccucaccugggccucacugaccauauguuguugaugcaguuuaguuacuccucacucuaacagcuaaugggaagcagugguuuccaguccuuggagaaacuccacuuucaacaucuaauggucaguaguaaccccaaaggauagaggcccagaucucgcaugucaggaauuaguuauaggaaucuuguaaggaugguauaagcuguuauguacaaaucucuuacaaaauagaggcagggucucaucauguuggccagguaggucccaaacucuugagcucaagggauccuccugccucggccucccaaagugcuaggauucuacaugcaugagccaccacgccccgccaagaauugcauuuuuuguuuugaauuuugguaaaagauaggcaauuauuuaagcaaauggccauuccauaugagagcgagagaagcugaagauaacacugguguuaaucuaauaauuccuguggcauuuaucaucuuucuuuagccaccuuuauuuacaucugcauuugggggaagaaauagaggaaaacaggauuggagaguuuauaauuuauaucaaaaguauaaggaaauaauuauuuuuugugaauauaugagauaaauacucaucuuuaucacaauaugaacuuuuuuuuuuuucuuuaagagacagggccuugcucugucacuuaaguugaagugcaguggcacaauuauagcuuacugcagccuugaacucuugggcucaagugauccucccaccucagccucccgaauaacugggacuacaggcgugagccaccaugccuaagauuuguauuuuuauuuuuuguagagacaaggucuugcuauguugcaagucuugaacuccuaggcucaggcgauccuacugucuuggccucuuaaagugcucggguuauagacaugggucacugugauuggcccaaucugagcgaaauucuuuuucaagugagauagccaucaucgucugguauuaauugaucaccuaccaggaugaaggaaggugugcuuuaugcaaauugguauuuuaccauaaaaucuuuuauacaaccuaacacaaccuauuuaugagggaauagguuucacaauuaauggauaaaaaaugaugauguaaauuaugugguaaaagaacucuuggaaacauauaauguauuggacccugagaaaaaaacauuuugaaauuucuagcuugaauaauuggacaaguugugggaauaguaauaaaaauagggauaucaggaaaacgggaaauuuuggagaaaugauaaugagguuuguuuuagguagcacuucucaagaggggaugggguggggacguauuaaaaugugaagaugauuaaguguucauauuagaaaauugagaaauucuguuuugaacgaaccgaguuugagauuuugguggaauagcaagauggaugugacuagugauaaagugacagugcagauuauuacugucucugagccuguucaugcuggacucugaauuaggugccuggauacauugucuuacauagcaucagcacagaacugacauuagcauagaacugacauuacccccccaguuccugaucucaaaagguuuagguaacuuguauuuaaaccugagucuucuaugucagaacccugguuuuuauuccuggcugcuugggaauauuggaauaauaugcagacuguauauguguuuauagaaguaacuggcuuuuuugugguuuuaacuuuaccccuacuuuaucuaucacacaaaauuaguuaccuuuuuuaaaaagucuacaugacaugacagauguaguuucucuucuggcuuaaccugcugacaguaccguacauaggaauagauuuaagacuuucaaacaucuguuaauuuaccauaugcuuuuaaaacugcaacaguuuagaggaaacaaaauaucaaggggcauuaccuaaaauauuccuccuaauucugaugacugacuuaaauuccuuuuauguaauccacaaaugucuagugaaagaguagaguuuguaccacacuaugcuuaagcuuccagguaagacaaguuccaagcucuuugacuagagucaucuuagucucuccuaagucaucagaguaguuaucagaauuaauguucuugucuugauugauaauagugucaucagggaguuaauuuuuuaaaucauuaaccaaaguagaguuuguugaacucaauacaaauuugaaaggaauaacuugaaaaaaaugaaaaaagaaauuguaaggauuuucccccauaaacacagaaaauuacauaaacaguuguaagaccuuucuagaccaaugaauuuuagauacucagacagcgauaggccaauaggccauuucagaguagggccagggaaaguuuagguugauauuuaguguauauguguguguaucugucugucuaauuaacuucuccaacuccugauauuuucauuauuuauugucccauagauacgaaauguggaaacgaaucagugucuagauaacauggcuagaaaagagaaugaaaaaguuggaauuuuuaauugccaugguaugggggguaaucaggugaguaucuuagaaaacucuuaaaagggauaauuuucagauuguuuuuacuuugccuuuuuuuuauaccaugacaucauucaggaaauauuuuccuuccuuuaaagagaaaauaauaaagacuuuuaggugaaggaagcuuucaauccagugauuuuuuuuuuuaaugaaacauuugugaaaggcccauugugagaacuauguuuacauugcugagcacaaaauuuauuuugcccuuuuuauucaaacagaugacaacccuugacaauacauucaguguauacagagagcucaaggucauuuuugcuucagcuuguaagcaagaaaaugaguaacauaacaucaauguaaauuagugguagcuuuucugagucacuuuauucuucauuacuuuaauaaaguacauaaaucauguaccuugaaauacuuguauuuucccugacagcuaauugggcauuuaaaaugcugacuaauuuauuuuuucuguuuaugugugugcauuuuuauuuccagguuuucucuuauacugccaacaaagaaauuagaacagaugaccuuugcuuggauguuuccaaacuuaauggcccaguuacaaugcucaaaugccaccaccuaaaaggcaaccaacucugggaguaugacccagugguaaguuaugcaguugccuauaguaauaaaauuaugugugucacuggguauauuuauauacuuuauaucuaaaggaaugaguucuuguggaccuugaauauggaucaaacuugucuuauacacuaaauauugacaggcgggaaaaauaaguaaaauaaauguguuuuaaucucccuaauaauuaaauuuuagucuuauaaaaucacaguugccuccaaucccuggguccuuguuuacugaguagccacuguuccuucuguaugucuucaaguucuauagucuaguuugggagaaaugaggcagaaaguaggcuuuuaaaauuacuuaauuaaacacuucagugaaagauaaguuuuaauuaauaaaguucucuggcuugugaugauuucccagugacauauaugacagaaccuuuccuauuuaucuuuccuuuugucuggaaccuuucucuccaccaccaucaaaugggcucacauggaaguacuuaaaagguauuaguucaauuaaagcauccgugguaaaccucuuuccaccuauuugccuaauuuuucaacuugugcuuuugccagguucuggaaccagcaccaacaucuucaauauuucuuucucugguucuuuuuaauuuggcuuaacuucuguaaggcauuuagugccacuaaacagaugacuuuuuuuuuuuuuuuugaggcagggucuugcucugucacccaggcuagagugcagugguacagucacagcucacacaaccuccaccucccaggcucaagcuauccucccaccucagccucuagaggagcugggaccacaggcacacgccaucaugccuggcuaauuuuuguaauuuuguggagacagaguuucaccauguuguccaggcuggucuugagcacuuaggcucaagcgauccacccgccucagucucucaaagugcugggauuacaggcaugagccaucauaucuggccugauauuuucuaauuuauuuuuuuuuauuuuuuauuuuauuuauuuauuuuuuugagauggagucucgcucuuaucgcccaggcuggagugcaguggugcaaucucggcucaugcaaccuccaccucccugguucaagcuauucuccugccucagccuccugaguagcugggauuacaggugcccgccaccaugcccggcuaauuuuuguacuuuuaguagagacaggguuucuccauguuggccaggcuggucuugaacuccugaccucaggugaucugcccaccucggccucccaaagugcugggauuacaggcaugagccacugcacccagccuggccugauauuuucauauccucuuaugccuuggccauaagaugcacuacuguuuagguucuucucuuaguuugcucucuguuccuuuuguuggccuggcucucucuccuucuucguccuacuccuuaaauggaaauguugucccaaguuacugacuuuggccaucuuuccucccuuuacugugucauacaccaaccauggucuacuuuaaucaucaauaugcuguucucugaacauaccuuauacuuuccuaguucacaucuaagauaauaugcuucccucugccugacacaccuuacccauucuuaagaacccagcuuugacaucacuuccaugaauccuaaccugaaauuaacucugucaaucuuaauuacagucaucucugaccucuauaaagcuguacuuguuuguaguuauuuaucuagcaaucuuuucuccacuauuagauuguuagauccuagaggacagagaucaucuuuuauaaauccugggucuccuuucacaaugucaggcuauagaaaaaaugauauuaccuauaauaauagcucaguuaauauggccauuggaaauggccugaaugcucuguucuaggguuucccaugguaugugccacugccauuuugggugugacugccccaugcauugcaggguauguagcaucucuggcuccagauaguaagugcuaguggcaccccauagccauugugacaaccacaaaauuuuaaaaaugaaaaaccucuuaaguuuauuggaaaaugacaguauauuaauuaggcaguauuuuuagaaaccuauuuauuauagcuaaaacaaauagggauuuauuuuucuuacauaagucuagagguaaguaaauucaguggcauagugaugucagggauaacguuguuguaauauucuuagcuuuuccuuguggccacaaggugguugcugcagcuuuaucgcaucccaacuccaggcagaaagaaaagggaaagaggaaugguacacuaccacauguguugcucuuuauuagcaaaguaaaagguuuuucuggaacccccuuagcaggcucugcuuaugucuuauggaccagaacaucccauggugacccccagcugcaaaggaagcugggaaagcaagucuuugguuuucuagucguuagagugugagauggccaagagauagagggauugggaaagacuguuggcuagccaaccuacacagucuaccacaacaguauuccaaaaguaaauguuugaugaaacagguaagaagcuggagauaagaguauuuagaaagagccggccgggcgcgguggcucaagccuguaaucccagcacuuugggaggccgaggugggcggaugacgaggucaggagaucgagaccacagugaaaccucgucucuacuaaaaauacaaaaaauacaccauacaggcaugguggcaggcaccuguagucccagauacucaggaggcugaggcaggagaauggcgugaacccaggaggcggaguuugcagugagccgauaccgcgccacugcacuccagccugggcgacagagugagacuccaucucaaaaaauaaaauuaaauuuuaaaaaaaagagccaguuaugagugugaaguuuuaaaacuucuagaucgcuuugcaagguuuuuuccugcugagauaaaacauuaaugcuggggauugauuucucccagaagcagacucgaagauaaaguugagcauucaggauguuuguuagggagcacuuucugggccaauaucuguaaaaggaauaccucccucucccugggcagagggagaaguugaguugcaaugcagguccaacagccugagcagacuacagggaaagcacuggaggggaacagcccaucagaaucguccugccuccauccauugaaaacuuaacagucuagaaaaauaacagaauacuuauguccauuaucuguaaucuaaaaucaugaauucuuagauuucaaagcaacccuagaaauuaaacccaggauacuuuuuauacaaguagaaauugaaacucagaauuaauuucccaaggaaauuaauugcccaaggucucugagcagccagauaguaugacuagaucucaaaucuggaauucuagauucucgauccagguuucuuugcacaguaccacgcuauuuuugauuaauaguuuugagucuugcuuguauuacauauuacauaaaauuuacaauaaggcacugggcucuuuugcuuugacuacuuguaucuguccuuucuggaauaaaaugcagauuuuagaccuaguuacaucuagaaauuaggaguaggagcuuggcaaauuauuuuuucuaggaugcagguagacuuuacuaaaugauuaauuauagcuuuuauccucuccuucaaagguuacgguuagaugcuugucacuugcuuguccugaugccuuaguccagcucucucugaauggagacuaguugguguugccugaguccucugaggagugcugugaugacagcauccuacccacaagguuccaagccacaaggcucugugccugcugucagcagccagaguuguaucuggaacaggguucuccaccagagucuaggcuuccugggggugcugcucaccuuccaaguuauggggauucuguccugaugucgaauaguuaaauacucagcacagagcaauaaccuauguguuugugauggguuuauuuuaaugaaucuagaugagugaaaugcacauuuuuagaaacuagguuaagagagaccaacucucccaacuaaauuuuuuguugugccuaguuggggguuuuuuguuuuuaguaauagugaccaugggccugaugagggaggccacugggauaagcuuugcgggaacucccggaauguuugagagguucucuuguucuggucuuuccugagacugaagccacuggcagcaaugugcacgcugagccgcagcgcucuggcugcuggauuguguccaugacugcucaggacguugccaggauguuguguuuuccaauaauaagcauuacucuauaaaugcaaauuaccauuguauguaaaugucauuguaccauuuaucaagcauuuacucugggauaggcagcacuuuauguacauuaucucaguguuuccucauaaaaacccggugagguauuuuuguccccauuuuauagaugaggaaacugggucucaaagaguuuagguuuuugcucagaagcauauaguuggugugugacaaaucuggaaaucaccccaggaaugucugacugcaaagccccuccucucaauaaacuacacaaagucugcauuaaaaaaagaaaaaaaaauucccacagccaugcugacucucuucuagguucuagucuuauauuuggaagcauuaaagauagaauccugaaccuaaagacaguaucaguagugacaucugcaaagauagacugucaucugccagguccuacuuugaccacaacacggaagaauaauaaaugacuggaagccuaaguaguuguauacaauuauuagauuuuguuuuaaguucuaauaggugcaaaaaaggccucaugaaaaugaaauguuucagauaaaagaacuacauuaaaauagagccaugaguaaaagaaucagauaacuauguguuaaacauuuuacauuuccuucgaguuaauuuacauuuguagaguaaugcuuaaugcacauuccuguauacaacuacuuugaaguccuuaacaugaccagagcauauuaucacaaucauugguguggaucauuguuaacuaucuaucuguuaauucuuaccugcccugcccuuucaaaauuauccuaauaacauguugcugcaucaaaucuagaacuuaaauaaguggauaaaauauauagcuaugucuguuaaccauuuauuaagaaucucuuuuguaggugaggcacuauguacuuuaucuucauuaucuauguaguuucccaaaaucugcucaaaauauguaaugugauccuaauuuuuaaaaugagaaaccucaaguuacccaggcugugaacucaacuccacauuccugugcuuuucuuucuguaccacaccaucuccuuuaaccaccaggauagccucuggguuugcuauggacauaggcauaagauugauuuuacuaaauaucagcugucccaacauucuuaugauuuugaguuaucagaaagaccugaguuucuaaaaacuugagcuuuggaaucacagaauuaacuugaacagccuuaucauagagaaaugaaacaauuuugaaauagcuguuugaaaauagguugaggauccuaaauuaggaaccacuaaucuggucuuuuuuuguuguuuaggaaacugaagcacaaaaaagagaagcuucucauaguguuacagagcuuaugccagaauuaggacuuagaauuuaggucaucuugcagcaagucaaguguacccuacuggaccccagugccuuucucccucccucauaccucuuuaucgaccuacauaucuaccuacuucucucucucucucucucucucucuguuucuccauccauccaccuaccuaccuuuucuccguugucuuuuaaauaauguauauuaccaaaaaaaacaccuuuucugcagaggaacuuaaucaccaaaacugaugcuugagguguuuuguuuucuuccacucucauguuaagauuuuuucuauuucagaaauuaacccugcagcaugugaacaguaaucagugccuggauaaagccacagaagaggauagccaggugcccagcauuagagacugcaauggaagucggucccagcaguggcuucuucgaaacgucacccugccagaaauauucugagaccaaauuuacaaaaaaacgaaaaaaauaaggauugacugggcuaccucagcauacauuucugccacauucuuaaguagcaaaaaaggaaaagugcuuuccuccucugcaggauguaagguuuaucagccauuaaaacuuagacuucucuagcuuuucacuagcugugaaccagccuuccuguccauggacgugaaacugcauaguaaugagacugugcacacugauguuuacaagauugaaagagucuuucuccgaaaaucaugguaaagaauacugagacaaugaaaaaaaaucaacaaaauaugcuuucuggagaacuguaccuuuuaugguuugcuugcacaucaguaguuucugcugaacgugcugucauaaugaagagauuuccaagauuuuuuuuccugauuagaacugguagccaguauauuaaauauugauauaaaaauaaaagaacuggaaccagauucagaaucaugaaaacaacauuuuuacaacaacaaaaaaacuauauuaaacaggguuuaaaggaaauuaaaacagaacuaugagaaguacaauuuguuauaguauaguaucaaauuucuauauagauuuuauaccucaguggggaaaaauaacugauuccaaugacauucauuuuguuuucaucugugauagucauggaugcuuuuauuuuccuuggggugcugaaauugagcugaaaaaaaaaggcucuuugaauauaguuuuaauuucucucuacaguuuuuuuuguuugguuugugggcuguuggaauuguaauuuuuaauugccuucuaaaaaauggaaauuuaacaaugucugaucucagcugaacaaauuagauguuucaguugcucuugggucaacuggcuuacagauuuacaugugcacacacacacaaauuucuuaucacauuuucgacuucuucacuugaccuaacugauuaugcgaaauacccaagauucaugcuacuguaccacagauuuguuuucacagcaauaaaucuucaguucuuuguuuaugauuccacuuaacaaaaggccugcagaagugauuuauuauuuggguauuuggagauaauacauuugaugguuuuuuggaaaaccuuuuucacuccauacucagauaugcuucauugucaaaugcauauuuagauuagauuauugaauuguaauguuuaucugcugcuuuuuuuaaauaaaauuugacugaaaauguuuaauuggcauuuuuuaaugacuuagccaaagaagugcagcuauuauuccauauuaauaggcuugcauuucuuuuccuaaaucuuauuuaggcuaaaucaguuuuauuuuucucugauuuuuuuuaauaccacagaaucaccugagugucaauugaaaguugucaauuaaaagguaaccuuuuaaucucguaggaggaaucucauuaagacauuuuuccugauauguagagcagucuguuggcaaaaaugcauauauuuucuuucauauuuguaaaauuauauuuaauggaauucuuuucuuugauuaucaaggacuuucacugcaggcagugcuauuucuugugccuaagaauguuuccaaaagucgcaucgcuaaugauauuugccaaguugaguguacacaaaguuucucauauccuguucaaguuaaucaacaucaagcacauggggaugcuuuagggugagucuauaguacaaaaugcauaaaccauguccccaggaaauuugaaaggaagcaggugcugaauggaauuuuuuuccuuuuccaugagcuguguuaauucuaucuccaguaggccuaaugcuugaauaagcaagaugucuaaucaauaaauuauuuucaugcucagaauuucagguuuuuguacuccagcauagcuuggucuuauuucuuacuguaugaaagcuuaacagcaaugugauuuaagguuuuguuuuaaaugggagauguaagugauuuaauucauggguacuuuuagaaccugauagauaaucccauugccuuuauuuuucuaauuaaagaauuccuaaauacuuugaaaauacaaaauauuccugaaua

SEQ ID NO: 192742 - RNA, 126248 nt, Homo sapiens
auguuguuuuuccuguaccuaaguucccgcuguaggugguaccuuugcagacggugcgaugggggaagcagagaaguuucacuacaucuauaguugugaccuggauaucaacguccagcuuaagauguaagagaacacucgggacagggagugggauugcuggggcguagggacgugggggcaggggccuguugggagugagaggcagaaaguacgugacucgucucaaggcccagauugggggcggcugugagggcuguagccagggaggcgcgagagaguggaucguggagaggggcucuuuuggaaaaggauuuaauacguggucuccgugagaagcacagcaguaggaauagcccuuaaguuccgcuguauuuuacagucuuuaaaguuuuugcuguucagccuuuugagaguuuauuacuauuucauuguaaauuaagaaaucaagucucgucguaaguaagaggacgaucuuuauuuuggaacggggcuuguaggguggaaugaaggcuucagaaauuauggagagguagacacaggcagaugcgauaguugagaauaagaugagcacaugguguauuagcacgggaggugauagaggccuagagugaaucuuuggguaguauggcaguguuuagucagggaaguugggaguaagucgaagaugaggguuccaguuucaaagguaccaagaagauaggagaaaagagucuuugcaggaaaacguuggggcaccacggcugaaguaaaggucaagggcgugauaucuugagaugaggauaauagaacugguauaaugacgagggaugcacaagacagaguuggaaauuaugucccuuuuaagguggucauguaggaguguugucaaagcuaucacaaauuauugaccauagcaucauccauaauuaauaaacauuucuuguguauguucaauuaauauucaacaaauaugugucggucaaaggccugcaguaagugauagauaaauuuucucaguugucugauguaccuuugaaugaucauuucauuuuauuuucagaagucccuuauucgcugacaaauacuuuacuuuuuaguuuguggugguggugguaaaaguaauaugucaacaaccaccuuguaccuuuguaugauacuuuauacacucauuuaagguauuuuccauagcauacaccacuaguaguuuauacaggaucaauauugauaaagggcuuuccuucagcuugaugcucaguauuucuuggauauaugaaugcauuuuuugaaauguuugaacauuaaaaauaaagaaaaagccaaaaaaaccggucccuuuuuuuuuuuuuuuuuuuuuuggagacagggucucacucugucuccuuucccuuugggaugacguucugcuucuuuugcuucaacucucaugcauuguucaggaucauuucagacaucuaucugggguacuaagucccuuccccaugccagccuaaguacucuugagacucugauuuaucuuacuguaaugggaagaauauuggcuuuggccucccugcccuaguguuuauucucagcucuguuacuuacguugugacuguggauaaggaguuuaguuuauaagucucuguuuccucauuuauaaaaugagaauauggugaaaauuauguaagaaagaaaauauaaaaugccuggcacaguaucugauguaaucuugaugucuaaaaaauguuccucccucugugauaguauccugugcauaucuauuuaugacuuauaccacuguuuuaaagaaaugaucagacaaugcauaugcauaguaaaagaaaaaaauggaaagaguagaauaaaaacaugcaguuaaaaguaaauuuuuuuccccagaagcaaugacuuaauauuuuauuguaauacuguauugcuuaucuuuucuuucuucugggcuucuuuguccacuaugguaaauguuuccugaaagaauagaugaauauguggucaacuugaaaugaagaaaaugaaaccaaggccuagaaagcuggugacuuccagaggguagaucaagggucaauggcagcguuuaaaauucagaaguauaaaauagagaaauguguugaugaagaugggacugauauuagguauguuaggauuuuaagaaacccuuaucauauauaaaaaugacauuaauuucauauacaggaaaauguuguuuagguagcauaccuuaacacaaagguaaacuuuuuaguacuuaugcauauauguacaugcuuaaagcauauauguacaugcuuaguacuuauguauauauguacaugcuuaaaaaauucaugucugaaacauuguuggucuugugcuuucagaggaagcuuggaagggaagagagaacaaaagaguuauaaagcuguccuggaagacccaauguugaaguucucaggacuauaucaagagacaugcucugaucuuuauguuacuugucaaguuuuugcagaagggaagccuuuggccuugccagugagaacauccuacaaagcauuuaguacaagauggaaguaaguuuuuuuguggcauaugguauguuacagacuguucuuaccuuucuuuauggaugcugcaaguauaauuuaguaggauuauagaggaauuucuuaauaccuauaggcauugaucaaaucauuugaaguagaaacauacucagauaaaguauuaugcaugucaguauuauaacugcaauugaaauagaaauggauuuauguuuguaguuagcauauugacauuuugauaagcacuugacugauuuacaugaccaaaaacaaaaacacgucuguggcauuuuaaaauucuuuaccauccugugcucuugaaugcauaaauacuucuggauagucugaaauauuguccaaccugauguuuggagcucagauuuuuagagauagaucuauugccaucgguucagauaaaauuuuuauuauuauuuuacauaugaaacuaauuuauuuagauucauaguuuauucagcauggcacauuagcaagaccuugucaagaugcaggguaaauauaaugaacaugaaguuccuguuuuuuucagaagaguauuguggauccuuaaucugacuucuugacacuucuuauuugauagacuauguagugcaguucugauguuugaucagcgaguguuauucagcacucugguaggcucaguguaggauacacaggcuguaugcuuuuaaggaaggaguguucauggaagacaggaugugaccacauggacagccagacugugccauagaggguucaacccugugugucccaggugucacccaguguagcuggaaaggguuuucaaacagcagaagccugaacucuggugaucuggccauaucgaaaccaaguauuuuaaugguguaauuucuucaguagucuuuguggagagauaucugucugucugucugucuaucuagccuaucuaucuguauauauauauguguguauauagauauagauauauauguauauagauauguguguauguguauguagauauacacacacacauaaaaaauauauauauauacuuaauacuuuuuauucuggaaaauuuuaaaccuacaaaaauagaauaauacagugaacgccuaaguuucuguuacauaccuacuguuaacucauggccaaucuuguauucucaccauuuuguaacaaaccucaaacguuauaacaccuuaacuguaaguauuucuguauaucuguuuuuaaagcauaacuacaguaucaucaucaucacaccuaaaacaauggagcagaauuccuuaauuguaucagagauucuuaaacuggaaucaggaagucuucaaaccccugaagguguaugcagaauuuuguguuuuguguacuuuuucagggacagagcucaaagcuuuaauuagauuuuugaggucaccuauuacucucagaagaguuaaaacaaauuuaggucuagaaggccaaaaacauuuugguaaggaaaaauguauaguggcuucuguugcaugacuugacaaaaaaggaaauuacaacaaaagcaaauucucaauuacaagauuaaagguuuucuccuccuccucccauuugccaacucuucucugcauuaguuuuuauauuauauguuugcaagaauauaaaaacuuccauguuugaucucuaaaaguugaauuuuuaacguuuguaguuuuuaaauugugaaaguacuggaaaguacgcuaaaauuauuuaaaacgacuuugaaauuaaaaugucuaagcuauguagacaauagauuuagaaaaacaccuuauuuuggauaaaauaccacgagaauaggcuuuuuaaaaaaauacuguacagguggaucacuugaggucaggaguucaagaccagccuggcccacauggugaaacccccuauuaaaaauacaaaaauugccuggacaugguggcagguaccuguaaucccagcuacuugggaggcuaaggcaggagaaucgccggaacccaggaggcagagguugcagugagcugagauugagccauugcacuccagccugggcaacagaacgagacuccaucucaaaaaaaaagaauagucuuuaggagacuaagagaaaacauuugcacauuuuauacauccugcucuuuaguauucgaaaguugaauuuauugguaguucaucaaaacaaaaauugccauccuaaagugaguggagguaaaaaccuuaaauaguccuuauuuauaaguauuugcuuaaaagagauauucuauaaaccuuggaaagaagaaauuagaucauaaagggaucucuugcuauccaaauuuuugcauuccuuaguucagauaguauuuuagggccaguaugagauucuaaauuauuuaaaucuguuugauuucugacuuucugauagugaguugugagaguucuaauaaugaggaacucauccgaaauuuauucaagucuaucauaucauguccuauucuguccuacacuaagagaucccaugagggacacuuguacuuccuuuaauuacacuuaagguaaauucucauuuuuagguguauguacugcaaauuucuaaguuuuuuucuuaugugaauauuauucuuuagggaaguaguuuacauuuuuaagaacacuuauauuucacauugucucauaaagguuuugaaaauggcuuuagagagacauauaauacaaucuaauucaaaaauuacaaaguuaggauucagaaguauuuuaaucagauucgagugcuagcacaaugguaugcggugauggcgguaccugguggggauuggagcauccagauuuaggcuuugcagucuggugauguuuugauuguugccaagugaauguaaucuuaagguuaaugaggguuagcggaugggguagggaugauucgugaagaggaggagaacgaagugguguccaaaauauauaccuuuuuggugucugacuagauuuuucuauaacuucuagaauaucuagagcaguuuucaaacuuuuugacugaaggaucauuuuuucuuuuuucuuuuuuuuuuugagauggcgucucgcucugucgccaggcuggagugcaguggcaugaucuuggcucacugcagucuucacccucuggguucaagcaaucuccugccucagccucccaaguagcugggacuacaggcgcgcaccaccaugcccggcugauuuuuguauuuuuaguagagacacgguuucaccauguuggcgaagcucaucuugaacuccugaccucaagugaucugccugccucggccucccaaaguaggaucauuuuuuucaaaagaacucuucugcagaagccucguauauaaaacauauuaagugcaguugcuuugauugaaagugguguugccugguauuggauagcaaaagguuugagacaaaugauuaguuggucauugguguugucugguagucauuaaaggacagaauacagaauaauaaauuccacaauauuauccaaaaagaaauuuggauaauauccaaaacauuauuuuggauguuaucgcuuauuguugucuucaacuuuagccaguguuaauuaacuucugugguuuauucauuggcaaaaguuggcacugcuuaguguuuuucuuucuagccugcccuaccauguggcuaguaauuagauaauuuuauuuaguuguuugagccuauuuguaguagauacuggcuuucuuaagcaugugauuaaaaaaguauuucauagaagaaaaggauuuaauaacuccuuuuucuugaaauugauagccaucucuaauuuauauggcguauauaaaugauuuguuguuuaaguuuuuggaaauuuuguuaaauguuuuagcaauacagauguauuuaacauagacuaggauaugucccuuagauaauaacuuugaaugaacagaauaauuuugaguaaacagaaauagaauucuaugugucugcuagguauuaguuuggcauauuguuggcacaguauucuuuuggaauuuaaaagccagcuccucuugaagaggguugaaauuaucaaaugaauacagugugaaauuuaaaaguauaagaaaauuuacauaaauauauagaggguuuaaaaaaaaagagcuguggugucauuaacuauauuauuauuaacaaacauuccucagugaaagaauauauacagaugugcuuugaaagcauaaagcacuaauagcuuaauguuaucaguauuaaugaaaucauuugaggaacagaaaauucucgcauaagaagucacauaucugucuggagcagucugguaacuucaugugauaaagguaguagauuuucuacuuugaguuuuuguuuugauuguuuuuuuuccugauuuauucucagaagugcuuuugaguaugaguaauuuugauuauuuuaucuucauaauguaaauuggguuuugaagagugguuaaagaaaaucaugguuuguuuaaaaaguucuaacagguugaaauguuuucccagguuuuuuucgccauuauauuaucuggugucuugguguuuucugaguuuuauuaaaaaauuuaacagagcuguuuuucaugagcucuauuaaaacaauuauguuuuuauuuaaaauggaaaguugccuuuagcaaaauugaggugacugccauauuauuuuuuagagucuaacaacauuuuuggaaccuuuuccucuggccaaaacuuuuugugugguuuguuaauuuaaaagaaagauauauauauauguauuucugauuuauguuaacuucauuuccauagcuggaaugaauggcugaaacuaccaguaaaauacccugaccugcccaggaaugcccaaguggcccucaccauaugggauguguauggucccggaaaagcagugccuguaggaggaacaacgguuucgcucuuuggaaaauacggguaagcauucuguuggucucaucuguaggaguguagcagcuuucugacccuuuucuuuuucggaaugagggaaggcuuuaauaguuuaugcucagucuccaguguaaaccaguuagguacauaugauuugaucauuccuuacacugauuuuaacauauauuuccuacaggauauacagauagauuaggaaauacaauuuauauugcucuucuguuggugauuuaaugugauuucuaguagaaaauagaagucauugggaaauagaaccuugcuuuuagggaaaagugacuaugacauauaacugcuuuguuacaggguuuaucugcuuuuuuuauaauauugacagaaaggaugaaaaacaggauuaaaaagcauucauuagcuaaugaugguaaugauugugauagaaaagauaauucaguuuuugaaacauuugcaaauacuagauguuaauuguuaaaaaaaaaaucccauagucccaaaggauauuuucucuauaucguuuuucuccugggacagaggacucagucugucuuuagagaauuugugacauucuguuauuauucugcauuuacuaauaggaauuuuucacuaaagaacuugguccuucaucaaguauuuacuuaguucauauaggaaagacagauaaauauuuuaacuuucuuucccuuuaccgauuuuaagacuaaugaguuugugcccuaguaacuugcaaagguggugaucgauggcuuuugugcauuuuguuuuuuauguguuuuaguccauugcugucuuuacucuuuauaaugcucaaaaaaucucauuuuuggucaguaggagacccuucaaguagaccccguguccuuuuggcaguacacuacuagugauugguagcuucuuugcuuucugguagacaaguuuuuccaggcucauuugguaauuuucugcuccagaccuggaaucucugaaagaaguucugguuccuuucagugugaaaugcuauagaucugucuggauauuacaaaugucuuaauuuuugucuacuuuaaaguuaaaaaauguuauuuaauuuuuacaucauuaaguaugaggaggauuguauuuuggaguguuuauugacuauuuguguuuauguuuccaugaacugcuuuuugauguacuuuguccuuuuuagaaauugagauauaauucacauaucauaaaauucuuugcuuuuuuuuuuuuuugaguugucguuuucuuauugauauauaaggagucuuuguagaugaauggaauuagcccuuuguggguuauguuacaaauacugcuuuucugguuugguuuguucuuuugaauuaguauguauuuguuugcucuucauggauuuuaaauuauuaucuugaaucuaucaguuuuuaguuuuugggcugugaauuuaauguuuuaggaaguucccauuuaagauucuuuaaaaugguuucuucuguugugcuuuuauuccuuuauauuaaaaucuuugauuuaucuaaaauuacuuuugugaaagagugguauagugagaauagcuuuuuagagaaaaccaaaacaaaugguuugaauauuugucccaacacugcuuauuaaauaagucaucuuauccagcuauuuuaaaauagcauccuuauauacucaauucaucauguguugaagucuaagagaggcauuauaguguauagugcuauagugguuaggaaagcaaguuguagauuaucuggcuucaaaucuuggcuucuuugcuuaguaucuguguauccuugggcagauuauuuaaucuuaugccucaaugucuucauauguuaaaugaaagaacaauaguauccaccucauugaguaguuuaugauuguuacauuacuaaauacauuuaaugggccugauaaauauuauaucauauauuuauguauugaauaaauauuauaaugaccuuaauaaauacuagguauccuuccugggcuauucugucaguuaggauaguauuauaaaauguuuaaguauuagguaaggauaauucuuauuagucuuucuuuuaaaauauuuccagguuuguuuuggcagauacauuuuaauauuuucucaauuaaaaaacucaauguuauuuuguuagaaaaucuuacugaauuauauauguuaauuaaagagagaauugaugccuuuauaauauuaaauuuuccuauccaggaaaagagugugucagaaaggcuucuaaacucaugaaugaaaucuagauguaaucccauuuggaauagcuugguugcuuacaaauaccuagguauuuuaguuuaauguggcuauuaaagagauauuuguuauuaaaauucauacaggaaaaauaacuuagauguagucugaaacauuguaacuuucaguuuuaaaauauacuuuuugauaaaauagcauguuacagcagaauggacauauugcuaaaucaguauuguuucuuuuacagaguguuuaccccuuauuuuuuguuacuagggaggggcuuguuugcaacagagaagaaaaagaaaaauguacagcucuucuuaguggcuaaauauuuuugagaaauaaccagacauuccucuugguuuuuccucccagauucaucacaagugguuuaccuucuggaauaucaacaggagguucccucauaaaaacaccugcguuaguacucaugcauuuuaggggacuuuaggaucuaguuucagaggauuuucugacuaggauguaguugugggagggacaauugaaauuuccacagaugcagugaaaugaacugcguacaucuaaacaaacucucagauugauuuuugguacuguuuaguuuggcuucuggcacguuuuuuuaaaaaguacuacaucaaaucaguaauaaucaaccuguguuuaagaaccauccuggaagccuaugagaaaagcaucuuccuggguucucacuaacucagugugucugugguggggcccaagaaucagcauuuuaaacaagcauccugagugagucuguaaagggagccuaugaaccacauuuugagaagcacugaacugaccuuugugauaguuuauuaauaugacuuacacgugcauucaugcguuccucuucuuuacuccuucucuuggugcccacuuuauuuguaauucuguguauaucccagugaaaggaaaauuccuuuaccucccauccaaaccaagcuggcagcgugccuaaagacaaaucaguagcacuuguucuacuuuaaaaagucauuaaaccccaaggauuucuauaaagggagcaguagcaauaagugagugguuacuuaaauuuguuuucugccauuaacuaaaauaagacuuugaaucuuggaaagucaucuguuuucucuuaacucuaacuggaaaauaggucauccuacacuccuucaugucccgaacacaucagaugcccgauauaaaugaaaccuguuagagagaagcacugauugcgugaaauuaucucacuuagagcuugauuucuccaacuugagucauuuacuuaucacuuuuagaauuccauucauaucucuuugcuaaguauauuguuccuuuuuuuuuuuuuuuuuuuuuuugagauggauucucugucgcccugcuguggggugaucugagcucacugcaaccuccgccuccuggguucaagcgauucuccugccucagccuccugaguagccgggauuacaggcccaugccaccgugcccagcuaauuuuuguauuuuuaguauaggcgggguuucaccguguuggccaggcuggucuugagcuccugaccucagcugauccgccugccucgcccucccaaaguguugggauuacagguaugagccacuaugccuggccuauuguucuuuacuugauaucuuuauuuaccccaacuuacuuuuuuuaaacuuccacuuauuuuaaaagaaaagcuugauaucccuguuauacauggaaaacaaguauuauuuaacauuaguggguaauagcaagacuaaauauaaugacaaaaacuaugcuauuaaauuuuagaaauugaagcaaaagaaucccuagugaauacaaaugauaugaaauucauuugauuugcaaaauaugcauacaauaucugcaaaaaaguccuuuaauuagaaugguucuguuuuccauagucagauauacacggaauauucagcucacucucagauuaaggugaagaucaggcuuuacaucauuuucauuuuuaaucaguucaacuccuauauaguuguagggcaguuauccaaacauaacuaacauaacguaagauuuuaauauaggucuaagauauuuugaggggguggagugcaaaaagacuaaaucaccaacuccuguucccccuguacuggcgcuuguacugaccuucaccucagaagaaggaauucuaagaaacccuaugaaauuaaaacaacuuuuuuuuuuuccucucuguccuguagccuugccaugugggugagcugccucgcauuggagaaaagccaggcauuuccuaguccuaagcagcuacaggucuucuugugcagcuuuggauugugaaagaugauguucaggauguuccuggugcuacagcagagugcagacaucuccuuaugcuguuggcucacagcuacuuccuugcauggugcugccauccagggagucagggcaauaugaguauucuggguggucucagcaagaagcgcgugcagauuuucuuccaccuguccucaaaaaccaugccaugugccacuaccauucucauaacuuagggaaacgcugccuuuaaccauaguuuucucagauguuucuuaugcagugaaauaacaccaaccaucccucgccuuuuccccuaaaggguucugauguguacuuaguagcuguuaaaagugauccucaagacaucuaguauuguaguauuguaguauugguaaucuugugacuaucagcucuugcuguuugcuaauaucuguuuuguuuacaugagucaguaugaggcagaacuucuuggagaauagucuaauuaauaauugaaauacugauuuguuagggauaaggcuagaauaauuugucguccuuaauuuggaagucuagcauaugaaauuucaaaguagcuaaagaauggauugauuguuagguugaccuggcaaagaaccacaugcaagcuguagauuucucuugcaguuguuuuuucuaaaugugaauccuggaagucaaggcaguuggugcuguaguggcuuggcacugcaagcuggaauaucaacagcagcuguugcuggggccucugcuggagucagaaggagauccugcugugcuguuucuucucucucgccuguuuggcuuaauuucccaaguggacacgaugcucugagcaucuucugccuugccaccuggaggcuguguaacucugcaaaguuccauuagugucaaaagaaaguaauauguucacuugcucauuugagucacuuggcaucacccauacccuccacguccccuauccuuaaaucucuucucuagauccaucccaaggcaccuaaaucauuuaguaaacugacuucuugccaaaugugcuuauuuuugauuuaguucagccagccaaaguauucacugggggaugggaagguagagagaaggaagggaagccuucugcuauuucugaagguacauuuaaggauauuuauuuaaagugauauuaucaucucacuguacguaguuccuuagagacugcucuaagcaggccugcuuaauguugaaucuauaucucaguugaaagagaaagaaaauuaacuuuauaagagacauguauauaugugguuuuuguacuguaauuuucuuuugauguuuaacaugauaaauaaauauugagaauuuugauuuaucacagcuagucaaugcauuuuguauggguccauaagguaagcuuuugcaaauacaguuacuagaauuaucuguuuuauugccaacuuuagagaccuuuuaacagauauggucuuugaucuuauugugcucaugaguuuguagcugucuuuuauaguucccaaucuaaauguuuauggcaucauuacuuauacacauuauauaauguugagugaaaaucuuuauuaccuuaggaaaaucuaugaagaaaguuuuuauuagccagaacauuauaauaaugauuugaaaaaauuuauguaaaccguuagcaguuaaggagacaauuuuuuuuuguuguuuuuuuuuuaaguuuugaaacagggucucacuuucucacccaggcuggaguacaguggugcaaacauggcucacuauagccuggucuucccaggcuuaagcaauccuccugccucagcccccuaaaaacuacaggcauaugccacuguacccaccuaauuuuaguuuuuuuuuuuauuuuuuagagaugggguuucgccauguugcccaggcuagucucaaacucuugagcucaaguggucugccugccucagccucucaaaaugcugagauuacaggugugagccaccaugcccagucuguaccuuguuuuuuuuuuaaaguauuaaaugugaaaauguaugaaaugcuuuagauuugccuguccaucuacacacacuucuaguuuuuuucuuucuauuguaauuucuauagucuuuuuauuucuaagaguaagaaauaacuuauugagcuuugaguagaugcuguuugaguagacuuuauguuugaaaauucuuguucaaaaauauuuuuuugaaaagaaaccgcauuaacagaagaacaucuuuaaccuccccaucagaaagaaacaugggaacuuggcagcagcauaauuaaaacacauaguuaucuaaagcucuuuaugaguuuguuucaucuuuauauguucuugguagcuuuuugacaaaaacaagacaaagguuauauauuguuucacuuugaagcaggauaaccaaacuuaggcugaauucuggcuaugugcuaaauuucugauuuauagacaugggaaauguuuuuguaugaaucuacuauuguauucacuuuuagaacaugccuuuuauggaaaagaaaggagaaaucaauuuguacagcaaaaagacuaguaauagcuaacauuuauugaauacuaacuguaugccagccacuguucuaaguacuuuuuacuuguauugauuuauuuaauuuuuccaguuaccuugugggauacaaguccuuuuauccuauuuuauaaaagaggaaaccgagguacagagagguuaaguaguuuacccuagguuauguggguaauagcacagcugugauucaaguacaggcaguuugacuauauagucuacuguaaugucauuuaaagaaaacaguuauguaauuauuuaaauuuugauuuuagucauuguaaauguggcauucuucaguugguuaggaauuugaucucuguuauuccuuagaucuucaccaaagugaugaaaugugugugcucauuucucauccuucucuccuuccacucucuguguagaauucucugucauaguucugagcgcuuggaggagaaaagaauggcaugugcaaagcagugugacauggauuuuaguugcuugguuaauugcuuuacauuccauugggggcuuaaagcuuggcaguggagauauacauuuccauguauagaauucucuuuauuuuuaggaaucuaaaauuuccuguaaugaacuguauuaauuuacuucuacccugaacauucucuuuuucccuagcauguuucgccaagggaugcaugacuugaaagucuggccuaauguagaagcagauggaucagaacccacaaaaacuccuggcagaacaaguagcacucucucagaagaucagaugagccgucuugccaagguaaaaaaagucauuuggaacaggugcaaagcucugacugaugucuauuguaguauauauaccuugacauuaugaacucugucagauuuuuaaaaaaucuaaaucuuaacuuuuaaauaauuguuuuauugagauauaauucacauaccauaaaguucacccuuggaaagcauacagucugaugguuuaguaaauuuacagacuuguauaaucaucaccacuauauaauuuuagaauuuuuucaucaccccuaaaagaaaccgcaccauuaacagucacucccauuuucugcucccugcaguuaguuccaggcaaguacuaaucuacuuacuaucuguauggauuugccuguucuggaaauuucauauaaauggaaucauucaguaugugaccuuaugucuggaaaucugucagguuugaaaauguggagcguuggugauauuuucaagaugaccacccacuuuuucuggugacauagccuuaaaguuguuaguguaacauucuagagaagcuuaugccacuuggaagugaagaugacucagacaauuaacuaguauaaaguuucuuuguaagcaaaugaaguuauuaccuuuuucuuucaaaauuguuuuaaucaaguguuuucacuuagaaauauaaaaacuaaauucuauuccgugcauuaauugcaacgcugucauuuauuuugugaacuuccuuucacaaagcacuguguuagauacuguuuaaggaucccuuuacaguuaucugauuaggacacuuucuuguaguuauaauacauacuuuuuuuuugcaaucuuauuaguaggagugccucuuuaaugucuggaggaaguuuuguugcuaagcuuuuaacagcuuguugccuuuacccacauauagaagaaaucuucaagaauaaguacuuggguuggcuaggcuucaugcuucaacacagaauuuuugucaaguucauuuugucuuuuguauugcucuuuuaaggaaaaaugguguuguagcaaccugauaacuauauugaccaauauacuauugucugcuucucccauccauaauuaaauaaaauuuaauauucauuucuucuacucauucugagauuuuguuugcauucugacgugggauauaggaaaggucucaagcuuuucauaugucuaccuuuaagacuuuaucuuagugaugaucuuucauuugagcuacucucugucccuuuuacaaaccuugaauaguuaauauaaauuuuauuagaaucaauucauuuauagccugugggucacuauaauaugaaaaagguuaaauuaaaaaagaauaaagaauaauauuuuuaaaaaagcucuuaaauugucuuuuaagaguagccauuaugauucauauuguaggugaaauucuaagucugagggggaauggccagagucaagaaauauaaagcuuuauaguugcacaguguaacuacauuguuucucuguuaaacacauuauuuaggcuucuguucaccuaaaaaguuagguuucuaauuuuuuucccuaauucuuuuugauggaagguuuaaaaaauaauuuuuguaacaacuaugacauuuuucaggcaucgguguauggaguauaaucauuggaauuagucccaguuggacugcugguuuuuuaauguagcacaacguuaauaguauaucuuuuucauuuuaaucuuuugaauuuuauacuagaaaaaagaugugacuuaaugaucaccuuuuuuaugauugaaacaguaacccuucaugcuuguucauauuugucuuuuaguuauuugugcacauuaacaacucuagaaaugaugacuaagcaugugcagagcucaaugagguguaggaaagaagccuucuuaauguuuuuguuaauugguagcaaucauuauccccaguuuaaauuccuuagaguagccaaguggauccuacuuuuucaagagauaguuauuaaaauuuaugugcuguuuguauuguucagaaugguuagcaguuuucagauaaguuuuuauugguuuguaaaucuuuaaaaugggaauaaaaauuaaugagagugagcagcuuacaguccuccugauaguaauuggagccuagcucuuuuccacauucuuucaucccuaauagaauuguacuuuuaacuucugaauggaguggagacaucugagcuugccgugcugugacagcuugcauuaguauuaacuuauguuccccaaagacuaaacagaaaccaucaaaaugaguaauuacuuuuuuaaggggaaaaauguguccuguuuguagcuuuguuaaggaauugcucccucuuugaaggaagcucuuuuuauuuuuugauguauugugcuaacucgauauuccccucuucuugauauagcaguugcuugugguuuuugagguuucagaacuguuguauaucccagcugcuauugaagagaaauguuuuaaaaaugaugucuuaagauuugacaaaauuggaagguugggcacuuggaaaugcauuauagugggaagagcacuguacugcgagucagaguuuuggccauucugcuaacuuggggaaaauaauuuuugaguuugcaaaaucagguguuuagaauggaugauuuuuauggucucauguagcucuuuaauugauucuaaaaguacugauauaggaaauaauugggauuaucuaccuggguuucauaguuauuaucuuacuagggaauaaaauugugauuauuaauuugcaacuuugaauguauuguuugcaggucauuccuuuuuuucugcaauguguaugccuaggguaaaguguuacauagggcuugccuaaugugaauaauggggcuuugcucuuaauuuuguuguuugauuagugcuugcuucuuaaauuuuuagagaggcuuccugaaaaacaacucuuuccucaccuaaaacauggucuugccuuauacuugagaaaauauauuuugauacuuguauggucuuaauuuacucucuuacucuuuaguuaauuaauuaauuaaguuaguuaauuuacuaacuuaccggagagaguauacuucgguacuuacauucuuaaaauuauauucuuaacuuaaaauuauuuugacugaauuuauuauuauuauucuuaaauucuuaaaauuaugcuuagauacuuaacuuguucuuacaguugugccacaauagugucugcugucuuucacucuuuuucugaugacacauuuuaaaaaguuguucaguuagauugucacucucuuucucaaaacguuuugaaauuguauuagguauaauaaacuuuuaaacaugggaaaguauuuguaugccuccugcuuccauuuucauacagaaggaacagagaugguagauguaaugucuguauuucucacgcuaccauuuuaagaaaaaaaauuaguauucaaauagaugaggguuaaguaguuagaaccaaaugguuuauuucuuguugcaacuuuuauuuuccauccagugaauuuacuaugauuguuucuaauuuuugagaagacaguuggcuuaagacuaaaaagauauacauaaaucuuaauaauagcaaagcauuuuuacuaugcaugguacccaugagccuaaauaaguagcauaguaguaacaguuuucaaacugcaguaugagagaguuuacucacuuauagaacuacuucagucuugauugucuagggauaauggacaagaggacugugaaaugaagauuaacuauuuaauggccugugaaaagacgguguuagauaauuauuaagcaaagaacuuccacuacaagccagacuuaacccucuucugauuuauugcucaccuauuacaguugaauucuaauuacaguaugaauagcugaaguuugaaagccugcuuuucaaguuugagaguuuuuaaaaguccaguucuuucaggaugaauuuagcggaauuaaccucucucaugauuuuaccugauuuugugaacaugccuaguuuugcuuuaaggaaaaaugaguaugaaaaaaggaaacauaaucauuuuccuuaauuuuuauuuuuuauaacuugaauuucuuagacuucuaguagggaaugaaagaaaugaauaauuuaaauacacuauuacccccccacccccugccccauuuucuucuuuuucccauuucuaaguuucccuaauuaauuuuuaguauagugucuuuccguuugaauugauuugugaaaauaauaaaagaccagacuucuagagcauuuauuaaacuuuccuuguccaugacccaggcuuuugguggcugugggccuuacuugagcaaauuuacccauuguucccaucugcucuguuuuucagcuugucauauuauaagaguuuuaugacuagaaugcauauccaccugggguuuuggaugugacuaccaagcuuuaguguuugauuuauauuugaauccaugucuuuagacaugaaagguuagugcaaaagcaugcuucuccacugucuccuuuucauuuuagcagcucugcuugaugccuuuggaaugugcuuuaguuucugucaguuugauuaagaggaggcaaagagaaaguaacaacuagaugaaaaaugcuuuguacucugugugacacagauagguaugggaauguuguugaguagaguauagaggugaacacuguugcagggaagaugugguaagauguggugguguuucaggcugaaccacagagugccuguguggcgucacuguggguccagggucuagaucucagguuuaaauaggagcuggauuuuuuaaguucauuuaguuauuguuucuugagaauagguucaugccaaccacuucaaagagucauuuauaaucuggagcugcagugucuaauaucagagccacaagucgcauguagcaauuuagauuuagguuaauuaagaugaaauaacauuaaaaauucaguugcucugucacuuuaacuacauuucaaaugcuuagacgccccugguggcuacaagauaucuauuggacagugcacaugucgaacguuucuauuauugccaaaaguucuacugacagcauugaucuagagugccaauuuacaaauuuguggugggugaguacaucuuucugguaaccauauuacuugugccugcuaucuaggacaccguauuucaagauacuuuggaaauguaaguagucuucaugauauuguugauuucuuagugaaccaugaaggagcuggaaagguuucucagauauuuuucucaguuuugggaaaucuaaaacggacuguuuuuuuuuuuuuuuuucugagauggagucuugcucugucgcccaggcuggagugcaguggcacgaugucagcucacugcaagcuccaccucccaaguucaugccauucuccugccucagccucccagguagcugugacuacaggcacccgccaucaugccuggcuaauuuuucuguauuuuuaguagaaauggggcuucauuguguuagccaggcuggucuugaacuccugaccucgugaucugccugccuuggccucccaaagugcugggauugcaggcgugagccaccacgccuggccaaaaggacuuucuuuauaguauccuuuuaauuuaaauuuacuugaauaugcugguuguacugcaucuuuugaauaaacguugacaaauuaucacaaucccaaaauaauccuugaaaaucaagauuaagauagcaaggaauuuucuggucacauaauuaauuuucuaaagugggauugaaguaguuugacccacuauaauauuuacccuugaaagaaaguauuuugcauuaaucuauugcaucaaauggguacuuguccuagagcauugauuagaggagcucccugagauuuuaguuuuauguacauguagaaguccucuuucaucuucaccauugucaaaggcacacuucuaaauguugaagaccaaaaaaaaaaaaaauuguauuacuaaguuccugaugucauuauuguuaguguuauuaugacuaauaauaguaacuacauuuauaaucaccuuguauguguaaagugcuuuaauaucaacaaaaccucuuagcauagauugcaaacuaaaauagagaagggauuaagaucauggcuuuagagaccauuuuuuauucaaaucccagcugugaucuugaacuagcuauuuaaccuuuacuaagucaugaaauccucuucuguaaaguaggaauaguaguuauaucuguuuuuggagauuauugugaagacuaaguguaaaugauaaaauguuuaaaggauuuagcauacugcucagcaaauacugagcacuaauaaauguuagcuguuguuauuacuuuuuuuacuugcuuuuauuugagucugacaaguguaggauugggacuuaugcacuacauuguuuuuaaauucaugaaaagaugaaagcguagagaaguuaagcuguuuauuuaugguuacauauuugguaacuugcagaaccagcaccuaaaaccacgucuuuaaauucuuuauggaaaucucuuccaaaauaaguaucagugacauaugcuuaagaucugaggauugagaggaauguguuugcaugaagaauguauuguucuuauuuagaagauuaaaauugaaaauaggagaaaagguagauagaauaugaagcagugucuacacugcagguccucaaguauggcauaaaagaugaugcccguuaagucaguaaacagugaccugccuaugguaagcacccauuacauaucuaugcuaugaaagaauuggaguuaugaaugauauauggcuucaguuguuacgaauacauacuucaaaagcaauuaaaaaaacaguagaucuuaagauuuauuucaucauagucagugcaaccucaaaggacaaaggccuaggaggaaaggaaacauuacugaaaaagguguauguuguucaaaggaacuauuaauaggauaggaaccucaguguacaaacauaugagagaaccccuuaguaaguauacaagagacguacaacagaugcugcaaaauugcggaaacguuuuagagccaugagaggaaguggcuauauagauauauguguauuuuuuuuuuuuugagacacagucucacucugucguccagacuggagugcaguggugcaaucucggcucacugcaacuccuggguucaagcgauucucugccucagccugcugaguagcugggauuacaggugcgugccgccaugcccggcuaauuuuuguaauuguagagacaggguuucaccauguuggccaggcaggucucgaacuccuaaccucaagugaucaacccgccucggccucccaaagcauuggaauuagaagugugagccaccaugccugggccagaaauggcuauuuucuuugugugaucacaaaaaaugaugcagcuaugaugguaacgaagucucauucauucagcucaggcuuuugucagauuauugacuugaucacaggauuauuuuucagaaguuugaggaaaaaaggacacugcuucucuagaccaauuuuuuguuuguuuuuguuuguuuguuuguuuuggggacagggucucgccuuuuuucccaggcuggagugcaguggcacacucacagcucacugcagccucagucucccggacucaagugauccucccacauccucuggaggagcaggaacuacaguugugcaccaccauguuugaauaguuucuuuuauauagagauggugccucacuugguugcccaugcuggucucaaacuccuaggcucaagcaguccuccugccucagccucccaaacugcugggauuacaggcauaagccaccaugcuggaccucuaggcuaauuuacaccacuauaaaagaagugauuaaugaaaagggaguaacaggaauuuuggaaaaaacuaaagaugucacauuauacuuugggauugcaauuauaaucaaggagugcgauaauggaccaaguuagggauaugucaguucucacaaaguuugagaaaggcaagauguuccauucaauugagaaccuauaagggaagauaacccaaaaggaccaagggguucuuugguucuuuuggucccauucucaaggggacaauuuggcauggacuaaagaaggucuuggauuaaaauuugaaaggaaaaaucccuaaauauaacaauauuuuaaaauuuucuuucuuuugaaugcauuaaacgcacauugaagaaguaagccuguguuagacacugaauugauuuaguugaguuauaaucuucauccaagugcccuucagccuaggagaguuagccaaauaauuuaguuaaguaguaauugaaaaccaagauuguugagaaggguagcaaaaaggcacucauugaucuauucaguuuuccuaguccuggaaaguuaacugucaggguuuuaacauuuacaugaugaaugaauauugaaacuuaccccccagaaagaaaaaauugggauucuuuugaucuuaccuuuuuucccuuuuaauuuuacauguagaagaguuacuagcuaggcauguuggugugcaccuguaguuucagccacucagcuacauggaaggcugaggcaggaggauugcuugaguccaggaguuugacaccaggcugaguaacauaagagaccccgucucuuaaaaaaaaaaaaaaaaaaaaaaagaguucacauagcaggccuaaggcugcugugcuuagaagggccugcuugcaagguuggcccuuggcugaugucugagaacugagcuucugaaacaauuccuaacugauacagauguuucacugugucuagacuguuuccacaugugauuuaugaugagcacuugcucucuuucuggaagucuaaaauuuugguaguuguaaggcagagauugccuuugugaccagcucccaguaaaaucccuaaacucucauucggaaaugggcuuuuuagagcugcauuuuucccgcuagagaugugaauauacuugcauguuaucucugaaagacuaagaucagucaauguuuuggauuuuagagauaugauuuaagaagugauuuuuauuauauaguggacaucaguucuuauuacaaauccuauaauggguuaucaaauugaugauuuauaugaauuucuaaaccuguacccacguaaugauauuuuguaguuagauuuuggagaaaugagaaacauuaaaguauccaaggaggagguguuuugaaaaaugaaggcauuauguuuuauuuuacgcuuuuaagauuaguagaacuauaaaaacugaugaaagauuuaaauaauaaugagauacauuauaacugggguugaagacugacagucaagauuccugaauuacagcucucacugauggcagcuuauugaauagcuagcuguuucuguauuccuggguauuuuucauuguuaaaauguggucagaucuccauuaucucugcuaauuauaggaaucaugccauuauuauuauuauuauuauuauuauuauuagcuauucugaaaaggaaaauuaaccucagacuauuuuguuuauaaauuacagcaagcugauuaaguguacuucuccuggauucugaauacacuuccuuccgccuugaauaaauuaugugaaauaauguugaugaauaaacugacauucuggaucaaauuacuuuaacagaauaaauuguuuagaaggaccuauuagugaucuuuuccccuuauuauuguuacauaauuuauuguuuucagaauuuaacacuuaaguuccuaaaauugcuuucaauugauuauauauguuagcacuuuucuugggaaguuuguauucuuuguaagaaauaucuauacuugguuaagucuucacuugguuagguauaucacauaaagaaaguguccuuucuccauagcugaaucacuuaaugauuuagguuauagcucaaguagcuugauaaucuucgguuuucuauuuucuaaucaacugcccuuaguuaugaugucuacaguacaugcagugcaauauuagacuaaguauaguaauuuaggagggugaaucuaucaucccuaaugauguaaccauuaccccauuuagguaaaugaauauacaaaauauagacaguguucuguuaauauguauguauauuacauuuacuuuuuacccacaauauaaaacaauucacuuugggaggcugauggaggaggaucacuugugcucaggaguucgaagccagccugggcaacaugaugaaacuuugucucuguaaauaaaaaaaaaacaaaaaacaacaauugggacuugaccauuuguaauaaugacuauaguaaaaauaaucucauuuucucaaaaacaguaagaacacccuuauuuauuuaaucacuaggaacaaaagaaaacuuccgucuuuuaaauguauguguuuuagaggaagaaaaacgguguccuaaagaguugaagaaugcauuuguuacuuuacaaaucaaaauauaggauccuagauauaacauuuggguugagcagaagagucuuauauuuuuuucuuccucgaauguuuuguaaaugacaauaauaaacaacagaauuaugauaaaugcugaaauuauucaaggcuaucaaauuuauucauugaugucauugauaucaccaaauauaccuccuagauauagguuuuuguauaaauaucugguauagcuuuuauaaacauaucuuauugcuuugauucugugucgccauugaauuguguuauaacaagcguuugggaauaucucguaaauuuauuuuuaaugcuaccuucuguuuuauuaaucacuuugguuugcuuacugcuaagacugucagaaguuuuggauuugucuggaaaccaaugauagcaaguagacuaaauuaguuuuugccagugcccuaaaacaguauugauuuauguucuguaaaucuauuuucugucuuuacaguuauaguuucugccagaaaaauaguaagacacuuuuaagacuagauuuaucuucaagaaguuuaacuaaaugaaacuuuuaugaagcaaauacuacucuuccugaauaauaagauuuacauguacaguuugaaaguaaaauuggagauuugugaccaagacuucauuaaucaggaagauagaagaaacuucuaugcuugccaagaauuaaauacauaggcauaugcaaagucucuaaaacaugcacacguacaugauucuuuuucuaaucucaguaguucaaauaaauuauuuuauacaacugcauuuugucugaaguuauaaauuacggcauagcuuggccgggccugguggcucacaccuguaaucccaguacuuugggaggcugagaaggguggaucauuugaggucaggaguucgagaccagccuggucaacauggugaaaccccuucuguacuaaaaauacaaaaaaaaaaaaaagaaaaaauuagccaggcaugguggugcaugccuguaaucccagcuacucgggaggcugaggcaggaaaauaggaaaaucucuucagccugggaggcggagguuguggugagccgagaucacgccacugcacuccagucuaggcaacagagugagacccugucucaaaaaaaaaaagguacugcauaguuuauauuugauuugagacgcuuauugucuuuuuuugaagaauuacacuuuuuuaguaauauaauucuagugcaccaugcaacuauauuagcagacaaagauauugucuucaaguauuuauuaauuuagcucaguucuauuuuagacucagagaggcauuagagucaaaagaguuaagcuauggccuuuaaccugagggaguuuagaggaaugagaugggagguaauugacaaaaugcaacccuguacaaucauauaaaggguuacuggaaaaacagucuuuuguauauaguaguaccagacauuauuaaacaccuauugaaaaaugguaacaucuucuaauuuauaugguuuuguaguuggaucuaguugaagggcccuuggaagaaagugagagagcaaucaaguuuauacuuggauuuuauuucaggugguuaaguuaaauuaaugagauagggcuuuauucuuugagcuuuuauuaugaagugaaauugcuuuauuuagcauuaucuuuauaaaggcuaaucuuuagugguuuucccaacggagcuuucuccacaauuaauuguuucuuaaauuacuuuagcuuuuaaaugacuuuuauuuuuucuuacuacaaagauaauauacaucuucuacagugguagaauauuguuaaagcacaaagaggacuaugaaagucaccccagucuaccuaccacucaaagauaaucacuagcacuuugguuuauaugcuuucaguaaauuaauaaauguauguguguuauagaugaauaugugaacauuuauuuuaaaauuagaaucauaccguaucugugugcuuaauugaaucuugcuuuuacauuuaauggugucucagaauuguuccagguuauuuaagauacuucuaccacauaauuuguaaaggcuggaggguuuugcauaguguagauaagucauaauugauuucagcagucuucuaugguuggauauuaaaaauguuugaaauucuugguucauuuucuauuuauuugaaaugaaaagugaggauuauauuuuuaaguuguuuuuagacaacuuacuugguuugcucauauccuguauuuccaaguuaucagucauaagguauuacuuucauaucacuguuucaauuuguaguuacacuuuuaagugcuuacuauauugaaugacucacuuauuuccaccuugauguucuguuagggcagagaacuugcuucuuuuguucaacauucuaugcucaucugaaggacagaggacaugauggaaguuuguuacuuaauagccagcaaguuacauauauuuguauugagaguguauaaagauuagggaagagugaccaagggcaggaaucuuuuuuuuuuuucucucuccagcuuccuuuuuagugucacucccaccucuuccccugaagccccaaagcucuuugggcagaauaucagaguauacuuacauuuguuuuccauuaugucugucacccuuucacauagaaagccuuucaauaaguauaaauagacauugaaugaauaaaugcuagcuucuauugaacauucauagcucuuauacucaagaagcucauuugucuaguaaaauagagaagaguacggagcaaugaacugugaguucuaaugaucguggaagucugucuauuuccaaggaucacuaucugcucugaaauuuguuuucccugcuggucuuauucuuacacagugcagcaaguuggccuacuuuuggcucuguccuugauacuuuuauuaaacaccuacuaaucugagacaucuuccucaaacacaucuuuuuguucuuucauuaaaucugacaauacagaauuaguacuccaagaaguuucccaggcauguuguuauuugguucuuguggauucuuuuauuuaaauagcuuuuaaaacuccuugcuuuuuaauucuuggagaaguuagggcuaaauuaugccuuuuuuuuuuuuuugugacaguguacuuuucuuccaaacucuuugugacuuccugugaauucuguuaagaaaccuguguuccuuuaaaaagagagaaugaauuuuuuuuuuuccuguuucuugaccuauccccauccuagaaugggcauccuagugaggauuauuucuucaugaguaauugaaacaguuuguccuacuuuuaccuuucugcuuaacagaaugcagauuuucucuuuggaaagauguaaaucacugacauuacagacccaaaauuaaauauaaauuguuaugccaccugugucuauuguucauuuuuggucuuuaguaucuauagaaguucguggauuggagauaacuagaaguugcuuugaacugaugaaaaccacucaaguauaucuacauuguuaucagcacccauaagagaugaagugacauagguuaugggcuaauuagaauagcuguuacaacuuacauagugcuuuauaguuuuauaaaauuaauaaaaaaauuuaauauaauuaauaacuaauuauuucacuuacauugagcaguaaagguaaacggcuuuaugguuugaagagccagaagagacuguguuagcuggaguuuagugaguucguuggagaggugaaggagauuauucugaagaggaaggcagcuauggaucauuuagcaauugugauagcuaguucuagacuuuuucugcugccuaaaguccagccaagagcugacuuugccaucucuaaacucuacacaccugcucccuugcaguggaacaauuaauuguauuauuugcuuggacucucugauaaguaagcgcugugcuagcuagucucuuaggauggcccucaaugaaauaugccuucugauagucacacucuuccacauuauauuaccuugugacugauuuuaacuguuauaaugcagcagaagugaugcugcgucuguuccaggcaagacagcgugacagcuuugguuucuucacauguuaggaacauuaagccaucauguaagaaguccagcuauucuguuggagugaccaaguugaaaaaccacuuggagagggagcagcacugagaauacguggggaaagagaggcccuaccacccugguaucccggcuaagcccacccuuuaucaccaagguguuagaaaugugaguaaagccagcuuggauguuccagcucuaaccacccaaugaauacaauauuaugacuacugauaagugagacuacaagaaaaaauuauuuaaaugucucucaagaagaugauuuugccaaaaaaaagauaaugagaaacaauaaaaugaaugucguuuuaggccacuaaguuuuagggugguucguuauguaguaauagguaaauaggacaggcaucuaggagacauuuugagugguaacuguacaauucuguggaaaucauaaaauuagcucaaagaaauacacagaauuuuugcugucaaucucaaagucagguacaggagacagacaugcaaacaauuuccauagcauaaaugguaccuuuaauuuugcaaucgguuuugcacucaacaauaucuuuccugugaaggcauacagauuuuucucauucuuuuugauuauagcauuucauaguguguguguacucuaguuuacuuaacaguucucacuauugaugaacauuuucauucuuuugugucuaauuuuucuguauugcaaauauggugcacaaaugugaauuucucuaguauaauuuaaacuuauuuucauagugacuguaccaguuuuaguacuggcaugcuguccauacauucuuuaguagcucuuauacaauugagauaggucauauuugguauucaaauaggaaagcuaaucauaugcuauaugggagauaauauauauuagcagcaaacauaaauucuagagcuagugaaaauggcuuuagaacauuucuaauuugucuggauaguuuuaguaaaggaggaaaaaaguucccaccacauucucccacauccaaacuuaauuuaccauugccaguucuuugcucauaggaaauuagcaguggaucaacuauuguaucauaaauacaaaacuaauauucgagaaacgacagaauugaguuucacuuaaagcucuuaguacaucaguagagaggauagcagacuggugguaggaguauaggcuuuagaaucauauagucugggguuuaaacccuagcuuggccacuucauaguaguaguugauagucaucugcaaacuggggucaaaauagucuacaaaauagugugguuauaaaaagugccuauaauuuggcauguaaauaaauguuauuuuuuucuccauuccuauaggaaguauauaaacucuuauuacuaauuuuuacuguuacuucguucguacaagcaaaggauguaaaaugaccuuuuacauuuucauuuauuuugaaaaccaguuuggagcauauugcgaagugaguaagaauagaggcuuccaaugacugcaugaaauaauaccaccuguuauauuuugcaucuauuacuuuauuugaguuuugggaguaagaauagauguuaauacuugaauuuuauugauguggguucagaaaggacauaguuugaaaauggaguauuaagguuggaacucuggucuuccagcuccuacucuagcacucuuuucuguaggucacauugucugaucuucuuuugguuuccuugugacuauuucuaggucucuuuccauguugcuagcauauuugucuauuauuccaccagagccaccacgauauuuaguuccugcuuuuuguaaucaugcuaagcuuauuaauaacuuuucauacauuuucauauagaaauuaccucacaugaaagggaauuauuggaagaaagcuaaauugauauuacuuuuuuuuauuacaaugaacuucagacuuuuugugugacauuaguauuuuuauuucugaaauaguaugaccacauaguugugaugaguugaggaagagaaagaagauugauagugaagauuuuuaauucugcaagagagaugaaauugguggcaguguuugcuguucuuauaggaaagcugucaugauauggacaaugaagcagaagaaacugauauagauaagcuacuauguaaagcuuugauguccaguuuugcuuuauacugucaauuuguuuagaaggaaugagagggguguugauuuuuaguauuacaguuucuaauucaaaaccugguucuaauuugagguccuuggaacuuaccaggaauucucuauggauuugaagagucaaugaauuauuaaaguuauaaaacuaagguuagauugguauguaagaccucacaggacucuaccaacugcuauucuagaaaauugaagucuuuuaucaccguugccuaaaauuaaagcauacaugcauaugugugagcuuaaaccuuagaguauuaaugugcaaacccagaaaaauaccuuauuaccuguaacugucauuuuuucauguugguuagauacauugaaagaugggaagaaaagagaaaaagugguuuauuucccauucaugaaacuauuauuauaauuucaucucuuuguaauagucaaaauacaagaaauauaggaacacggagauaauuucaggaacaacuucauuauucuuuaucaugucaaaauauggcaaauuauggaccuuuuuaaaaaaaauuuaauuguuuuucuuuaaaaaauaaugauuugucucuugccaaguuucuuauccugcuaauugcguaugguuucuauuguguauaggaaaguaucauaugugaaguguacauugccauucugacauuuuugguccuucuuucuacuagauguauauuaaaauuuucgucauuguauuuauucugcagcucaccaaagcucaucgacaaggacacauggugaaaguagauuggcuggauagauugacauuuagagaaauagaaaugauaaaugagguggguuauaucacucuuuuauuuuaaaauauuuucuguaaauuuuuaaauuaacaauuuuuugauaagaauuauuauuagguaucuuacaaauauaggauuaucaggguuaaccccuguagcugggaauucuaugcuaauaacuggaaaauuggagauaucagccuucccuauauuuuaacguaaugucaaacuaugaaguagguaguggauauucaaagauguucuaaauaucauaugagugaagccuaugcagacuuaaugccucagugguguguucucugucauaucagcucauguucaagucagcguuggauaaaucuuccaucagcacagugccagcuuuucacuucaguuaccauaaaucauuucagcaaguucucucuucaauuaauuuauuacuugucuauguacuacauauaggacuccgcacccucuauaaaguuacaugauuuaggugauuuuuuucuugaccuuguaugugagccaguguguauguuuaaauaaagauggcuucaaugagaguccugccaaaaguuguaacaagaauaguuuacuuuuuuguauauuugcucuaaaaugccagauguuaggccuaauguuccacaucuagagaacagaaacaauaauuauauuaaucaaauuaggagagaaggacaucaauuugugauuugucuaauuuauaaugaccauaaggcacaacuuacuuaauuuauauucuccaaauaauuuucagcagguagaaagagagaaguuuuuaauuuuacagugaacuauuacaaaaguuagauuuuagcauuauucuuuuauuuuaaaauaaagguagugauguuuaacaacauuuauauucaauucucguauuugguaccuuuucuaaauuuauucauaauacauuccuauauacauaaacuggaaggaagccuuuuuaauuuuuauaauagucacuuuuuaaaaagaguuuacucauaauacuaacuuauauuuuucucuucuuaaacuuagauaucacuggguauagaaaacguaauguuagaguuugcccagccuuuuucauauuuuuacauuuuaauuucuuugaaagaaauuaccauuaccaccgcauuacuauuacaaaauagacuauaauaugcuucauaaagcugaagaauuuaaguaaccucuucagaccuuuaucauuuauuauuucuuuuuuuuguuuguuuuuuuugggggacaaggucuugcugugucacccaggcuggaguacacugguaugcuuagugcagccacaaacuucuggacucaggcaguccuccugauuagcuucccaaguugcuaggacuacaggccuggcuaauauuuuuaaaauuuuuuguagagucagggucuggcuauauugcccaggauagucucagacuccuggcuucaagcaguccucccaccucccaacgugcuaggauuacaagugugagccaccaugccuggugauuuuauguuuuagauguaaagccauuuauaaagguguuuugggucaaggcuaaucacccgcuuagacuucauuguauuuucacuuuaucaucaccuuaguauagucaugugccucaucauaucauuucagucaacugcagaucacauguacaaugaugguuccguaagauuauaguacuuuauuuuuacuguacuuuuucucuuuuagguauguuuagauacacagauaccuaacuauuguguuacaguugcccacaguauucaguacaguaaccugaaguaacaaguuuguagccuagggguaauaugcuacaccauauaaccucggugugcuauaggcuauaccaucuagauuuguguguuuacauuucaugauguuuacacgacuaaauugcuuaaugaugcauuucucagaauguacaccugucguuaagugacaugugaccauguuugcuuuuuuauuuuaaaggggacacaauuauauaaauaacuuuuuuuuauguuggaacaagaaguaauuauuccgcaguauauuuaaaguguggauaaaaauuuacaaaugacaaaucauuuuaagaccauuuauaaauugcgaaaaacuuguaaaggcuauacuugguaaacucaaauggccucuguucuuagguugcacacuuuucuuccuuuugauuuuuguuacacauauugauuucuaugguuuagucauauaaguuaagggugaacuuagcuuaaaauuguuagaaggaaaaaccauucuuuuuauuuuugaaauaaaauaguucucaugaacaugugugcaaaauaccuucaagauuauaaacccaaacuacugaauaaaccaaaaauguuaaauuugagaaagcaguuauaagugcauaguagacacuacugaauaaacaguagugcugucuauaauaaaauaauagugcuguguaaaacacacuacauguauauaauaaaauaaaaauguguuauguuuugacuuguauuugauagauacauguauuacugaauuaggaaaaaugauacauacugauccuuuaagagaauguugaaaauaaucauuuuucaugaaaaucauuuuuuuuuucagagugaaaaacgaaguucuaauuucauguaccugaugguugaauuucgaugugucaagugugaugauaaggaauaugguauuguuuauuaugaaaagguauuucccuuggaacuguuuuuggucucuaaaguagaggggagaggaaacauuaaaaaaauauuguuguuccugcugggaugaauuauuugguugcaggguagcagcagacagcugucagcagcagcuguuuauguauacagaaaucaaaucauauaacuacaacaagauuacaaaagccuaucacucauguaaugcaguucuggguuacagaauucaauaaguaugcaagugauuaaaaacuuugugauuaauuguucugcaaauuggcaaguaggacacuaaguaauggcuucauuuacuaauauuauuuauuuaaaaaaugaaagggggaaauuauauuucuaagugguaggcuauuuauugaaaguuaagagucuguuuguuauuugaguguauguguaaugucuauauguggcccucacugaaguauacuuaugaaauacuucagaaauguccauuuguacaauagaugcaaaauuaagacaauuuuaccaucaggcuggguaauaacaaauaugcaguuauagauuugcuuuguucugcccauuaugcuacagaaaguaguucuguguuuauuauguaccuacuugaaaguaucuuccuuaaaugcuuguagaaggugcuucauuuaaguacuacagaaauaauuauauauuuaaguacuacagaaaauaauuguaugcaggccaggugugguggcucaugccuguaauuccagcacugugguuggcugcgugggaagauuacuugagcccaggaguuugagacccgccugggcaacauggcgagacuccaucuuuauuuaaaauaaauauaaaaaaaaauguaugcauaguuugaaaccacauaaaguaucuucuauuauuguguuaauagucaacaaauguuaaaucagcauaaaugaugacagacuuuugauacauggcauaguaguagauuaauauuucuucuagcauaugaccaagcugauaugcaguguauuuguucauuagaagcaguccuuuuaaauuaaauuuacauuuuauuguuguuuauuaaagcugucacaagugauuuuuaaaauauguauacuuuuauaaauuacuauuugaaagguuuucauaaugaagguuugaguuuuuacaguuuauuuaugaucuuuuuucaaguuacuguucauauuuuugucuuuaacucauaucccuuucacguuagugaaagacuaggaaguguuaacuuguuucugccuuuuauuuuauaaaugguacuccuuggauagauuauuuaacauuguuuauuaauuuauuagaaaaaauacaucaaaacaagggaaaugugagugaaacuguucugucaccagugcauuuuaauaaaaucauauuuuacauuuuaaacuauaugucauuucauuaaaggcaguauuuucugcccauauagaguuuguauugcaaaaacaugcuaauggagaugguacuuucaaacacuggagaugugaaggauccuuugaaagacagcuugauagcagaugaaauaauaacagaauagaaauuagaagaauuucaaguauuuuugaaaagguucuugaccccuuucuaccacuuccugaaaauugcucauaaauuaaugccugucuacccacccugucauauuuccacuuaguguaaagauugcugggccaguguauugaaucuaauggaaauagacuuucuugucaccugucuugugacagauagccuuagugaagauuacuugucacagcuaggcugauaaauguguuuucugguguugugacugagaacaagccuguuaaacaacggcugugggaauuugugguuuucuguaagacucaauuacugaacugaaguaaaguuacagugcuuccccgcuuucagucucucuugaguuuguugcccauauuuaaaauugaaaacauacuagcauuuggaaauugacagaaaagcuugaugcuaaauauacagucaugagaaagugaauuuugaccuuaauuaguuuagccuuuuuccaguauauuuggcagugacauuuuuauguugaauuaccuuucucacauuggagaaaaauaaaagccaacauucuucaaaggugauaauaccaacaaaauaggauggcuuuauuucugaaaaacugauugauugauuuuauuauucaaguuuagauuauguugagcaggugucccuuugagaaacaacguuguugauucucuagcuguguguaaauuugaguaauauuaacccuacacuuaaaauucugcuucuuugaauggaucuccauuaugauaccuugaaaaauuaccaacauccacuuaguuuuugcaaaugaugcaacacauccauugugccacauuuuacauauagucugugguuucuuguucugaguuugaaaauuagcacguuuuuaaaaauccacugucauuauaugaacgaaguuuaaaaaaaaggaacaacucgaaacaaucuaauuuccagaccucauaccucuaaaacuuuaguaagaauuuuguuagaguuuuucucaaaacaauuucauaaucaaccaaggagagguacaaaguggacaugcauuuuauaauauuguuagaagaagauaaggauuucuuuaaagggaagaaugauguucaucaaauagaauuaaaauacauugauguguacaucauauacugcuuccuauuguauuaaauuucuuuuuuuaaaaaauuauugcucuguaaucuaggacggugaugaaucaucuccaauuuuaacaaguuuugaauuagugaaaguuccugacccccagaugucuaugguaaguuauugugcaauuuuuuuaugaaaguacuuuucuucagaguaauugugaguuagccacaucauguacuuucuuuaaacaaaguaauauauaacugccuccguuaccuaaaagugauucauaaauucacuuuagcaucuaggcacuguuucugauggaauuuuaugaggaauauuaacaucuuaaaacuaagguaaggguagaguaggguugggcauccacuuuguuugaauugcugaaagagcuaggcaguauacucuuuuuuuuuuucuucagguuggggguauauaaucuugaagugaagacuuggcagaacugguauuugaaagauugccaucauacagaaggagaauuugccuguuacaggaggauucuauaaccaggaugaaugcgugaaaguuuuagggagaccaauuuguuggaaaauagggaagauugcuguagcccuagaacuguucaauuuggaacgugguaacuuggaugauggugggauaccuucuuauuaacgaauuuuugagaugauagcuuucagggauaugaggauaagaauucauacaaugcaaaagagguuuaauuagaugacuuuagaauuacaaacuuguaggcacaaaauccuuuuagcagcacgauaguuaccaugauuuuugcaguuacagcucauuuacaucauuccaacucuuuuuguucuaauuuuauacauuucuaauuagauuaguuaccuuccucaucagaccaaaguggauuaaaauugggacauuggaugaugaaaacaugaugauugagauaaguacaggucaugaaagcaggaacggcugauggccuaauaucaaaggaagagaugggcagcagggaaaguagaguauaaaaaguuaaaaagaaaaggccacuugcggaucugguaggaacauucuaaagaccuugauaguuccuaugcauaguauaguagaauccaguuaaucccaaauuggcacugaauuuucaguauaaaaucaaauuauauuuuacacuuuugauauucagagcacacacuaaguaugaagaaauucaguucagccugcaguuauaguuauuuguuaaaugcagaaacacauuuuaaauguaaacuuugggugggacugagaugauauacagcuguaucugacaauaaaacagacuauaauuacaauaaugugguagugacacacauguguaaaccaauauacugguugaacagaauuaaaagcccagaaauacauccaaguaugcauggaaaucuaguauaugauauagguggcauuucuucacuaagucauaauacugaggaauggaauuaauuuggaaaaaaauaauaaaauuauauccauaacucaugccauacauaggaauaaacuccaaauggaucuguaaucuaaauguuaggaaaugaaacuaggccaaacaugguggcucaugcuuguaaucuuaacacuuuugagaggccaaggcaggaggaucacuugagcccaugaauucuagaccagucagggaaacugagggagaccccaucucuacaaaaaaauaaaauaaauuagccagguaguggcacguaccuguagucccagcuacuugggagguugagguaggaggauugcuugaacucaggaggucaaggcugcagugagcuauauucaugccagugugcuccaguuuggucaacagagcaagauccugucucaaaaaaagaaaccacacuaguauuuuacugucaguguagggaaagacuuuuuaacugugacucagaauccagaggcaauaaaauaaaugauugauaaauuuaacuacauuuuaaaaauuacauggcugaagagaccaacaaagccaaaagacaguuaacaaacugggagaaaauacuuaacuacauacauuacagauauauuaaggcugauacauaaagaacucuuaaaaaugaaggacaaaggaccauaaagccauuaaaaaaauuaggaauaugacauagacaauucacacaugcaauaaaaaauaaauaauauaaauuuauaucuuguuuuaggcaaugacaguaugguuaaaacuaauaauuuuguccauggguaaaauagcaccagauguguauauucaagcguugugauuauuguccuugcccucaguaacugauagcuuaaauaacugcuaagaugauaauacagugacaucacaaggucauuaguagcugacaggaggaaggaaugcuuuagucuauguugucagggaagauuuuacagugauggugauauuugauugguuagaggauauggaaaccuugaauauguggagagugaagggacgauguuuuaagaagcuguaaugacguguguauuaugggacuaguggaguuuaaggcauacuuaguuucccagucuugagaaggauacauauuuuuaagauauguagaagacugcuaaaguuguaucagaacaaaacauuagauauuauuaaaugcuccuaaguaccuuuucuauuuaugaauagcuuuugaaauuuccuuuuggugaaguuuacauugucaauauuuuaaaauaauuuguaggagaauuuaguugagagcaaacaccacaagcuugcccggaguuuaagaaguggaccuucugaccacgaucugaaacccaaugcugccacgagagaucaguuaaauguaagagaauuaugaaauauuaauuuaaaaauaguuaaauggguguucugguugaaacugauagcuaucaccucacuuaaaaauuauuuagaugcacauuuucuccagguugaugaauccuacaucauguucauaauuucacagaucagcaguucuguuaucauuuggggcuuuccauaaauguguuaucucuggagacagaacugcauauacuguauacuuucaugucaguaguauucuuagaagcuggcccuaagacauugccugagaggacuuaguguguacacaugccuuguuguaugcauugacuuuaaaagaguuuauugugugcacauuuuuccuuuuucugguagaagacguuguuauuuugcuagguuuuguuucugguugaauuaaaugaacucuccaguuaaauauuuuccuauggaauaugacuuuaucuucuuuucuucuccuuuaaacugcauuuuggacacauaauuauaacaaauuuaaggccuacuugacugaguuuacauuuuccuugcuuguguaauaauuguaguauagaauuauuuaaauaaaugaaaaauauuaagugaaauggaaauauauaggacauguauuguugacaaaauuaguucuuuuucuuuuuuuguuuuagauuauugugaguuauccaccaaccaagcaacuuacauaugaagaacaagaucuuguuuggaaguuuagauauuaucuuacgaaucaagaaaaagugagugucuugaauauuuucauauaucaaauuuaucuaccaacuuuguuauuaaugaucaagaugaggaaaaugccauggaaauuguuauugucacuuuaaagaaaaguuacagagcaguauauaugagacuccauuuuuuaaaaaaauuaugaaauucugcauacaaagacaccuguaccuguuuguugacucauagacaaugucugaauggguuuugaagucagagagacuuggguucguuuuccagaaguacauuuuacguuuguuugguaggaugaggcaacuuacuuuggcagcaugguguccuuauuauucuaauggcgacaguucuccuucacaaguaagauaauacagguaaguaaccugguagaguaucuggugcauaguaggugcagaguaaaugcugguucucuucuucuuaccucuuugaaccugggugacuaggaaaauacguaugcuuuuauaauaacgaaacuacagaauucuagacgagauguggcuggagagagaguaugagaaauauaauuugagaugugggaauucaguugguggaguagcauacagguuggcauacaggauaacggguaggucaaagcucaaagcuagacauuugcuuccuguaauaaaaccauggaguggauaagguuucuggagagagaauugugguaaaguagucaucacuaaccugaagucuuuggacacuuagucuugagucuuacuguugccccuaagaagcuuuuugacuacaggcaaauuacuuugccuguauaagcuuuaguuuucuuauauuuaauaugagacaaucagugauugugaacuuugucuccuaguuuuuaaaauagucuguaaaaucuuaaaacagagagccaagggguaccucuuaagguauaauaauaauagcuagcauuuuuuaaacagauacuauguaccaggaauucuuuaaaucccauaacaaccccacaauguauguauuauuguaacuguucuacaggugaggaaacuugagccucagaaagauuaggggaccugugcagacucacaaagcuuauacaugcugccucuugauaugcuugcaucuacgaauuagaagaaaagaaagucagugaagacguagaaaagagaauuauagagaaaacauuuucaacaucauauacaugccuuagcagacacccugaaaugcauuagaggaagagcagagaagcauuaggaaaauuaauaucuguucaggaagcuguuacauauuuauuugagaaugaauggauauguuuuauaaucuugugauauggucuuuacuauuuuaaguuguuuuucugaaccaaauguccuuucuuuaguuucuaaaguaaagauaaaaauccaguuacagcucaucuuaacucuucagcuuuucugcuuugucauuuauugaugccuuaggaaauucuuuguaaaugaaucauauuuauucuccuuuauauccauaauaagaaugagagaagaauuuucaauuuacuauagcuuugaguguaauucucuucaucacugaagaaaaggaaauauucacuaacagaaacacagguuugugauuuguguuuuauuaaaagauugaguuagugucaugauacuguguuaaaugaagaauaaccuuggucacagaaacugcaucuugaaugcagcucagugucgucuuaaauacacagcuagauauugaauugaaccuguuagaauguauagguuuaaaaagcauacaggaguagauuuacagagcagaacuuuuuuagauagaaagguuugcaagaaaaauuguuuguuuaaacaaguagucacuucccaccgaaauucaauuacuucuagauaugugcaaaagaaauaaaauguucaagugauauaaagugugugacaaguuucauuuaacuaguugauuucaaguuuucgaaaggugagugaugaaacuucaauucucaggauauguuauaggauucuucugaccacuagaguagagugaacgauauguuuuaauguucagaagucacuauggaguaaaccaaauauauauaggccuugaagugaccaaaggaauuauucacacagccacauuuguaaccuuguaauaauuucagauggguuuugugaaaaacggauacucucauacuccacccauuaauuuauuuacagaaagaaauucuuuuagcgucagacucucagaaauuaugauuuagguuacuugacauuugggcccuggggcugaaaagcuuuucuagagagaaggcagugcucagaaaacaaauuggaggaaauugguucucacaaagucacacuuuuuauuuuuuaauuaaauuuugucuuucuacccccuuuuuuuuuccuuaaugaccuaaguauuucagaugaaaaccuucuagucaggacuugauguuucacccagaaaguucauaguaauaacuuuguucaauuaaauuuguuaccauuuaaauuuaugaaguauuuucaaauucacaguuuauagcauguaggaagugacccauuucuguggaaccugaaauaugaauacuguaauuuuucaaaacuauuugacaaaaacugcaauuacuuuugcaccaaccugcuuuuacaauggacuuuuuucuuauaaaaauacuaauuuaaauuaacuccaugccuuuugauuaugcuugggggaaaaaagcaguuggaagagucauguauagugaagauaauagugaugcacugaguguucuuauaaggcuguuucugagacagugacaugaggacaaucaucauauuugugucuccugacaagaaauugauggugacccaugggauaaaugaauucaguucagcaaguauucauuaucaccucuuggccuagcauuauauaagacuaugagcuuucagguaucauguccuuguauucauauaaauuaaaauuguuuugggguaaggauauuuacacauaauuaaaauuaggaaguauagcauaguaauugauuaagggucacucucuuaauaaacauauaaguaauuaauauaauauaaauguggaggaugaccagaucagugugcugugacaugaggaagguuucacagaacaaagauugcccuuaaagugugagcagacuuugauagcauuuuuuauuugguggucauuuuuuuauggggcaggaaagcaugaguaagguaggcuguuagguucaggaaacaguuuugcaugaaugguuaugaaauagaaaagauggcaucagauugugacgagccucaaauuauacccuuaggaauucaauuuuacuggcgacaagaaacgacuaaagcaggaaaauguguguuaacaagugauauuguacuucucuuuuuuucuuuggagacagaguuucacucuuguugcccaggcuggacugcaauggcaugaucucggcucacugcaaccucccccucccagguucaagugauucuccugucucagccucccaaguagcugggauugcaggcgugcaccaccacgccggcuaauuuugucuuuuuaguagagacaggguuucaccauguuggucagccuggucuugaacuacuggccucaggugaucaaccugccucagccucccaaagcgcugggauuacaggugugagucagcacgcuggccuaacaagugauauuuuaaggaguacaaacuaggguagauuggagcagagcagaaaaugaaaaaaagugacauaauuaggagaaucauauacugacuuagagaacaguuuuggagggcaagggauggagaagaagcuauacaaguaaguugacuuuggagacaauggccagggguuaggccugaaccugauggauuuauauacguguguguucauaccccacuuuugguaccaauuuacuguauuauuccgcuuucacacuucugauaaagacauaccugagacugagaagaaaaagaauuuuaauggacuuacaauuucaugugacuggggaggccucacaaucaugauggaaggcaaggaggagcaagucaugucuuacguggauggcagcaagcaaagggagcuugugcaaggaaacucccccuuauauagccaucagaucucaugagacuuacucacuaucaugagaacagcaugagaaagaccugcccacgugauucaguuaccucccaccaugucccucucauaacacgugggagcugaagaugagauuuggguggggacacagccacaccauaucaguaaggauauaucgcaagugggaagaaacgaaugagauguuuucauguuugaguauuuggaaucaaaagcauuggaaaagcagcaaaauagacauuucugagaauuuaguugguagaaguuuaaauuaggaauauauauaugagauauaguauuuucaguucuggggugauugugauucuaagaauaggagacaacuggugauuuucagaucaaaugaauaaaacauaguaacacauauaguaaagcuaacauuugaugucaacaucgaaauagaauaaaaauaauaacugauaauaaacuauuuacuauaggauacuguuacaaacauuuuacauucauuaacuuagucuucaccacaagccuaugaaaaaggucucuuaaaaguuaaugugcuucaauuuagucagcuaauaauugauagagccaggaauuauaauuggaacccaaacacccuggcucuacagccugugcucuccaguaaucuguggaaguuacacacagagagagaauugcucuuuacaauucucuuuacauuuuuacauggaucaguaaagcaucuuuaaaagaccuagggucauuuaaaaaggccauuauuauugcugucuucaaauucuuacuuuuugucuuucuuauucuuugacuccuuguuuucuucuucauucuguuggcuccuuguuuacauuuguaacauuuaacauuaaaaaguugugaaauucuuuguacagugccuuauguuuuuuggcagcagcauacuucauaaaucuugcuaauaagucuauaaaucugagaaucuaaguuuuagauuguuucaguuauugaauugaguacaucggcaugcuacaagauuugcuuauaauaaguacauacccgcacauuucuauuaagacugcugauguacugugaaauggaaaagcuuucacugucauuauuuaagaaguauugcuuuguuuccacauucaaccuagaaauacguuuuagaaguggaaaauaaauucauggaauaaguuaguagggcaaucuguguucuauacagaaagggagcauuauacuaaauggugugcaggagguguagaggaaguggacagcuguccuuggggaaugcagacuccaguuauagagauaaaaaugcccacaaaaacauuuggcaguuagaaaaacaucauuuaaaugacaguaguaaaauugagccagcuucuaaaggaauagcugaaaguugccgaaaacuuccuguaaaacuuucaacaagaugacuuuagaggagaugauaucccuguuugaugaagaguauaugggaggaauguacacagggguuagagagacauuguuaauguaaguuaacugggcugaagcauggaagggcaaugagagguuaaugaaauggguuugcauugugguaagugguagcaaugaaauguuuugagaaagaagccaagguuauuuguuuauuuacaaauuagaauguccuaucaucuaguugaaaccacuuuguaacaguauggcaauuaucuucaaauauuggaaagguuguccacaucguauggggcuaaauuuacucccauucucuacaaagaaugaaacuaaccaauuagaaaaagcaauaugaagacauuuuugucuuuugguucauuauaguuaaaaucaaaacaaaacaaaaauggcuuagcuuucuaugaauauaauggcuauuuuggaaauuaguuccuggagucacuuaaguaaauauugggucucuuuuuggcauucauguugugggguauuucugcuaacaauaggaaauuugugcuaagaucacuuccaacuugagcuucuaagaguuuguaugaaaugauuagaagagaaacucguauuuaguuucuuagcuagaaggcucuguccaacuccagaugugucauauaaugagaaucaggcugaagacaaauauaggagauauugcuaggaaauaauugaaaggaacuggaauggauucaggagauuaguguugucagaguaauggcuccaaggggaaugggacuaacuagggaauggagcgccuuaaugguaaggaagcaccaucugguggaagaaguauggggcugagaauugguggaccugaguucuacaucuagcucaugcaccaucuugaggugaugggcaagccauuuaucuuugcugagguuauauacaauuuaagcauugaacuagacaaucuccauagugccguuuuucuuaauaaaaucaagaauaaguuaggggauggguuugaagguucauuuagugucauacuaacagaaauuauguuuuguuguccaaguagacauuuucuugaggaauugauuaguuuacuaauaaaaagauuuugguugggcagagcaggggucuuaacauuuucaaguuaccuauuuuucaacaaauagcaacagaggaagacaaagaagaagaaaacaucuuggguucagccaggaaaguguugccuuugagacccagcaauaaguauugcuuuuuauggaaagcaaguacaugcuuuucuuuauuuucauuuguuuuuguagagaugaguucuugcuguguugcucaggcuggucuugaacuccuggccucaagcaauucuccugacugagcaucugaaagugcugggauuacaggcaugagccaccacaccuggccaagaaguguguaccuuucuuaaaagaggacuuacuguuugugcaaugagugauauacuccaagacaauuugcuuaacugacagucuugugaaaacuuccgugugcugccuauucaagggagugagguugcagaaagauguacaaccagccagaucauagacuguuugcugcuguuucuguacuuacccauuuuuaugcuucuguuuugagguuuuguuggauugccuaucuuuuuaaguaguuacuucacagagauacguacauacuccacaucguuugagucuucauguuuaaguaucugcgaaagccgguggucauacucuagggaggugaucgagagugaggcuauugggaauuucugcccuagcauggcuuccggcccuucgcucagugguugcaguauuuucuguuguaaaauauagguuuucucuaaggcaucuuagaguucgugagaaaugccucaacuauuuccaugucuugagcccugcaguauuuuaaaauaacaauagcaaaaugaagaaaagccaaaacaaauuaaaaaauucauagugcucgcaaaugauuuggccuggaaaauauaaagauacagggaacaugcuuuuuuucuguccugcagugcuucuauaagaucauauauauaacuucauuuagugcuuacacaaggagucuaucacugacuccguggcucugucauuaggaccuaguggaacucugccuagucaacuucucuaucccaggaaauaggcuguuucuaauuuuuaaauauuuucugauuuuaggccuugacaaaauucuugaaauguguuaauugggaucuaccucaagaggccaaacaggccuuggaacuucugggaaaauggaagccgauggauguagaggacuccuuggagcuguuauccucucauuacaccaacccaacugugaggcguuaugcuguugcccgguugcgacaggccgaugaugaggugcauuauuauuuauuauucugcuucaaugggucauuuuaaacuagagccuaauuauaaacuauguguguaugugugugugagagugagagagagagugugugcacaugcaagagagauuuuuagaagggaagaggauauacuagguguauuuucagaaggaaaauuaaaauaugccucagaggacuccucugugaaaugaaaauuuacuuccugaucuguuacgugguaggacagucucucccaggacauuuaccuggcagcagagcuuguauugcucugucuggaagaaggaauucuagugaaaaaugguuuaaugcagcaccagcuagggaauaauucagaucuccucuaucagucaguauacaacaagccacauuuaauuguagccuugaaaagcccuuggggccuuuaaagcuuagagaugcauggucaucuuccucuccuucaaacucgccuuuuaaacuuucagcugaugacaauuauauguauauguagauuuucugaagggguuuuggauccuuggaaagcaaagauugccaacuauaugcuggcuauuuauauacaguuauuuaucaguuaaugacagggaaguguucugagaaauguguccuuaggggauuucaucuuugugcagacaucauggaguauacuuacccaaaccuagaugguaaagccuacuacacacugaggcuguguacuccuagguuacaaaccuguauagcauguuguuguacuaaauaccuuaggcaguuguaacgcaaugcuaaguauuuguguaucuaaacauagaaaagguacaguaaaaacagaguauuauaaucuuaugggauuacugucauauaugugguccugucuuggcugaagcauuguuauguggcacaugacuguucauguaaggccaucagggaaggaagaacacuuuuuugacaaaaagcauugcuggauuuugggcuuuaauaauucuuuauagauagacuaauccagcaacuuguuuucuuaauuuuuauagggugaauauguucuuaaacauaaccuaauaguuuaugcuagccagcaguacuuuaugggauguggaguaacuucucaagcuucaauauauauagcaaugucgaucgcauagaacaacuauuaucaaauaccuuuuuaagagggaggggacagugagaucauuuugaauuagugguaucugaauuucaagaagcaaauuaaauauuuauuaaaguugaucauuguauguguguauuuaauuauggugaaauuuaaacacuaaaguaaauaguauaaugaaccccaacaaauaauucaucugucuucagcaguugccaauuuauaaccaaucuuguuucaucuguaacacugcucagucucuccaccccaacccccuaaccucuacuagauuacauccuucugacuucuggccuacuggcuuuaacaaaucagggggcucccauaacccucuccuugggugugauaauuugcuagaaugacucacaaaacucagggaaacauuacuuacuauugauuuauuaugaaggguauccuaaaggauacagaagaacagcuagaugaaaugauaauuugccagaaugacucacaaaacucaggaaaacauuacuuacuacuauugauuuauuaugaaggguauccuaaagguugcagaugaacagcuaguugaaaugacacauggguugagguccugagcacaggagcuucuguccccauggaguuugcaguauagcacccuccuggcaugugggugcauucuucuucaccaacccaaaagcucucagaaugcugugcuuuucugagaaaagcagaaaaaaucagaguuuuuguggaagcgccauuacauuggcaugauugauuaaaucauuggcugcuggccgauuaagucaaucuucaguucucucuguuccccagagguugagaggguagagcuuaaagucccacccucuaaucacauggcuggcuuuucucucagccaacccccaucuuuaggggcuuuccaaaaguuaccucaugaacauaaacucaggugugauugaaaggggcuuguuaggaauaacaaaaaaaauuucaaugccagcaugcuauauuuuguccuuuuuauuuuagcauguccugaacucugucacuguagaucugccuuauucuuucuaaauaacagcaugauauuuuacugugaauuuuuuuguuaauuuacuuaaccauugggccucuuuuauaggcuguuguucccauucuuuuccuguaacuguauuuuagugaagaggugugugggggaggguagguggguauguuuuaaaaaucauauucuuuuuuuuuuuuuuuuuuuuugagauggagucuugcucugucuccuaggcuggaaugcaguggcgugaucucagcucacugaaagcucugccucccagguucacgccauucuacggccucagccucccaaguagcugggacugcaggugcccgccaccaccccuggauacuuuuuugaauuucuuuuuuaguagagacgggguuucaccguguuagccaggauggucuugaucuccugacaucgugauccgcccccaucggccucccgaagugcugggauuacaggcaugagccaccacacccggccuuaaaaaucauauucuugaauaaacugcuugcguuauaauuauugagccaaaagauaucugcuuuuuacauuuugcagacaauccccauaagucuuuuuacccuugucuuauacuuuuaaaaaauuuguuccuuuauaauacuuuaaauauaugacuagacaaagcuuuucuucuuuccuuuuuuuuauaauuuuauuuacaguuuuuuuacauuuguucuuuccaugaauuuuagaauaauuuuaucauuuucuuaaaacugcaccagaaucuuaaguggaauuacauuauguuugcauauuauaaaaauauugacaccuuuaugacauaucuuccaucacaguggcauaugauuuuuuauucacucacuuaucaauuuuacuaaaaucauauacauucuuaacauuuugauuuauucccuggcaauuauauuauuguuacuauuauaaacuagccuaccccauuuaucuuuuauuuacauuucuuaguuaaaaggaaaacuguuucuguuacaauauuuguuuuaucucaucacuuuauugacuuuucuuacucuaauagauguuagguugcuucuuauauuuuguagguauagcauuaugguagcugaaaagcagucuaguuuuucauugcauuagcuaaaagcugcaaguaauaauggugaauaaaaguaguucaauauucaucuuugucuuguugcucauuguggguacgcuuuuaguauuucacucuaauguguguugcuuacugguuucagucaaaugcucucauuuauguuuaaaguuucucccugucucuguuuguucuuuucuuuuucuguguguuuaaaucaagaauggcuucuauauauuaucaaacacgcuuuugacacucguucauaucauauagugucucauuuuuaucaaucuacuguaaguaugcugauacauuuccuaauguuuuaucagccauacacuuguaaaauaaaucucaauacugucugaauuugauuuguuaauaucugauuuaggauuuuuuuaauggcuauucuuuaucuugcauuauuuugaaauuuuuaaaucauauuuccuacugcuguguaguucaaaaggagacagaucccauauuagaauuuaaugaagaaguggcauuugaguugaaggaaauguagaauuuuuacguuuggaguuuauauuccagguagagaaagcaauaugagcaagagcaagggaacugaaaguacaggaagaauggaaaguaugucacuuagacuggagugugggauauauguaguagccauugagaggcaaaaucggaacccaugucucuaacugaaaaugccucuauggagaguuauucuuaauucaauaagaaaugggaagucacuaagugauuuugauaugggacuucacauuugcacuuugaagcauuagaauuaacucacucuugagaaaaauggugaucacuaucuaguaaaaauuucauagcucuugggaaguauuuacagaauugccugagauggaagccugguuuuuuuuuucuuuuuugcuuuguuuuacuccaaugcuuauguccuucaugcuuggaggacuuuuauauuuuucaagacaugaguauauaaugagaaaacagacucuguacuuacuauugaaguuaauucauuuucauacaaaugaaggaaaguauaguuugaauauagaauauguaaugaccaagaaaucagaugaugauaagugacuuagaaaaguuuucuacugaauuuccccuuccuggggaauuuaauaccgcagccuuuuuuauguuauaugguuaacucuuuucuguaauuaggaaagcacacagguaauagauugagcagcacuccgaaugaaggcuggcagugaaacugaauuacuuauaccuccaaagagggauaccugccauuaaacauauuguuuaauuuucuguuauauaauacuuuuuuccuuaggaaacaacauguaauuauauguauaguuauuggaugccaugaaucucaacuaugauaauagaaaaucagauguuuauugcuccaauuaaaaaguggguuuuagaaacaacacuauagagagacuugauuucccugacuccugacauugacauauuugaacaagaauuaauaagccacauaaucuuccauuuaauuuauauuuaugaugaagucauauguauuacucuuuguuaguguuugccuaaugaccuuuuuaaaaauuauuuggugugagauacaaauucugaacaaaagagaaauauacagucauaccucagagauacugcagguuugauccagaccucugcaauaaagcaaaugucacaaagugagucauaugaauuuuuugguuuccuaguacauguaaaauuuauaaauauaauuuugcuguauguuuauauaguaaauuauacuguagucuaaguauguagacuacauuauguaauguacauuauguagacuacauuauguaauguacauuauguaaugcuuacauuauguaauguacauuauguaaugcuuacauuauguaauguacauuauguaaugcuuacauuauguaauguacauuauguaaugcuuacauuauguaauguacauuauguaaugcuuacauaauguaagcauuaugucuagaaaagcaauguacauaucuuuuuuuaaaauauugcuaaaaauuuuaacaaucaucugagcccuuagcaaguuguagucuuuuugguagucaagggucuugccuugauguuuaugacaacugaaugaucagggugaugguugcagaagguuggguuaccuguggcaguuuccuaaaauaaaacgaacguaaacuuugccacacccauugacucuuuuuuucacaaaagauuugucugcagcaugcaaugcugcuuguuagcauuuuuuccacaguagaacuucuuucaaaauugaagucaguccucccucucaaauacugucacugcuuuaacaacuauguuuauggaguauuuugaaucuuuuguugucauuucaacaauguucacagcaucuucaccaagcauagaucgcaucucaagaaacuacucuuugcugcucauccauaagaagcaacucuucaucuguucaaguuuuagcaugagauugcagcaauucagucacauguucaggcugcaccucuaauucuaguuuuuuugcuauuuccgugacuucugcauuuacuuccuccacugaagucuuuuuuguuguuguugagauggagucuccuucuguugcccaggcuggagugcaguggcaugaucuuggcuuacugcaaccucugccuccuggguucaagcaagucuccugccucagccucccgaguagcugagauuacaggcguaugccacugcgcccaccuaauuuuuguauuuuuaguagagacaggguuucgccauguuagccaggcuggccuugaacuccugacuucgggugauccacccaccucggccucccaaagugcugggauuacaggcacugaagucgucagccccucaaaguuagccaagaaaguuagaaucaacuucuuccaaacuccuguuaaucuugcuauuuugaccuucccccaugaagcucaaauguucuuaaugacaucuagaaugaugaauccuuuccagaagcuuuucaauuuauuuugcccagauccauuacaggaaucacugucuauggaagcuaugaucucacaaaauguguuucuuaaauaauaagacuugaaagucgaaaugacuucuugauuuuugggcaguagaauggauguuguguuagcaggaauguaaauggcauucaacuucugcaucuccaucggagcucuuggaugaucagguacauugucuaugagcaguaauauuuugaaaucuucuuuucugaacagugggucucaacagugggcuuaaauauucauaaaccaugcucuaaacagaugugaugucauucaggcuuuguucuuccguuuauagagcacaggcaauguagauguagcguaauucuuaagggcccuaggacuucugaaaugacgaaugagcaguggcuucaacuuaaagucacugccuacguuagacccuuaccaagagagucagucuaugguugugagagucuuagauggugucuuauucuaaaacaaggcuguuucaucugcacugaaacuuugugguguaguauagucaccugcaucaauaacuuguugcaguuucuacaucaguacuuguugcuuugcuuugugcuuuuauguuauggaaaugacuucuguccuuaaaucucaugaacaaaccucuuuuaacuuccaacuuuucuuuugcaguuuccucaccuuucucagcuuuuauagaaauggagagaauuagggccuugcucuggauugggcuuucacccaugggaauguuguggcuaguuugaucuacccagaccaccaaaacuucuauaucagcaauaaggguguuuaccuuucuuuucauuugugguucccuggaauggcauuuuuaauauccuucaagaacuuuuccuuugcauucguaccuuggcugcucaguaugagagacuuagcuuucaaccuaucuuggcuuuuccugugccuucuucacuaagcuuaaucauuucuagcuuuugauuuaaagugagagacaugcaucuuuuccuuuuacuugaacacuuauugugcacuguagguuuauuaauuggccucauugcaguauuacugugucuuggaauagggaagcccuaggagagggagagagacagggaaacggcugguuguuggauuagucagaacacauucaacauuaauugauuaagugugccauccuauauggguaugcuuuguggcaccccugguuacaauaguaacaucaaagaucacugaucacagaucaccauaacagauaaaauaauaaugaaaaaguuugaaauauuaugugaauaacuacagugugacacaaagacauggagugaaugcaugcuguuggaaaaaugaugccaauagacugcuugggugcaggguugcuacaaaccuucauucuguaaaaaaaaaaaaaaaaugcaaugugugcaagguacaauaaaaugaguuaugccuauaguauuaaauaaggaaauauggguugcuggcagguggucucuguccuccugguuuacaaaauaguggaaaaaccaagaguaaguuauuacaggugcuauaguuguuacaaauaggaaaguguggaccaucaaauauuuacaggagacuuaaccugguuugugagcuuaaagaggagacugaaguugaguugguagucccaaagucucagaauuuucugauuaugaguuucaagugucuaacagggugaaugacaauuagaauuggaagauaauacguacauuuaaaaauuuuuugagcuuugcaauuuucuucacuuuuuaguuauuuuuaaaaguaaaauuuuaaaaaguacauacuugugaagaggacaaguaugucaagacaaccuuuauagagaaauacuggaagcauuuccauccuaaacauuaaagaguuuuauuauuauuaagggaaaacucaguaaagugaaagcuacuuuguugacugacaccuuuuuaguccaaguuaucucauugauugucacuuauggaaaauuuagucuuagcaauuuguuuuguucaaaucucuugguaguuggcaggaauagaaagcaugucucuuaaucaacuguuuaaaugucuguuuuacaggaucuuucauuuaagaagcaauccaaauucucuaaaacuugagcuuucaggaaaaaagaaaacagaugauuuuuaaagauucuaaccaguaguagucauuaaacagaagugcuuugaaaacuugaaaauuuggaauuucuuguguaauauuaaacauagaaugcacucuucugauccauuacugaaaaaaaggauccuucuauaauuucuuaguuuuaugcaaagcaucuugaauccuucccacuuuuuuuuuuuuuuuuuuugaaacuacuaccuaaaacacgucauuuacuggccacuuagucugugccggacacuauacugugacuuucuuuuauuuacuaauuuaacccucaugcucuucucuaagguuuauauuaugauguccauuuuaaagaugaaggggcuguggggcacagagaaguuaaguaauuuggugacgugccaaaaguaauacagcugaaaagugauagauaaaaguaaaauguuuacuugauauuuaggaauaaauuaugucuguaauaauuuugcauucuuuuccuaauauuacuuuacuuuuuuuuguuuuccaggauuuguugauguaccuauuacaauugguccaggcucucaaauaugaaaauuuugaugauauaaagaauggauuggaaccuaccaagaaggauagucagaguucagugucagaaaaugugucaaauucuggaauaaauucugcagaaauagauagguauggauauccagggaggacauauuuucuaguuuguuaauuuuucccuuuucaaauuguuuucucuuuuccuuuccuuagauguaccaaaugcuaguguuacuaauuuugaaguuuuacuagugaauauugcauguguacucacagcacacagauuacuauauuagggaauaguguuuugcaagcuaucaaggcugaauaccugaguuaaaaaucuugacucugccacuuacuagcuguauaaacuugcauaaauuacauauucucuaugugucuccgguuucuuaagaguggugauagcaauauuaacucaucuuuaaggguuguuuaaucauuaagugaauuaacacucauaggaaacugucuaauacauagugcuuaguaagucuuagcuacuauuacuuauuuauguuaaaaugaaauagaaggagcaggugugguggcucaugcuuguaauccuagcacuuuaaaggcugaggugugcagaucacuugagucagaaguucaaaaccagccuggccaacauggugacacccgggagguagaggguguagcaagcugagauugcaccagugcgcuccagccugggcgacagagcgagacuccgucucaaaaaaaaaaaaaaaaaaaaaaaagaaauggaugaaauagaaggacggagcaugcuagugagcucaaauaguuuaauaaaaaguugcauuuuuuguuaacuguuuacaccucuuuaguaguuaaacugaaaauaauagcauauuauuugaauuaaaaguuagcuauuaacaauauaaaaauuaggaguucccaaauguauaucugacacuguaccacguguccacacacauuaucguguuacaacuguccucugagguacguauuccugucccuaauuuagagauggacuucaaguaaauugcccaaacuuuuauguaucuugcaaaugguagaguugacuccaaaucccacauuuuuucuacuuuuugcuuuucagagaaucuuaaaauuugcaaauaguaguaaccauugggugaaaaaucuuagccuuagugauaggaaaugguuuugugaagaucauuagguuuguuauugacaaaaccaggucuaaauuuuagacuuccugaaucaguccagucauuuaaauuauuacaugagcucaagauuggauuuuugaauuuuucuuuaugauuaugguuaugcuaugcuuuauguuguguguuuuauuuggagaagaaccgaaaaagaggaaaauaauuuuucuuucccagguuacuuuauauuuuucuauuuuuaagggaagaugcucuuuauauuuuaucucacucuauauuggaggucuucagucucaagucaugcuuauuuacuuucuucccuaugccauguagaacguuuuguaaguaaaagucuauucagaauuuuaugauggggugaaaacuguaaccuagucuuuuccaacuuacggucuacuagucacuaauuuuguguguuucuuuuuuaguucuuuuuuuaagcucuguuauguuuuuaagaagauaaaagcucuauuuuauuuuuaaaaagagagaaucuuggccagauauguuugggaaaugcuaguuuaaagcuaaaugggcuuaaacaaacaaacaaacaaacaaacaaacagcacuuacccaaaccuuuaauaugcagacuugcacauaaaucucccaagaggcauuacccauaaucuuugaccaugcgcuuuuuccagaguacaaugugacucuaguguugcacagaacacacuuuaggaaguguugcauuaacuagacacaauugaagugaacuguuccauaaaaaauugugcguucucuuauggacagaguauuuuacaucucagugaucucuuuuauuacuuuuucagcucccaaauuauaaccagcccccuuccuucagucucuucaccuccuccugcaucaaaaacaaaagaaguuccagauggcgaaaaucuggaagugaguacaaagcuuuuccagcuuccuauaggagagauccuacugcaugaacauuuuauacuugucuuuaaaaccucaauuuugauuaaauaacuaaauauuacaacuuuauuaaauaacuuacuuuaugaugcacguuuauaacuuuucccccucagcauaaaguaccagauaguccucaauuugagucauuuuauuggugcuuugggcauauaaauggauucauaugcaauaugaaaauaaacuaggcuuaaauauuuuauuagggaaaccuagaauauuuacugucaauguguuuaugaaccuuacuguaauuguugucagugcuugugauuacaucguagaaauguauaacuuugauauuagaguuaauacacuaagcaacuuuuuaacuauacauauaaguagacacauuuuugagauaaaacaggccuguuagacuagugcuacucugaaaaguacuuuggaaagugcauugcagaagcugauguaguacauauuuuuuaauuugucuauaagacuucuaauuuaaaagaaaucauuaauaucucugauguugaaaacaaguaacacauguuuuauuauuagaacaguucaagugauuuuucaguguguguauauauauuacuuuuagucagauuuuaggaguaauuguuaauggcugaaugaaucuuuuaacuauuagcuauugauuaaaguuuguauguuugcauaucuuucgguauaacaaaauauucaacugaaaaaagaauuuuuaaguuacagaaucauagaauccuuagauaagcccuuuaagaagccaaucugcuacagucuaaguuuucccuuucagagcuaagauauugauucauugauucagucauucauucauucacauauauuuuuugagcucuuaacauguaugggaacuguucuacaugcugggguugaugcagcagaaaacaagacaguuacaauguuugccuucauagagguuauguucuagaaagcucuuacaaguuacuuguuacuaaaaaaguaacaucccucuaaaagugaagcaggugagagaacaaccauauggcuaucuggggaagagcauuucagauagagggaguagcaaguauagagguccuaagaccagaguuuaaguguauauguuugaagaacaccagaaacuagugugccugguuugugggagagugagcaaaagagaaccuggcagaagauuggauccaggagagaauuggauaucaguaguguagggcuuguaggccauuaguccgaaugaguuuuccauauugguagcuugaacaaagggugauuuacauucuagaugcugugaagugauuggauucugaaaacgauguucagaauauugauuuacacucccccaucacucaaaauguuuaggcuaaaaaugauaguuuguauauauuucugauauuucucuugugauugaugaaccuaucuguuguuauucaaugauuaagccauuuaacuuuuugucagcugaauaguuuuuuagaggguucagguauccagaaaagaguggcaaucauuuugagugauauuucuaucuuccccuaucccuuccccuauucccauagaguguauuguacaagccauugucaccuuuauguuaauacacaaucaagcugaauuaccucucuucuuaucacaacuugagauaucaacauuccugucuccuuuuugacaccugagcaguaucuuauguccuuccucguuuuauucuuggaguuucaggagaacauuauacgugucuggccaaauguuugaaaggagacagaaacucaauuauuccccaaaucugcucauauuuuaugaauuccaugggucaugagaagaaguuguauuucccagcuguuggguauagcauuauacauaaguuacuagagcaagcuuauuguguuauugaaaucuguacucuguccuaacauuuuuuucugcuuuaucugugaaagaauuagggcaaaauuccccuguaugaugguagaauuauuaauuucuucuuguaguucuguuaguguuugcuuuaaauauuuugaagcucuucaauuaaguaaauaaauugcaucuuuaucacuguuugguaacccucuugauaucuaauaaugcuuuucaucuuaaaaccuguuuugucugauguuaauagagcuuugucuugauuaauguucauguuuaucuucucaauauuuuguugcguuuaucuuuuccuuugaauuuuuuuguagccuuauauuuuagguuuauguuuauauuuaggucccuuguaaauaucauguagcuaaauuuuguuuuuaaaucuaguuuaacacucuguuuuauaacuggaacuuuugccccauuugcuuuuauugugguuguagcuguauuuugacugauuucacuaucuuauuuaguacuuucuauacuuucuuauauauauauaaauuacauauucuugcuugucauuggcuaaauccuucucccuccaccccaccccaucuuauuuaacuuccuucagauuugauaauauuauuguuauuauuguauacacucaguaaauauuuagagauacuuuucuugaaggauaccugcaccuuccucaccauuucuucuuaugucugugaccuacaauaugugaucuuuuuuuauaaagcacuuuuuucuuuaaauuguuuuaaaaccuuaaaguauugcuuacacagauugaguuuuaacauuuacaauacauacuuccuguuucacaguuuuuuaaauucaacuuuucuuuauguucuguaaguaauuuuuuaucaaaaaggcauaguaugaaaugaaacguguuugcuauugaaauauauacaucacuguacaaaaguauaauguucuuggcagauagucaaaagagaaacuuuaggccuauauucugccuauuaaacucauggacucagcuuuauauaauggcuuccugauugaggaguuuuuuaaauuggauuuuuggugcauauuuaaaauguacaccuaagcuuuaaaacuggagauaaaauucuuacugaaagcauuggcacaucuacuuuguaacaacacccucuuauuacucggacuuuacuuaagaaaggaccccuacuguguuaaaaguucuaaucuguugaucccuacucuuucauuauucaucagcucccuucaauguuugcuuuucucugaacauagcuuuuaucccauggcugucauuuuaguuauuauuuuauuaguaccugcaguuccccuggcaaaaaucucaacucuugauaagccucauuaauuaccuacuuucgcuaugccugaauauugcugaagaaaagcacauagcauagcauguuggugucacuauaaauucaugaucacaaaccucagaugagcacucacugcugucugccaucuuccauuucccuagacguguugaucuuccugcucugcagugauuuuucauaccauuuccacucuguucuucaugccccgccucccaaucucuagaugacaauucugccucauacuuaauggaaacaauagaaaccacuagguaagaauggucuguuucccaucaccgguuuuauagacaggaaucccuaccccauacuuuccuucuguuuucuuacacagaagaaacauagcucucuucaaagauguguuauuuucuuuuccugauagaaauacucaaguauguguuagaauuuuccauguuaaaaauucagaaaaacaaaacugucccuugaaaccacaucucuugaaacagcaccuuguuuucuuacuucucuucucaaaggaguuguuuauacauacucuuuucuuccuucuuuccagccuuuaguccauaucauucuggcucuugcuuaaaacccaauuugcuaaguuacaaaaugaccuuaauacuuuugguugcacauucuuuucagcuucuucagaguauucaacaaaguaaauaacuuucuucuugaaaaacuaacucuucucaugguuuaggugauacuguauaucucuuguuuuucucuucaucugucuugccauuucuucucaguuucauuugucagcacuuuccucucuccuugauaucuuaauguuccucaggguccucuucuagucucacuugauacucuuguccuagguuguguuaauaaacucaaauuugcauuucuagcucagaucuuucaccugaguuucagauucaucuauucaaacauguauuugaucuccauuguaugucugacaggcauuuugaacuuaauauuucaaaauacaacuauuuccucuuacucuauagauaggcagcuuuuugucugaaaucuccguuugugccauaacaaaucaauccagaaauuugggaguuacuauuaaugccuuucuuuccuuccuacuuccucuccaccagcagguccuguuaauuauacuuccaagauauuucuuauauuugucuccuuuucaccaucuccacucucauuauuuacucuccuagucuaccguaauagcaucuuaacugaucucaggucuguacuucacaggacaaccagucauuuuccuaaaauguaaaucacaucaucucacucuccucuuaagauccuuuguuggguauccauugcuuuuaaaauaaaauccauacucaauaauaaugugaccuuaaaggucucacauacuuugaccuuugccuaucuuuucagucucuucaguguucacuauauuuuauuuacauuacuuagcauuccuugaacaagccaaacuuagagcuuuccagugucauuuuggucuugccugaaugucaugucuucauuguugccuuuucuaaucucccaaccuaaauuauuucuaugaccauuucuuuuaaugucucucuccucuaccaauaugaagcuccaggaggacaaggaguccucugaacugcgguauucuaaccacuugcauauuuucugauuuaaaauauguuuuauguauguauguaaggauagauaaauggcagaaaaucugaucuauuacauaagauauacagaugaaaacugauaggcaaauguaaacuuacuuauuuucccccauuacuaguagaugauaauauauaauacauuucuuuuaauucuuucagcaagaucucuguaccuucuugauaucgagagccugcaaaaacucaacacuggcuaauuauuuauacugguauguaaaaauaauuuucuguuuauuuucuuauuacccuuaagaauuauuuuuucucaugcuauaaacacaaagaugauuuaaaauaagauaugagcaaucaucaaaagucuagauauaguauuuauaucuaacuguauucccugacagcuggguucauggaaaugcuuguuggcaucaacauuucucucccuuucacuaaggauauaacuuuccaggagcuaggauauaacuggggaggguaauggguacuuucaguuuaauaucuguuuggcauguaaaguaguugaguaugauauuucacaguucuucaggaguauauauuuucacauuauuuacuaaaacauuggaaucauuuaaaaagaaaaaguuggaauuaaaaguuaccuuauggcauuuuaaacaugaggaaacugaggcagaggcuugcuguagcugaacuugauagacucugaucuaggauuaaaucauuuaucuacugcuuugccauuuucaggguauuuucaguuaccuuuucucauuuguuucuaugacguuaaaugggcaagcauaaauaucucuauuucacauuaaaacaauguccugagucacuugaaggaaagagagaaacuaaggcacggaguggcugacuucuugaggcacaguuaauaugaagcguggugcccuuuauuugccccagaauccugaagagaaaaaggcaaguagcuuaagccacaaucagaaauauuuugcuucaauaaaaaaaaaguacugggauuaaacacuagauaagagggcuucaucuaacuuuacggagcaaacaaagggcagagccagguggguaagaccugccuacagccuucuuuaccuuugggagaauccuuaaaacuacuuauaucacuuuuuaaacuucuuggcaugaggcuuuuuacugucuaaaugauuucuaaucuaaucuuacugcucaauuuauagccuuaaacaaauuacaaauuaguagauguccauuguaaaagcucacuacagguugagcauaccaaauccaaaaauuugaaaucugaaaugcuccaaaauccaaaacucuaugaucauugacaugaggugcaaaagaaaugcucuuuggagcauuucagauuuugaauuuuuggauuuaaggugcuaaguauaaugcaaauauucaaaaaucaaaaaaaacuagaaauccaaaacauuucugguucuaagcauuuuggcuaagaaaugcugaaccaguacuuuugaauaaugaugagguauuuugcuuuuugugagaaaauuauacaaaauacgauuuuguuuuaagacugauuugggaagcugcccuugugggucaaguccagccuuaacuucauucucccacucuccagagguaaugcucugcuggguacugccccuguacuuaagaaguagguaacuaaauuggagcacucuuuuuccuuuuuucuuuuuuauuguacuuuaaguuuuaggguacaugugcacaacgugcagguuuguuacauauguauacaugugccauguuggugugcugcacccgguaacucaucauuaacauuagguauuucucccagugcuaucccugcccccauccccaaccccaugacaucagugugugauguuccccgcccuguguccaaguguucucauuguucaauucccaccugugagugagaacaugugguguuugguuuucuguccuugcgacaguuugcucagagugaugguuuccagcuucauccaugucccuacaaaggacaugaacucauccuuuuuuauggagcacucuuuuaacacacacaauuuuugauuuacauaaacaauaaauauuuguuuaguuuaagccuuuaugguucucuuuacaacaaagaaaaaccacugucaacaaucuuaaguaaaucagugauuuuccccccuuuggaaccuguguuuauuuuuuuuugguuguguuuguuuuuuucuguuggccucuguagugggaagaaaaagaguuuccugcuuuuacuuuagcaguuuaauauaauauucauaaaacuacauuuuccucacguuaaauuucauuauguccuugaaaauauaggagguuuugacuaauuguuaaucacuauucuuucuuugaaagguuuacuuagaaauucucauauugccaaauugcuacuauuuccuuuaaaugccaccuuuuaccucuaauguucucuguguuccaaucugaauauuuaaggauaugucuugucgccggucuuauggaaaaauauuuccucaugaaaaucuaaauauuuagaaggaaguaaagagaaaaaauauuugugggguauguuucuaaguuuuugaguaaauauuucaaagcuucuuagguauuuuuaaauuaaaauuuuguauauuuuuaaaaccauuugcuaagaauucauuuagagauauuuuuguuuccuugcaauauucacagaaacuuuucucuggcucagaauuuauagucuagaguauucacuaugguaagagcuauauguguauauacugauuauguggugcuuucaaguuacauauucuuuguguuugauugaagacuagauuucauuauuaaauuugaaaugaguuuugauagaaucuuugaucucuuauuucaaguaggcagaauuuucugaaagcagccaaacaguaggaaaucuguucgaugaaguuuccaacauagcagcugcuucuguucauaaggagcacacuuuuuuuuccuauaagcaaaguacagccccaguucccagucuuauaaacauucaaucaaacuuagauuugauuuguguuuucccacuauaucucugauucauugaaucaauagcauaugcugugucuauucauucccuaaggaguaauuguuuuucccauauuuacagucugccuauuacauauucagaaauacucauggggagaaaagcuauugauguguggacucuugccuuuaauaaacacugcuuuugugaauguaagguaacaauaagggaaauaauuucaaauaguugguuuaaaaugaucauucuucucuuccuuugagcauauaaaaauaauaaaaugugagaauuuaaaugcuucucuaagccuacucuauuauaacaaauguauuaaaauagaaauuuuaauugugcuguuuccuuugaacacuugaauuuccuuuuuucauuuguucccuuucuggugauuuaaacaggauucuugcuguagcuaaauccuuaggggccuauaguugugcagacaauccuuuuaaaaugaauagugucaaccuuuuaagccacagaggggcguuacagucuccaguuuguaaaaugaugggcaucagaaucuauaaauuguugcaguuuuuuauuuuuauagucauucuaggguguugaaauugaaaguaaacuuuggcugcuuugacauguuuucuauaacuuuuaagaccuuucaagguaauaaagguuauuuaugccacaaaauaaaauugccaggaaacagguagcccacugaugucaucuuacaauggguaccuggacaauuuuguuugcauuccuacuuuaagaugacagcuuucaaagaaauaccuuagagugcuuuagaaucuaguuuauugaugugaacagaaaccucagaaaugauucaaaucuaggucuucuagucuugauagcuaaccuugucucucauauuuggagaugacagugucacuuuucuuuuuuuagguggccuuuuuguuugaauagauguuuggcuugaaugauuuuuuuuuuuuuggagaugaaguuucauucuuguugcccaggcuggagugcaauggugcgaucuuggcucacugcaaccucugccucccagguucaaucaauucuccugccucagccucccacauagcugggauuacaggcaugugccaccaagcccggcuaauuuuguauuuuuaguagaggcgagguuucuccauguuggucagccuagucuugaacucccaaccucaagugauucacccgccucggccucccaaaguguugggauugcaggugugaaccaccacaccuggcagacuugaaugauuuuugagagguguuugauacuugaugcuuauuaugagcaucaacauauuuuuuuucuuuuuuuuuucuuuuuuuugagauggagucuugcucuguagcccaggcuggagugcaguggugccaucucggcucacugcaagcucugccucacgaguucacgccauucuucugccucagccucccgagcagcugggacuacaggcacccgccacugugcccggcuaauuuuuuuguauuuuuuuuaguauaguagagacgggguuucaccguguuagccaggauggucucgaucuccugaccucaugauccgcccaccuuggccucccaaagugcugggauuacaggcaugagccaccacgcccggccaacauauauuuucaauaacaggaaauggcugcagccauaguguuuacuugguggucagaaagagcaagauacagcagugagccccuacauuguggucagcuauauguucauuuggaaauaaguuugcugcauaaacacaggaaaagcugaauacccuaagaugacggagauaaucaaggacuuuaacaaugaaggguagaaggggauggcuuggauuugaauaauaccauauugacaguuucaccauuuagaacugcuguuuuuuguuuuaauguucggcuuuagauucauggaccacaaauugaacugagugccaaggaaaguuugagguagugcuauguucucugguuuggcugcagccccacuucucugucuuuccuucuauuuaagugauucaaacauuuguuuccugccugccuuuugagaaaauuuggaguuugugaacccugcuacaugagaauuccuagcccaaauaccuuggauauuguuaguaccuucgauagagguagaaaaaauucaauuuaaugugauaaguuugguuuuacauguguucaguuagaaaugacaaacagugucuugaaaaggggaucugguccuugaaaauuagagugcaugaaugugaaagcaggucauguaauggaauucaagauuagaccuuagauguaaaaaaugaauauguauuuauauuugaaaauuaucaauaaugagauaguagcuaaauccacaagaguggaauuauucauucaacaguaauguauuaauaauauguugagcaucuauuaugagcuagacauggacgugcugaagauauaguggagaacaagacagguaagcccucagcucucaugaaguugaccaucugaauggcugaauacagaguauacucucccagaaauaguggaaagcauaauaauaagcauccgugacuugagauuugggaaacauugucaguuaagaaggucgaaaaguuucacauguguuuuaaagauaaaacagugugaaagucaacuuaguaaaaucaaaaaagucugaccugggagcccaaaguccuggguuucaaucucaguuuuacaaucagucauaccaccauagacaagacacagccccucuaaguuucacuauugaugaagcaagcaaguugauugagauugaugguuuucaaacuacacaucaucaugauccacugaaaguaauuuaaaguuucacagucuagcauuuguauuuaaagaaaaaugaaauaaacagaauagcaaauauuaacauauugcucacaggauguugcuuugugaaacuuuuccguuuuauacaucugugugcauauguggcuguguguaucaagcugugauacuuuuuuuuuucucuuugagagauaucaucucccuuuguugcccaagcuggagugcaaugguaugaucauagcuuacugcagcuucaccugggcucaagcuaucuucccaccucagccuccuuaguagcugggacuauagucggcgacaccacacuuggcuuauauuuaauuuuuuuuuaaauguagaggcuggucucaaacuccugaccucaagugauccuccuuccuaggccucccaaaacacugggauuauaggugugagccaccaugcccaaccuguuauuugcuuugguuuguucccaguggaacauuuagaaacacuggauuagaagaccuauaaagucuuauucagaucauugcuuauaugauuuuuguaauuguauaagcagaugaggguuaagaagacauuuaaaaugucuuuuacucuuuaaaaccauaguuuuuuaauuggaaaguuaaagauuauguauggaucuuugaaaaacgggaaacuggaugggaaaggaaaaauuacuuaaaauuuuauucaucuuuugaaaauauaagugacaagaauagcuucagagagguuuucagaauaagagagucuuauguaauaccaaaguauuacacagauuaugaaaauaauaguuuuuguucucgaguuacucaguaaauaugugagcuuagaugauuucugaggauguuaauacucuaccucauaaauaggagaaaaugcuuguuuugguggcaaaaguuuuagaaaauuugggauauuacacaaauuaaggcauuaccacucuuaguuuaccuuuuauugaugguuguauguguuccucuuuaaguuuucacuuuuaaaagugaugauaaaauguguuuuauuacuccaauuuuauuauuuuugcauauguaaauuaaucuguuuuagugaaaugauaugaguauuuacaaacugaaucuaaguuucauuucacaucacaugaauggcucaaacuauuuuuaagguaugugauaguggaaugugaagaucaagauacucagcagagagauccaaagacccaugagauguacuugaacguaaugagaagauucagccaagcauuguugaagguaacccuuaaaugugaggguuggcaaacugcagcacaugggccaaauucagccuguugccuguuuaggaacaucccaugagcuaaaaaugguuuuauauauuuauuuuuauuuuuauuuuuuugagauggaggcuugcucuguuacccaggccggaguacaguggugccaucucagcucacugcagccucugccuccuggguucaagagauucuccugccucagccucccgaauagcugagauuaaaggcgcccgcuaccaugcccagcuaauuuuuguauuuuuaguagagacgggguuuugccauguugggccaggcuauucuggaacuccugaccucaggugaugcaccugccucggccucccaaagugcuggcauuacaggcgugagccacuauaccuggccugguuuagcgguugaaaagaaaucaaaagaagaagaagaauuugugauacaugaaaauuaugugaauucaaauuuuaguguucauaaauuuauuggaauagaaucauacucauuuguuuuuauauugucuauggauacuuuuguacucaauaggaguuuaauaguuggaaugaaaacugcauggccaagaagaccuaaaauauuuacucuuugacccuuuacagaaguuuucuugaucccuaauuuaaugaaauaaaccugugcauggaauuaaaaaaaagcuuugcuuuuuuauuuuccuuucuauuguguaucuuucuuaucaaggcuauguacauuuccagaaaucuggcaauggucauauugcagauucuuuuuauauaauguauuuuugccuuuucaacagcuuuuaaaagagauuuauuuuuccuguguucgauucuuaaagcagugucacaguuuagccagcagagggugcaagggcagcgaaaagaaagcuaccacacauuaaucuguggcuugccgcagaaauagucuauuucauggcaucuuucaucuguuugauguuucaugcuuuuaaaaauuuaaaucacaucuuauuaaacacuuugagacuaagcuuuuguauucguucccaaagcuucucaacaucaaacugauuggcaaauaagccuuugguccucuccucuaaucucguuucuguuacagccuuugucacccuugaagacauuucaguuucuuuaaguuuaaauugccucaucuuugaaaugagguugauaacauuuacccagcuucccuuaccaggguaauugggaagauuaaauuagaaauguauuuuauaauauuuuaugaacuaggaaucacuacauaggaccguauagcauuuaguuuuuaugacuuauauuuuaagcacauauuguggugcuauuugaaguuuucuuuuuuuaaaaguugauuuuuaguuccuugaagaucuauaucuuuguuucugccauauacauguauauaugucuagcacauuucugcaucauaagccaucggauauuuauugaaucaaauaaugagugaauguauuuuaggaugaaugaauucuaucuugucacaugguuuaugugggaaaaaaaugcgguuguagauagaccaguauuugcugaagacucagauaauuuucgauuguggauggauuagugguguuuaacuaagauaagagguuucuuguuauuuuugaaucaagauaaucuuuuucaguuuugcuuucuauuuaaguuuauaacugugagaaauaugaauaaggauuauccaugcuguuaaagaaauccagaucauuacgcaacauagaacuaauuuuuucucacuuugaacccuucagggugauaagucugucagaguuaugcguucuuugcuggcugcacaacagacauuuguagaucgguuggugcaucuaaugaaggcaguacaacgcgaaaguggaaaucguaagaaaaagguaagccuaugguguaugcuuuuguuccuaauagcaucuuggcaucagaaaauacugaauuuucacuauugucuuuuuggguugauacgugaauuuuuuuuuuuuuuuuuuuuuuuuuuuugacaaugucucacucugucgcccagguuggagugcaguggcacgaucucggcucacugcaacccccacuuccuggguucaaucaauucucaugccccagccucccgaguagcuaggauuacaggugcccgccaccaugcccagcuaauuuuucuauuuuuaguagagaugagguuucaccauguuggucaggcuggucucaaacuccugaccguaggugauccacccgccucaaccucccaaagugcugggauuacaggugugagccacugcgcccggccuauugugugaacuucuuaccaugaaauuauaguaauaggaauguuuuaugaguuuauauauauauugauaugauauuuaaucuucauaacaacccuauaaguuaggaccuaauauuaucccaauugugaggagaagaaaguaaagagaggucaaguaauuuguuuaaugucauacagcuaguaaauauuggaguggggauuuguacucagacauucuuaguccauauuguuauccacagugcuuuaccaccucucauuuuagaaucuuagcaaauuagaauauacaauauauuugauauggaaagaaucucuagagaucauuuagacuagaauucuucugagaaaacaaaaguccagauugacuugcccaagguuucacaacugguuguuaguaaguagcuuuguaacuguucucuccuggcuaguucaucagucugucucucaacuaugagguuuccacuugauggguagaagugaaugaguagaugaguucuucacgugacauuuuuucugaucaguagccuaaaugauaugaaagauucgcuugguaucuuuuccuaauuccauuagauaauuggcaggccuuucuuggugaccuuuguaaaacaacacauuuuaguguuccuuugacuuuuaaaggacagcagaaagaggaggaaaauaugaagauuugagucagugguucaaaagcaaagaaucaggucuaaagagaaaugcuagcagagccaugcagaagaaguaaugaguaacguucagcagguuagagaggggaaaacaggcugagaggaaacacgguucuguugaguugacauuuucuuuguuguugagaagaaucacaaaccuuggucaaauaaauauauuucuacuacuguucccccuguagcaccucuccccagagguggcugugugggaaacagugugauucccagaugcccaccagcagagggagugucugcugcucugaccugcaguuuggggcuuauauuugaaagcaguuuguuuuagugccaggagcucuucaauuuagcaggcacaggaaccuuggcaacaccucaguuuuagcucuucuggaggcugaccaccuauuugagacaucacucagagucuccccaaauaaauuuuguguuucucacauagccuauauuuuaagccagaccaucccaaguauaguuucaguauuggcuaaaaaucuuuauaggcauuuuaucaugauaugguaaaagacaaacaauuuuauuuacauauauuuacuagaaacaagcccuggcaccaugaagaaaugcagagauagcgcucuacuaccauuauuggcauuaauacuaguaauauugaaauggccacuaaucauauaaaaucauauguagcacuuuuucaucccucauaauuuauuugcgagagcuauaucacaguggguauaacaguguuagaucuguggcagaguaaucccugaguuaagugucaaaugaguaaagaagaugauaauguugucuucuuuccuucguugaucucuaguuuaggaaaaauuauguuagaagaggucagucuacauauuugaauucuaauaaaaugccuuuuucaucuacuuuuuuuuugagacauagucuugcuccgucguccaggcugcaguaccaugguacuguggcaugaucucagcucacugcagcuucugccucccgucuucaagcaauuaaccugccucagccucccaggcagcugggacugcaggcgugcaccaccacgccuggcuaauuuuuaguaaagauggggggguuucacucuguuggccaggcugaucucaaacugaccucaagugaucugccagccucggccuuccaaagugcugggauuacaggcaugagccacugugccuggccaucuuuuccaucuauauuuaaaauaaauuaacacuuucacuguuaauauuauaagcagucucuuuucacuuuaugauuuuuuaggggauauuacucauuuauguguucuacaaauacgaaauauguauugcaugccuacucugugcagagugcuuuucuagguucuugggauacagcagugaauauaaaaaucucuuccucuauggggaucauauucucguugaagagaguaaaugcaauaaauaaauaaaauguauauagugugcuagauaguguuauauguuauggagaaaaauaaaacaggaagggggauuaggcaguacuuguguccaguaguaaggcaguguuucacuucuuaauagaguggccagguaaggccucacugagaaauugacauuugaacaaaggccugaagcauguaagagagcaagccggucuucuggagaagauuguuccagccagaggaauagcagugcacagccccggaggugggagcauguguggcaguugugagaaauaggaagaagcccaguguauuuggagcagagggaauggguacaguaauaggagaugaaguuagagauaauugggaaauggauggaauuuauccuuguaaaucauuauagucaauauuauuuugacugaaacacugaguaagaguagaagcuauuggagauuuugaauagcaggguaacaugaacugacuuugauuuuagcagcugcacucugguuacuuuugauaagaaacuguaggagggugaaaaguuugaagaagagaagcaaucaggaggcuauugcaguaaucaagaugagaaaucaugguggcuggguucuuagggcuuauagugguagaggugguaagaaguggcuagauuucucuccccauucuuauuuuacuuucugguuauuuuauuuauuuauuuauuuauuuauuuauuuauuuauuuauuuuaauuagcgcaucaacuaguaauuuguuaagguaggauaacuuuacucucaaauuaguugacauuacuucacauuaguagaucugaccauccauuuaguuaaggaguagauuuagugauuuuuguaacacuuauguagaaauucauaccaguugauuuucaguugauuuuaacuugaacuuuucaucauucaggaggagaugggauuauuacugaaggaaaauaauuuuacaucuucuuuguccuugaaacauacuauuuuuuucugaacuucuuucacugauuccagaguucucuccuuugaggcuuacccagcagcacaaagcacuucaacuucccaguagcauuguaguugaaguguuuuaugcugcugggauugucaugucgaguuuuccuucuuaaagaacaaacucaccuauuuaggugagcaagcccugcuccuaaagauugcaggacucucccagcuuuuaaaggaaauuaauuguucuuuugaaauugaauagaagggguucuucuaaauaguauagauguugcuuauugaugaagcuguuucaucaugacuuggauuucucaguuucuggaauguuagcuuaaugcauuauguauaugagcugaagaaaaugaaugaugaugauauccuaggaaaaguuugaccauacagacucagugaaaguuagaaaguaggguuauaguuucuccaagugaauuaaguuuccuuuuuaaacucaaaaaaugcacuggggcagcauagugaaauuuuugcuuaauauuuggucaugcaaaauuaaacuuugaaggaaauuucaguuucucucuguggcuucacaaauccuuggaaacagaaauugaaucuuuagguccaacuugaauaaauuccugauucuuugucagcuuuagcaagugaaauguauucuguauccuuccugugaaaaguccaacuuucacagucaagcgauuguuugguuuaaagcaugcugcugcuguuguuagggauuauuuauaagugcuugucucucacauacaacaccaucuccuuuauauuauuuuggugcuuugcaaauacuuuuaaguuaauggaaucaauuuuuaugucuuuacuauauguuuuauaaacuacucuucuauuuuaaccucauuaauccuuucugauuuguucuagaaugagagacuacaggcauugcuuggagauaaugaaaagaugaauuugucagauguggaacuuaucccguugccuuuagaaccccaagugaaaauuagaggaauaauuccggaaacagcuacacuguuuaaaguaauugugauggauauuuaauguguaugauuggaaccuaauucuuaagcuagaucagagauacuaccuuggaaaacuauuacauugcagagaucacaucuauaauucuaguugauuuaguaaaugcuagauugaaggguaccuuuuauuuaucaguguguuuugauuuaagaucuucuuuuguuaccgguacaugggcauuuuuauguaacaugugaaauacuuuuauaucucuggguuguuuuuuaauauuuaauuuuuuuauuguuuuauuuuuguagagauggguccucacuuuguuauccaggcuggucucauacuccuggcuucaagcagucuucccaccucagccucccaaaguguugggauuacaggcaugcgccaccauacccaacauaauauuuaguuuuucaagcuaauuguuaaucagagcuguaacuauuuuucuuuauguaaauuuuuuuagagggcagauugcaaacguaucaugcauucauucaguucauuaguucagaugguuagauaugagucccaguugaccuuuuuaacauuucucagucugauaucuguuccuguugaaccuuaaguguuuucuuauauuuucacguggcaauucucuuuaguccuuaguagcauaccaggcuugguguuuuuucuauugacuggccaccaguucagguagaaacagcugaugcagcagccuucucuaaucaugcucaaaggaccaaaggccagagcaucauuaucugucagcaucauacugaaagaucuuugugagacauggugcuuuauguuuugugauucuagugguagaaaggcauaguugcauugaauauuacuuugcaugaguuaagaaagggcucauagaacaacaacuaauguauauacacggguguaauuauaguaggaaacaguucauauuuuuuaaaaaaguguguuucaaggcaaccucauauuuggucauggguugcagcccagcucauaugacuaaaacauaaguuucauaaagcaaucccuaacuuuaacuggguguuauggauggauaguuaccauuauuuuuaacauuauucuguugcuuuaauuuuuaaauguugcuuacaaccuauugguuuuaaaacucucuaacagauuacaaccugcaaguuaaaaauacugguauuacuauaugcaauuugaaaauacugguauaggagauacagugcaauuuuuuuuuuagucugugcuugcagucuacuggagacugaaauguaaaaagcuaugcacaagguaauauacauauaacaacuggcauuccuuugggcuagaacucccaaagaagaccagcuucuaauauucuugaacacuaaggacucaucaagagcagugaauuaaaaaaguaauuuuaccauuuuuuuuccaaccauggugcaaaagaguaucuaagacauacagcagggguuuuaagaguggacuauaagaagauauaucucccucuauugguagguggauucuagacucauacucaauuauaaaaaauuauaauuaugucuuaugaaauaaaauaugggaaaucuuuuugaccucaguauucagucuugauuauuuuucuuucaacucuuaaguauaugggcauucuuaaaaauuuugaguuagaguuuaggaauaaugguucugaggcaguugcuacguaauauuaguuauauagagugucucuguguagggaguugcuacuuuggcucauggaugucuuugagaaucugaugaaagugauggauuaugcacuucagaaaauugcccguaugcuuacacauacacugaaauuucugcauacacuugcagaggaucuguggacuccuguuuuccuuguaugagcuccuuagagcugaaaaggcuagggacccuuauuucuaguaguuuuaaaaguaauuuuguagaccuuaauguaacagccaaagcuggauauucaugaagacuggaccccuuaaggcacugggauaagugcauguuauccugugguuguuuucuugcuuuaaauuucagaugaaaucuaaauuagaugaaaucguauugaaucucaaaaaagaaaucacaacaaagauucuccugccugucauuuaucuuuaggaagauaacuuccaauuacuagggcucaagguaauuuauaaaauaacauuuucaaauaaaaggauauuccaaauuuaagguaauuuaaaauucagaauuuuauuccaacuagaguuuguaaguuuuaaacauacauucucugaaccauuuuccauguuuuuguuuucccccagcauuuuauaggaaaguuuucaagcauacagcaaaguugaaggaguuuuacaguagacaaccguguaucuaccacuuuaauucugucaucaacauuuugccauuuguuuugucacaucuguucauccaucuauaugauguuuuuugggccauuauuucucuugguuauuaccauuuuuuuuguuuuuguuuuuaaauuucuuugacucauuuuuuuuucuuuggauuaauauauuucuccaaauuuuugucuuauauaauuucuucucaaugaccaaacucaauagggucucucucucucagaacaauuuucugaccauuuauguccagaauauccaucuuagcaugccacuuuaugugagguuuuaugauucccccuuucuaaaaagaauauaauuucuuuauuuuuuuuuuguugauuuaaacauauaccuaaacuaauuuagaccuucauauaauuaagggaaggacuguggggaaaacauaauauuauuccagaauaaaagauacagauauuugagaucuccucucauuuuauaaaugaggaauuugagucuuaaagcugcacaacuaguacagauugagcaucucuaauccaaaaauccaaaaucuaaaaugcuccaaaaucugaaacuuuuugagugcugacaugaugccgcaaguggaaaauccuccagcugacuuuaugucaugcauuacagucaaaacacggucagaacuuuguuucaugcacaaaauuacuaaaaauauuguguaaaauuacuuucaguuuauguguguaggguauaugugaaacauaauugaauuucaaguuuaaacuugggucacagcccuaaaauauuuuauuauguauaugcaaauauuccaaaauccggggaaguccaaaaucccaaacauuugcaagcauuucuguuaugggauacucaaccuguaguauacuugccauuaaaaaccagggcucuucacuuugcaucugguacauuguuauguuguacuguuucaccuuauuuauuucaguauaccucuaaaaauaaaaaaugaugauagauauauaaagaaugucuucuuuguauuaggcauggugccagacuauugaccuguauaguuucugauugccuuagcaacucugcagaagagaugguaucuuauuuuacagaugaggaaacaaguuaaaggauaugcauaagacuguccagcgaguaccugggagagcuuggaauguuuuaaccacaugacugauugcagagcuugugcgcuuuccaucguguagucuucugacuacuagcuaguucacuguucuuuccaguauacccuaauguaucucauugaaaacccaacuuguuuuuuagguccuauuuaccuguguauuuaucuuauauaucaacauuuucuuguauguauaguacaauuuuaugcauuaauucauggccaaauuugaaaucaauauuuuuauuuuccagagugcccuuaugccugcacaguuguuuuuuaagacggaagauggaggcaaauauccaguuauauuuaagcauggagaugauuuacgucaagaucaacuuauucuucaaaucauuucacucauggacaaggugaacaugaccuuauguugguggggaacauuuuuuucguuuuggaauacuguggcuuaguucauuugcuguuuauggaacagaaguauuuguaacauucagguacgauccuagaaagcucaacagucuccacuugaccuugaaaaaauuuaguugcuuuuauauacuucagaaugguuuuuguguugaguauaaauuggaacuguauguguuccauuaauuuuuuuuccaaauuaaguucucuaaauaagggauuuaguaguuuccuuccucuuagucuauuaaauuuuuuuuaaauccuuuuaaucccaucucugucccuggcauuaaaaaguacaugcuugcccuaguucccuuuuucugagcucuaaaguacuuuauggccagaaaggacugcaugaagugauagcaacaacccuauuguucauugaaaacagcugacagagauuuagaguagaugaaaaauuuagcauaccgucaucuaaguccuuaaucaauuuaauuuugaugaucaaaguuaaauuaacuauuuuuuuuuuugagauggaguuuugcuuuuugcacaggcuaaaaugaaguggcgcgaucuuggcucacugcaaccucugcccccuggguucaagcaauucuccugccucagccucccgaguaguugggacuacaggcaugcaccaccacgcccagcuaauuuuuuguauuuuuuaguagagacaggguuucaccauguugaccaggcugaucuugaacuccugaccucaggugauccacccgccucggccucccaaagugcugggauuacaguggggaaccacugugcccagccuaaguuaacuaauuuaaacuuaauuuagcuuaacuuccuaaaucuuuauuacauuaaacugcuauacuauuugcccacaaaacugucuuuuaacagucuuuacauuugguuaauauauuuuaccuuuugauuaaaagcuguuacggaaagaaaaucuggacuugaaauugacaccuuauaagguguuagccaccaguacaaaacaugguaaguguauuuuacaucauuauuauuuacuuuaguguacauuguguguacuuuuucaaauugaaaauuuuuaaguauguuagagauacaaauaaauuccauuuguagcacugaagacaaguuggaccuuccugccugcuucccuucugucuuuccuucuuuccuguuucucaguaacuacugauuaauguaacuacugguuaauguaguuacugagaaacaggauauuucagacauuccugacaauccuguagacacacauacacauacacacacacccucacacacacaaaccauuuaagucuuuucgagaugaauaaucccugggaguuugguagaagauucccuaggaaugcuugccuaaugcuuacuguaaauuccauagucuugcugcccuuccugcuuuauacuaguaguuacugagaaacaaaauacaugcuuuagguuccuauccuuccucuggcuacucccaaaucuuuuugaugccuuaauuacucuucucaguuucuucucagaaugauauuuuaaaaagugcaaaugugcaucuuuacaauccugcaaaaagucauuuguuagcuuucauuuucucuuuggacaaagacccaaaaaaccuuuaccuagcuucuaagugcuugcauagugugacacacccugugucuaucuuucaagccucuucuuuuugccacucuuccccugcauccugggcuuuagccauacuggcuaccuucuguuuuaucuaaugcauugugcucuaaggccuucacauacacugugaucauugucucaaacauucuuugcuccauggccuauuaauuuuauuauccuugaaaacauggcucaaaugucagauguccuucgaucccuacuguaaguuaggucuccuuacacuacuuccuuucauaguacccuuuauucauaguauuuacccaagugaagcuuauaagcuuuaagauccauguaggcagugucaaacaucuauuuuuacuuacuuggcaaauuucuuccgacauggucaagaaacaauaaauaccuguuaagugaauuagugccaacuauucuguauuuaugaugcaagaauaaaugagauauuucuuauucuacagggguauauaaucuccuaaugugcaugcaaauuauuauccuauaggcuuaccagaaccagaucaugauaguuuaugauccugaaauguuguuugcuucauccaacuuuuuuuuuuaauauauccauuguuuuauguuucuguugucuucagacuuaucagacugacuuuuucuccuucuuccacauacugucuguccccuuuccuuuuuuuuuuuuuuuuuuugguaguuuaagggauuuacacaucuguuauuaccaggaaaugacagaagauggaauauuagacaaaaggagccauuacauaacaguuuuacauacagcuuuuaggguuagguaauuguaauccacaauucuagauuucuuacggugauuuuaaauuuggaauauuuuaauugguauauguuguaaaucuauagaaagaagaaauuuuugaugcuagauuuaagaagcuuagucuauuaguuuucguuucucauauuuuauaauagaaauuagccuagagaaacauacagacuaaaucagcuuaauuuaaaaaaaaaaaguuuucuuacagguccuaugacauaaaugccaguacaaacuuaauguaguguacacugaucuuuuuaaguuguucagauauggaaugcauuuauucagagaugaggauuauucuuagcagaaccuuuauuuuuauuucuuaaccaguagcuaugcuuaaugcagugcauacauuucuguguaggcuucaugcaguuuauccagucaguuccuguggcugaaguucuugauacagagggaagcauucagguaugguaucaauaaagauuaugcaauucaugaauauauucuugucauaaaaaauucagucuuuauaacauagaguuaaaaaugaaagucuccuuuuaucauuuuucuuucuucaaguuuuuuuucuuccuuuauucagaaguaagcauguucgcaguugaagauucuuccauuuguuacauagauucucaguuccuugaacagugcauugcauaucaagggaucaggcauuaauuggugaacacagccuggccaacauggugaaaccugucucugcuaaacucacaaaaaucagccgggcaugguggcaugcaccuguagucccagcuacuugggaggcugagccaggagaaucgcuugaacccgcgagguggagacugcagugagcugagaucacaucauugcacuccggccugggugacagagcaagauucugugucaaaaaaaaacaaaaaaaaccccaaaaaaacagaguuaauuggugaacaaauuaaaauuuguuaacguuuauuuauacuugcauuauauuccaaaguauggaaauguuguaauuuauuugauauuaauugaugagcacuuuauuuccaguuuuuguuauucagaacacugcuacaaugauauuguugcucaucugucuuuuguacaauuauuuaagacccccuauccucucccuucaaccuauugcuccccuuuaaauaugagaaaaggugagugguucugugacaaaguaauguauauguuuggauuuuuuuuuuuuuuacccuuuaaauacauggauuaguucuuauaacauguuaaugguuuauuuuuguuauuuuuaaaauauaauuuuccugcuucccuuuguaaaaaaaaaaaaaaagguauguaauuaaaacaaaaauggauacaccugagaugaaagauaauacacagaagggcuugguagaugauguuugauacaguguguuuuugccuuucccuauuuaauuguuccauuuauucaguaugggagucagauuuguagaaaaguauuacucugauucuuuugcaaagcaagugcuuauucuguucuuugauuugggguacagucaugugcagugguuaaaagcucaggcuuaggacaucaaacugccugggauugaauuccaccuguguaacuuuccagcucuguaaccuugagugaacugguuaacucuuuuugcagagaaaaguuaacauaguagcccuaagguugcaaucuuuggaaaggccugcuugccaggagauuggucauuggcuuucagcauguucccuuugcuuccuaauugauaagggugguucgcugugccuagauuguuuguucaaauaauaugcuuuauacuaaacaauccacuuuccuucugggagucuggaauuuuguacuugcuugacagagguugccugggucaccaguuccugauaaaaccuuggguucuaagucucuaaugggcuuuccuugucagaaacauuacacccauguuacugcuuuuuauuuuuuauuuuuggcuauuggaaaagaagcucacugugucuucauaggacagagagggcuaggaugccuauguaugaauuucuccagauuuuuucuguguauguuuuccauguugauucuacuguguauccguucucuguaacaaaccuuagucaugguacaacuacauguuuagucuguaagaccuucuagcaagucaaaccugucagugguccuggggacccguuuaacauacccuucaagacaccaguuuuugcaucuguaaaauuucgguaauaacccauauuacuccaggauuguuuugaagaggaccugaaguguacuuaaaguuuuuaacaugggcccuaauugccaucauuguuucauaaaguuuuucauuacuuacauuguuuuguguaauuacgauuuuauaaaaugaaaacagugacaguuuguauacugauucuuggcugcacaucugaucuguguaagugauuuaccugggucauagaucacauucagcuuuacuugauaaugaaaaguuguuuuucgauaauuaaaaguuguuuuccaaaacaguaacacuucuuguguuucuccuugcuacaugucugccaaaucguaguguugccaaacuucaaacucuucguaccucuuuuugguuugcauuucccugauuaucuguaagguugaauguauaaaaauauauguauaggccauuuguuucuucugugaagugcauguucacaucuuccuguggcccauguuccugucgcguuguuuguauuuuuuguauugauuuauaggaguuuuuaaauauauauuccagaugcaaauccuuugucagaaauacaggguauucaaaaaaggugaaaacauaggauaaacuuuuuuuuuuuuuuugugagacggagucuugcucugucgccaggcuggagugcaguggugcgaucucggcucacugcaaccuguaccucccagguucaagcaauucuccugccucagccucccgagcagcugggacuacaggugccugccaccacgcuaauuuuuguauuuuaguagagacuggguuucaccauguugaccaggauguucuugaucucuugaccucaugaucugcccaccucggccucccaaagugcuggaauuacaggugugagccaccacaucuggccaggauaaacucauuuuuuaauaguacguuaaucguauuuucagauaauaugcucugugguuuuguuuguuuguuuguuuuuuguuuugccucuaaauguaaaagaauaggugcaauuggaaaucugggguggguggugggggacauuaaacacaguuuccccuaauggaaacucuaguguauuuaucgcacucuuacaauucuuuuguucagucagcaucucucauacuguauuuugauuaagcuuuaugcuagacacuugcuggucacuauuuauaguuucaaaacaccuaguuuguuuguuuguacuuaauucuaaaacauguaaauaaugucuuuucagaacuuuuuuagaaaauaugcaccaagugagaaugggccaaaugggauuagugcugaggucauggacacuuacguuaaaagcugugguaaguuuuucaggcuauuacuuuccauugaucagauaaagaagagcaggccauccugauauugccauaaucauauacauuuagaacauguuaauauuuaaaugcucuauaggaagaguaaaagauaaauguugauuaaaguagucauugaugcuuugacauaauaguauuaacaagguguaaauucuauuuagucuuucauggauauaucuuuguaaucacugaacuauuuuauaaucacaguuuaucucuuccuggaagcuguuaauuuuccauuagauuuucucuauuuuugaauaacagaaacuaaguagaccaugggaaaaguuucaaucagaaaugauugugcuuuagauaaaguuuaagagcuaagauaauggugcuucauuaagagggugcccuugugguauuuuagagucaguccuuaugguccauuccuagaaauaagaaagcaguaguaguauuuccuagaaauaaauaguaagugacauagggauuaauuuuuauucuucaggcauuuaugucuaacuucacgaagguuauauucuacaggauuuuuuuuuucauuuucuuuauuuuuuucuuuucuuuucuuuuccuuuuuuccuggagacaggaucacacucugucacccgggcuggcugaagugcaguggcgcaaucacagcuuacugcggccuggaccucccaggcucaggugauucuuccaccucagcccgccgaguaccugggacuguaggaggugugcaccaccacacuuggaugauuuuuuuguauuuuuuguagaaacaggguuauggcauguuucccaggcuggucucaaacuccugggcucaaacgaucaccaccugcuuuggccucccaaagugcaaagauugaaggcaugagccaccauccccagcauguuuauuuuuuuauuuugauuuuuuuuauaacuagauuguuuaugggaggauugguaaaggaguugacacuagaguugagcccugaaugacaggauguaugauguguuauaacuauuuuauauaagcgcuauauuuguuuaugucccuauuuaugccuaugcuuaagcugggagagcaagaagagggcuuucuaguuaguuguuaagacuauauuuaaacuugcauauuauuuucugguuuagaaguugcuuucuuauacauaauauuuuuguguuuuucacaacaccccugugaagucaccuuccaaauuauuuuggaccuuauuuucaaauuuauucgugaugauacauuuuugucugaaaagcagaaagaaaaugaacuuugagaauauggaaauaaaauuguguuuuauaaauuagaguccuuuauaguuuuaauucuuguuuuuacuauaggaauauaaacauauauuacauguaacugaauuuguuuguaaacgugauuacaugcaguauuuaaagacuuaaaaacacugaagauuuugagagaaaauguuuacccuuguccucuuacucuguguuucucucucuucccuugcuccuuucuuguuucucuucuuuauuuugccccauuucucuucuguuuuucucagaccuucaagucuauguuuucugugaucugaaaaaaaauugcauaucaucuaaaggcucaacuaggcugaacauccaagauggaucacucacauuauuggcagauuauacugucuuagcuaggcuuauugugaaucaccuacacaugaccugucccuggcuugggccucuuagagcuggguuccaagagcaaauauucagacagacaggaaauggaaaauacuaguuucugaaggccagggcugggaagcugguacuauaucagcuuauaguauaacuauauuuuguuauauucuguuguucagagcaguccuagagccuuccuggauuugaggggacggaauauauauagauccaagcucuggaugaaaagggugucacagaauuuguggccauuuccauuaguacguuauuacaugagguguuuuauauacccccaaauaauuaucuuuuaccuuuuuacuauagcauaguuauuguaaaccuuuuaaagucauaaaucuguuuaauaaagaaauacuuuuuccacacaaaauacauacacacacgcuugcccugucaguauugacuacaauuugaaaauucugcucauuaguaaaauuaucagaaugguauguuacagguacaugcuuaaugucguaccauugugucuuuuguauagugguccauuuuccccccaagagcuacugaaaauaugacuggcuuuuucauggggaaagaauagcaauuuaaauuaucuuaccuauuggacaguuaaauucacauuauaucuuaucucuccccuuuuuuccaacauuucacauguauucauuccucuguaagugauuuaaugguaggccuucucuucaucuagaagagccuucuguuuucuguauggcuuccuguaugacaaaauaaucuguuuuuguguaacuuucauuuuagaaaauaauguuuuaauguuuuugcaggguguaagaaaaaaauugauaauaguuuuggugacaucuuuuccagauuaucuaaagucucaaguguauaucaugcagcuaaaugugggaauacuguuuauucucacauacacacauaucuuuacuaaguaaagggaaauaggaucaguggucuauuugucuuuauauuuuucuuuaagucaaaguuuuuuuauaaaaacaauuucaagauguuuuguaucucacauggaauaaaaaaacuaacaacauuguuuugacaagauuuucuuggacagaaauaguguuuccauuguuguauaguuaaagaauaacaucaauuucccuaaaaauuuucuagcaaauuuauuucaggucaucuuaaaucauucugaguauuaguuaucuccucaacguuucugaggaucaucccauucuuaccucaaauguuuuguuguuauuuuucaggauguagccuuguuuaaagugcccuacugaguauugacacuuuaaacuauugaagcacucuaaauuuucaucuuuacuauuaaauauggccauauguugauacauauauuucacuugacuaaacauguuuaucagaaugaccauccaacguauuuaugaccauaauccacugagccagggcaaaagacccuuacuuauuuuugcauuuccauauaacaaugaaaugcacucucaaauuugaugaugaguaguuuauagaaauauuuugcuuuaucguuaggauuaagcauaauucauguauauccaguuacaugaaaauuuuaggucagaauuaacuguugcaacacaggugaaucaguauucuauagagauagcuaaacuugaaacaaaguaaauagugacaaaaacuaacuguaauuuauaauuuaaaaaugggaauaguaaguaggucuggauugaacaacucagcugcacugauguacagugauguuauuuuucaaaauuguaggaauuucgcuugucuucauaugcacauuaucgguaguuuaguacccuugaguggcagguagauuucuacgaaucacauguuagagaaccuaaguguacuaaguucucauauguucucaggguauuguacuuaguuucucuuuaggaauaucaaauuuaauaucccucaguaagucacuuaguuauuuuucaauggggagucuguagucauuuuugaaauugcauguauuguggcaguuuuagagcagugcuacuuaaagugugaucuguggacccacaguauugacuuuaccugggagcuuguuuguauuacagaaucuugggccuuacccgacuucugugaucagaaucuucauucuaacaggauuuucaggugauucuuauguucaucaauacacuagaguuuagagaaggcuucucaaccuuuggugugcauaguaauuuuugaaagcuuguuaaaauggaauuguggcugcugccccuaaaaauucugauucaguaggacugaaguaaggcugaagaguuuacauauuuaauaagcuuucaagugauagugauacugccagucugugggaucacauuuuguguagcaaugcucuagaucaagggugaguaagacuuuucucuaaagcuuugcagauaguaaauauuuuaggcuuuucaagucagaugaucuguguaaccauucaacccugccauuguaaugcuuaaaccaguguguaaaugaaugaguaugacuguguucaaauaaacuuuacaaaaacugaggggaaccagauuugaccaucaggcuguaguuuauucucccuucaucuagauacccuuuaaguccuccucaguggaccacuaaauguuaucauugcauuuagcugcaguuaacauaauguaccuauagugauuuaaucauaagaguuuauuuucucuuuugugacaaaacuaguuauaagaaauugcuguuguucuaacuauuuaaggugauuaggaccaggugaaggcucuguguuucucugugauucucuugcccuuuuccuuauggucugcaacuacagucaucaugucgcaaucuagacaggaaggagaaaaggccuaaagggcuaaccuccuagcugagucagccgcuugcuuaaaacugcuuuccuugcaucuauauuugcuuacauuucauuggacacaaaucccagcccagugacuuugaacaauacuauuaauucuuggagccugaaguuuuucauuugaaggaugguuaucuacuuaacuggcaucauuaaacagguuagaaaugaugaauaugauaugccuagcuaagagccuagucuucaguacauuguaacugugauuauuauuaauuaauacuauuuuuccaauaauuaugccauugcuuaaguugcuuuuggacuucuggaauggccuucagaaccuaagucaaaugaacuuuauuauuuauugaauuugaacaggguuauaaguucauuaacagguggucccaucuuguuuuuacacaugggcugaaauaaacagguuuuuguaaauauugcuauaguuuuauauguuuacaaguuguguuuguugucagguuauuaaugguagaaauaaacauaguuaaaaaaacaaacuccaaaagggugcuauuugcuaaauucuguuuaaguaguuucaauaaaugcuaaauuuccagacuuuuuuuagaauaaaaagauaacagaauacagcuagagccaaugucuuugccuuuagccuugaucauguaauuuuucuuaaugcuuuagaagauuauuguguuaacuucauaaaugucuuuaccacucaaaugaaugcauuugguuuucuaucugcuuccauuucaagauuauuuuuccacagacuuaaaaaacaauuuaacccugcauuuacuuauguuaucuuacagauaacaugguuacgaguuaugggauaauugacgguugacuuuuaacuguguccaauuugauauuagaauugcuaggcccauguuauaauuuaaggucuccugaaccuaacuuaaguuuugaugcaagugacuuuuguaauuuaacagaauucuacaagauuuucucuuuuaaauaguacuuugaguuucaagugacagacaugaagauugcauauuugagaauucagaugagaaaccagagacauuagaaaacaaauugauauuaaaguugcacaaacugcuuuuauauucaguagaauguauaaccugguuugcauuuguuuucacauauuuuuuuuaacuguuacugcagcuggauauugcgugaucaccuauauacuuggaguuggagacaggcaccuggauaaccuuuugcuaacaaaaacagguaacaauuaaugacuaccaguagacauacauuguauaugcccaugguuuuuaccccugaaucuauguacuaacaagauaaguugcggccuggcgcgguggcucacgcccguaaucccagcacuuugggaggccaaggcggguggaucaccugagguugggaguucgagaccagccugaccaacauggagaaaccccgucucuacuaaacacacaaaauuugccgggcguggugguacaugccuguaaucccaacuacucaggaggcugaggcaggagaaucgcuugaacccgggaggcggagguugcagugagccgagauugcaccauugcacugcagacuaggcaacaagaucaaaacgccaucuuagaaaaaaaaaaaaaaaaagaugaguugcguaauugaagauaaaucagagagucuuaaaaauuccuuuaaauguuaccuuggaagaacauuuagggaaaguccuuucccuuuuaagaauugcuuuaguaguaauccuacagauggucauuuugcccacacuucuguacuggaaaaugccucuuuuuauggaaagccaauaauggauacaaguagcuuagucucuuacuguauagcucuaguuagauuguuaaaauguccuuucucuuacaaagugugcuuaauucacuuuaauaucuaccuuuaauuauuugcuuuuccccuuggaguucuaugggauaaucauucucaguccccuuuguccugacaacucuuuagcccuauguauuuaucuuuaugcagacagcuuccagacuuacagcuuuuuaccucaguccauuucauuaacuucaaauugaaauaucgaacugcuuacuugaaauugucauuauauauggccaguuguaaaagguuguccuuuccucuacuaccugccuaaaaccuguuucucaccucauuuuuccauuucaauagauagcaacaucaccuacccaguuguucaagcucuagaccucaaagucauucuuaacaugucucuuggccucaucucauauacugaaccuauuagcaaaucuugucuacuccucaacuccaaaauagaucaugaaguuacccacugucuucauuuuuacuacuuugaccccacuugaagcaaacaauauauguugccuaaacaauuugaaugaaaccugaacccuuuauuggggccuuguggcuuguccaggcaggccauuugucugaaugucaaaccacuccugccucagacaagagccuuuguuguuuucucuuucuggaaaguuauuuauucagaucuuugcagggcugacuuuaguuauuaaguugaaguucuaauggcaucucuuuagagaagcccuuucuaacuccuugaucuguaauaacauaucugcccucuuccuccaaugcucucuacuuauuacuguauuguuuauagcacuuaucacuagcugaaguuaccuuuuuuguuuaauucaacaacuauuuauugaacagcuaguagaugcugggaauaccaaaguuaacagaagagacagaaauccuugcucuccuagagcuuguugaguucuuaucaucaucuucuccccuucaggaugcaaguuccaugagagcaggaaccuuuguccauugggguuacccccaugccucuggaccuugaacaccaccuagcuaaaguguucaauaaaucaguguugaauuaaugaugaauaaauacuucugcucuuccaugaaccugucugggcuaaauaauucaaguuucuuccgcuuucugcagaaagcagauguuuacguuacucuuuaaauuggucucucaaaacauuuucuguuuuguuuguauuucuccaaauugugauaauaauaauuuaacauaauacaucaagaauaaucuauuaauauaaugguccuauuaauuuauaauuuggaaugucauauauucaguuuuuaauuauuacauaugaaaaaucaucuguuagaacuugcaugggugaugucaugucugugucaaagccagucaaucuccuuaauaaccaagaccaaaagaauauaaucagagugucaugcagauucuuggcugauuugcucauuuagcagaggauauuuauaaaacauuaugguguauuuggagagaauuguaauuuggaaguuuucauguguuauuuucauuagcucuuuuuuauugguugaaucuuuuaaccacaagaaucaagcaaccaaaaugauuccauuuuuuuccagauuguaaucauuuacaacuacaauggaauucuuuaauauaaaaauaaugcuaaaugacgaguuaaugggugcagcacaccaacauggcacauguauacauauguaacaaaccugcacguugugcacauguacccuaaaacuuaaaguauaauaauaauaauaaaauaaaaaauaaaauaaauaaaaaagaauuugccaguggaaaaaaagguaguauuacaucuguaauuuuauauucacaaguucuacuugauucuuuuuuuggaaauugauaaacaaucagacaguguaaaaaaccuuuuucuguuauacuuugaaaagugcccuuguguguauuugugugugugcguauguguguuuugauggggguauuuaagagugaaacuggaaggaagaaucugcguaauacacuuuuuuggcccaggucucaguuacuuguuuaauggaaauugaauuaaauuucagaaacagaagcuuuaagcuuuuguuaacaguuuuccacuagagggugcuccagauuugcuuuuucaaaaccaagauuuuacccuaaaacgugcauaaguaagaugcacauuuuuuuccuauuaaaacagcaguucauuuuuucuuaacugcucuguaauuauuucauccaguuacauuaugcaguuagcauuuuauaucuuucuuacuggauacauguuuucaaguuuuuaguuuugguuuggaugaaauuagauucuauaaggagagacugaguaugucaagacaaauagaaguauaaugcauucuucaaguucuaacaauuuauaauaauuuuaaaaaguuugugucucuagucauuuuuacugagaguuuguauuucaaagugguuuuaaguuacauuucauauauguuauaaauagacuuuguauaguucaaagugaauuuugaaugugguucagugcaggaaauauauuccaauguuuuuaguuuaaaaaaugccucgacugucaugaagacuuguccauuguauauuuugaguuuauuaugccuucaaauugaaaacuuuggguucucuuacauaacuguccaaucuuucaauggcugauggagcauuuuuuaauaaucaaguaacauuuuucuuauucugcaaaauacaauaccuuuguuuucuguacuccuuugccagcccaagcagguuuagagucuaagauucugcuuuagauuaaagugguuuugaauuucaaucagacuuccacuguuucaucuguguccaguucuuugauaugggggauggagcagaagaaggagccacgcagauuucauuucacugauauuuuuuggggacuuaaaccagacaaacuauucuacccuguaaauauagaugaaauagaaaaugauccagcuaagaacucugggcaugugaaagaaaaugauucgcugcauauagagaaugucaaaaucuauacaagaguaauguucucaaaugcaaaauauuagucucaauuauggauuucccagaccuuuuuuuggcccaugcuuuguuuuugaauacuucuagcuugguugaaguuuacucagcuugcacagcagagggcgcuguguauccaccauaaauguaaaaguguagcgauuguauugucaguguauugucaugugauuaauuauaacgcuguuuucuugaaacaaguuuggggugaaugauauuuuacuuauuagugcauuacuauugaauucuuuuuucauuauuacuauagaauucuuuggacaagaaauuacaaagcuaggcugugguguggaguugaaaaauaauagauuuuuucccaagaaucauuguccuuaggagaagcuuuaaaaagcuuacuuagggcgaucaguugugacaggauucaaaugaaacaugguuugaguuuaucccagcucuuuggagaaagguuaauuuuuuuguuuuuauuuuugggaguuugaggaaagaggggaaggcaguauaacugaaaaauauguucacugcuuaugguauacuuuuuaaugcaaucaguauuugaaauucauuuguaaauaacugaaaaauguucacaaaaguaaagagggaacugguaucuguacuaaauggaaaguucauugugaguccuaaggauggcccuccugaucuugaguugccauuugugagagagguaguagcuuuucugucugccuugccacuuuagaguaauacacuuugaaacuuuucucagaaagcucaacauaaagaaaaaugguuauucuuauuuuuaucuuaauuggacauuuucuuucaauauagcuccuguaauacaggguucucuagagggacagaacuaaugguauauauauauauauauauauauauauauauauauauauauauauauauauauauauauauauauaaaggggaauuuauuaaguauuaacucauacauucacaaggucccauuauaggcugucugcaggcugaggagcaaggagagccagucugaguuccaaaacugaagaacuuggagucggauguucgaggguaggaaacauucagcacgagagaaagauguaggcugggaggcugggcaagucucucuuuucacauuuuucugucugcuuuuauccuagcugcccuggcagcugauuaguuugugcccaucuagauuaaaggucugccuuucccaacccacugacucaaauauuaaucuccuuuggcagcacccucacagacacacccaggaucaauacuuuguauccuucaauccagucaaguugacagucaguauuaacaucacagcuucuauccugauuuucuguauuauucuuuaauuuuaugugaaaaugauuauuuuuuagaccaagaaacagucuuucagaguggcuaauuuguuuggcucuaaaggcaaauuuuugcauuuauuuugccccucccccauugggugacuuuggguaaguuacauaauaugccaguaacucagucucuucuucugaaucuguaaauaauaauagaaccucucuccuaguggugcugugagguuugaaugagauaaguagacuuuugcuugguauugagcacauaauaaacauuccuuaagggcuauuagguuuucuuugcuuguuuguuuuaccaccaugagaugaauaaugccuuuuuuuuuuuaaacuuauguaguucuuauuuggacucauacuauuagagagaagaaaauaguuaauauauuucaaaaauuucuuuuucccacuugcuauaauuuggguauuugacuccuccaaaucucauguugaaacuucauccccauugauggagauaggaucaaaugggaaguguuugggucauggugguggauucuucaugaauggccugguacugugcuggagguaaugagugagcucuucuguuaguucccuugaaagcugguuguuaaaaaagagcuucguaccuccccucucaugcuacuaugugaucucagcacaugccagcuccuuuucgccuuuauagauuauugaucuuugauacugaaaacuauuauugaaaaauauugcaucauugugcuuuuaacugagugaaaauacugcuaaccaaguauauuguaaggguuuaaguaauaaguauugggaacagagagugggaguauaaauguagggagccuuuuuaauucugaaaauauagguuuugcuauaagaauaaauugcuguuugcuaccuucuguauuucuagguuuagugauagggcaguaggaaagauacgacauucaauuaagacaaaaggcauuuuauggaaaaaaugguaaauaaaugccagguuauauauaaaaaauugaagagugggaaacucacuggaguaggaugucagggaagaauuuuuggaguugggaauuauauggaaucuuuaaauaauagaguuuggauuauaaggaacagcagaagaaagucaaguagaaggaggagaguaagaagagguaugaaaaacagaaugaauacaguuuugauguuggacacguuuaauuauuaaacaaaauggaaauuuaaaauaaacuuuaccauuaaauacugucaaagagaauaguguauguucucuuuaauccaagaauuacagaugccucaaacuacaauuuuagaaauaaguucauguuauuuaugcaaauaacaggaaaauguaauuagcaccucuuacucccuauguuuuacaaguuggagacaaaaggagguuaacaaccaguuuguuuuauguauacuuuauuucuugacuguuuaaggugguagauucgaauaagaucauacucucugaacuucuuaaacauuuuuuuuaaauuucauuauguguauuuuuugaaccuuuacaaauugcauuuucaaauauuaacuuuaaaaaaaacauucccuucaguauuuaugaagaugaauuuucuuaaaacauuacauuaauaggcucuuuugaaaauacauggcuauuuaacuuguaaagcauaauauaauuucauuguuagauacugaaucuuuuacaccuuuuaauuaaguaguaauccuguuguuugaguuuucugacaagaaggauagaaauauacucuucguuuguaaacagugauacauagccaauauuggaauuccaguaauuccugucaugaaaugaagaaaacugggauagguuucguauuaaaagcauggagcucauuaaauaaaccaugcaugauggcaguuuugugucagagauugaccggauuggucaucuguucaaguauauugguaacaaaacauuauuuaaauaauuaaauaaaaccaaggaaaauguaucuacaccuguaauauugugagcuucuuauuucuuuaccucuuuuggggcagaaucauguguauccaacaagguaaaagauauaugagaacuucaaaaugagaauaaaguaccaaaagaauugcuuagcuuaguugaacagagaacacauauuuaguugaaggugguaaaaugguuaacagaaauugaucauggacuuuucaucaguucauggaaaacugaaaucauagcauacuccccuugaaccuuaagagacuauagggaugcugcuuuuccaguggguacugaaguugucaaauucacuuuuguaaaacugguuccucauauuuguugaauuauggacuuuccuugggaaucuggugaaguauauugaucuccccccaaaaucaguuucauuguacuuagagaccauuaaagcccauuuugggauucugaaagaguaguuuuucagucauaaaucauucaguaguuucuuuuaauagaaaugaacccccccccccguguugacauuuuaugaucuuaaauauguacaacgugaaaccucauaauugugccuacucuuacauacuauacaaugaaaacagauuuauaaaucaauguguuacagauuaguaaaauuuaacaacauuaaaaugauaggugguauauuauuacaacuaaauugcuauuuacauacuauacaaugaaaacagauuuauacuauacauuacucuuacuauacaaugaaaacagauuuauaagucagucuuucuuacauauuaguaaaauuuaacaggauuaaagugauaggugauauauuauuguaacuaaauugcuauuuaugcuaagaauaugguuuuuaaaauuuuuccuuucuaaaauuuuuuuugaguaauaauaaguuagcagaaggauucaucucaggaauauuuaaagaaauaauuuucuacuauaugaagggcacugugcuuaaacuuuagcacaaaaaauuuucuacaagauuccacuuucugcugauaccuuaaaaaguuacccaggcucugaccgucuuugauucugaagacuuauaaauaggauuuaacauuuuuagauuaccauuacugugacaugauuuuaggcauaguuucgugugaacgaaugaguuaaaaugaguuaauuauguucugaaggccacucucaaaccugcaguuagaaauaucgaagaauuuaauaggcuucaucgugaacuaauauucuuuaugaagagacacuguuuauaucaauugugugacauaucaccuacccaguucuuuaagauaauucuggaaacaaaugaguuucuugucaacauccaggcaaacucuuccacauagacuuuggauauauuuugggucgggauccaaagccucuuccuccaccaaugaagcugaauaaagaaaugguagaaggaauggggggcacacagagugagcaguaccaagaguuccguaaacaguguuacacggcuuuccuccaccugcgaagguaaguugauuugcuuggcacagagaauuuggguaaauuuauuuuauuuuauagaacaagagaauuuguuuaaauguaugcauucuuuagcauugaucacuuuuucaaaaugacaaaggcaacaauauuuccuaucuuacauuuaauaccaauuuugacaaacugucaaauaucaaaggaaaaagacauaaacuuucuugcuuucccacuaucuuauuacuauaucccaccagcuaggaagcuggcaucacauaagaugaagcaaacauggaggcuuccaacucaaugguguugaugucacuuuaauaaaguauacuuugacaguacugagauagagaaaagguuaagaaacuucauaccauucagaucugccugaagacaguccuggagacuuccuucucccuagcugacuuccuauuucuuuaucaaagaauauaggauauuuuagagugauauuaguucaaucauuuuuauucuuuagcagccuuaguuuuggguacucuucaggaauauucagaaguuugcucaaugauugugguaaauguuaaauaugauuuuuaucucuuuuuaacaccucaucagucauucugcuacaaaaaaauguuuuuucuccguccuuuuuucuucaacaccacuaaaucugugcuuccuucuugcuaauuuacuuaggacugacuaucauaugucaucaggaagaaaaauaaaagucauguuugguaaauuuaggacauggcucugaugauuauuagucaaaaaugacaggaucauuugacucaugcuauuuucagcccaacuaugcaaaaugaacuuuucuuaguccagcagaaaaucccaguccaggaaacauacauacaugcucuuccaggugaaaauauaaccaauagauagccaguugccugugcacauggguucuguuuccuuugacuucauaaccuuugugacaucaauuacucauacaguguuuaguacauaggcacucauuguguguuuauucauugagaacucuucguauuuguaugagaacccuccgaauuccugcuuugagucuagugugaggccauguucccaguuaauguugauguguugguccuaggagacugguuuucuuacaguaaugggguuucauuuaugcacugacuaggucuucauuguaaacucagucuuuuccauguaucacaaaccuguaacaggcauuuuacaaauggccaugauauuuauccuuuggguggcagaauggcucaguuuuaccuuccagaaaugccaaaagaauaaugagaaaaucagugcucuuuagauuuguuuggugaugcagaagcacuuucagagagaugagagugccauuuaauaucugcgauuuuuaauuuaaaauagucaaagcccauagaaaacuaggucgaaccauggauaucucagggagguggcggacaagaugguaaggaaugauaacuagagaaaugucagaggugcucuaucuuauugaaagcagaaggaaaacaaugugguuuauaaacugucauugguaguggauuaguagcaauucaauagaauaagaaaacaggcagguuauuaauggagagccaagguugacuuccuugcuacaaagaaaagccacagagagauuaaucuaaauaauuuuaugcagaguuuuaaugaaaacuguuuaacuuuuaaaaauuucccuguacuuaauauuaucuggaccuaaauuauuugaucaacuuuuuuuuuuuuuuuuugagacagguugucacugucgcccagguuggagugcaguggcaugaccaugguucacugcagucuugacuucccaggcucagaugauccuuccaccucagacuugcagguagcuggaacuacaggcauaugccaccaugcccagcuaauuuuuuguguuuuuuuguagagacgggguggggucuugcuauguugcccaggcuggucuugaacuccuggauucaagcugucugcccaccuuggccucucaaagugcugggauuacagacauaaacccaucgcaccuggccaacauuuauuuuuuaauguuguauuucagaguauguuuuaguugguugaaaaaaugccuucaggauauaagaauuaaccugauaguuguuuggagcuaagguuaucggcacuuuuauuaagcuauuagauaugaucggcccuguuauuuuauaguuuuucuugauaauugaucaguuucuucacaaagaauccacugaauaacauuguaccacauaagcagaguaguccauuugaacuuaguuauaaaugguuacaaaauacauuaucaucucuuauuaaucaguacauauuaagucuuucucccaacccacacuuaugccaaacaccauucuuagacacugauguuacaaagauguucuuuuuacauuuuuugguaaaaauuuucaauagugaaauaaggaauacauuuaccagcugggcacggugacucacuccuguaauccaagcacucugggaggcugagguggguggaucacuugaggccaggaguuugagaccagccuggccaacauggugaaacccugucucuacuaaaaaagaaaauacaaaaauuagccaggugugauggugcacgcuuguaaucucagcuacuagggaggcugagguaugagaauugcuugaacccgagaggcagagguuacagugagccaaaaucacaccacugaacuccaaccuagacaauagagcaagacucugucucaaaaaaagaaaaaaaauuuaaaaaaauguguuuaacuaucaaguaagguucucauauugucucagagauguuugccuagucaccaaacaucagugaauuuauuggucacauacaucauuaacuacauugcuuccccucuuugaaguaguacacuuauugaauaacacuuucacaggaacucugauuuugcugucauggaaaauagaauguagaggaaauacauuugaaauacuauaagaaccucaauguaguuaauggauuucuauuuucaguaauaaagguuuuuccugaaaaauuuaaacuaucuuugugugacuagaguguagcacaauaguuggcaugaacguggguaagagaaagagugcaguuuccuugaacauuacaugcaaccugcuucuuucuaaaaauccuaauuauaucacauuccaucuugcaaucuuugcuagauuuugcacgcuuucccacccuauuauuguuauuauuauuuuuuaucuuacccuuagguugucuaauacugguuuguuggccgggcaggguggcucaugccuguaaucccagcaccucgggaggucgaggcagguagauaacuugaggucaggaguucgagaccagccuggccaacauggugaaacccugucucuacuaaaaauacaaaaauuagccuggcauaguggcacugccuguagucccaguuacuuggggggcugaggcaagagacucgcuugaaccugggagguggagguugcagugacccgagaucgugccacugcacgcuagucugggugacagaacaagacuccaucuaaaaaaaaaaaguggccuuuaaauuuguguuucugaguaggacauuaaaugacuguccuaugaaguaaacacuugguauuuugguucacuugauguaucuuaaauggaaaauucagguuaaugacaacagauguaaaagauuaauaccaaagguagugacaaauuauucacaaaguauguggauaucuaaccuuuauauuuauuucuguuucccuuugcuauaacaauagaagcguggaugguuaaauuuaaaucaggagguaauccagaaagcauuaguauuuacuuuuguuaaaaggaacaucgcauucuacacccguaaaggcagauuuuuuuuuuuuuaacauugauccuggcugcccguuagaaucaccuggggagcuuguaggugagguggcaaggggaaaguucuggacucgcucauauuuaauuggucugagauugggcucaggcauugauacauuugaaaagcuaccaaggugaaucuaaugggcagccaaguuggagaacuucuaauauaucucuuucaaaacugacuuuguauucuccuuauguuaccuucugguagauuuccccaugccaagaugggaaaaaauuauguaccuauguaaucaacaaaacagaguacgaaugauggagaguuaguugaaagagcaucuuuuuuuuuuuuuuuuauaauauguaacagcggauuguacgcugcuggcaucacauuccuugaagcccucucaaguggaucaucucuauuuccauagagaagggcuuaucuaaccuguggcccccaggccacauguggcccaggacagcuuagaauacagcccaacacaaauucauaaacuuucuuaaaacauuaugagauuuuuuuuuuugugauuuuuuaaagcucaucagcuaucauuaguguuaguguauuuuauguauagcccaagacaauucuucuuccacuguggcccagggaagccaaauauuggacaccucugauguagaaccuucauuaucauuauaaaggguuucauucuggacauuuauuuuugcccaccccucacuccccuuaccauuuucauccaguccugugacuuuacguaugauccuagugcugaugacuuuaaacuaauaucacuagccuucauaucuccucugagauauaucugacaucucuacuaaaaaucuaguaggcaccucagacuccacaugucuaaaacgaaauucuugaaucccugccuaaaauccuguuccucuuccauuuagccucuccuaucuuggugaauaacacuaguguccuauuaggcuaaauccuuuguguuuuucaguuucucuauccucucacccugaccuccauugaaaccaucagcaaggaucaucuauuucaucuccaaaauauagccugauaacccccauguugguuccuguccaccuggaagucuaugauauaguuucucuacuuugauucuuacucccuucaagauggccagugugaacuguuaaaaaugccuaucaacguguguuacuccacuccuuaaacuuaguugcuucucagugcauuucaaauacaacuauaccgccuuaagaugccucucucucauuuucccauuuuccuguuguuuuuuucucuuuuaaaucuuuuaaucaagcagacauaaaauuaucauguuuaucaauucauuauauuaguuuacacccuccuccagaauguaaacuucaugaauguggggacccuguuuguucaguucaccacugucugucuguaucccuagugccuacaacaguggauauagugaguacuaaguaaguguuuguugguugaaugaauaaaaugauuacaugaguaggaauggaauaacaucugugguaugcauuuaucaauucccacaaagaaauuaguaauuuaaagcuagguuaaagcuguuuagcuauuaucauaacuuuuuguuccuaagaguuuaaguggguuagggccugauuugauuagacuacaucaagguagaaguuuuucauuauaauuccucuugauuuuuauuggcaauauaaaauucagaaaugaggauaaaacagauaauuugaaacuuauauggauagucauuuuucuauaaaaguuccauuaucauuacaguuuaacuguuaaacauuuaaguauuaaguaacaguucguauuuuauuauuauuauuauuaucauuauagauagguagauagcuggaauaaagauccuacaucacccagauccugcccccauccccuagagaagacagugcaaggcgcuugguugacauuuuuacugaaacagcuaaaacccuucauugccuaaaaccaacgcuuuccuuacauccauccugaagaucaaaccugaaucucuuuuuaucagugcuaaggaggggccacuaagagcauaacuacccaaaguggagaggucccaguggagauuuauuuaaaacuuuccccagaaggccccaccucuggaaaugaccauucagaauaguaacauuuguucucuuuggaggaagaggaagaguuugaggauuggugaagagaaacuguuaguuccuguuggaggccagcauacucugaagauaucauuauuuagauaucuugcccauuuuuaaugcagcagaguacuagcaauuuuuucuuucuuauagaauuacuuuuauccaggucagucacuguaguuccugaaaugaugauugguguaucuggaagauacucaggagugauucaugggaugauuuuauuucccuuucauucauuuagccaugacacacugaggucaucuuaaaguagcagauuguuaucuucaucuagcaaaaacagauagauuuuaauuguuauaaaaugugaauugcacauaaaguagaucuuccucagaucccuucuaaaauauauauauauacuuacuaaaaaaugaaaagaaugucauuauuagaugauuacuccaaaggucugucccaugguguaggauuuagaaaugguguuauacgaagaccccaaaauaaaauauuugucaaggcuugcauuucauugauaccaacugaugaauuuucugcuggaauaauaguaaucacuguagaaauccaaguaccacuacuucuaaaguauucuuaauaugagaaagaaaugcagaauucuuaaucguugcuauuuuuuucuuuucugcucuucuuuagguauucuaaucugauuuugaacuuguuuuccuugaugguugaugcaaacauuccagauauugcacuugaaccagauaaaacugugaaaaagguaauuuuuaaguaacauaaaugaagagcucuucuguauaauuuuuccauauuccagaauacaacaaccucucaagucucugcagccaguuuuauccccuuccuuguuccugcccacagucacaugaauagguucucucaucuggagagacaguuugcuugcuacuccagcccugcagucacagggaggaggaagcagcagcccaaagcuuaaagaacugagcagaguuuucagcuauuguccaucauagggaggauuuauuuuaaaauugaauuuagccaaguuaacugccagcuacaaugaaucuucacaagaacacaacagaauucauagucucucuaacauaucauuuggaaugucuauuaucucucuuuuuuuuaauaacuagaugugugaauaaacagaaaaugugacacuaagccaaugaaaaaauaaaacaauccguagaaacacccugagaugacccaugaccgcagaaaaggacuuuaaagcagcuguuacaaauguccaugcaccuaagggaaaauaaaugcauaauuacugaacagauaggacuaucaauagagacauuaaaacuaggaaggaagaacaaaaugaaaauuauggaacugaaaguacaguagcuaaaaugaaauauuaauuggguaggcuuaacagcagauugaguuauggcauuagaagucaguaaacuuaaagauaaaucaauagaaauuauuuaauuuacuuccacagcuucacugccuguggaggaacaggaacgaugucaaucauuggcaaaauaaacuaaacuagaucuucucauaugucuccauuccuauagaauuucccuguaucccuguaaaggacuaccucaauagaucuguaguuuccaaagauggggauuuuuuuuuaguucauauuuaaaguugugguuaauuuacaauagccuuaaguauuagaacaauuaguguauguguuaagaaucuuaagaaccuagaggacagccuaacauaagucaguaaaucugauaccaaauaacuauuuauauacaguuaacccuuugguauaaaagagaauauuuucauauuugguaaauaacauuuuuaugccaaguguauaccuucucuuuguaauucaggcacuuauguaaguaugcaagcuuugauaaauugggcuaaaguuuauuuugauucuccugcucuguagauuuuuuauuuccuuaaaaauaguuccaaaauugucagauauucucucuguaaguagaaguuaaggaaaucaaaagaucgaacuuaaggaauauguuugucauuaucugggaugcagacaugagagagcuaguucauugaagauacagccuuagauguuccuccaccaaauuguucuugucuucacuucuuacauuuaccucucuuuuaccuccugcuaucuuguggcucaagcacucucagaucaccugguauaccuccaguacagugaagagacaagggcacugagcuggggcuauggauuguugcacuguuugucauuucuucuuuguagcuuucuaguagugaaacccuauacuucaaacacuaaauggggaccacacuuuauccacuuggaauccccauuuucuccuagccugucuuugagaaguauauguggguuauuuacaagagaaaggaguagucuguaaugguugugugugguggcguaggauugucuggaagcaugugccaguuaaggguucuugagccggcuucgugaauucucugugccucaauuucugcauauuaucgaugagauauuaucuacuguauguuugcguaucagucggaugaaauguugcauguauaauauuuggcauggcauuuugcacaaaguaguucuucaguaacauugacuuuuauauauauauaaaauauacgcacauaaauauacauacuaguuuuucuaguacuuaaugcuacugaaaaucaaguguagcuuuaaauaagacuaaaaaaauuauuuuaucuuuggaaacgauagaccuauugauguaguuuuguguggggauguagggaaauucaauaggaaaggaaaccuuagaagaucacauuuaguuugucagugauugacauuguuccuguucucauauagacacugaagguaugggagaauauuaauauaaucucaccuugcuucauccaauucacaaggaauaacaggaauaaaguggauuauuaauaaacauuccacaauuuaaaucauauauaguaacucuagauuuuagauuaaaaaaaaaggcacaccuuuaguuaaaagagcaguuuuucuguuuuugagauguagggcccuaagaaauauuucuucuuuucuuuuuucuuaaaaacuguuuacaaccaacaagaacaaggugauauacagagcauauaacaaaaacagcaaacuuccacacuccaaagaaugccauucagaauucuaauaaguuacaggucauuuauuugccauaggaauagcucauguuaccuuauaaugucugcaucaguuugauucugccuguucaaaaugugcccuauuuuucuucguuguaaagacuaagaguguuaucuuauagguucaggauaaauuccgcuuagaccugucggaugaagaggcugugcauuacaugcagagucugauugaugagaguguccaugcucuuuuugcugcagugguggaacagauucacaaguuugcccagguaaguucccugagugcagugcauuuuucucaccuucuccguguacugccccagaguccuuggagagccaugcauuucuccugccaguugacaucuuuucuguuuuucuaucaagucguuuugacaucucaccagccagcugaagugaauuguguuucacacguuacuaauuccaaaacaucugcuuuucuuaguaaugacuaacuucuggagcaccagcauagguauuuuuguucuuugcagucaguggugauuauacguccucuugagaaugauuuuggauccagcagaggccuuagcaauugaaacuuggacacuuguuggguuuuggugaaugaugaagugcugggaaaguuuagaagcuaagaaaagcaauccacaucacacaccagaaaggucuauccauagacuuacuauuagcaguauccacagauaagugagggauuaccccuuuaugguaaacuucagauuuaaaacccauuuuaauuaugaauugcauaauaaggaugacuaugaaaaugguuagcaaacggaaaaauuaggcugcuuuuuucuucuaugcccucaccucuccugugaacuccuuccugguguuacacauucacuuaaugauuuuccuaaucauccaagcuuaaagcuugucugcuuugaauuuucccucagccagugaccaguaucucaccaagccguguuuguuucuuuaaccuuuuuaacccaguuuuuuuaaacuuuaugauaccuaggugugugcaguuuccucauugccuaacagcgaagucaaaucucuggcaacuuaaggccuucuagaauauuguguucuaugcugcuuuucaagcuguuguguaauacucucuuucucuaaauauuuuguugucuuucaucauaguggacaacuuugcugcugucauuucuucagcccagaaaucaaucuucuuaauaauguaucuucuguaaacuucuacauggcaaaauccaaccuguccuccaagagcucuuaaugcucuuugauugaucuuucucuaaauuucuguauguuuucuaccuuuauuacgacuugcacuuauguuuugcuuucuuuuuuuccuuccccccaccucccacuuuucccacauuagcugauguuuugcuuuuuauuauagauauuuagauucccggggccaggcgcgguggcucacgccuguaaucccagcacuuugggaggccaaggaggguguaucacgagaucaggagaucgagaccauccugacuaacacagugaaacccugucucuacuaaaaauacaaaaaauuagccaggugugauggcgggcgccuguagucccagcuacucaggaggcugaggcaggagaauggcaugaaccugggaggcggagguugcggugagcugagauugugccacuguacuccagccugggcaacagagcgagacuccgucucaaaaaaaaaaaaaaaaaaagaaauagauauuuagauuccguuauaacucuucaaauacagacuuccugaaggcugggcuuugucuaucagucaccuaguagugcaaugccuuauauacuuaaaaaauauuuaaugaacauaaaggaauuccugccucuagauguuagcuuauacucuuuuucuagcucaauaaaaagguguuuuucccugaacaccagucuugaucauauuuuuauuacaagggcugccucagggucugcuucaugggucauuaauuguaaccaaucauuuguugagaauaaauugugauucaaauaguaugugacucaucaaagucaaccagcuagcuaaagguggaccuugcucuacauauagcagaacagaauauuuuagagguauagggggaaaaaggccagagagauaucaugaccacuugacaucugugacaaacaagggacaaaaccaagacuuaaacccaaauauuuugacucccauauuuaguauuuuuuaaaccagaucuuuucagugucuugcucaucacuauacuacauuagugucaaucaaacuuuuccuggccacggcccaucucuguguguguacaccuuauuuuuuucuuuuuuuaagcucaacuaguuaaaacaugcuugaagucagaaacucuuaacuucugugucuuugcauuucuguagcaggggauuuacccguuguaguuggucauuuauauuuuaucuuacuccaucucuaucuacaaguguagaaauaucucuccaucauggguuuuccuuauuccauacuuguagauucugguuuuucuccuuuguuuuccuggagaaugauauaauggagcuaaaacuccaaacuugaaauuagugcugcugccuaacacugauuucaguaaucuauagcuacacaagcaucuccagacuuaguagcugaaaaagcaauaaugauuuguuauuucuuacuuaggaugcuucagucaggaauuuagcuagagcccagcuaugagguuuuuuuguuugcuguaauguuagcuggcuucacuccuucagcuguauucgacugguaguuggguuugucuuggagguccagcaaagcuucacucaauaggucuggcacuuagguguucucugcauggacuaucucucuccacuuccucugucaucauuucagacuccugcccaaacugcugcucuacagcauggugacugauuuccccaagaggauaugaaggcagacguggcaguccucuuaaaauaagucccaagagcagcccagauucacagagagaaaaaauagauucugccucuugacaggaggagagaguugcauaugcagaaaagagaggaauuaaguagcauuuuugaagauuucacugccacucagcuaaugugcuccagcuuaaaguugagccuucaaguucuguaaaaugaauuaguggcaugcuuuauuuuaguggucuaguuuugaaauucuauuguuaauuugcauaagaugcccauuuugcuugcuggaucuaaaaauagaagggccauuuuucuuaauucucuuuauuaaaaauggaggagaaaaagagguugauaaaaaguaguaguuuuuagggggccauaguauuauuuaggggagcuaguaauagaaggacuuugguuuaccaaagucucugggccucaguuuucacaccuauaaagugauugacauugagguuaaaacaucuguuuuugauauaaauuuaauauaaugucaaagguuaauugcuuuauaaagcuaauguugacuacugcaaggguugguaaaugaaaucugccucuccccucuccccaucuuagggaugguuacauugugaaaguugcugagagcucuuugaguuauuggcguguaccuauucuucuauucauagagaaaauaaaauaugaauggcaaaacgaauugguaaaauugcagugggcaugcucuuaaauuagggagggaucauuuuauacacauuaacagauuauuauaauucuugagaagaaacauuaagucuguuuccuagguuccuguuuucuaguucuucauuacaauaguagauacgauguagaaauccuguaauuaacauuacuuuagccuugguuguuacaggcucuuuuggacuaggauagauuguugauaaccuugauaaucaaaguuacugccacaugaaaauaagaguuaagaacaaauauuugaauuauucuaacagucuaaggaucaccaucuuagauuuguaaaacuggagguuuauugcagcaugaauauguagaugaacuuuuuaaauaucauuucuuagcucuccaguuuacagugauggacaguguuugggacaauaacagcuucaacauuuauuggaauguauuucauacaaugcuucccauuuuuaauuaaauaaccauuacugugauaauacaaguauguuuuaguguuaucccuauuuuauagaugagaaaacugaaccacauaaaaaguuguuuucagccuggcucaguggcucaugccuguaaucccagcacuuugcaaggccaaggcaggcgaaucacaugaggucaggaguuugacaccagccugaccaacauggugaaacccugucucuacuaaaaauacaaaaauuagccagacgugguggcgggcaccuguaaucccagcuagucgggaggcugaggcaggagaaucacuugaacccaggaggcagagguugcagugagccaagaucacuccacugcccuccagccugggcaacagagugagauucugucucaaaaaaaaaaaaaaaauuaauaaaauaaaagaaaacuuaguuaguuguucuaacuuaucagacagauucaguucuuuuuuaccagaauuucauacucuuuauccuaagggaugaacuuaaaaauguuugugauauuucuuagauuuccuuaaauauauaauuugugcuccaaaauaaggguuaccuauggauguuuaauuuuacuggaacuuguuuaggcacugaagcauacaugggaugcuaaauaaggucuuagcuucauacaaaucuuuucaaauaacaauuauaaaagcauaguuguuucuuaauugaucucuggaguuuauuuucucuuugaaacucacuugucuacauauauugucuaaguauugauacuaauaaaucacauaggcauucaaauucagaugacuggcaucuauuuuuuugucacuuguagucaucuauuauaaugaugcaauauuguuaaucgauuuaugguaauuuuaguacauucccauuaaucauuguggauaguagaaccaacuuuuuaaaaaaugggaguagauuaauacaugcuuaaagaauuacagauauuucagcauaaaagaaacaacauucaaaaagaagacuaagaguuacuagauacaacuauuauauccaaaugcuacaaaagcuuguuuucuuucaucaugcaauuccuuaggaaggguagagauuaaacacugcaauauuuguuuccuagcaacacccacauauuagugauacaaauuuuccacuggaaaacaauuuuauuuuggucauugucuuugaaauugcaucauuguaacccuucucuaugccaaaaugaucuuuuuuggcaucuuguucugucgccccccacuggagugcagugguacaauaaugguucacugcagccuugaccuccugggcuugagugauccuccugccucagccucccugguagcuaggaguacaggcaugcaccaccauacccagcuaauuuuuaauuuauuuuuuuguagagaugagguccgacuauguugcccaagcgguucucaaacuccuggccucaagcaauccuccugccucggccuuuugagugcugggauuacaagcacgagccaccaugucuggccuugaagugaucuuuacagugcuuucgaggguuguauacgugggaaagauagaggucauauaguuugggucauguacaguugcacaaguaggccuuucacuggugaucucuuacacugcaguccauuuccuguuucugcuucucccugucauccuuucuuuucauuuaugguaguaaaaaucuugagaaagggguguguuuuccaguaauguuaauacauacuaaaucuaauuaauuaaaucuuggcagauuaacuagagacagagguuuuuguuuuucagaaugacuguaaaaaaauaaauaaccaauagauuggguucagaagguucagaaguuccagcucaagauacuaggaacauagcacugcuguccauuuaaagggaauccuuacucaucacuugcaguguucaaggaggaaaagcacacgucuaggcagagagacaccugauucuauagucacuuauucuuaaguuagagaccaguugccuuuagcuuaagggaauucaacugugauauauuuggguggauuucaaaacaaaagaaacaaaaaaaauggaaggaggaaaauggugugguuauucugcuugaauuuccccuaaagaauaccuguccucuaaggaaugugacaguggcucucucaaaaguguuucaguuaucaagugccucucaugcauaacauggcaucuuacuacgcugaaggugaucccaaaauugaaaauucugaguguuugguauuuauaucacaguuucuaagugcaaaccaguugcugcuuaaccagagaaacaggguuuucuugugucauugcugagggaaaagcuucugauuuuggacuuuuuaagagauacaugucucuuaugugcugccuccucaagggcuuuucuugaguaauuuuuuuuuuuuuaauuuguauuccuguuuuuccuuucuauguugacuuuagcaccuaaacccaguguagagugauuucacuuuauuugcuguccucuuucaucuucuuuaagaaggcaaccuucuaggucagugagugagucucuugguuuucagaauugggaacuaagaccauucaagcccauuucuccuuguauuucucuagguaaaguacaagcauuuucuguguucagaguauguauaaaaacauuuaccuuagguuuauguguauauucacagcaccuuugacaguuaagagaucaguacuugugcugguguuaacucuuccauuuuuuaguuacuugaaagucgcucuuuccugggucaguggaauuuuguuuuuguuuuuaagcuuuugaauaguaaauguaacaauaguaaauguuuagauauacuuacaacccuagucuguuagucuuaaauauaccauaauguguuuucauuugaugaacuuuguuugaaauuugaucuuacaugauacauuagcaaagcuaguucuguuuuaggaccauacauagcuaauacucuuuuuggaaaaggagaacuaucacacacaggaauuuuuguuuauguuuuuuuucuuuaauuuauuuaaaguccuuacucccagacuuguaguauaauuuugggucuugauuucaggugaacagauaaguagaaaauaaacuauaucuuaauucuuuaaugagaauguacucuccuuuaacaaacauguaauuggcuuuaauaauaaaaauguugauaaaacucuaauucaugaauuuauuauuuccugcuguaaauauuaaguggcauuuaguauuuaguugugaaaccgauacauaaguauguagcugcaaaacaaacuauugcagguuuaaagcauuacuaguacucguauguuaaauauaaguacagaucuuuuuauauguguguuuuguuuuuauagcauuacuuuauucauacuaacuuuccauuuuuuuucuuuuggugacccacuuuugccucauauucucucuuuguacuuuuugaaacuucccuuuuuauguaaauugaccacuaacacugaauuccguuuugcaaauugaagcucuuuacccuuucauguucccucauacgugccagacuagagaacaugggaugcucucuaguuuuaaauuguguuuuacuuaaguaccuacucauacuucccaugagguugaaagccguguagccuugaguacucaaauagccauguacaaagguaaaaaguucauaucacucaguauauguaauucauauagucucccuuuauauuuaguucuucuuauuuuaccacuuuaaacaagugugacucuuuuuauaauaacuaaaauuuguuuggaacaucagguuuuauccuacuuuauggaugcaaaauugugaccuaaaaagaagagaaaaaucaucauuucugaguuuccauuuuuagggaccuaauuuuaucauuaggaaugaagaauagcaguguaaaauauuucagugaacaaaacaaaaaguauugauuugggggucaaauagaaauccuuuuaaucuaaaacaaauuauuuuuaauuuaguaauuaauuuucuaaagaaugagaugauucccuuaccaguggcuuaaguaaauaauguaacaccaauauaucacacacagcuuuuuuucauucugucucccagaucuaauuuauuugaauuuuucuuggcagaaauaacaacaacaggaaaaaucauuaauagcaaaguauugaacauuuaaaugugccaggaauuauguaaaguucuuucucuguaucaacucuuaauucucacaccugugaaguaaguguacuacaaguuauguauuuacagaugagaaaacuaagguuaauagaugacaaagcccagauucaaacucaaaauauuuugagucccagaucuaguccuauauuuauaaguaauaauauguauauaaauacauaauauacauuuauauauauguauuuuuauauaaauguuuauauauaagauauuuaguaacuagugacuauuuccagucaccagcugcauuagcccuuaccaagaaagucagccuguccuuugaagccagacuuugacuucucuguagcaugaaaguccucuguggcaucuuauuccauuagaaagcuguuucaucugcacugaaaaucuguucucuaguguagucaccuucaucagugaucuuagcuagauuguagauaacccgugugcaguucuuccaucaguacugaaaaucuguucucuaguguagucaccuucaucagugaucuuagcuagaugguagauaacccgugugcaguuucuccaucagcacuggcugcuuuaccuugcauauauauauauauauauauauauauauauaugcgcauauauauauauauauaugcgcauauauauauauaugcacauauauauauaugcacauauauauaugcacacauauauauaugcacauauauauaugcauauauauauuacauauucauacacauacacacauacauacauauaucaaagucuuaauuuagagaccugaauagcuuuuguugugaguagugaguuuuuaaaauuuuacuuguaaauuuaaauuaucuuuuaacuuuucuuaaucuuucaccuacccaucaaagaaaaaaacguuagcuguguaaacagacaaguaagugugauauauaaaggagucgccaggagcuguuaauccaagauaaauaggauaaaugugggauaacauuuauuuugcacauuggccaaaacuagucuugaauuucauugacccaccugugcucucuuguuccacugcagucagcauugcugcacaacuacccauuaaaacacaugauauuuaaaaaacaaagaauacaggcacuugcuauaugacaaauguuugcagcuuguaagauuaguuaauuauuguaauagcaagagucagcagaaugccccauaauuuucagcccaaaugccuugcaguuuauuucucauucauacaaauuuaauuuucuuaucuucuccaaagaagauuuuuaaacacuugaaugucauccuugauaggguuugccauguuugcuucauuaacugcuuuuaguaagguuaguuuuauacuguuguuuucuuucccucuguguucugucaaaaccuuuuauaaaaauucuucaaauguacaguaguugaauauuuugggacugucucugcuauauguuuuuuauuuuuauuuuuuuccuaaagacacagacauuucaaaguauuugggaaaaagaaggcauaccuuaaagauuuuuugaucugaaguccagaccacugcaauaaaugacuuuuuuguuuucccagugcauauaaaaguuauguuuacaugauacuaugcaguagcauuaugucuuuaaaaacuaugugccuaucuuaaaaauauugcuaaaaaaugcuuaacaaucaucugagcuuucagugaguuguaaucuuuuugcugguggagggucuugccuugauguugauagcugcugaucaggguggugguugcuaaagguugaguaguuguaaaucugugaaguuugccacaucaguugauucuuccuuucacaaaagaucucucuguagcaugugaugcuguuugauagcauuuugcccagaguagaacuuuuugcagaauuggagucaacccuuucaaaacuugcuguugcuuuaucaacuaaauuuauggaauauucuaaauccuuuguugucauuucaacaauguucaaagcaucuucaccaugaauugauuccaucucaagaaaccacuuugcuuauccagaaggaggaacuccucaucugcucaaguuuuaucaugagacugcagcaauucagucacauauucaggcuccacuucuaauucuuguucucuuguaguuuccaccacaucugcaauuacuuccucuacugaacucuugaaccccucaaagucauccaugaagaauggaaucaacuucuuccgaacuccuauuaauguugauauuuucaccuccuccuaugaaucucaaauguucucaauggcaucuagaauggugaauccuuuccaguagguuuucaauuuguuuugcugagauccaucagaggaauuacuaucuguggcagcuauagccuuacgaaauguauuucuuaaauaauaggacuugaaaguagaguaacuccaugauccaugggcuguagaauggauguugaauuagcaggcauuaaaacaacauuaaucuuuugguauauuccaucagagcucuuggaugacuggguacauugucaaugaacaauauuuugaaucuuuuuuucugagcaguaggcuucaacagugggcuuaaaauuuucaguaaaccggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggugcgguggcgggcgccuguagucccagcuacucgggaggcugaggcaggagaauggcgugaacccgggaagcggagcuugcagugagccgagauugcgccacugcaguccgcaguccggccugggcaacagagcgagacucugucucaaaaaaaaaaaaaaaaaaaaaaaaaauuuucaguaaaccauauuauaaacaaauaugauaucauccaagcuacuguuucauuuguagaucaaaggcagaguagauuuaacauaauucuuaggggcccuaggauuuucagagugguaaaugaacauugacaucaacuaagucaccagcugcauuagccccuaccaagaaagucagccuguuuugaagcuuugaauccagacauugacuucccuguagcgugaaaguccuauguggcaucuuauucauuagaagccuguuucaucugcauugaaaaccuguuacuuagucaccuucaucaaugaucuuagcuaaaugguagauaacuugugugcaguuucuuuaucagcacuggcugcuuuaccuugcacuucuauguuauggagauagcuucuuucuuuaaaccucaucaaccaaccucugcuaccuuuagacuucucuucugcaacuuccucaucuuucucagccuuuauagaauugaagacaguuaaggccuugcucugcauuaggcuuuggcuuauggggauguuguagcugguuugggcuucuauccagaccacaaaaacuuccuccauaucagcaauaaagcuguuuugcucucaucauucguguauucacuagaguagcauuuuaauuuccuucaagaacauuucuuugcauuuaaaacuuggcucuuugaugcgagagucuuaacuuuuggccuaucugagcuuuugauaugccuuucucacuaggcuuaaucauuucuagguuuuaauauaaagccagagauaugcgacucuucccuuucacuugaucaccuagaggcccugauagcguucuuaauuggccuaauuuccauauuguugugucuuagggaggcuuaaagagaagaagagagauaggggaauggccaguugguggaguagucagaacacauguaauauuuaucaauuaaguuugccaucuuaugcagacacgguucguggugccccaaaacauuuacaauagugauaacgaagaucgcugaucauagaucaccauagcagguggaauaguaaugaaaaauuuugaaauauuaugagaauuaccaaacuaugacacagagacacaaagugaacauaagcuguuggaaaaaauggcucugauagacuugcgcaagcagaguugccacaggcuuucaauuuguuaaaaaaaaacaaaacaaaacaguaucugugaggugcaguaaagcuaagcacaauaaaacaagguaugcugguauauuagagaccuuugguucaauagcaacauuuuugucauacauagacgcauacacguguacauaugcaguuuuucauugcguccaaauuacuuccaaguuauuuagacucccucguauguuaguguagacccuuugcaguuuggcuuuuaccugcacuuucaacccuuaucaucuucaaaagccuucaaaaagaaccuucuuuguagcucuguugauucaccgccgcuaccuccaggcaacacaccucuucucuuugcauggaaugaguucccucuuauuuccccaacuuuugaguguguguguguguguguguguguguguguguguguguauguaagagagagaguguguguguguguguguguguguguguguaugauucugucuauauuaauuugguccucgggcauuuugucuuaauuugagaucucccacagaaucugagacacuuccuggcacauaguaggcaccaaauaaacauaugugguuuuauaugagugccgaguaccauuucuuuaggaaguuuauuuucucugauaauugccuuuaguaaaaauauuuaaauugcuucuuaaauucuaaauuacauuauuuuuauucacaugaaaaauaaaucuugccaauuuuuuucuagagugacacuuuaaaaugugucagauuaaaagccaucaacaucuuggcauuuuucacauuuguacauguacacaugcaugugcacacacacacagacacacuugucagcaagguguuuugccuucacuuuuucucugaguaauaaugaagugaaggucuuagaaacagaauucauguaagcagcauucauaauuccuccaagagaaugccaguauauuuguaucaaacaaaaagggcacgaguuauggaugacucaguguauauucagccaaacaaagaaaucuucguugauuuuauuccuacuggggauaucucaguauugaacaccauuaauaguguuggccccaaaacagcucuucacuaggccucucgacuucuuccuuugauuugauuuccagaccauuucuggaaugaaguaguugcacucucugggauaagcuacagguuuucacagccucucaaaauguggcaccaagaaccaagcacacuacucaaaaucacuuuaucuaaaucacuuuagaauucaguggaauuuuugccuuccuagugcuggaugagaugauuuuugcuugucucguguuaauuacauucaucuugagcuuacagucagcagacacccucuccuugaauuauuuucucauauaaacugauuuuuaagugaagccucaggaauccuauacaguauaguuaauugcaauccucuugguagcauuuagcaaacuaauuaaugcacuuuuuauuuuauuaguagucuuuuuuaaaacuauagacuauuguuuaucuuugugaauaauuaaguaaauuauuuucuguuuauuucuuuuuaauuuuuguaguacuggagaaaaugaaacugggauugacccaucaagaugcuuggcucaauaagaaaaccacguuaggagcaaccuuuguauauuggagacuucagaguaaccagcaaggaagagaaaucuuaaucuucaaguuaccauauuuuccaaauauuacaugguaccugaguucugcuuccuuggaugucauugcuuaaauauagucuugaagggcuuguuuugaaauauuguauauauuuuuucaaauguauacauuguuaauaaauuaagaaaugagaaacauucuuauuuauguacauguuaugagaguucuggaggaaguaauauguugaaauaguaaaacauuuuaguuuuugaguuuaa

SEQ ID NO: 192743 - RNA, 24308 nt, Homo sapiens
gcguccggcccgcccgcaggccagcuucucucgggagcccccacccaggcgcauggcuccaugaagcaagaggaggaggcagagcgcgagaggucccguccgccccagccgcgucugggccaggagaaaaggugggaaacucgggcugcgccgcacccuucuccccgcugccgggccaggccucccucgguccgccgccgccuugcccgccgggccuguucucgccggggcgggcggcggggccgggaagagaccccgcgguccuggggcgaggguccgggggcagcgggggggaggagucccgggcggcgggcggggccucaggccaugucccagcggagggcagggggucgggaggcacugccggggaggggcgggcggcgccgugccccgggccgcgaggcucggcucccgcuccugguccuugucugcacucccuccaggaagcaggcucgcucgcuguaaaguuugguggucuccggcgccgccugguggcccccacccaccgucccgccgccccgccgcccccucccccgcccggcgucuggauuccacccccgcggcucggcccaagcugcucuacccgucgcuccaucgucuccccaacuccccagcgccccggacccucuuuccucauacccucguuucucaccuuucacccugucccucggcccgcuuuuccccuccccgcucuguccugucguuuucuuaacacucuucacacgcgcacuuucuccuccuccucuucucuuuuucgcaccccuacucuugggcccuccuuccuuaaccuccgcuggccccccauuccaugauccguccaccugacacgcuggguuucaugccucucuuucccaggcuguggguugugcccuucacuccuugcccuccuacauucccuguccugaucugaacuccucuccuugccaugcucccucacccuuaucccucugggccuuauccucuuucacugcccucuccuaggauagaguggguggggccucucccacccacaggagauguaaacagucuccuguuuacuuacaucuuugggaguagcucaauucucuaguaguggggagaguuggugaagagaucaggaagagauuucuucgagacuaaggauggaugacccuuagcaacagugaccgucuccucccggcauagcaagauggccugcccucaggucccugccucuggcgugcuguccaguaauucuucaguucugucuuugcagaggauugggaaauuuauuuguguucugaaaccggcggagagcuuuuaaauggucucuucuggccugagagcaacuuuugcucugcaucugugguggggaaguuuuaaugugcgucucaugcucgaguucaauaaauaaaaccuuugauucucaguguccucccuucuugcugaugacgcuaaggaugagaugauucagggcaugggacuucacggcugccucagauuuagaguuugcaagguuuugaaauaaggagagccuguucucuagcuauuugcugugccccccacccccccgaaauugcucugucgaguugugauuuuucagaaaccguaucuaucuuaccucugcacuaccuggguguuuguucacugcaccugcauuuccgucuuagguacaggaagaaggaauggaaucggaaggaagaaaauucauuccagagacaaaauagcuccccuccucuguuguagcuguuccucuggcaauacaaacuuucugcuuucagugaguauuaucuugggcauauuuagaguagagcaucguuguaguuuuugauuuuaggcaugugcuaggauuuugggauguagguguguuuucauuuguauuuuucuacuuccaugaggggguccuaauguugaugaaguuuuuccgcuuguucccuuuuaaaauaauuuaaauaugcaaaggcaaguuuguuuuucauacucccauuagagugagcuaggugguggcguggcaugaucuuuccuuuauauuucuaguuuguaaggucuggcuccucacccuucccaaaugaguuucucaauacaaccaaagagguugucuuaaguuuuaggguaauuaacucagagguuaaugcaguuccugaucaaagucaauuauugguucucuuuucuauaguuucaguccugagagacuuuuggaacauuuuguccuaaauuugcaauagugaagauauuuucuugaaaaucccaucacagauuugaagauaauuaaaauuuuucacuguaaacuugaaacaaaguucuggggaaaaauuaugacugcugugcccucuugaguugauuaaugauaguaugcuaacacuuaggagagaguuuucagaguguuucacuucuuggugaagccucccagccccucugagggacacaggggauaaauguuuuuauuuuacaaaugaaagaacugaggcccagaaaaauguggcaccuugcuacaggucacauagaaaacagaggggaggugaaaagaguuuugacuccuagguacauguuuuucuuuaagcuaaguugaaaugaaaauguauaguucuggccaggcgcaguggcucaagccuguaaucccagcacuuugggaggccgaggcagguggauaacgaggucaagagaucaagacauccuggccaacauggugaaaccccgucucuacugaaaauacaaaaauuagccaggugugguggcaugugccuguaguccucagcuacuugggaggcugaggcaggagaaucgcuugaacccgggagguggagguugcagugagcugagaucaugccacuguacuccagccugacgacagagcgagacucugucuaaaaaaaaaaaaagaaaagaaauuugcaguucuuuauguuuuuaaaaaucuauaaagcuuaaaaacaauuguugccaggcaugguggcgugcaucuguagccccagcaacuugagaagcugaggcaggaggaucgcuugagcccuguaaauagccacuucagccugggcagcauagcaagacuucaucucuuuaaaaaaaaaaaaaaaaaaaaaauucugggcacagucacucaugccuguguaaaucccaaaacugggaagccaaggcaggaggauugcuugaagccagaaguucaaaaccagcuuaguaacauaaggagacccugucucuacaaaaggaaaaaauuuuuaaaaauuggccgagugugguggugcauggcgguggucccagcuacuugggaggcugaggcaggaggaucucuugagcacagaaguucaaagccgcauugagcugugauuguaccacugcacuccagccuggaccgcagacggagacccugucuccaaaacaaaaaggaacaauuguauagguauaucugugauuugugggggaaaauuuucacacaccaaauguuuuggauguguguaugauggggguuucaaaaauaaaugauuauuugguaugguuaccagaauguauguggguuuuucugacuguuuccuggaauaguuccauaaguaggacagaauuauagcucaggugccauuucaguacccauaauguaauuauuaaauugaauuucaagucaacucugugucacaaaggaaacaacagcuuguucccuucugugaaaagcuugauuugagcaaacaucuaaaugcuaaaugauaacagaagaaaaugcagagacccccuuuuucuuggccuuuuucccaccucccaaaucuuuaugagaucgugcccucgaauaagcuguuuugaggcuugucuucaaaaggugaaucuagauuuuuccccccaccuuuaggcuuuucuagauauuuuaaucuggugguugugugaaaccuaacuacuuugacaacaguuuuuaaaauugguauucaguaucuaucaagaugucuacaauaauagcauuuuaagcaaauuuagucucuauuuuaguguaugucuguaagcuuaaaugaggacucuaguggaauaaaacuguacaacucucaaggcagccaaguauuuuucucuguguuuucuggcaucucagaaugaaaagaaacaguggaugauuuauuagaagccauugcucuccaaagaaggaaaccaucaaggucaugagaguaauaaucccauguuaauaauaugaucuuuuagauuacaaggucauucuuaauggaauuguauuaggagggcauuauuccucuagaaauuguaagcacucagagcuguguuauuuuuauaaccaacgcuacuuuuaucagugggguagggaaguauugguaacagcagacacuuaauagauaguaguuaugugccacagaacugccaggugcuuuucgugucuuucacagcucacaaauaaaccucugugguagcaggagcccaaguccacagagaugugaaaacuugccugaguugcguagcugguacguggcaagucagacuugggaucugagcugagauuguaaccucaaaaucuagguucuguccccugaagaggggagcugcucugggaaaaugggaguuauuuuuuucaguggacuuaguagccuuggaagggaccugcagugagagaggaagguccuuuugcccagccagacacaugagugggggcaucaucacaucuuugugucaauagcagucucaauaccugguuuguaaauacuagcaguguaugagaaauaguuuguauuaaucccugaaaccacaaauggccacccaggcaaauaaauucuccaguggguaguucugaaagugcucuaucauugaaaaaggaaaaaaugauucuucccaacugcaguuuagauugucugaccuaucaaaagaaagccuugagccaccucgaaguggcaccugaagccaguucagaacugacagcuacugguauguuuuagcaaggaugacagcuaccagcauacauuggaccaagaagugaauuuaggugauaguugaccuaauuuuuaaaaugaauuauccacaguggcuauccauuuugcuaugaauaauuauuaaacuaucccuugguuugggcugaauagaauggagauuguugauaagaauaggugcuuguaauucagucauccucagguucugcgauacuccacugucagcaggcaaacuuaaauuauuagauguguagauaagauuguuggugacaaucaggaguguguguguguguguguguguguguauacuguauguagggcaccauguuaggugcagugaaagaugaaacagaugcccugcggccucucaggcucagggugaugccgaguucagugcuggcugaaauuuuuaaguuguaagcugcuccaaauagcagggcagugcucagcguccccacagagagggaggaagagucacugaguggcccuuguugcaggcccuaaugaaguucagggcccccuugaguguguacaucagguggagaagagagaacguccugcaagcacagggcagaugaggacgccgcagcaucacugaggaaggcuggugacuuuaagcacuaagggcacacuuuauuugacaccugcaagguuaggaggucuuaagagguaaaacagugguugcugugauuucugccagcuuuuuguugagguaugaguauuguuuccaucugguggaaaccuaguuuuaacuagcuuauucuuauuggugguccuaauggaugaacaggaagaaaagggacucucaccauggcccuugagcugagcuuugugcaaguaaccagcugaaggccuggaagggucuugguuauauauacuuucauaaagcaaggguuuuuacaccugauuucaaacuuugucuuuuuccuuccguuuuuguggagaaugggaucuuacuguguugcccaggcaggucucaaacuccagggcucaagcuauccgccugccucugccucucuaaguguagggauuacaggcgugagcuccugcgccuggcuucucuuauuucaaaugaaccagcuucacaguaauuuguacuaugcucacaguaccauccuugguaguuuuuauaaaguuuggcagggaaguuuggcgggcacagauuuagaagagguaaguaugucauuaaguggagcauuuguuuuuggcugaucagaaggauagucugaucuauuagaaugcuauuauucugaaguaccuuaccuaguacucacaaagccgggcugcuggaggaccaggugucucuugaucacuguagggcagugcugagagcugagucgggaacuacuuaguuguggaugagauaccuacauuguuggaauaggacuagagaaucucgaaccuaaagagaaaauuucgaugaaauuuguugauagugguugauguuuaagaagucuuuguuuauuaccagcaccuugguuuacauucuuugccuguaguuguuauauauuaguccauuuuugcauugcuauaaauaccugggacugguaacuuauuuaaaaaaaaggcuuaauuggcucaggguucugcaggcuguacagacagcauagcagcaucugcuucuggggaggccuuggagguuuuacucauggcggaaggcaaagcaggagcgggcacauaacauaacaaaugcaggagcaggagagaguugggaggaggugccacacacuuuuaaaugcccagaucuugagagaaggcgcucacugucaucacuaucaggagugcagcaccaaagguugguccuaaaucauucaugagaaauccacccccgugauccagucagcucccaccaggccccacagcuaacacuggggauuacaauucagcaugagacuuggguggcgacaaacacgcaaacuguaucaaguuaauauuugcuuuuuguuggcagauaaguaaaauauuggaccccucaaaaaacugccuuaaauaauuccauagagggaugggagguggagagaguagguaaugcacagagguauagaugaaguaagauuggccauagguuggaaauuuuuaaauauugggcucauuauacuauuuguggaguauacuauuuucuccacuuuggucauguuugaaauuucccauagauuugaauuuauggaauaagcuuuuaaagaaaugccuucuaauauauuuuugaugcagaaaauaucuaacucugcuuuuggucacuaaaacucaacugagacuaucaguugaauugguuauuuaguggccuccagagaaaugcuuggaucuaaagggccaaagauugugguugguucuguucauugcaaaucauaguuggaagauguuggggaacuguaaacacaacuguguaaaaucaacugugauuaugacccacugcggaucagugauuguauguggcauguaggcagaaucuucuggacuugaguucaucugcauuggugugguuugaaaaucccuucuguugcucugugauggaguguuucaccagucagguggcugauaccaccuggaagagaaugucugaguuguugccucuaucucacgacauuuagcuuuuccuucaggugugguuugguguaaugagaaugaugaaagguuuuuuuagcuuuugcauuuuauucuuucccuucgauucuuugaauucugaggcucuagaggugcagagccucagagcccuauuaaaacaccagcucucugggaaugcgguccugcugcuucaucugaccuguaucucuagcucgcugcccacaguugcacacaaaguagagucaagugagaacucaggcuggugacacccaucguggauucaaaugacccuggaugaggggauaauuuuccaggugauggcugagauguugacuuugggcuugguuuuucauauuguuuuccuggcuccauuuuuguuggcaagauucuauaagcuguuagauuaguucuuaacauacccuagaaauuaaauuuuuauuuauuuauuuauuuauuuugagacagggucuuacucugucacccaggcuggagugcagugguacaaacauggcucacugcagccucaaccuccugggcucaaggggauccucuugcuucagccuccuguguagcugggaccauaggugcgugccaccaugcccagcuaauuuauuuuauguagagacagaugucucacuuuguugcccaggcuggucuccaacuccugggcucaagccauccucccaccucgaucgaccucccaaaguguugggauuauaggugugagucaccacucccagcccagaauuuauuuauuuauuuuuuaauccugcccuaaagaaagacugaauccaguggauauuauuggcagaacucauucuuucuuguaguuccaggccauacagccugauacauagauugugaucuaaauccuaguucuggcccaggugcgguggcucaugccuguaaucccagcauuuugggaggcugaggugggcagaucaccugaagucaggaguucaagaccagccuggccaacauggugaaacaccaucucuacuaaaaauacaaaaauuagccagacaugauggcacgugcugguagucccagccacucaggaggccaaguaaggagaauugcuugaaccugggaggcagagguugcagugagccaagagcaugccacugcacugcagccugggugacagagugagacuuugucucaaaaaaaaaaaaaaaaauucuagcgcugccacuuaguggcaguguggaugcuguaaaauguaaaaugaugguagcaucaucugccuuguugagugcuuuagaggauucagugaagcccuuuuugaagagugugugcucugugcaagcucugcuguaagcccagagugcacagccaaguacuggccccccaggaguugcccuccuagagaacaguggaacaagaacccagaugauaagagcagcuaaaaguauugaugcuuaacacauacuagucacuguuuuaagcccuuuauguacauauauauauauauauauauguauauauauauauauuuggagacagaguuucgcucuuauugcccaggcuggagugcaguggugcgaucucagcuuacugcaacuuccaccuccagaguucaagugauucuccugucucagccucccggguagcuaggauuacaggcaugcaccaccaugcccagcuaauuuuguauuuuuaguagagaugagguuucuccauguuggucaggcuggucucaagcuccugaccucaggugauccgcccaccucggccucccaaaguacuggguucauaggcgugagccagggcgccuggccucuuuacauauguuaaacucauuuaauucaccuaacccuaggaagcaaauacuauuauuauuccuguuuugaguaaacugaggcagaaagagguuaaucguggaggaaccaggauuugagcccaggccaccuggcuuuggaggcagcauuuuaaaaaaccaaggcacucugcuuccccucucaacaguccaaauaagacagugacauccauggucagaaacaguguagucauuggagguuuuauuauauugaguauguaagacuuucucaaaaagaagccagguguggcucacaccuauaaugacagcuacuggggaggcuguagugagaggauccccaccgcacaccgcaccgccccccuaccaccuuuuuuuuuuuuuuuuuuugagacagggccuugcucuguugcccaggcuggagugcaguggcauggucauagcucacugcagccucaacccccugggcucaggcaauccucgcuccuuagccucccaaguagcugggaccacagacaugugccaccaugcucagcuaauuuuuuuuauuuuuuguagagacugggucucccuguguugccuauacuggucucaaacuccucggcucaaggaauccuccugccucggccucccaacaugcugggauuacagauaugagccacuguguccagccagcgggugggggggcggggcggggagcggaucccucccuuguggccaggaauuugagaccagccuggacaacauagugagacccccauaucuccaaaaaaaaaaagauagcugggcauagugguguguaccugcaguccuagcacuuugggaagcugaggcgggaggaucacuugaguccaggaguuggaggcugugguaagcuaugauugugccacugcacuccagggugggugacagaaugagaccugucucuuaaagaaaaagagagagagagagagaagaggagaggggaggagagggaaagagagaagccccuauuucaagcaaggcaugagaauguacaagcuauuauucuucggccacagagagcuuugaucucaaucggaaaugcccuugauguguauuuuguuauggaucagcauauaugaagaacauaaauaauccuuguaaaauguuuauaucauucaacguaaagugacaaguuguuuagaaauaauggcauugcagauggguguguaaauauuuaauuugaaauuuaaaagguugaagaauuuacaccugaaauacuauuuguagaucaaugccuaaaaagauaauuauaugacauguccaaaucacaggggaaaauuuagguaggacagcgcaaaucucucuucucucucucccuccccccacuugcccuucuuucucucucuuuccagccaaaacaauaacauacaaugacuugagagaaaacuuaguuuucuguacuuagaaacuucaguauugucaacauugaaauaacuaggcucuauuuuccugauucuguugaggagugacacuuuucagacaacagagaggaccuuaguuguguuauggcuauacauuuuuaccgcgggcuuuuaaagaaaaaaacaauuaaaaaaaaaaucccuuccuucccuucgcaucaucagcugggaggaggcuguggcuccccagcccaugugacaccacauuuuguuaagcuggguggcuuuguaucugucuggcuggcuaugacagggcagaaacugccaccucacaaaagggcugugaagcuugggucauucaugugaauaaagguuucugcuagguugcagguuuucugaauggggucuugaaaggauagggagauguauagaaauuggagugaguucagaggggaaccaaagagaaugagggggcuggaggaggagagcugcagagacagaaaggugggagccuuguguuagaagaugugcccucuucagagugacagccaacugcuuuucauccuugcugugguuuggggcugaaaguacgaagauagauuguaguuagugaugaggaaaauacagaaggaugugguuaacaaggaaaaucaugaaaguuccucuggaguucuuuaaaaauaggaugguucaauuuggagccucuaaaaaagguagagacaucaugaugaugagucugacaggucgugcgcagcccuccaggcagucuggaaauguccucagccagcuucacgcuggcuggugccccacccugucuucugcccuggggacucuuggggaacagggagcugcuuggugccugccuccauccaugguagucaucuggaaauuuuauggaaaauaaaaauucucuuuuaggaaaagguuagggguuucuucuccuggucugugaccuggagguugagugggagaaagaauuugacagcucuuagcuggucaaugcagacucucuaucuuugauguuuuuuccucuccuuuuaacuaaccagucaaauuaaugcuuaacuucucauuuugguuaggguucugcagcauuccagaccuugagcacugaaucaggaugggaaaaagacguuguguuccuccacucgagcccaaguuggcagcaggcuguuguggggucaagaagcccaaauuaucuggaaguggaacgcacagucacgggaaucaguccacaacuguccccggcucuaguucaggaccucuucaaaaccaccagcauguggacagcagcaguggacgggagaaugugucagacuuaacucugggaccuggaaacucucccaucacacgaaugaaucccgcaucgggagcgcugagcccucuuccccggccuaauggaacugccaacaccacuaagaaucugguggugacugcagagaugugcugcuacugcuucgacguacucuacugucaccucuauggcuucccacagccacgacuuccuagauucaccaaugaccccuagugaguaaaucaugugcugggggcacugaggaaggcauggugacaucuuucuggggugauucucuugagagggucugcuacuuggaagucuuuauuaucauuugaggaaaggguaaugggaagagaaugauaagaaauguccagagaauauuuaaaacauucaguggauucaguaauggaagggagcaguucacauuuggaggaggcuguaggcuuguuguuaaaguaauguucuggaaaucaagugaguucauucuuggcucuucuguugguucacauggcaguggguauggcauuuaaccucucaaguggggaagucacgccauaccauuggggacacccauaguguugaaguccaggugaguuggaagucugagggccaggcuggagacuaggagcucucauucacugggaucugcgauuugguuaacagggguccccucacuuuguucaugagaaaucccuugguaaaccuguagggccacucacaucccaucaagaagucagaaucugcuucaguauuuuuaguucaagauucuuuguugcuugucccaagcccucuacuggucucagugacuuaaauaagcaauauguauaaaguaaacugaagaauuccaugcuagcauuuucuucuuccucagaauuggaagccgcucugagcuggcuuugaagagcauugcuguuuuuuuauuuuuguuuuggggguaugcuuuuggaguguucauugauaugagauuauucauuccucaguuguugauugccauacggagacuacaaaaccuuggcuggggcauggagagggugugaagaaaaggagccucuucccuugggaggccugucagguuggcaaaucacacacgcacagagcuaaggggaaguuguucucugugagugugucagaggagaggaaaccuggagggaagugugcucgguuuuuugggaaccgucacccugggguaacaugguuagaaaacaccugacugagcagguggagaucccaagccugagugagauccagggugccccacguaagagagagaugcaguuuggaagaacaggugaugauguggguguuuagggaagguuuagacuguuguauucaaggcuuugcauuuccauccugcaggcaauggaggccuugucuugaaggauuuuucaguaggcuuuggggcugcagcuuuggcuggugcugugcaggugcuuuauugggaggaaaagauggcuagaugggacagcugcuguggggaccuuugugacagugaucaaagcagauaacuuugaaaacuuaaguugccucuagaaaugauuaacucaaucuaagagguaaggacauuagaguguggagggauuucaggaagagggaacaggccuugaaaccucuugcuaaaaaaucugucacugucaaucugauauagccuuaaugaagugugacuuuggccuagaaacagaaaauggcaacucagcuaauaaaaagguuccuuggcugggcgcgguggcucaugccuguaaucuguaaucucucagcacuucgggaggcugaggugggaggaucgcuugagcccaggaguucaagauuagccugggcaacauagugaggccccccucuauuuuuuuuuaaucuuuuuuuuuuuuuuucuuuuugagacagagucucagucuugucgaggcuggagugcaguggcacaaucucgguucacugcaaccucugccuuucaggaucaagugauucucccaccucagccucccgaguagcugagauuacaggagccugccaccacgcccagccaauuuuuauauuucuaguagaggcgggguuucgccaugaugaccaggcuggucuagaacuccuuaccucaagugauccgcccaccuuggccucccaaagugcugggauuacaggcaugagccacugcacccggccuuuuuaaaucuuuuuuuaaaaauuaaaaaauguuuuuugagggaacuuuuuuuucugaaaauuugugaguggaaauauuuguaguugucaggggcagacaugaucauggaagcaacauggguuugcagaugaacggggcugugcaggugaggcgugucaucaugaaagacggagcgggggagcauggcuaccuggauaaauagacuuagggaagaggaaacuggagaauucgaaggaaaaguugagucuugggcagagaaagaggaaaguagcauguaaauuuggcggcaaagugaauuaaagcugucagcauggaacaugggaaccacuacacggagccuuuccuuaugcugccuuguagguuucccguuuccagccaggggcugugccguuuucagaaaggcagagaguccuucggguagcuggcaaguccaaaaacagggauuuuuggcaauaacagaaaugaauagggacaaagccaaaagguuuuguucuuauccaugauuaauuuggggcuggagaauguuuuguguuuugcuuuuuuuaguccgcucuuugugacguggaagacagggcgggacaagcggcuucguggcugcauugggaccuucucagccaugaaucuucauucaggacucagggaauacacguuaaccagguaaugacaccagacauuaagaacuguagauaaauuggcuagaaucagaaauagcugccugacuuuauuucuucuaagugauguacguugagcuuucucuuuuugguaaucaggaaauguaaggggcuuaaucuggugagucaguuaucaguucaaguacagacaguuaauagcaucgaguuguuuuuaacauguuaguguugaugaacaauagauacucucugcauagcucaagauucauaaauaugugggcucuauggcaccugauauuggcuccugacuccagagcagccuuaccuauguuuucugucccccuccagugcacuuaaggacagccgauuucccccccugacccgagaggagcugccuaaacuuuucugcucugucucccuccuuacuaacuuugaggaugccagugauuaccuggacugggaggugagaacagccgcauuuggaacucugcaucucucguugcauuuggguucggguuaguacauggcaauguaucuccuucauugagagaaaggguauaagaaugugaaggcugaguuuggaaccaauugugggcaacauaggugacagaagaggugcugcuauaccaggaguaggcagaagugucaguggaaaggcucgcuucuccugauucucccuagucugcuugguuuacauccuucucccaugucuaauaagagauaaugggguaaaagaaaauauuccagauccuucuuggcaagcccuggaguaaaaguuuuuguuugcuuguuuuuuuuuuugagauggaauuucguucuuguuccccaggcuggagugcagugacgugaucucggcuuacugcaaccucugccucccgaguucaagggauucuccugccucagugucccaaguagcugggauuacaggugcccaccaccaugcccagcuauuuuuuuuuuuuuugagacagagucucgcucugucgccaggcuggagugcaguggugcaaucucagcucacugcaaccuccaccccuggguucaagugauucuucugccucagcuuccugaguagcugggacuacagucgcgugccaccacacccagcuaauuuuuguauuuuuaguagagaugggguuucaccguguuagccaggauggucucaaucucuugaccucgugauccaccugccuuggacucccaaagugcugggauuauaggcgugagccaccaugcccagccauuuguauuuuuuuaguagagacaggguuucaccauguuggccagccuggucucaaacuccugacggccuuggccucccaaauuguugggauuacaggcaugagccaccgcgccuggccaaauaaaaguuuuuauuaggaaucagaugugaaggaucaugaccccagauaaaaaccuuguggcauguuuauuuaauggaauagggucaaggaacauauucacaauuccuggaugaauuacuuaaagaaugcauuucuccuaccuucauauucucagaguuggcugcacauacucucgacccuucccuaaaagcagaacuuucuuuggccucuauaccuccugagauagaauuagucaugaaaugcgagaaggucucccuuuuccaggccuguguuaagcuggucagggaacaauguugauuuauauguggggacugaaguuccauuagaguaaguaaaugccauuuacuugguuguacuuuuuucuauagguagggguccaugggauucgaauugaauucauuaaugaaaaaggugucaaacgcacagccacauauuuaccugagguugcuaaggaacaaggugaguuggaugaaugggauuuuaaugacaaguaucauucacaguggugccaguuaaagggcaagaaagugaagugugucaucuugcagcccaacugcagcugagaaugagggccuuucugccucuuaauaccugucaaauuccuauagaaccaaggguaaacuuccaaaaagguuuaggagcugggaaaagcaaaaggguaaaucguucacuuacucgccugauauuucaaacacuucuuuucaaugaauaguuuuauuucuuagccccuuaaacuacaguggcaauuguagcaaaauaccaccaaucaaccugaccauauuguagaauucaguagguaccgaacuuuggaucacaaaucauuaaacaauauuauacauggcaaaggguguaaacauagucccuacuguuuuuuaaagaacucaguagucggccaggcgugguggcuuacuccuauaaucccagcauuuugggaggccaaggugggcggaucacaaggucaagagauugagaccauccuggccagcauggugaaaccccgucucuacuaaaaauauaaaaauuagcugggcaugguggugcaugccuguagacccagcuacucaggaggcugaggcaggagaaucacuugaacccaggaggcagagguugcagugagccaagaucgugccauuacacuccagccuggugacagagcgagccuccaucuccaaaaaaaaaaaaacucaguagccuauaaguucuucugauggggacguuaaagguaggguggaucgagcagauuuugucuuuaaaagaauaucuagaaggguaccuuuacauguugcuugugcauucugugauacguagugcaguuuuccuucuuucuuggaauuagucugauuuugaaaauaauaugugaaacacaguauuuguuggguaugagccuagaauagagaaaaaauacccggugaaguguauaucaugagcaaacauggaaaacgauugccugguugguuuuuauuuugcuugugcuuaaacuuuuucaagagcaguguauauguggcauaauagcaaaccuuuuagccaccucuuuuaggucauaaaccuaacacacucuguacaaggaggcauaccauguuuuguaauggggagguguaaauaauaacuuaaguaaauaauuaaauuacuuuugccauuugaaaguugguuggaaaaauaaaaacuucggagcaccuagcauaguaauuuaggggauuuucuuugguuuuucaauuugaugaaguugguuuuaucuguuaagaaugaggcugggcacguuugcucacaucugugaucccagcacuuugggagggcaagguagguggauacuggagcccaggaguucaagacuagucugguggcgaaaccucgucucuacaaaaaauacaaauucagcugggugugguggcacacaccugacagucaacagcuaguuggguggcugaggugggaggaucacaugagccugggagguggagguugcagugagccaauauugcgccacugcgcuucagccugggugacaggagugagaaccugucucaaaaaaaagaaugugcaagaauaacaauaguauaugcaugagcaacuugucugcccuuccugaaggaacagcuccuuccuuccuuccuuccuuuccuuccucuuccucuuccucuuccugucuuucccuuuuuauuucuuccuuaagacagggucuccuccugucacccaggcuggagugcgguggugugauccuggcucacugcagucuugaccuccugggcucagaugauucucccaccucagccuccugaguagcugggacuacaggcgcaucccacacgcucacuuaauuuuugcguucuuaguagggaugagguuuaaccauauugccuaggcuguccuugaacucaugggcucaagugauccuccugccucagccucccaaagugcugggauuacaggugugagccaccacacccagccagcuucuuucucacugucaauuuuuuaccauagaaaacaggacuccaaaaaucaucagauugaaggaagaucacacaaaggaauauaaguugcagaauuuaaauuccucucuucccacagagcagccuuggguaccagcacuaggccaauaggcuggucuaaguuggaaccauguuuguuccuagauaauuauacugggguaacaucugacaggaaggacgcaggagcagggagccuggggacagccauuauggcaugugucgggcuaucaucucaugucucagagucuccacgggacuggcagacagacugggcgccagguacgugggggucagugcccagggcuuccucugccuuagcagacucggcugcuucucgagucccauuucucuucuugcacgggccaugugagagcaugccuuacucuugcaugugcauugaccucaguguggccuuucuccuccccagacugggaucagauccagacaauagacuccuugcucaggaaagguggcuuuaaagcuccaauuaccagugaauucagaaaaacgaucaaacucaccagguaagccauugucuuguuuuccuuaucauuucaauuuaguugggguugaauggaggauaauuuugaugggauggagaagaaguguucucugugaaugucccuaaaucaaagaagugugggugaaguucacauuuugaggaagcaguggcagcaaaggcagagacucucccagcauccugugugucuccauagcugagcugggggcacaguuggagcagggcaggucugcccugcaggcuguggauggcuuugccagacccacgugguugggaggcugagggggagacugagauuaggagacaaggcucucuggaaguccagagucaguugaggugcugcuuucugacugcacauguagucagacggcaggagauacaggagaguaagaaaaugcuuuuacaaaaaguuaaaaggaaaugccucucauuuguggggaauacuucuaggaggaggcugccuaguguaguagaaugcagauggacuuggaguuggaaucccagcucaacauguacuagcugugugaccugagccaguuauucugccucucugagccuguucccugucuguaagaugugaaugauaauaccuuagaguuguuugaggcugugcuaagguaauguauggaaaauuucuagccuguggccagucaacauuguaggugaucaggagauguuaguucucuucucaucccuauugaaaucagaaacacugagagguuuagcuucuaugggcuuuugugggccucuuuugggccccucaucuguaaaaugcugaauaaucauauacuaaucucacaggucuguuuggaagaugacccaguguuuuuuaaaugcuuuggauuccaaaaauuuuuaaaaaacaacaaaaaacucuucaaauacaaagcauuauuauuauuauuauaauuuauuugaacagccauuucccugucaaaauucaggaauaaucaccuugcaguggaggagugauuacagugggaaagagauggcucuggguaaggauugucacacccagcuccuguggucuguaguaggcuccauagguuuguaacaccccaugcuucgcauccugacucauggcucuuuccagagcacagccaaagugcuaugaauucuguucugacgacccugugauauggcauauucaucuggggagugagaccuauauagccccaaggauccuuuaaccugcuucagcagacuuugacccagaauuagguaucugugucccuuuuaguuauaauaacuuguuuguugcucuuacgcgaauugagguugcauuucugucaaauguaucacauuuacucuggaaguagaugugcaguuugcacuggguuuuggugcagccaucuuccaaucugccacccgaguaauuugaccuugaaauucuucauccagaccccaguagcggauugcuuacgagcagccugaugauaagcacguguaguguuucaaggugggaugugcugaaacacauucucgggggaauugugauugugcuuuuucaucuuguucauuuguaauaacaacauuguuuucuugugcugucuuucauuuucuguaaguaagauugcucuuggucuuccauuuuauucuuucaaaauguggaauaagcuuuugguuuuucucugcugagugacuuuacaaaaugaagcguuugggguuccuaauacccuuuccuguuuccucauacagguaccgaagugagaaggugacaaucaguuacgcagaguauauugcuucccgacagcacuguuuccagaacggcacucuucaugccccgccccucuacaaucauuacuccugacacacggcugcaugaccagucccacccccccguggccaccaauggcuaugacaucauuggagcagaugccuccucuuccugguccaguuacuucuauuacugcaccauuuuaugaugcuagcuuccguugccaagucugccucccgcugacugagggaggguaggguuaccuugaacgaaacagaacuugaggggcccaagccuuaucucagccuuuccucaauaugggguuccguuggauuggggcuccuccaugacuagugggaauuacuguggguucagaagacccuugucugguauuugccacaugggguauuggccacacgcuggaagcugaaauugaugaucccugaagguugaacccacacacaccccugcagccuccccagaugaaguagguguauuccccuggcagucugggcaacggagaccaagaaacauuuuuagguuguuuuaaauuccuuuuuuuaaacuuccaguuuauugcguaccaagaguugauuacaaccuccaugcuucauaagcggacgccacguuaggguuggacgugggcaccacgaguccuuugaggcuccuggacagagacccacaucaagaucggaagcccuuuggguggcguugcagaucucauugcucaguaggccgugaagauuuucauccucaucccacucucaguuggauuuucuggcacucuuccugcauugagucuccugauuacugaacagagcuccgucauguagccugcugaggaauggaauggaauggagaugcccacaggagguccugaugucaucacugcacgcaggugugagaggagagaccucuucugcaccgccuggcuaccucacuccucugcugguagcagugccuauagcuggaccuaaguucucagaagcguagaugugcaaacaagcgauugaguugggcuuuaggaggacacaucauaggagagaauccagggucuguaagcugguuuucuuuucaggugacauccugaggggccuguaagcaggggagcuccuuuuucuaguuugccuguagaggugggaagacuguugguguuucuguccuuuacaggacauuaggaaacaguuguguaauuacacaagguggaccuuuaucuugccugacaugcugggaaucuucaccccaccagggcaaauuuccaaauagcucauuuuauucuaggucuuucaaacuuucaugugacauauuucccuuucccauuguugcugauuuccaaaucgcugucagcaauuuuuuccucucuccuugccuauucuucacucauuugguggcaaaguucauagaacuaggggacuuggaagaugcuuugaaaauauuguuacaaaggcacugcuaaaaugauucacagggagaguggccaguuggaagaaggauccuaaggaugugacacugguuuucaacaacaugcuuagagaacucaugaaguggauugggugucaacccagugaacauguuuuuauuuaauuuauuuuuugaaguuuauguggugaugguguggcuuuccgaaaugggcaaauauucagaagaucuuuugcauuuucuucugucaggaauggggaaggggagugggggcacaaucugagaaaggacaccugugcuguucuaggcaucgcuggcaaguuugugggaagggaugggcaagggugaguggguuugcuccacaccguccugugcugcucgagaggaccugggacgugcgagggaaacgugggugacggugccuaggcugcggcccuucacugcugugcuggguuccugcagccugcuacguuucccuuggcaauguaaaugaagauggaggggucguuucgugauuuccugcugcugagaauaaaugucuuguuaaaaacguggcaacgguuacucuuaggugccauggaucgaugucaggguggucagcucuggacuaagccacccaccuccaauuuguacaacaguauugauacauagggcuacacucauuacuguucaaguguucuauguuaagaguuguguuuaauuucuaaagauuaaaaaaagcaaaaaaauuggugcuaaaccuucaccccugagcacgcucagugagacuggucaugcaagcauuuacagugccaugcuccucaagccgauuuuuucuuguagaaauguugcccuauuugucuucuccaauguaugguauguuauuuuauuuuauuauuuuauuuuauuuuauuuuauuuuaucgaggggggguacgauaccugccauuuaagaaaaugaauagaaaauuuuaaaacccgagaaauggggaaaaaaaaaucagugcacaagaauugggcugguuaggcccagcaccacacugaagugggcucagugguuuuuggagugaagaagccuuacucccugcacauucccucaugcucccacacaaguccagcaauggaaaugcuuggguuccucuugcuuugucaggggacucaggagucgaccaagggaaaccauuuggccccgugaggaaugggcauugucaguauccguccugaacggggccuagucaggaagcggucuagaaguguacggucacggucgccucaugaaaguguguagcagguggcucucaggaaaaauaccaagucuggaucauccauguggcagcuuugcauagggagaggauagcuccgaacuggaacugaacugccuucucugcacgcuugaccaaagcagugaugagggcggccaguaccugcggugugcgugguagguuuaaagaaaagggaauguuuucugcugaguguuuccuuuguccuugggcugcucgagcuggacaguagguaaccacuguuuucaaggaccagcccaauuucucuggcuugguucggaguucguuucaucccuagcugugagugccuuuuggucuggaaaguuggcuugucucauaauacccacagcuaggacauucucucuguaauuaugaauuguccuuguuuuacauuaaaagagaaugucuuugaucacuagagucugucgguguuggauuauuuccacugugagauucuuaaaacuuuuuugcuucauaauaauaaaacaacucauguuagagacccuuucaacaugaaagguuuguaguugagacauuacauauauuuuauuguuuauaauaaaaaucaucuauacaaaagaaguccuggguguuaauauuuugcacaagaucuguuuuccaugauguguugacaucuacaauuucacuaacuguugacguuauuuucuauugagauucuggagccuagggagcuauguguucuuuuuguucauuucguucuuacuucccugaagcaagagacuauauggccuucagugcaaagacuucagaccaauucuuuguauuacacuugguugccucuuggcuauauaacuucugagugcaaaucauugaacacuuuaacgaaguauuguagagaauaaaucauaauggauaa

SEQ ID NO: 192744 - RNA, 44561 nt, Homo sapiens
uuuuauuaauaugcugaucuguuuuaucuucucaggccauaaagaaugcugaugggagaaccauuuuccuaauuuucaaauuguugagcuguuugccauaaugggugaguucaaacuaaaagcauuuuucagcaauaauuaaaggauagaauggaagugaaaaaacuuucucuauuauguguuauuauaaaccuuuuuauaaauaaauuuuaugauauagcagauuuaugaaauguuuuauauuuacuuaauagacuuugaauuaaaguacuuuuuguguugcuguaguuuuagaaugaucauuuuaugcguaacagcagggacauucaaaauaagcuguuaagauguguugugauuugcuuaaagucugauggcaagagagaaaucauaaaauuuaauuuuaucauucauagagcagcaaaucauuggugcucagggagaauauguuauacaacucuuggucguauauugugguauaauguuaguuuaaagacacuaaaguaugggaauggauuguguauguucaguuuacauauuuuguuuuccuguuuaccuccuuuuuguuuuuuccuuuucuccuuuguguuaaggguuccagcaugaggcagggaauuaguuagacaggaagacacuagaaggaaauggagucacgaauggcccacccuauccuaaaucaagaaaaaugguacugaguaguuggaugcuaaauuuugaaacuuagacugauccugggauuuaauucugacauuugcuugccagaguuugccuuuaucacacauuuucuacuucuugcuuaacaaaacaaauacacacacacacacacacacacacacacacacacccucaugaagaacuuauauuugcccaugugaugaaagugggggcuaggacacuuucacugugugucauuguagcaaguauguaagcuuagacuucaccucccuacuuuaaaaauuguucuuccacuuccucuucuguagucaugaguagcagugcccccuuguagcccaaauucuccacucuagucagccuuacuuucagcuccaaauuggauguacuuuuacugaacuucuuucaacuuuuuauuuugggugcugucacuuguacucuauguaucgaucaaauuuauuuuugucagccucaaauaauacugcucuauaguagggcaacauucauugcuuaaaaacauacaaaguuagucacagaacaccaugacagauguuugaauuuuugauugaggauguucuucuguaauuauuuuucaaauaucaugaauaagcauauaagguauuuaauucaacauuucugauaaaagauuuuugaaaaaauuauuuuccaaguauuuuuugguuuugugcucaauucaguguccuuccaacaugugucagaaacccauugggccgggcgugguggcucaugccuguaaucccagcacuuugggaggccgagucggguggaucacgaggucaggagauugagaccauccuggcuaacacagugaaaccccaucucuacuaaaaauacaaaaaauuagccaggcaugguggcgugcgccuguagucccagcuacucaggaggcugagccaggagaauggcgugaacccaggaggcggaucuuguagugagccgagaucacgccacugcacuccagccugggcgacagagcaagacucugucucaaaaaaaaaaaaaaaaaaaacaacaaaaaaaaacccauuguacuuacccauaaguacguaaguguacuuauggguaaauaagugcccaguaguaauucuucaagcccgccaaguaaggaacucaauuaaauugcccuuuguuuuuuaugucaccuuccuaauaugggaaguuuuguucaacuggccccaccauuuuuuacauauauaacagaaaacgguacuuauuuuuuuuuccguucucauuuuucuuaauaaauaaguaggccgggugcaguggcucacaccuguaaucccagcacuuugggaggucgaggcaggcggaucacgaggccgggagaucgagaccaaccuggcuaacucggugaaaccccaucucuacuaaaaauacaaaaaauuagccaggcgugguggggggugccuguagucccagcuacucgggaggcugaggcaggagaauggugugaacccgggaaguggagcuugcagugagccgagauggcgccacugcacuccauccugggcaauagagcgagaauccaucuccccuugcuucccccgucccccccaaaaagaaagaaguauuuauaaaugugauaauuuuagccaaaggcccucccccaaggcauuuauuuugacauuguaauauuaagcauauaaaauuguuuaaauucaaauguuuagguuucuucuaauaaaaauuagaacaacauagauagauuuaaguucccacuuugggaggccaaggugggaggaucgcuugagcccaggaguucaagaccagccugggcaacauggugagacccccaucucuacaaaaaaauaaaaaaagaauuagaguucaucuaucccuaguauagaauuaaggauuuaccuuuuuuuuuuuuuuccuuuugggaaacagauucaugcucuguugcucaggcuggagugcaguggugcaaucucagcucgcugcaaccucugccuccuggguucaagagauucuccugccuuagccucccaaguagcugggacuacaggcaccugccaccaugccuggcuaauuuuuguauuuuuaguggagacgggguuucaccauaucggccagacuugucuugaauuccugaccuuaugaucugccccccucggccucccaaaguguugggauuacaggcuugagccauugugccuggccaaggauuuaccuucuuaaagaaggucacaucaaaugcuuuuauuccaguugagaucauugugagcuuauugauggguacaucuauugugauuauauuguaccugacuguggcuugguuaccuauuuggcuaaacuaacauuaugauaaaacuuuauuuuauaaaaaauccuuggugaaggauuauaaaauuuuuucuuaaccuggaaauauuaauaaauuaauaaaccaauaaaaccauggcaaccauuacuuuuaaauuuuaauaugcaaauaauuucacuacaaaauagacuauauuaaguguuauuaaaaauuaguaaauuagagaagucagcuguuuguguguuugagagacuauuagggcuacugaauuguuggaauauuuuuagugauuucccauacaggauauggcauguuuuaauuuuuacuacuccaagaacauaaguuacugcucaccaaaaugguuacauuuuaaaauguaaaguguaaagucucuugauuccuuuauuuaucauuugugauuaucauuaguagaauugauuuacuagugaaaauaaauuaaguugucccugaugucuucuggagagcuuauaauuggcauuacuggcaggcacaugguuuuagucucagaaggaaaucuuugguauauuuauaagagucuaaaaguucauguucaugaugcuuucucucaguuuuauggacuugguacuuuuucuaaggaaaggaauuuucuuacauuguugcuggccaagaucuuuaaauagucuguuuuuagucuugucaaaccuuauggugaagaaguuugaaagagcauuuccaaauacaguaggccaguauccacaggugaagcuuuucuuuguuucugacucuuaaguauugaugaaagaauaaaaaaaccuuccaaaauuaagucuguacuuugaauauaaaugcuaaguaaugagauuuauacaaaguuguuuauuuuuuuuucccuacuuuuuaaaacauuuuagauaccuugauguuuuguuuaggagucauagaaaagaauuuguuauaacagggcaguuuugaccuuauucuaggauauuaaaucauuggaagaaucagaaugacuucaucuuguccauuagugucucauguguggacugaugcuagagauuaagucuagugcaauuuuauuuuaccaaaaguguaggcauuaaaaauguucuagaugcauuuuugcauuaauacauucucuacaucaaauuuuauuuuaaauuuuguguuugaugucuauacauguugauauauaugucacaauuacaauucuauguauguguuguuucaaaacuaccuagaugaucagcaagcuuugaacucaaucaugcaagauuuggcuguccuucauaaggccagucgaccagcauuauccuugcaggaaaccagaaaagcaaaaucuucaucaccaaaaaaacagguauuuauuuuaauaaguauuuuuuuaugaauuacuuuccuuuaauauccuaaucuuauggaggacuuguuuaauguguucagcuuuuacacuuucgaaucaagaauuuuguuaguguuuguuacacauuuucguguaagaguguguguucaucuauuaacaguagcaaagacguggaaucaacuucaguguccaucagugguagacuggauaaagaaaaugugguacauauacaccauggaauucugugcagccauaauaaauaacaaaaucauguccuuucaggaacauggauggaacuggagaccauuauccuuagcaaacuaaugcaggaacagaaaaccaaauaccacauguucucaguuauaaguggaggguaaauaaugagaacacauggagacauagaggggagcaauagacacuggggccugcgagaggguggagggcaggaggagggagaggaucaggaaaaauaacuaauggguacuaggccugauaccugagugacuaaauaaucuacaagcaacuccccgugacgugaguuuaccuguauaagaaaacugcucauguaccccugaacuuaaaaguuaaaaaaauuuuuuuuaaguuuguguucauaaagaauuguagcauucugcagccaacguugaccccuucccagaaaaaauaagguagcauuucauuuaaugugguaacuguucuccaaagcugacauuucauccauuuuucaagcacuuaagcaaauuguguuuuguuuuguucuucaaauagucuacucuggauuuuuagaaaugaggauguuuuugauucugauaaaugaaauuaguuuuggauacucagcaugacacauaaaaauauaauauucuguauuucccauaacaggaucagcaaaugucucauacuccugguaccuucacuaauagaucuugguguucuuuccuguugagcccagauucagcaacauaauucucaacuuuuuagcagacacuaucaauuguuuggagcugguacagaacuucaaaauucccuccucgucuggucuauuuuaaaugaauggcuaaaaaacaaaaucauuuagaaauuguagaaauuuuaucuaaucucugaaugaucugucuaaucucugaaagacugauuugucauuucauuacagaaugauguccgagucaaauuugaacauagaggagaaaaaagguaaggaaggaaacauuacauguuaauuaauugauuuaaucaaauguguauucuaauuaagcuuuugaaagguucuuuucagauuugaaugaaguuucaugguuuacaaauugagaauagaguaguccuugggaauguguaaugugcuuagacuuaagauagauaaaauaugucaaaauucagguuaaauauuagaaaugauuaaugucuuugcaauuuucagagauaaauaagaucacuguuuaauacagccuuuacauauuuucacuuccuuucauuuuuacuugggggaaauuaaauauauuuuuccuuauaauuguuucaucccuccagauacuauauagcauuuauauaugugagcuuaacauuuacaauucugauuauucucaagagaccucaguuuuaugacauuuacgucauuaguaauguugaggaaagugaauuggacuaguggcugcaaauuauuuagcagagauguaaaccuagucuucuacuugguaucuguaucucagugcacaaaugauagggugguaguugacaacaaaauugcuaacaagaccuaauaggaauuaaggccgauagaauuuuuuuuuuuugagauggagucuuacucugucgcccaggcuggagugcaauggcgugauuuuggcucacugcaaccuccaccucccggguucaagcaauucuccugccucagccuccugaguagcugggauugcaggcaacagccaccaugccuggcuaauuuucguauuuuuuagucgagauaggguuucaccauguuggccaggcuggucucgaacuccugaccucagaugauccacccgccccggccucccaaagugcugggauuacaggcgugacccacgcucccagccugaugauagaauuucauuucugcuauuagugucucaugaaauuaauguagugaaaagccuaacaguuuuaaggauuuuaaaguggcucacaaaucauauaagcauauucuacauagaaauauuuaaaacuggaauauaucagauaaaccauggaacuauccaaucuauuuuccuauuuaagauucuuuuuuggauauuuucccaauuuuuucauucauucagcauuauuuguugaguacuuaguauaugcuaggcccugaaggaauaaagggagcaaagcagacacagucuuuuuccuuauggggcuuauagugugguauugguggucuucaagcuuuaggugcaugcucucuaggggcagcacaggccagucuuugggaaguagaaagaaaacacuagaauuuuaaucuuguaaaaauauuuauuuuggaaguaugccuacaugauauauguacccaaaaauguugaguugauaaggauacagaaaucaaaauuugaaucccuggagaacaacuuuauucuuuuuaacaguuucauuucauucugucauacagaugucacauaguuaaguuuaaucaguuuccugaauaaacauuuugcauugcucuuuaacauucauaugguaguuucagugcaaauuaaaaacugcagaaaauuuugagaauuuccuuuuuaaaauuuguauuaggauaaaacagacuucagaguuuuugaacuuuguguugaaaaugugugccuguguuaaaaaaugugcuguuguaguguuaaguaaagugaauauuuacguaauuuuuaguuaaucuuguaucacucuaaaaggagguaacuuuugcaaguuuauuauuuaacuuugccuaagaaaauaaaaucuuaaaauuguguuuauauagaauccuucaguuccccagaccaguuaaacuggaagaucugagaucuaaagcuaaaauugccuuuggacagucuauggaucuacauuauaccaauaacgagguaaacauguacaguuuaacuuuaguagaucuuaccuucaaaaguaauguguucguuuaagagacugcuuuuaagacucguguuuuuauuuagggauugauaaauauaugguaugucagaaggauaaaacaaguaaauuuuaacugacuaaaauggauuuauuucauuguggaaaauaauagagggugcuacuaugcaaauaauugaaugaggguguauuauaggggaaaauauauguauuacuuggaauuuugcugcuuauuuaugguuuuguuuuuauucuguguacuuuauuggugaacugucuuuuccucucauacucuacacuuggcuacagaugacagagcuuugguaguuaaacaauugaguuaaaggauuauuuuaguguugguuagggcucaauuagcuuauuauguuugggaaucaguauguaugaucugaagggcuugcucuagcagugaggagcucugcguuguggagaaaccccuuuuuaauguucuguaaacuuaggauuggauucagugaucucugaaguuucuuuuaguucuugagauucuaugagauaucaggaucuugugaucuuaaaauuuauaggacaauuuaguuaauaauuggguuaguaauuaggugaauuuguuuuuuauauucagaaaguauuuauuaauuuuucaggcauaaugcuauaaguuauaaguugcagcaccucauggaguauagaccuuauagacuugugguacaagcaaaccauuaauaaaugaguuguuugaauauacgaaguucuuugaaagaaaugcauaaaguaggccagacaugguugcucacgcuuguaaucccaguacuuugggaggcagaggugggcagaucacaaggucaagagaacaagaccauucuggccaagugguaaaaccccaucucuacuaaaaauacaaaaauuagcugagcguggugacgugcaccuguaguuccagcuaccugggaggcugagguaggagaaucgcuugaacccgggaggcagagguugcaaugagcugauaccgcgucacuacacuccagccuggugacagagcgagacuccgucucaaaaaaaaaaaaaaaugcauaaaguauuguguugaagaauaacgggcagagcacaguggcucaugccuauaaucccagcacaucgggggaggccaaggcaggaggaucaccugaggccgggaguucaagacuagccuaggcaacauagccagacuccaucucuacaaaaaaguaaaauuaucugagugugauggcauacaccuguagucccagcuauucgggaggcugaggcagggggauuuaaggugggaggauagcuugagcccaggaauuugaggguacagugagcuacaguugaaccacugcacuccagccugugugacagagcugucugaacaaaaaagaauaaauuuuuaaaaaaugucuugaacuugaauuauuaucucauaggaugauuauaggggagccuagacauaucuuuuuuucuuuuuucuaaaauuguauuauggaaaacuuucaaaugccaagauacauuaagacuacaauauugucuuuaucuacagccuaguaggucuaucaagaaaaaugagguuagcaugacaugauuuguccauauuauaccuaugucaccuccuaagaauugcugguuuuuuuuuuagugacuucucccaguuugcuauguaauuuuuuucugggguuuucuugaggauugacaucaagcuaacugguuuuuguuuuuguuuuuugugugagacgagguuucacucugucacccagguuggaaugcaguggcccgaucucaccucacugcaaccuuugccucccaggacucaagcgaucuucccacgucagccuccugaguagcugggaccacaggcaggcaccacugcucccggauaauuuuuguauuuuugguagaggcgggguuucaccauguugcccagacuggucucaaacuccugagcucagaugauccaccugccuuggccucccaaagugcugggauuacagguaugagccaccgcgccuggccugaucuguauuuuuaagaaccuuuucccauuuucuaaaaauuggaaaacugcuccauuuuaguuuauuuuucucaugcuuucugaaggauuucugugagugguucuaccauuauauuuugguggccucuuggcaggaaugugguagggguggcauuaggauaagauuacauuuaagauuucuugcaacccugagauucugugagugaaccguauccuguuucauaucuugacauauugucccaaaccaaaugcaugaucuuggacacuggggguacuaaagaaagucuuacuaguuuuguggacauguggucaggcaaaaaauucauuuauacugcauguuauuccacuucuauaaauauuuuucuaguguaauauuaauuccucuguucaaaaugaacuguuacucuauaaacuucuaguuggcuagaauugaaacguuaaggaaauuuaagcuggaaauauaagcugagguuguuuggauuuguuaguuuggcuucucuuuaauaagggguguguguguguguguguguguguguguuaugaggguugguuguggagguguucagggugcaugugugugugugucauggggguuggauguggagguguucaagccaaguaaggauuuucuaagaucacuuccauuuuagaugaguagagcaggaauuuuuuuuuuuuuuuuuugagacagcaucucccgcugucacccaggcuguaguacagaggcacagucauggcuuacuggagccuugaccucccuggcucaaucaauccucuccccacucagccuucuaaguagcugggacuacaggcaugcacuaccauaccuuguuaauuuuuguauuuuuucuagagaugugguuucaccauguugcccaggcuggucucaaacuccagggcucaagcgacccgcauaccucagccucccaaagugcugagauuacaggugugagccacugcguccagccuggagaaccuuuuaauggcugucuucauacuucacuauguaaauucaggaagauaauucaguucuuucagauuucaguucuguuuaaugguucucgaacucaauuuuaaguuuccuuucuagaaagcauuuauaucaacaaacaacugauuuaucaaaaauaagccagagggugauagauuucaugaaugagacugaaaugaauucaccaagccagaaaacauuaucugauuuauuuaguguaauguagauaaccugggacuuguucaugacucuuaguccucauuuuacgguuuguaauagguaaccuuagaacacaggcaggaucacauuaggucuguaggcaagugccuaagcugcugcaccaggcaccccuccaggauguucacauuuuacagcagcaaacugaagagcagcagaaucauuuauguucauauuuuuuucugucauuugacuuaguguuguuuucccccaaaaguagcaguaucuuggagaaguaaacaauccaguuauaaaugaauaauaaaaguaaguauucagauuuuccccucaaaugaaaaaucggcggaacagucauuaccauugcuuuaaaauguuuuccagugcuugaaaaguaauagacuauugaagauagaagcaagauauaccaauauguuucauaauuggugggaaauagaaauguguuuaaguagaucaguagaucaggcuuguucuaugauaccaaacaguuaauaauuguauuuuauuagaaaaaaauucucauagagcgaaaagagcccaguuagucggucccuuacaguaauacaaaauuagcuacaaacagaaauugggaauauauuuuaacaacagaguaaguaaaugcaagcagauugucugauggaauucacauaaauccuucuuuauauucguguuuggcagccuuucuuauaacaaggacuuuuuuggcugggcaugguggcucacgccuguaaucccagcacuuuggaaggcccaggcgggcagauaauuugaggucaggaguuugagaccagccuggucaacauguugaaacccugucucugcuaaaaauacaaaaauuagccacgcgugguggugcaugccuguaaacccagcuacuggggaggcugaggcaggagaaucacuugaaaccaggaggcagauugcagugagcugagauugccacuguacuccagccugaaugacagugagacuccauuucaaaacaaaaaaucaaaaaccccaaggacuuuuuucacaaagaagucugcagaaugaacauacaccaugccagcuaguggguuuggguucagauugagcuuuuaacacugugagauuuauuagacagcauuuaccagguugucugcucuuugcucauugcugguguaggggguccuugucuucaaagaauuuauacuguagagaccccaaauuaauucagccuugcauuuuaauggcucauauauugugcugaguagagcagguuaacuagugcagaauauguucacuuguuuuuauucuguuccuccuucaaugaaauggaauauacuuugaaguuauugacagagucuucuuaaguuacuaaauugacuuuuuuuuuaaaaaaaggacauauuuuuauuucuuaaauuguaugaauuacacuuuuucucauagaccucuuaggugcuuuuguccucuauaacaucugcugcaugagaagacuagugaaagcagauuccacaugcaggguuuacuauggaauaguuaacucauuagcuuauuuguuuuaggguauaguggucaggucacuaggcucagagagaagaacucuaggugggcuguagauugcagauauguuacuagugguaccccuccauggcagcuguccuccauggcaggugcucaggauguugguauguugaagagcacaccagcugagagugcaaauuugugguuacuauugaaaaaagaacugaguuucaucuauacagaagaaaaguaguaccuuuauuucauauggucuuugucuguacuucuucauucuuuuuaggggcgaacauacuauaacuuaaauuuagcaauauuauggaaauauccuagaaaauuaaucuuuaaauguuauuuucuagaagaauguaaugauuaauaaagaaaaauuuaaaaacauacauguucauucuaagauuuuaguggcgguagaaugaggagggcaaaacaauauacacauacacauucagacuuucaucauaguaacaaaucaaagagcaagguauuuugacauuuguaauuccuuaguaguggagaugcucauggaagaacuugaccuggugagauagcugcaugguuccuuauguuuguuuuuaguugguaauuccauuaacuacucaagaugacuuggacaaagcuguggaacugcuggaucguaguauucauaugaagagccucaagauauuacuuguaauaaauggaaguacacagguaugauuugggauauuuuuuucaguaagaauuauaggacuuaggcuuguaaaaguuaacauaugaaacauaauuauauucuauaaucauugcaauauuuucauuaugauuaaauguaaacuuacauccuuuaauuacuauacuuuaauauccuuacuccucaaaaaccacagucauaguuauaaauaaguauaauauguuguacauacgaagcuaauagaaacugacaacuuagaauuauguuagaauuaaaauuucaaagaguagaggauuugauuaaggcucacaaacaauauaaaauguuuuguacuugguaggggagaggauucuguuuaaagccccaaggaggaagaauagcauuaacugucuuuucuccuuuguaggcuacuaauuuagaaccauugccaucacuagaagauuuggauaauacaguauuuggagcagagaggaaaaaacggcuaucuauaauagguaagaaacuagugucugaauuaugaaaugaaugauuucucaauuucuucuccauccuuuaauguaguguggcaccuaaacauauuccugauaaauaauauuuuauuucucuacuuccuauaauuuaauuuaaauacacucuaauauuugacgucccuuggaaauucaaguuuacaggauuaguaaucuccaauuuaaauucuuuauuuauauacucaggguauuuuaauguuaacaaauucaaauaaaacuuuaaagagguuuuaggcugggcgcgguagcucaugccuguaaucccagcacuuugggaggccaaggcgggcagaucacaaggucaagagaucgagaccauccuagccaacauggugaaaccccaucucuacuaaaauuacaaaaauuagcugggcgugguggugcaugccuguagucccagcuacucaggaggcugaggcaagaggauugcuugaacccgggaggcggagguugcagugagccgagauugugccacugcacuccagccuggcgacaaagcaagacuccaucucaaaaaaaaagguuuuaauuguacaaauagaauggaggaaaaaaauuaaaagaaguaauuauaauguauuaaaauuaauagaguguaaauucacaagccuuucucuaggguuuuagugauugccaagaaugcucucaaaauaaagauacuaagaauuuuuauauuaugcuuuauuauuacuuuauuaguauucauuuucauuugccauuaauuuauuguuauaauuaagauuaugauauaaagaaauaaagaucuugcaugcuguaguuuaaggaggcuuuauucgugcaacaugaguuugacacagguacucucaacuccccauucugucuguucuucaauuuguauaaaacauugauaaucuacauuuuuauuugauaaaagcauuaacauuguuucaaaaaaccgcugguauaaauguucuuugagagagggcagugaguauggccauuaaagauggcaugaaaacauguaugaggggcggauuuaaaagagaaaaguuaaagaggaggaaaaacaaaugugguugggaaucuaaaaaagauugguaacagaagaggauuguugauaaucaaagaaaaaauugaauuggcauguggaccaucaaaaaaauagacauuauucauguucucuuuugguccccagaagaagcuauuuuaugaccauucucuucgaagugucugucuuaaauaaguccuacuuuggguuucaggaaugcagaaaugcgagcagcagaggugauacacaagcaaaauacaaauggcuugucuuuugcauucagauauauuucgauauaguuuuaaaauuuggugaaagaacauuugaaacacccaaauucaaauuccagcucucugaugaaccugagaccaguaaaugugucuucaucuuuaaaucaugggauuguuguagcauuaaauugagagaacacuuguacauuuuacuuuucaaacuagaaagcuuauuguacauuuauacauuuuguacauuguacaaagcucagauguucauuguacauuucuuucuuuauccccauuucuuaucacauuacgguacuugucauuuuuuaaaaaauugcuaauucacuuuauuuuauuuauuuuuugagacagagucucacuccgucacccaggcuggaguacaguggcgcggucucagcuaacuguaaccgcugccuccuggguucaagugauucuccugccucagccuccugaauaacugagauuacaggcgcccgccaccaugccuggcuaauuuuuauauuuuuaguagagaugggguuucagccuguuagccagauuggucucgaacuccugaccucaugugauccacccaccuuggccucccagagugcugggauuacaggcgugagccacagugcccagcucuaauucacuuuaguugcauuagacaaaacaagcuaaauguacuaguuaaauugacauuuuaaauauauuuugaauuaaaauuacacugaauaccucagucuuauucuaauaaauauucuuguuugacgucagugccagcauaagaagaaauuggaaaucauaaaguauagaauuaguggucuuuuauuggcacugcuuuaaacuuggaauggcuuugcuagauaugaccauuaucuauuuuucuuauauguuggcaguuauucuuuuuaauuguuuuuauaaaagggagauggaggaaaaacuccuuuagguuaggaguguaugcugauaaacaggucucaaccaagagugcguuggcauacgcauuacugugaaaaaggguugucaaauaaggagacaaaauuuucauagcuuuuuuuuuuuuuugguccuaucuccuuuuaguaauugacuauauugaucuuuuguaagcacggguauauggaaggaauaaaaauauuagggaccaguauuauuguggcuacaguuguuaugaagccuaaaucaauccugacucaaauugagcuccuaaucauuuuacagacaaguguagacaguacucucuuuuaugcacaugucuugguaauaauuuugcuuucuuuuuccucccugucucacuaacaaaugcuugcauauacucacaaugacuccuuuacauaaggcuaaaauguuuuuugcuuuaaauuggaccagaacuuaaaugcucacauaguuuaauuucaaaaaacuaugaggaaaggugagacacuguacuaauaaauauagcaucauuuccacagaaccaaguaaaauagaguggguuauugucucauaagaaaugugauuacuuaaauaaacugucuuaaugccagaaaucuauauuguauuaucauccuaucagcagucagaauaccauccuaccuagugaguauaaaugaauauuauggugagguuaauaauuaugauagggugggaauuuacaaagguuauaaagccauuugaagauuuacaaaugaauguucugauaaguuuuaauaaaaauugaauuuucuuuugcugaaauuauuaaugauauaauucagaaauauagccuauuuaaaacaaaacuugauucccuugccuauaauuauaaauuacauuauuuuucuuccuugagguccuacuaguagagauagaaguucuccucccccagguuacauuccagaugaauuacaccagguugcccggaaugggucauucacuaguaucaacagugaaggagaguucauuccagagagcauggaccaaguaagcaaaaguuugauuuuuuaaauuuaauuuaaagagauguugucagggucagugugauuuggcacguaacuggguguguguguguauuaucucuucucuaauuacauaucuucuuaacugaacaaaauagaaaaaauauaggaaaaugcccauuaauuuacaugugccuguauaaagaaagcuggaauacagcugguuuuauauugcucaauaagugaaugaaugagagugagugaaugauaaugcauuugcuuuguaauuuaacagccagauuuuuuuuuuaaacauuugaaagauagaaugaaacuacaaauauuuaccuuugugaaacugagguuugugaacuuucugaaacauuuaaaaaauacuucaauuuuauaguauuaaaauguuuucauggaguugcuguuauucccuuaacauugcauugcaucgcauuauauguucacacuauuauaguaguuuacauuuucuaauaauguaauagucauagugucauuagucucaguuuggguggggccauuguucaguuuucaguaagcaaaauagugugaaauauuguagcuuuuaauuauuuagucaauagucuauagagaaagaauauuuuucucuuaggaaauuuugaagucguggcuugcuuacaagggacauuugaaaaugaguaacucuggagagugaccacuauugaguauggaauuguucuaaaauugugagugaggguugcacaacucucaguauucuaaaagccuugacuuguauacuuuaaaugggugaauuuuauguuacaugaaguaugucuaauuaaggcagguuuuuuuaauaagcaacuuuugguuauaucaaauugaaucaugguggaacuccuuuuuuuccuagaugcuggauccauuaucuuuaagcagcccugaaaauucuggcucaggaaguuguccaucacuugauaguccuuuggauggguaauguuuaucguaguuuuuggaggguuuauuuguuuauuugagacagaguuuugcugucacccaggcuggagcgcaguggcgugaaugcggcuuacugcagccuugaccuccuuggcuccaucaguccucccaccucugacccccgaggaacuaggaccaaaggcauuugcuauuaauaccacaucuggcuauuuuguuuguauuauuuguagagaugggggucucacuuuguuacccaggcugaucuugaacuccugggcucaagcgaaccuccugccuuggucuccuaaagcgcugggauuacacacaugagccaccaugcucagcuuacuguaguuuucuuuuuuaauagauaugaguaaauauucauacagauagaauguugaauuaucaguaacuuuuuugugcuacauucagaggaauagaauugguacuuguguaugaugacggcagaugaauuuuugcacaguguggauaaaucccuuuaccucaugggacucaguaucuuuguuaguuaaaaggaaaucugauuauaauaguuugaguauuccugcuugucaaaauuguguguuugaaggcaaaucaaauuuagaauuuauguacauuuacuuuuaaaacuguguuuaugaaaagugcuaucaacuuuuacauuaauauguuugguuuuggaaauuuccugaguuauuucaccuguucaggauuauguucauucuggcaccagauuagaaauaauuuaaauucuuggaaauuguagcccacugugucacauugguacauguaggcaaaaauuuaaguacuuuugugaaaaagcuguucaggaauaugagcaggauaaaguugcaaaaugugaauuuuuuguuacacgugcucccccuccuggucucaauaggacaguauucuugguaauccucucuggaauugcuuuaugaaagcaaauucugaaaaaaauaacuaauauugcgugggaaugcacauuuaaguuucuuuuauccauguauaugaaauuucugucugugucaaugucuaucuuaagguagacauuuaagaaauucagggaaguaguaacgagaaagcuauauauuugaguacuuaccauuugcaaaacacuauccuggauaccuuacuuauguacacuugaauaguuggaaauuaucuuuuuuguugaugcagaagggugauuugccaagguuacauaguuaaguggcagagcuuggauugaaacacagugcuuagaaacaccuaaugauuccaaaauacgucauucuuccacuguacuguaagguuaauuuuaagucaugcucuuugccuacauguaccaaguaaguguaguuuuucuuuuuuagguaugcuaaccuuucaaagugagcuccuuuacacaaacacauacagagaggcacagauagauauagauauugcucaaagauuuucuuuuuaaugucuuacguucuuucuguaaacuuaaugugauguuuuuucuuuauagagagagcuauccaaaaucacgaaugccuagggcucagagcuacccagauaaucaucaggaauuuucagguuagacuuuauaaauucuaaauguuuaaauguuuaugucauuggauaauguuuuggcugggagggagaggggggauuuuugaaaagucaaauaaagauuuauaaaugugcuuuucaucauuagaaauauuuaacuuuuuuuuuuaaauaaaagauaaccaucuuauaugucuuaacagacuaugauaacccuaucuuugagaaauuuggaaaaggaggaacauauccaagaagguaucauguuucauaucaucaucaagaguauaaugaugguaaguuucuagcaauuagaccacaagaauaguuaaaaaaucucaacaacaaaaauaaauacaaaaauuuuuuaaaaccucauauuuguguuaauaccauuagaaaaauaugaggaauuguguuauaacaaaaguauaaugggcauuuuggcuuuaugacaacuuauaagacuugguuaucccuuaaaagaaaaugaauaauuuuuuguuuuaagagacaagguuuuguugcccaggcgggagugcuguggcaugaucuuagcucacuguaacuuuaaauuccugggcucaagugaucuuccugccuuggcuuccugaguucaggugugugccauuacaggcauuugccaucacacccagcuaauuaaaaaauuuuuuuuguagagacagugucccaccauguugcccaggcuggucuugaagucuugggcucaagcgguccuccugccucagccucccaaagugcugggauuacaggugugagccacugcacuuggccaagaaggaguaauuuucuuucuuucuuuuuuuuuuuuccccugagacagagucucacucuguucugucacccaggcuggagugcaguggcaugaucucugcucacugcacccuccaccuccuggguucaagcgauucucaccuggcuaauuuuuguauuuuuaguagagaugggguuuugccauguuggccaggcuggucucaaaacuccugaucuccagugauccacuugccuuggccucccaaagugcuaggauuacaggcgugagccaccgugcccggccuaauuuuuguauuuuuaguagagaugggguuuugccauguugcccaggcuggucucgaacuccugggcucaagugaucugccugccuuggccucccaaagugcugggauuacaggcaugagccacugcacccauccaaaaggaguaacuuuuaaaugauauuagaaaauuacucuuugaugaugagauugauacuuacaucaucccuuuaagaaaaaaaauuacuggccaggugcgguggcucaugccuguaaucccagcacuuugggaggccgaggcggguggaucaccugaggucaggaguaugagaccagccuggccaacgugaugaaaccccgucucuacuaaaaauacaaaaaauuagcugggcaugguggugggcgccuguaaucccagcuacuugggaggcugagacaggagaaucgcuugaacccuggaggcggagguugcagugagccgagauuguaccacugcacuccagccugggcaacaagagugaaacuccaucucaaaaagaaaagaaaaaaauuacuaccugugaacuucugcaucuuuguuuuagauuuuaaaaucauuauuggaaaugagaguaaauuuuuuuccuccuuuuuauccagaagugaggagguuccuuuuuaagauguguguguguauguuucugugugcacacucauacauguuuuaucauaagagauuauuugaauuuguauucagauccuguuuauuuuuucccacccaaucauuccuauuugaguuucuuagccuagucacaggacaaauuucuauucucuacauuacaaauuuuaaauacuuuaaaaguauaacauauuaauaaaagguauaaggucauucucuuuucauuuuuuaggucguaaaacuuuuccaagagcuagaaggacccaggggaccagcuuacggucuccugugaguuucaguccuacugaucauuccuuaagcacuaguaguggaagcaguaucuuuaccccagaguaugaugauagucgaauaagaagaaggggaagugacauagacaauccuacuuugaccguaauggacaucagcccacccagccguuguaaguaauagaacuugguauagugaaauguagagcagaaucuuugcagaauuuuauauuauuaaaaggaauaaauacuaagugaguuuuuggggucagaugaacuacucaaaaaagguaauaaugguguuucuaaaggugguuggaaugucagguauaagcaugguaucacugcuaauuacuuuagauaauucuguucuucacuuguauuaggaaaauuauuaccaacuagucauucuuuauccaugcauuccacauauccuuguugaaugccuaccacugagauuucaaacauaaucuccaagacauaaucuaaugggauagaugauacauggagaaauaauuauuguauagcauuuaaaugugaguagaaaucaccagcugaggagauaaugugcaagaggccauaacaucaucuaaaaauggggaauaguucaauuuuuggcugaugugggaguaucuuacuugaaauagugggaauaggccuacagugguaacucaggcuggauugcaaagcauucagaccuuacuguguaagcagugcauacaaagauucauguucaaagauguuuauugcagcacuauuugcauacucugaauuccuuuuugugugcuagugugucauaguuuacuuuuauauccauauugaccccaugcuauauugcuguuauuuuugcuuuagacagcuaucuuuugaagugauuaaaaauaagagaaaaaugucuuuuauauauaucuucagucuauucauuuuuauagaucuuuguauauauccaaaaucuguauaaacaaagacagauccaagaucuauuggguaucaaauuccuucugccugaaaaacugcauuuuaaccuuucuuguaauauaggcaugcugguacugaguucauucugcuuuuguuuguuugaaaaaagucuauuucuccuucauuuuugaaacaggaucucacucugucacucaggcuguggugcaaucucaacucauugcaaccucugccuucugggcucaagcaauccucccacuucaaacucccaaguaucuggcacuacaggcaugcaccaccaugcccagauaauuuuuguauuuuuuguagagaguggguuuugcuguguugcccaggcuggucuugaacucuugggcuuaagcugauucaccugccucaaccucccaaagugcugggauuacaggugugagccacugcaccuggccuuucuagcacuuuaaagcuauugucccauugucuucuggcuuauauacuuccugaagagaaaucugcuauaauucuuaucuuuguuccuccauauguaauaugcuuucuucccccacagcugccccagcugcuuucaagauuuugucuuugauuuucuacagugugaauaugacgugucuagguauauuuguguaggguucccagcugguguucuuucaguuuauuauauuuauaguuugucugugaaaaguucucaguuguuaccucuccaaguauuuuuucugucucauucuuccuuuuucuuuugggauuccuauuaccuauacacuagacuauuugauacugucucauaccucuguugucucucucucucccucccucucccuuucucccugucucccucucucccccaccauugaucuauuuucagguucacugauucuuuccucagccuuguugcaucuauuuaugauccuguugaaggaauucuuaacuucugucauuguuuuucauuucaugcauuuucaugugacucauuccuguaguuuccaucgcucuguucaccaucuguucaugcauguugucuaccuuuuccauuagaaccuuuaacauguuagucauaguuauuuuaaauuucccuucugaaccuccugagucugguuguauuaauugcuuucucuuuugauuuuuuuuggaaggguugcuuuuuugugucuuaucauuuuacauugaaugccagauaucauguauaggauaagggaggagguaaauagaauguaugccuggaaauaggcacagcucuucuucugcuaggccguuacugugaggagcuaagucaaucagucuaguuaggaguugagcuggguuuggauuuuguuguugucauggucucugugcaccacugacuuuaaauucuucuaauuaccuugugcugguuuccuaaagggauuuucucaaugguccugcuccaucagcuuuuuuuuuuuuuuuuaauuugagauggaguuucacucuuguugcccagguuggagugcaguggcgcgaucucagcucaccgcaaccuccccuucccggguucaagcgauucucccgcaucagccucccgaguagcugggauugcgggcaucugccaccacaccuggcuauuuuucuuuuucuuuuuuuuuuuuuuuuuuuuuuuuuuuuguauuuuuaguagagaugggguuucaccacauuggccaggcuggucuugaacuccugaccucaggugaucuguccgccucggccucccaaagugcugggauuacaggugagccacugcgcccagccuuggccuuucuuuugugccuacuucucagagagggaggaucucuccauggccuugucaugcucucaguaaguggauugcuguuacuugccagccuaggagaggggaggcagacuagaggguucuguguuguccuauccagcuucagucuuaggcaggcuuuaucuccucaguucucagagaugggcuugcccaccuuccgggaguaggagugcucuaaugaucagggucacagaagguuuccagccucagccucucucucagggguaggguuuuuuuuuuuuuuuuuuucuuuugcauuccccuagccucagugggucuuuaacuguaaugcaggggugacaggguuugcugcuuucuccagcggcugaaggcucucguuucuuaggggaaaaggguuuggaaggacuuucugcguuucccacaacagugggccauuccccuuuuccaggccuugaccaccaagggaggcuuucccuggugucuccugcuccuaugagugcaugguagagguccacagaaaagacuuagagcaggugugagcucaccugugucuagaucucccaaggguucaauacucucaugccagcccacauuuguuuaaaauggaggugaauucuuccuugcuugugugggucuuugucugugcuuugccacaagugagccagugcuucuguucugucucuccuuggagguaccacuuuuuccuuagauuucagguuaguugguugcccugcaaucuuaguuuuuugauauguguucaacaaaaguuaaauuuuguagauuacccagauuucucuuguuguuuggaugggaaugauacucuuuccagcuuucuacauuguagguggaggcugaaaaacuaaguacaaauauuacugcagugaagaauagaaauggugcaucuuacagucuuuggaauguuagauugagugaaagaaagaugcugucacauguguaauuaggaaaacaauuucagaaaaaaaugagucuugggauaugaaucucuuuuugauuuaggauuuguagaaaauugacgaaagagaaaaauuugaaagacgguaacugugaauuuggauaaucauaauuuuuccuuauauccaaguacauucaaugaaggaugucacuaaugcaguaugcucauuuaguuauuaaccauuuauuugugugcuguuugauauuucacuuuaagaaaguguucuuuuucagcaccucgagcuccgaccaacuggagauugggcaaacugcuuggccaaggagccuuuggaagggucuaccucuguuaugauguugauacaggaagagaauuggcuguuaagcaaguucaauuugaccccgauaguccugagaccagcaagguaaaaaucacugcacaaauuacuuugucacauuauaagaaacuuuauucauuauuauuuuuuaacauuaagccccuuccauucuaaauaagaagcauuuuuuuucaaaaaaaaaaaaaagcaguuuucuuuaguauaaauuauuuguaaaacagauuagauauguuugucuauuuuuuaauauggauuuuucuuuuuuaguacuucaguuauaauccuaaucugagucaguguugcuuuagcauaucaucaaggacuguuuaaaaaguuauugguuagagacuuucagauguuuauuacuugggaacuaaaauuuucagaaugaaaucaccuugaugguccaugaaguuagaauuuuuugcuuuuacugacauuguugaagacuuaacaaugaauucucucuuucaggaaguaaaugcacuugagugugaaauucaguugcugaaaaacuugcuacaugagcgaauuguucaguauuauggcuguuugagggauccccaggaaaaaacacuuuccauauuuauggaauauaugccagggguaaguuaguacaucuuuuugaaaauacacauucuauuuaaaauuuuaguuaauaaaagaaaaacaacaaaaacguagauuauaaaauguuaacccuaguuaaggacauuuuggaagaguuuuaaauuagagcugaguaguauuuucuauccucuuccucugucuuuguauuuuuuaacucauuaaugauaaaaguauucucaaguagguuacagacaucuuagcagcccaucuucagauuuccuuaaaugcccuaaaaugcccuuuauagcugauauauucacaccaaguuccagucuauacauacauuuaauuguuaugccccuuaauuaucucucucuucuuaaacaauuuuuuauaauucuuaaaaagaaguagagacaaggucucacucuguuaccuaggcugguuucaaacuccugagcccaagugauucuucugccuuagccucccaaagugcuaggauuacuaucuagagcagucaauuuguacaugauauagauuugacaaagagaagaggauagccuguuaagagucuucacucucaggaucuggaagaauuugaaaaaaaaaaaaaaaaauucucauggauuucucuaguagcauucuuguggauuuuguuuuuuuguuuuaaauuuuuuauaauuuuaguuauauggaaugcuuuacaaauuugcgugucauccuugcacaggggccgugcuaaucuucucuguaucguucuaauuuuaguauaugugcugccgaaaugagcaugcggauuuuaauuuguuucuuuaucccuuuuuuacuauaaacuccaaguuagaucugaggucuaaauuagauucacauucagccuuuuuuaucugauacgucauagaugaagcuguguacuuuauguugcauccuaucaggagccaauuucugguuauuccacuguagcaaugcaaagagcuaccauuagaugaggaugauugacauauugaguccugcauuguaaaguuuuguuuuuuccugcacaccagaaaguaauaugagguauagcaguggcacauaggaauagccuguuccuuuucagccauccaccuaauguuuuuagcacugauugauagucaucacuagagucuauaauuucauuaggaguuauaaaaugugauuugugacaucugucauuauauagaguacaucuaguauuaaugauuuucaagguggugauuaauauguuuacuuauuuaaaaauacaugcauuuccauaauuuuuauuuguuuaauuuugagauggaguuucgcucuuguugcccaggcugagcaauggcacgaucucagcucacugcaaccuccgucuccuggguucaagcaauucuccugccucagccucccguguagcugggauuacaggugcaugccaccacacccagcuaauucuuguauuuuuaguagagacgagguuucaccauguuggccaggcuggucucaaacuccugaccucaggugaucccgccugccucgaccucccaaugucgugggauugcaggcaugagccauugcuccuggcuacaauuuuuauuuuuugagaaggagucuuguuuuguugccuagacuggagugcaguggugcgaucucggcucacugcaacuuccaccuccugaauuaaaucaauucuccugccucagccuccugaguagcuagguuacaggcaccugccaccaugcccagcuaauuuuuuauauuuuuaguagagacgggguuggcuaggcuggucucgaacuccugaccucaggugaucugcccgccucagccucccaaagugaugguauuacaagcgugagccaccacgcccagccgaugccuggcuaauucuuguauuuuuaguagagaugggguuucacccuguuggccaggcuggucuugaacuccugaccucaggugaucugccuuccucacucagccucccaaagugcugggauuacaggugugagccacugugccuggccuauucuguauaauacuacaaguagagacacaguagacugaacaaacaagccgugcugaacuguaggugugaguaguugacuggccacacuugccgcuuuccauauguguguuugcaaauuuggguccacagaauugcaaaaugcucucccuccaaggauggcucauaaacaguggaaaggacaaaugguuaaaucuguaaaauccaaggauuuacuuucauaugacagaguacaccguuuaccaaaauucaaggaaaagcagaaacauuuggauguauuuuccugucaaaaaagagauuugucccucaggaagcauuuuauuucugucuuuuaaagggauuauuaaucaaacuuauacauuggaaucacuagggaaguuuucaaaauucaaauaccuauuccucacuucagacugauucagcuuucucagagauggcaccuuauccugcccuaaaaaacacuuaagaaaaucuauucuccuuuuguguauguucucauguuucgaacuugaguguugaguauauaaagaaaaaaacuuuaaaaucucuguguucuuucuaguuacacccauuccuuuuucugagaaaaucagcagaugucaauaaaauacuuuaaaaacagaauaagaacaaaauaaguaaaauucaaguaggacaugcuuagacgagugagaugagaauuccugcccucuuuacugauaaagauuuaauagcaguuuucauuucaaaccauauacaguaguuuuuauuuuuguuuucuuuucuccuaggguucaauuaaggaccaauuaaaagcauauggcgcucuuacugagaaugugacuaggaaauacacccgucagauucuggaggguguccauuauuugcacaguaauaugauuguccauagagauaucaaagguaaguaaugagguauuuucuauuuuaaguacacaguucuuagugaaugugaaugaaacaagugauguggguaagacauuuaacauuaauucaucugucucugaaauacuacagggaaacaguucucuugcuuucuuauggacucugucaguguucuaucacaccaguccugucuccacaaauggguagcucuacugugggggcucacagaaccaguaaaguuuaagagaccauacaagugagaucauguuuucauacauauugcauagguauuaggauagauuggcuaagaguaggaucccugcugccagauggccugauucaaauuugggcuuuuauccacaccguguggccuuggacaaguuacucagucucucaguuccucauucuuaaaugauggagauaauaguauccagcucauaggauucuuguaaggaguaaaugaguuaaugcaugcaauaugcuuuaauuuaaacucggaggaaugggugucacuaccgagggaaagaaugaagagaagcgaagaaaagagccccaaacugagcuuugaugaaccccaacuaugucaaacugacuuuaaaacucaaaaacucagcuguuugcagggauaaaggauguagguaaaugcauaaagucacacaaaagcaagugguggggauaggugcaauuuaagaaugcuucaaaaucuauacuacaaaacauaccuggagguuuaguccuguaaagguagguuguggccccaaauuuagacaucacuuuauaaaucaaucaauaaaaauaaugaauagcagcaugauggugcaugacuguagucccagcuaccugggaggcugaggcaggaggaucgcuugaacccaggaguucaaguccagccuggguaauguagcgagaccccaucuguuaauaaauaaacagucaugugccacauaaugaugauuccacgucauuauggaccacauuuacaacaguggcuauacuauauagacuagguguguaguaggcuauaccauuuagguuuguguaaauacacucuaugauguuugcauaaugacaaaauugccuaaaaaugcauuuuucagaaugcaucuccaucauuaagcaauguauuacuguaaauguguauguguacacguuuguauuugcauguauaaagauauuacucauuggucuugcuggggacucuuacgagcucccaggcuuucacuuccccuuugagguguggcacguccuaauuauggccauauucagaccaacaagaacauuccuaaccaguuccuggugauagaguagaaugcagaaugccuaagccagaucaccuguacuagagugggacuuagaguaagucugaaaagauggggacauugcucaugaucuacgcaucuuaggcagaccucccuuguuaaguacgaaaccugauagcuugaagaaccucauagagaaguuauucaguuaggaauaauguccauucaagccagcuucucguuagcccucauaaugaggcaaggcaaaggaacugagggagcuacccgccgaguggaucuucuucaaacuuugccagaagugaugagccauccuggucaaaagagaaggcuggaaguaagcugauuuuaaagcauagggcaaauauauugauaagagaauaaauguaaaauauaaaauuggaugugcaauaugaucuuaaguuuguaaaauucaaguaugaccuagaaggaaaauuuccauaugauugauggugguuaucaucaaguggcaggaugagugauggucguuuuuauuuuuuuuuuuuuuaagagagauucacucuuguugcccagggcuggagugcaauggggagaucucggcucaccacaaccuccgcccccacccuggguucaagugauucuccugccucaucuucccuaggagcugggacuaccagcaugugccaucacacccggcuaauuuuguauuuuuaguagagacgggguuucuccauguuggucaggcuggucucgaacucgcaaccucaggugauccaccugccucggccucucaaagcgcugggauuacaggcgugagcuaccgugcccggccuuuguuuguuuuuuuauuuugagucagggucacccucugucacccaggcuagaguacaguggugcugucauggcucacugaagccucaaccucuugagcucaagcaguccuuucaccucagccuccugaguagcugagacuacaggcacacaccaccaugcccaguuaauuaaauuuuuuuuuguagagauaggguauugcuauguugccaagcuccuauauacuuuuucuguauuucucaaauuuccaugagcaacuuuuaaaucguaagagaaaaggaagauaguugauugguuuucaauuuagacccgugaagucauaaugaaaccuaggaugaaaauuaauugauuauauugcuagggaaccaacucauuauuucaagaacuaguugcucuucugccuuuguuuuuguuccguuuguuuuacaaacuagaccacugaagaugaaauuaauggaugaaaggaaacuuaucuucauagaaguauuuuggcuaacaagcggagaaagaauaaugaacagauauugcauuaaacauuaauagcugcugauaucacuuaaauagagacugucuagaauacagcaucaucuaucuaguuuuguuccucagucccccagaaauugaaccugaaucugaucacgccuccaaauucgguuacagaauuauguaauauacauauaggacagaugagcauguuaaaaugauucuuugggacgcagucagcaaaaucuagaccaugagaaagcuauaggcaaacaacuuaguuucuucauaaguugcaaagaaaaaagaaaaggagauuggagggaacuuuaggaaagacuuagaagauuuaucagugacucccaauguauggacuucauuuggauucuaguuuuuuuuaauguaacaaauugaacaccgacuauauauuugauaauauuaacaauuuauuguucauccucuugggugugauaagaguccuuaucuuugaaagauauguacugaaccauuuguugaucaugacaucuugaauuugcuucaaauccuagagaggggagggggagugguuggcaguauggcuggggcaggauuguccagauggauguugaggcugggugauggcugcgcaugcugcucuaccuuuguguaugucugaaaagucuccuuaauaacuuauuuuuaacauguccaaaauaaguuuuuagaaacuucuguuggagccuggcuacccguuuucuccuccgcccuucuuguggauaagcauugguucaauauuggugauuccgccccagagacagcuuccccugucugugaccugccuuggacuguuccuuccccuaucagagcccugcuuguagccaguaaaaaaugggcuuuguuguccuuccacugguuaaguauucuagagacgguggcuuuuuugacauuccuucuuaaaguacuggaugguaggaaauguuagacagugcucuuucagaagaucacuaaugucauggcauguuuacacuuaaggugugcagagaauggacccuggacucuccucuggagagaggcuuuagggaaccaucauugacuagacuggggaauuugcugguagaacagaaagacagguacagaagccccgugauagggguggggucucuuuauccucuccagucuguaagguagcuuuucuccacuauucagucuccuucuuagagaccguuuuuuaagaaaaggguaagagaaccaagaaaaugaaucuuuguaauauaaaauaugguuaagguuauggaagaguuaaaaauaagaauugaaguaaaauuuuaaaauuagauaauaaaauaaauggcuuauuuaagaauagguaaagaaaaaguuaaaaaugagaagguccaaaguaaugagggcuauguggaaaaaaaugagaagagaaaugauuuauaaaagacggaaacuagauuuauaaucccagaaaaaauagaguuuuuaaaaugauaagagugaaaauagagaauaaaaaacaagugagccuagugcccaagcuugguuuuuuguuuuuguuuuuuugagacagggucucacuuuaucacccaggcgggagugcaguggcaugaucucaguucaccgcagccuuggcccucugggcuuaagcgauccuucagccucagcccccaaguagcugggacugcaggcacaugcuaccaugcccagcuaauuuuuuuguauuuuuuuguagagauggugucucaccacguugccuaggcuggccuugaauuccugagcucaagcgauccacccaccuuugccucccaaagugcuaggaguacaggugugugccacugcaccuggccaauaucuuguuuuuuuaauaccauucuccacuaaaaggaaccaggccuccuugagaaauggcugauucuagcacuggugcaggaaauauacaagaugagccuggagcaucuucaaaugccagaaagcaagaaagugcuccaaaacaaaagccaaggauacaaugauggggguauggcaaagggacacagagucaguggaaagaacuccaguggcugaaacugauaaauagcaggcaaauaaaguaguacuggauuauaacccaguguauaaaacaaauauccauguucauagugaugcaaaugaaugauuuaauaaauaugugggagaggggagacaaaucucuucugcagcauaacuccaaauaauuuauguagcuacucagccuggagcauaacucuuuacuccuuaauugugggcugugcguggcgaauuucuuccaaaguacggaaagggugggggagaaugacuuuacaguggagaaccugacaaacacuaucuuaagccaggugaucaaggucagcaucaacaaugauguugacacuaugugccuuuaauaucguaugaugagaauggcaguuuagcugcggucuuccuccaaaaaacuuacaacccccguuaugagaacaugagacaaauccuaauugaggggcauucuacaaaaaccugaccccaguacuccucagaaaugucauggucaucaaaaacaaggaaaauuugagaaaguaucccaccuaagaggagccucaggggacacgaugacuaaauauggugugggauccugguuaggauccuggauccagaaaaaugauauuagggaaaaacugaggaaaucuaagcaaaguaugaacuugguuaauaauauuucaguauugguuuauuaauuguggcaaauguaccauacuaagauauuaguaauagagaagcuggguguggggguauaugggaacucucuauacugucuuugcaauaauucuguaaaucugaagcuaucuaaaaaguuuauuauaaaagcuaaugaaauuuuaaaugaaaagcucaaagccugccuaugagacauuuaaaauauuagaaauugggaaguaaaauuaauauaaagcaagauucaauauuaagaaaacucuaaaauguaagguaacuaaauuuaaguaauagagggggaaaaugcuuuuguucugaaggucccuaaggaaguuucugagaaaaggcugacuucucagggaaauaagcuucauccaugggcuucuugcuuuaugauagagaaacugggggcuuucuugguccuucacugagcuucauucuuagcccuuuuccccuuucuccuccucuucacccccaccuccaaccugcaccaguccuuuucaauagaaacguccuagguccuaaacacacagcugaccuaaaaauguaguguucuugcagcaaauccuuaaugagcaccaccugugugacuagcauuaugccagcuacugccagaggaugaaaagcagccuaacuuuggggacaaaucaaagagucuaugaaguaauucucugccauuguucuuuuaugcuauauucgagacugccaauaaaauuaaugaaaugaggcaaugucuuauuuuuaggcgcaaauauccugcgagauucaacaggcaacgucaaacuaggagauuuuggggccagcaaacggcuucagaccaucugucucucagggacaggaaugaagucugucacgggcacaccauacuggaugagcccugaagucaucaguggagaaggcuauggaagaaaagcagacaucugguagguuuugauacgaaguuugcuugaaaaccaccugccgccuauguauuuccaccugggauugaauuacugaggcagauguaaauaaucuuuuguacuuccaaaauaggacguaagaauugcgaagauuaacacuauauuaauugugccuuauugaggcuuauaauugacuaaauaguuagaauccuugaaccuguccuccauucuuuaggaaggauuuugucgugagcaaaccucagcauuaaaaagcuuuuugcuauuacagaaguaaauaaauaguuacuuuguuugucuaaagaccuuuaaaaguacuucaucuuuguugucagugucuuauaauucauuuaaucuuuaauucuuuuauaauuuuaaguuagaacaugaaauggccauuuucuacuucccacccagaaaagacuuuaauagacauucauuuuaggcaccugaaggcaauugauuucuaaugcuuauauucuuuguaagauaaagacaaaaauuauuuuuaaaaucagguuagaaauuauauaaaacaaaaauaauaagaugaauaauguucuuugcccaaccguuugaauuaagugauagucauuaaauuuauuuuaauugauuuuuauguuuaaauuaguuuuacgaaauuagaacuuuuuaaugaaacuuugaacuugaaauuaagucauauuuaaauauauauggacuuaaugccuguuucucauuuucuagcuaacuagcuuucuuucauguuguuguuuguguaauguauuucuuuuuguuucuuuucaggaguguugcauguacugugguagaaaugcuaacugaaaagccgccuugggcugaauuugaagcaauggcugccaucuuuaaaaucgccacucagccaacaaacccaaagcugccaccucaugucucagacuauacucgagauuuccucaaacggauuuuuguagaggccaaacugagaccuucagcugaugaacucuuaaggcacauguuugugcauuaucacuagcagccaguaaccucuccugugccucuaccuagcucccaucuauucauucaccuucucucugacugcacuuuucuuuuuuauaaaaaaagagagaugggggagaaaaaagacaagagggaaaguauuucucuugauucuugguuaaauuuguuuaauaauaauaauauccuaaauuuuuuauauuuaaucuuuuuuucccuuacaagaacuugaaguuuuuuuuuuuaauuuuuauaauguacugaugugguucagagagauaaagcacuuuaguacauagucacucuuuuuaguacaaacaaaucauuuggaauaccuaaagauuguagagucauucccucuaucacugacacaucagugacgaugggaagacauggaaaacaaggagaagaaaaugauguauaauuuguaguuuuuagugauaguauuuaaaauauauccucauuugugggguugagcccuaaacuuuaguuuaggguagguacucaacuuaaagaauauagguuucuucuuauaucuguauucuuuagauccuaaccucugucuaccaaccuuuuugcucaguaggagucuugauagaagauaugaaucucugagagguauguuuauuuguuaauccuaaccaguauaauaagcaaauacacuauaauagauccacguuacuggaaucuguaaaccuugagggauagcuuucugcuuaaaaacacacacacacacacacacacacacacggaaaaccuuuauuuuaaagucaaguugugagcaaauagaaauaaaagacaaaaggacaucacucuuaucaaaugugugagcaguagaagagaccacauuuacagucaauagaaauaaugaaaaaaaauuagguguuuaguguauuuuaaacaguuuuguuuuguuuuacuugagggggacgucccaaaauuaaaggaauggagaaauaaucaaaaucauguauaccaucuucuauuuccagcuccugauuccccauagguaacaucccuuaggagcgaagaguucaauuaguaauguuuauguguuaugucaggagaugaaacccuuguucuuaggaucacagaauacuaaagcaccucaaaaaaacagguaucaugugaaacagugguugccaaaaguggagcgaggaugauuucacuaggcauuuggcaauucuuagagacauuuccgguugucacaauuggagggauacuaguaacaugaauuggguagaggccagggauguugcuaaauagauuauaauacacaaggaaagcagccucaaagaauuaccccucccaaaaugucagaagugcugaggcugagaaacccugauguaaagaucagucccaguuauaaacugaaaacagcuauuuacaaagcaguaaaugcaagaaagaaaaggaagucgcaaagagaaagugauguaaugcaaauugaggauuuuacaagaucagauacugcugcuuuaagucaagggugaauaaucucaacaaacagcaaauagcaaucacuuuaccagcugcauauugcacccacauagguaacucuucauuuuaggaacaaacugaauuugaacacugagccuuuugaacucagccaucucuauauauucuuuccuuaaaauucaugauuuugggcaaaaaaaaaaaaaaaagcauaucaaaacaaaauuuuaacuacuaaugggaagguuaaaaagcugccacguauuucuaguacaauguauccaauaagagcaaggacauuguuaaauggaacaagacagcugggaaaggccccacuaucucuaauagaauugugcuacuauaaaacaugaagauaucagcaauuuggccacuugcaguuuuuuucagcauguuaaagcaagugcuaaguacuuuauuaguacuuuauuuaguacuuuauuuuaaaggucuagaaaacaacagucuuccuggaggccccagaaucccuuucaugggauucauaagggacucagguauucuuauuuucugccaaaaggugugcuuauuuagggacucuuuuacgauacuuuguuucugaaguuagguagaucuugguuuacugugccaagguccuaccuagcauucccuguaggaauauuugaaauuccacuagcuagucuaagaagucaaagcacaaaauuaauugucaacgcuucucucauauucuuaaaauugaagcaguuugcagggaagaacaagaaugaggugucccugccuugguaaagcaacugccaaauuuuguucuagaaagaauccccaaguguguggaucuauuauaauuucuuuaucuuuuaugaaugagggcaucuuuucuacuugagcaagaucaugguccuugaccagugggcuuuuccuucauaucugucuuguguaguugugcuuuuccuuuggcucguuuuuggucugucaggguaaccagcagugcacaauaugagacaaaugcucuuuagagagaaaucuggugagacuguagaacccagagcaaaacuguuuuuuuuucagucucuguuuucuuuucuaaaugcuauagaaaauaaaggcaccugaaaagaaacuacuacuuuaacacugcuguggaaggccuuugcuuuauaagaaaaauauuauuagcuaugggaaaguaauguucuuuauguaaagacuuaaaaauagacuaauaguuuacagaguuauuauauaaaauacgaugugaauuuauuucaaacaaguugugaagguaccaaaaaccacaauaaaaguuaauauauauaaaaacuacuagaacaaaaaagcuugaagguguggggguggaggguauggaagaccaaaaguaaauuuaaaaaagaaauuuuugaaaggaaacagcuuuaucaggggaaguuaaauauaacacuccguuuuuuucuucuuucuaauaaugauauggaucaacaaaugcaauuugaacuuuuuaagauaacucuaaauguguuuuguuucuuaaaugcacaauugauucuucuauacuguaaugcuucuuugcugacgcuggaaaauggucagacugcugacuuugugccuuuaaaaugcauucugcuuugacaguggcagacuuuuuggugcuggagaagauucacuagcagucuuauaugugcuuuucaggaaauaucuuucuacuuaaggccuugagagauucaaaguggcaugacuuaggcuuggaccaaauauaagaucuuuuacauugcaaacaaaauguuguauugaauaaaaggguuaaaaaaaucauaaugacuaguggaaauuuugauggguuguuaauuauuuaaaauguauuugaaaguauacagacugaaaauuucaguaugaauaucuugaaaauuuucagcacuuuuccuuguuuacaaaacaucuuucuaacuuaaaaaaaugacuauugccuuagaaaguuuuaaaaggcacaguuacccuuacauaacauauauaaggaauuaaaauauuaaugcauuugcugaacuguaaaagaaaauuuuaaaccuugauuucagagugaauuggauuggcuuucacuugagagagucuuuaccuuauucccaaagaaacugcauuaaaaagaugaaacuauuucuuuagacuaagucucugcuacuccagcucauauauaugucagaucugcucuguaguauuucugacauggaguuguuauaagauaugugaaaucacuuagaaaauaaaaucagaugugaauaguuuagcaggaugaccaagccagaugcagacuccuuggccuauggcaaaguucugugccagugauuuuauuuggagucugggaacugauagcuugauauaaaaucaccuggugucaauuaaauauacaaaucuaucuuuuuuaauagaaugaaucuucuuuguuuguucaauaauuguaacuuauuaugucagguacuaaauuaacauccuuaaggaggucacaaucuaggaggaacaugggcaaacaguuacuuauuuuauggcauacgcuaacucugaaaguucagcaaugauguuuuaaaauguuauuuuuuauuaagggaaaagcaauuuuagguaaucauuggcuguuauaaacggaaaugucacugacaacagggauuagaguaaaaguaucuccaaacuagagggauccccuccccaaccaggucacauagcaucucucucaggacccccucuuacugcaaaacccagccucuacucaacaguucuggugauggggagcauuuauuccauaacaguguuuuuuuguucuuuuuuuuuuuuuuccccagugucucuuuuaaagaaaacauacuuuauuuuggucuaaauugugaaaauacccaaaacauuugauagaaauugaacucugucaacaguguuauuuauacuaagaucaggacaguuccuugagaucauacuguuuuauuacuaaguuuggccuuuguuuuacaaauguaauguucauauuuauuugaauuuuaagauugguuaaauguuaaugaaaagcaauccaauuguuaauuuuuaguagugccuuuucucuguaugccuuaauuuuauuuuauauuaauaauucaaguuacccaccaaaaugaagauuuuuuccaaaaucaguaggcuucacaaguucauuuggccuuagacuguguauugguccuuaaauguuucuuaaugccugccuccuccuacccuuuucuaccuccuuuuuaaaaaaauaaauaaauaaauaaauaaauguuaggagagaaacauuaggauuugucugugauagacaugcugcagcuuccacuagacaugaauucccaacacaagcauagaaagagguauucucguucuaaagagacauguaaauguuuucuggguugaauauuugauuuucaaucacauuggcacuguccaaguucuuggcauauuauaguucaguuaugauuuucaugguagaguuacaauacuuguuuuugcccuaaagaagucauucacaugguuuacaaauguuaaggcaaugagauaggacagugaguaggaaauccagggauagcagauucuaguccuuaauucucagcuaacauuuuggguaauacucacagaaaaguuacuuuucugugaagugugugcaugugugcauguaugugugcguuugcaugcaugugugugugugugugugugugguuagaguuggaggcagggaugggaaggaagaaggggaaagguaugaguguucaauuaggucaguuucugguuuuggaagaacaacucaaauguaugaccuacugaugacauacagugaguguagucauccuuggguaggaacaccaguacauuuuccagaaguagcuaguacaaaugauuguauaauaauauugauuguaaauugccauacucuugguugcuaaagguagauuaaaauucaauuuguguauauguaaaauaaucuuauauauaauucuuaaauagaaaguaauugauuuuacauaguucuuccugaacuuuuuggaacugaaauucugccaaacauuaucaaaauaagcuuccuuagcuuaccaaguauucacaaggaaauucucuuguaccucuuuuugguuggcuaggggaagcaugcugugaagcagcuauuccuacuuauaguugucuuuggcuuggcuuugacuucugccaugguuuggacaggaugccaugguaggugugggaaguaucagggccucccaucuucccauacucaccuuccagagcuguugauggaaaugagcucuugggggagccuagagauucuuuuuucagugguccuguaagcauucaagguugagcuucagaaagaugagggaggagucauagcuacaguaaagaaaagaauagauuuuaucuguugccuguauacagucucauagaauucuuauuuuucauaauugugcauuuuaauugauagucauaugguauuuuuguuaauaacagcaaaggcauuaaaucaguaccauuguuccuucugccugaugacuucuuguuuguaacacaaucuguauuaucagaaucacuuuaaaccaaagcuuuuauauucccuguacacauagccaaaauaauuagcacuguuacuucuguccacuuguaagcuaauaguauaaaaauuauaaagcagauacuaguagaauuuguauucugguauauccuucaaggaaaaggacaggugaucagugcauuuagacauccagaaguuacuuccacuauugaggaacuauguagacaugaauuuaagcuuguacaugugccaaucuuguuaaugucacuugaccacugauucacauagacagacauuaacgucugaugccucagguugauggcgaacuuucuuccuagugucuuaacauuuaugaacuuauguuugacuugaggggcauuucagcaaagcugugaggaaaaguagguucuggacugaugucugcuuugugccauagacauuuuggaacauaaggaaguaucugcuucuacuauauguacaggacuuguccccaaauaauuucugaaucccuuaaugcaguugagaaucccuuaaugcaguugagaacaguaaaguucaugaccauaccgaaaagcacuuuuaaguucacuucuuuuuaaauauuuuuuuagaauuuauuuuuuaaaagcauauguaacuagugaugauuuuagcauuagcuuuacuuggaggggagaagaaacaaaauuacaccuuaaacucuauuagauagacuacaaaauggauuugauguauucuuacuuuuccaaagaauuuuuuccaccuggaauaagaagagaggacuaguugaaacauuugagcuggagaggcuuaugggcaauaugaagugggccaaauucuugcaauacacccuauucaauugaaaguacagugucuaaggauaagaauacuucuuuaaagaccaacaauuguuuuaaugcaaucuuaauuaguaaaugguuuacauuuuuucuauuguuauugguuuuaaaauuugcuacccugaauucugaaauauuauaagaguuaauaccaaaaauacuuuuaaugucugacaucucuuacauuucacaugguucuuuuuauucauuguaaauaaaaguaaacuuggauaaauuugagaauaaacuuugaauuguugcaaacuaugauuaucaauuuguaaauuuacccuuugacauaauaauguacauuuuuaaauguagccauuaaauucucuauauuuaaccuauugguuucucucuaaauguuuuuaaucucaguugaaugcugggcaguuuauaauuauguacaaaggguuuuuuuccuauuaagauugacauuuuugcacauuuuuggaaauguuuaauuuguacacugauuuacuacucugaccaauaauuguugaugaguguaugagcaucaugaaugcgugcauugaacuacugucugugucuuuauguuuuaacuucuuucaagauguagccaucaguuacugcacugcuauuacugacuuaaauggaccuuuuugcuuuuacaaacuauacuuaucuaugguucuuuguugaagaacucaggaguucgacauuaauagaaauuagaaaauuuuauaauguauuauaaaauccauuacuaaguugaaaguaugcuuuuaacuguguaucaggggauguauguuuguguggagauguuuuuuucugucuguaggcacauguauauaucccaguaaguucuuauuuucauuucauuucuacauuuuuaugaacuuguuuuauaaggguacuguuuaguugugauaauuaaauauauauaaaagcuuucugagagauuauuuacuauaugaauauauuuucagcuggcugaucaaaaguauuuuuaaaauuuuguuuuuagccauucaaaauguauuuguauuuucagaauugaaugcaagucauacuuagagcucaauuaaaauacucuugcaagaaaaagcauuaaauucucuuugagaauuccgugaaaugcaaauuaagggaaaaauagguuuuaagcaguagcaaaaacacaccgcuaaaaauggccuuugaauucucagagcuauggaaaaaugugagaaacuaaauugucucgagaugucaagauuuuucuaucuccaguugcuauuggccuguccuacuguugucuuugaauauuuccuguauuccaccccaaaagauuucaacuuuuaguuuuucuaucacugggcaaggucagacuggguuuauaaaacaauauauuggcauauugugauucuuuguaauugacuauaaauugguuuugaaauguccaaacauacguugugugucuuuauauuguacuguguguuuuaaguaacuggcagaaaaagaauuggaaaugaaauuuccaaucagacaauguaguauuaaagaaaacuuuguuuuaaauaugcgguaccauguaaaauuacucguguuaggaauaaaguccacuguugaaguugaaugucacuaagcuuauuauguuaaaaggaaccagugugauuaggaaaaccuaccagaagccagauacagugugguacgugcaacauuucaugcacauuuugauuuuguuugucauucaaaauugugcuuguaaaaauguauacaauuucugaguuuuauaauuucuagguacuuguuuuuucuugcugguaaauagcuuuuuuuuaaaaaaaaaucuaauauaaaagaaaccauguuuauauuuuguuagugaucaaugacuuuguuuauauggaaauuuguauauuguuggcacacauuuuguugagguuuacgugcaugaaggccugcaauaauuagcacaaugaaaacugcuuuuucuuacauguucauuuuuuugaaagauuguggugcaaaggcuuacucuaauaaguaaccuucuggacuauggaaugaauauaaaugaauggcacuuugaguguuaauaaagcuaauauuuauuuccacugug

SEQ ID NO: 192745 - RNA, 36887 nt, Homo sapiens
gggagcuuccggauugagccggaaguccccccagagcggaugccgcggcgggccugugggagcggggucaucuucucucugcugcuguagcugccaugggcaaaagagaccgagcggaccgcggugagacguugcgcgggcacgcucagccacgacugcccuugccggcccugccccccgcucugccucggagcugcuccgggccucugcgccggccgacccugcuggcccucccgcgcgcaccccguugggacaggccuuugggcgggagagaugcuggaccugggcgcagcccagcgaacucggccuaggggagacgggugaggggcgcaacgccugcgggaugcagguggcucuuagcuaggaguuugcggcggcgcaggugaaaugcugccaagcggugcggagggaacccugaaggcuccugcugggcuuacuucuguguugguaucuugcagacaagaagaaauccaggaagcggcacuaugaggaugaagaggaugaugaagaggacgccccggggaacgacccucaggaagcgguucccucggcggcggggaagcagguggaugagucaggcaccaaaguggaugaauauggagccaaggacuacaggcugcaaaugccgcugaaggacgaccacaccuccaggccccucugggugguaagcaugcccuuagcuugggcagggcccaggagugugcggagcggcagcuaaaucuugggcauccucagagucaaaacugacauucaggauacugccccuagaacuggccgggagagaauuuucauccacacacguuggaacagcccaaggcaacagcgagcaguugcgcacacguguggcggccggaccugggcuuccaacagcucuaaccccucgguuuacucucacuccuuccccagcccuaccccauguagugaauccuuuuaucugccgaauaaauagcauuuaucauguaacaguuuguuuccucaaauaauggaagacauguucgguagcaagcuuuugcucuacuuuaaauaauuaauguuauacauuuaguugaaaucuagccaaaagguaacuugaggauagccaguaagaugggcuuucucugugcagaauaguaggaaacagcuguugacuuuggaaacacuuucuucuauuuuucuuuacucuucuguaucugauuaauguaacaggccccacaguugucugaaggagugcuugcaagaauaucugugguguugggcagcuuauucuuucuugauaaugauaugggcaagagcccaguagucucugcaacucauguuuccuugucuguuuuguccauuugguaucucucaggcucccgauggccauaucuucuuggaagccuucucuccaguuuacaaauaugcccaagacuucuugguggcuauugcagagccagugugccgaccaacccaugugcaugaguacaaacuaacugccuacuccuuguaugcagcugucagcguugggcugcaaaccagugacaucaccgaguaccucaggaagcucagcaagacuggagucccugauggaauuaugcaguuuauuaaggcaagugacagcugagaccagcaauuccaccugcccugcuaauguaacaauaggcauaggugcuccauguugucagccuguggcagccaugagaaugugccauucagauuuccuguggggagcauaacgacugauuaccccagccgcuacacucuggauccagcauuguguucugggugaggccaugcuucucaugagccgcuacacucuggauccagcauuguguucugggugaggccacgcuucucaugagccgcucccagcuguggguauuaacacagaggggcuacuaauucaggcccauuguagccagggagaauuuggaaaugcagcccaaagugagugugcuggggacugaauuguguguguuccccucaaauuuugucuucaaaaccuaauauccaaugguaauguauuuggaguaagaaaguaguuaagacuaaaugaggucgugauccgcuaugauuaguguccuccuaagaagagacaccggagcaugcuuucucucaccugcccuucuugucaugugaguacacaaugggaaggugguccauagacaagagccuucaccagaaacugaaucggcugauaccuugaucauagacuuucagccuccacagcucugagaaaauacaguucuaauguugaagccacccagucuggaauuuuauuauggcagcccaagcugacuaacacaggugguaaacucugucuaaagcuaaguaucugcaggagaccaauagucaacaaguuccaugagggaaagucaaaaacaacuucagauguuuuugacaaaacaaagaggguuccaugugauuaauaguugaacaugcuagguuucuucugcgagaugggugaaugccauuuaaaagagauggacaguggcuuucauugccuuuggcugauccaaaaggagucagauucagaccuugggaucuggaguggcagaagagugccacaggaauucaguaugguacugcagccagucccagagaagcugcaggaguccuggagagaacucucuuuuccugugaugugaaagcgugcccggccaggugcaguggcucacuccuguaaucccagcacuuuggguggcugagguggguggaccaccuggggucaggaguucaagaccagccuggccaacauggcgaaauuccugucucuacuaaaaauacaaaaauucgccaggcaugguggugggugccuguaaucccagcuacucaggaggcugaggcaggacaaucacuugaacccgggcggcagagguugaagugagcugagaucucaccauucauugcacuccagccugggcaacagagugagacuccgccucagaacaacaacaaaaaagaaagcgugcccaaggagaggaccuuguaccaacacuguggcucugccuggucuuggcugcgaauugccugcagggauguagguguuggugcacuguagugguggaucagggacaacagcggggauaggcagccccucaaagucugacuggcaaauuuuuuuuuucuuuuuuuuugagacggagucuugcucugucgcccaggcuggauagcaguggcaugaucuuggcucacugcaaccucuaccucccaggcucaagcaguucuccugccucagccucccaaguagcugggauuauaggcgcccgucaccaugcccggcuaauuuuuauauuuuuaguagagaugggguuucaccauguuggccaggcuggucucgaacuccugaccucaggugauccaccuggcucggccucccaaagugcuaggauuacaggugugagccaccgugccuggccugaguggcaaauuuuuauuguugccacacagccucuacuguauuccuuccuaaaggugguugggaaccugggaggauuuaagcuguauucucugccaucaagaugcuuacauucuauuuggggaaauaggagcauuggugaagaggcuuugcauuuuauuuaagccgcaauuacugugcacauacucuguggaguuguaguaauacugguguggucuucucuagacuagggugggggcugugggaauagagaggaaaggcagaaugcaagauuuuaagcagcguuuuauaacuuaauggauaugcaucagaauuacccaggcaagaggaagauuuuguucucagaaagcagaggccaauggaaaaagcucaguuuaggcacaucugaccacuuuaggauugcaaguuggguuucccuaaaguaaaaugaacuuuucacuugguugguagguguaagaugugaccaguaaugaauguguucugaguuagcugcacauuuaccuguuggauguuaucuguauuugcaguuguguacugucagcuauggaaaagucaagcuggucuugaagcacaacagguaagagauuccaugacaggccugucccaaggcacugucacuuucugcgcaccagcaggaauaaagggauaugggaaggaccugauguuuaugcugucuuuucugugaagcacagauaagagaagagaaacaagagauguggcccagacuggaaacucauccacuggccacuguauuuccucuagcaguggagcugggcucaggccccugccuacuugaccucaaagucacaacccucauauguuaaaucauggccggcagcucaugguacagauuuggcgaaggguuguggggagagucaugaggcuuguauuuccagaccaucuaauugaaugagcaguggaaucuccaggagguaccugcuggucaguagaccccuucuuccuccccugcuugcagauacuucguugaaaguugccacccugauguaauccagcaucuucuccaggaccccgugauccgagaaugccgcuuaagaaacucugaaggggaggccacugagcucaucacagagacuuucacaagcaaaucugccguauguggacuccugggccacccuugggugggggcaggcauuuaggauuucaguucucucaggugucuuuaacccagcacuuacaaccuagcagcccugcugguucuacccuuuacaacuucacccauugcuugauaacagcagaauuaaauguugugugcacguucagcaccuaccucucucacagauuucuaagacugcugaaagcaguggugggcccuccacuucccgagugacagauccacaggguaaaucugacauccccauggaccuguuugacuucuaugagcaaauggacaaggaugaagaagaagaagaagagacacagacagugucuuuugaagucaagcagguuagugaauguaccuuccuccugguuccuucacugagcugcuguuagaagcuaguccagccaugugucgacucugccuguagucugugugaaaggaaggagucccuguuggucccugaauugcuuucuccuuuuuauuaucugugagccauggcaucauuucuccugauggaguuaaagucccaguguccucuuuuucaggcugguaggcuggucuucacagguuccugaggagaugugagaaauggugccugaaggucaauuuugccugcugauuagauuucauuuucaaaguguuguuagucuggguugcuuuucugugcuuuaucccgguuguugacugagcaagaucuaaaaucuuguagaaguuuagauagaaugccacuuuuuugaccauuggaccucuuagaagauguaauguuuuugagcacaguaacaagauuuuaaaaccccuuuugugcccucuuuccaggaaaugauugaggaacuccagaaacguugcauccaccuggaguacccucuguuggcagaauaugacuuccggaaugauucugucaacccugauaucaacauugaccuaaagcccacagcuguccucagacccuaucaggagaagagcuugcgaaagauguuuggaaacgggcgugcacguucgggggucauuguucuucccugcgguaagugguaccagaguuaagaagguggucaggcuguugugucuggaucugccagcugccucccgcuuucucucugcacauuucccuaaaucacaccuugcugaaaagccaagaucaggugacucccugauucaugacuugacaaauauuugagugcuugcuguguaugggcccuggccuggacacuggggguauuaugguggcuagaacaacacuucugaccucauggagcucacucuucuggggaagagacagaugguaagcagauguguacaaccuuggguggugcuagagucagcgaagaaaaauuagagcacaugaggggugagauuguaaugauggcaaggggcuguugcacuuagugggguuagguucuuguucuugaaucagccuuagggguuguguauuuggagacucccuagcgcagaaacuuugguguuccuggaugacuaggauggugugcagguccagggaaaggcaggaguggcccccugggcaccuguuugaccacuuaucccaguagugucagguccuagccuagcuucuuggccagagaccacagcagacucaccuugggaccccacugaggacuuacagaggcaaggucuucagggaaggggagguucuuuuuuuccaaaacuccaaggguuauuuugauguuguuuuccuuuuuuauuucacuuuacaaauuuuuuuuauuuacguuuauuccugguaacucacaguguauuuuuauaauaaaggaaggaucucuguuuaauggaaaagcuugauuuuucucuugaucuucaaaugguggaugguaguaaacucagaagcuccuggaauuucauuuucucuguacacacauagcgcaucccugaauucucagccccguuugcuguguaauaauaauaguggucuuuugccgagugccuccuucugugggccaggcaugcugggacccaguagcuucacugucccguggcugugggcaagguaaaguacuccucagcuuuaguuuuucaaucuuucuuuuuucuuuuugagacagagucuugcuccguugcccaugcuggaguguaguggcgccaucuuggcucaccacaaccuccgccuacuggguucaagauauucuccugccucagccucccaagugaccgggauuauaggcgcccgccaccaugcccggcuaauuuuuuguauuuuuaguaaagauaggguuucaccauguuggccaggcuggucuugaacuccugaccucaugugaucuacccaccucggccucccaaagugcugggauuacagguaugagccaccguggcaugguggcucagccagguuuuucuaucuuuaaaauaacaauaacaggcauuucucuucucacugguuuguuuugagauuuugacauuuaaaugagauguguguaaagugcuacaguaggccccagcgccugccauuucucacauauguaugugaagugggcaugucuccucauuauaaagaagaaaacaggcuggagcagugugugucgcucagaugucagcuauguggacuguuacaagacauuuuccuagauugcuguacuugugagucauucugccugucccuguccuucauuucaaccuguccuugggugggauugcacucuuguuucuuguaggugcuggaaagucccugguuggugugacugcugcaugcacugucagaaaacgcugucuggugcugggcaacucagcuguuucuguggagcaguggaaagcccaguucaagaugugguccaccauugacgacagccagaucugccgguucaccuccgaugccaaggacaagcccaucggcugcuccguugccauuagcaccuacuccaugcugggccacaccaccaaaagguccugggaggccgagcgagucauggaguggcucaagacccaggaguggggccucaugauccuggaugaagugcacaccauaccagguaagcaggcuggagcugagcuguccacuugcugaacagacaaaccaauuuccaguuguuagguugggaaagggacugcuguguagcccacccaacuggcuagaaagacuugcuggcuugcuggguaaagcuuuuaauaguucuuuuuuuuuuuuuugagagggagucucacucugucacccaagcuggagugcaguggcacgaucucagcucaccacaacuuccaccucccagguucaagcaguucucugccucagccucugaguagcugggauuacaggcaccugccaccaugcuaggcuaauuuuuguauuuuuguagagacaggguuuccccaucuuggccaggcuggucuugaacuccugaccucgugauccacccaccucauccucccaaagugcugggauuacaggcgugagccaccgugcccggccaguaauucuuaagugggaugcaggcaggaguguucacauucacaguuugcuuaaucacuggcucaguagugauuuagaaaaugauauuuucuuuccuccaucuuccuuuugcugcucagcuucauccguuuuuuaauggcccucuaaaaacuggguuaggagcacugaaaagcccuucccaaaaugguggugauguguuuuauuugaagcccggaauauugauccuuagucaauauguaauagaagcccuacuucuccaaguaucaugggcaaaccuuuuuuuuuuaagcugcucuauugauuuaauuuauauaccauaaaaucaccccuuguaaauauauaauccaaugaguuuuaguaaauuuguggaccagugcaaccaugaccaugauccaaguuuucuuuucuuuuuuuuuuugagauggcaucuugcuuuguugcccaggcuggagugcagucgugugaucuuggcccacugcaaccuccgccucuaggguucaacugauuccccugccucagccucccaaguagcugggacuacagguguguacuaccacacccggcuaauuuuuuuuuauuugagacaguuucgcucuuguugcccaggcuggagugcaguggugcaaucucagcucacuggaagcucugccucccggguucaagugauucuccugccucagccucccgaguagcuaggauuacaggugugcgccaccaugcccagcuaauuuuauauuuuuaguagagacaggguuucuccguguuggucaggcuggucucaaacuccugacuucaggugauccgcccaccucagccucacccugggauuacaggcguaaaguaccacaccuggccaaauuuuuguauuuuuaguagagaaaggguuucgccauguuagccaggcuggucuugaaguccagacuuuaagugaucugccugcuugggccucccaaaguacugggauuauagacgugagccacugcauucggccaccaugauccaguuuuagauuuccuuuguacucauuugcagucaaucuuuguuucucuaucuagcuucagaugacuacugaacugcugucacuauagauuugcuuuuuauggaaaauuuauauaaacacaaucauacaauauauauuaugucuggcuucuuucacuucccauaaugauucaucugugccuuagcauuuaucaguaguuuguuccuuuuauugcuguauaguuuuuugggcgaaucuuuuuugauaaaaacagauuaagggauuaagauuaacaaauuaggagugggcaugguggcugacaccuguagucuccuagcacuuugggaggccagggcaggaggauugcuugagcccaggagcuuaagauuagccuggguaacauagugagacaugucucuacaaaaaaaaauuuuuuuaauuagccaagugugguggugugcaccuguggucucagcugcugaggaggcugaggugggaggaucacuugaaccugggagguugaggcugcagugaaccaugauugugcaacuguacuccagcaugggugacagagugugagacucugucucaaaaaaaaaaaauaaagaugaacagauuaggguaaauuaaggagucuaauagagguuacuaugaacaaaaugaaaucugaggcauuuucacagguaguguucaaaaugucaaaauggccccagcaucugguucuuucugugcaugagagcucuucagcccugauggguuucuggagauaccuagagauguucacagcuggccagggagggauuggaggucuuucugauggaagcccagggugugggcccugcugugggaaaguacuuggcauagugagacagcacaagguggccaugcggccagaggagagcauaggaacaguagucaaggcugaggaagauuagcgguauuggggcaggucuuguaggaccuuguaggccacgacaagaacuuuggcuuguacucuuagugugaagccaucugagggauuugagcagagcaugacaugaguugacuuuacacuguaaaaauacugcccuggcugcugugcuggaaauagacugaaggaagcaagacagaagcggugaggugaguuuguggaaucccaguaaggaugaaggcgugauccgacucuggauauguugugaagcuuuaauugacaggucagguguggaaucagagagaaaucaagaaugacacuaagguuuuuggcuugaacaaagggaggauacagugggcauuaauugagauggggaacacucucaaaggagcuggucuggaaggugacuaucaggaguugggcuuuagaugugugaauuugaguuuccuguuaggcauucaggccauggcaaaaagguuaagaaauaggccaaagaaauugauagacauuucaccaaaaaaggauauacauaugucaaaaaagcacuugaaaaaggguucaaccucauuagucaucagggaacugcagauuuaaacccaccacaggaugcucccauaugccaguuagaagggccaaaauaaaaaauacugaugugcgggugcugaugaggucacagcaacugaacugucacacauuccuggagggauggauugcaaaguguauggucacuguggaaaacaguuuguccauuuauuaugaaauuaccacaugacccaucagucccauuccuguguauccuggauacaugaaaagagguuuacacaaaauccuguacacgaauguuuauggcagcucuguucauaauauccaaaacccaggugcucaucagugggugucuggauaaacaagcugugguacauccauacacuggaacacuacucaguagugaaaaagaacaaacuugcugcauguugcaaccuggaugaaucucaaaagcauggugcugagugaaagaagucagccucaaaagcuuccauaguaugugauuucauuuauacaacgacaguauagugcuggccagcagaucagugguugccagaaguggggggucagagauggaugacucuaaaggagagcacaggggaauuuugggggaugcugucuuuaucuguacccugauuguggugcugguuacaaaaauguaaauauguuaaaaugcauagaagugccccccccaccccccgccccaagucaguuuuacugugagaauuuaaaaacucaaaagaaaaaagguggaaggguggguauugggucugcuaggauugaaaauugaugguacagagaaucacuacccacaaaggagucuggaauuguucuguagcaguuugguuggaagcuguguucagggcuugaggcauucugucugacuauauguuugguacacguucauguuuuucuuuaacccaagccccaggucccagguuccaggggacaacagcacagauuugggauugguuaucugaugaacaaguacaaaaaggugcaucucacacucacauaugucugugaguuugucugucucucgucuaguucacuggaugaguuagucuuugguugaguugcggagugaaaccaacaaacucuaagggauuuuugaguacaggccccauaagcccaguggccuggccaugcucauugucccagagagcaaauguuaaauaagggaaugcuaggaagucacaguaagucuccugacugucuuaacgucugcuguguuggguuagguggagugaucaaucuuugagauuuaucucaaaggauaaagauugcugugcuguuuuacagauuuuucaaaaggagcucuguuaugccuuuuuauuaaugauucauauuaugguacuuguguauauuaagugcuuccugugugcuagguacugugccaguuucauuauuucuacagguauuuauugagaaccuacuaaguuuaggcacuguacuuggcacuggagacaaaguggaagggacagccaaguaaccacacaaauaaaugccaaaugacaaccaugacauaauguugagugauacaagccacacacaaaagugcauacuaugauuucauucaugcaaaguucagaaaggaggcagaccccucucagaagucagaggaguguuucccucaaggaagagugcuaguuauugacagaaggggucaggggagagaccucugggugccugguucucuauauccugaucuaggugguuccacagcugcaugucuguaaaaauauauugaguaguaugcugugaguuauucaccugugacagcugucagggcuguaggagaguguaauagaggggugugauggggucacggguguccaggcagaguccuaccugccuuauccuugucuugggucaguaugucccccaguguugccucucuggggcccacacuggguugguguagccauugccuugacuaccauuucccucuaacauggggagcuuggucugagguucuuggcuacuguauuuuggagccagcacagucuuuccuuagacauaacccugagcugauuuuguuuucuguguuguguguguguguguguguuuguguguguguguuugcaugugguguugugugcaaaccauguagauguaaaaacuaaacauuuacuuagaguuaggcaacccuauguuauuucacugugaacgucuuuguguuuuggugcauucaggccucuuuuuccuuagauuuuugugucuauuuauuucugaaauaucauuagcccuacuuucaauuauauuguaagauaagcaugacucaaacauuuuaaccuugcuucagaguauuagaauuuuuaaaaggugagcccguggaaauccauaaauuagguuuuuuaaaaaugaauaacucauacccuuuauguguuuauuuuauuugauaaaccagagagaauuauaauguucaaaagaaaggaagaaaaagagguugcugguugaccaaagugauugaauugguaaaguuuggagaggggaguuuccuaaggcgggccggagggcuugggcgaacaguuccuggaguuucaucacucccgugggcuuggcuuucuucucgguuucugggaaaaugaugggaagcugagaagagcuggcuucuuucauuucuuccucucccuagauugucaacuuucuuuucaguaaccuggguacaaguguuaggggaaaauucuuugcguaauuuagagcuuaaugguauuaauaguaaguauugcagguuguauuucaaauugccaucuguacuucuacugauaacuguugugaggggaaugcugggauucauuaacuuggagauuccuuaagcucauuucacccucuuguucuccuuuucauuuucuuuuggacaggucuaaaagugauggugaagcauuugccuagucauucuugucuagagccagcuucugugguccugaaacccaaggguuaguucagguggugucauaagccaguguuaaguugcacagcuaugagcauuugaaaaagugacaguguaggcugggugcagugggucacgucuguaaucccagcacuuugggaggcgaaggcagggggauugcuugaggccaggaguucaagaccagccugggcaauauaaugagaccccaucucuacaaaaaauauuuuaaaauaaauaaauaaaaaauaagaaagaaaagugacagugugaaugcucccauuguuuccucagccaagauguuccgaagggugcucaccaucgugcaggcccacuguaagcuggguuugacugcgacccucguccgcgaagaugacaaaauuguggauuuaaauuuucugauugggccuaagcucuacgaagccaacuggauggagcugcagaauaauggcuacaucgccaaaguccagugugcugagguagcugggccugggcugggggcgucugggaaagggccuccuccuaugggcaggggagugaucagaucgauuccucaugggcagacacaggucaggacuuaggcucaccugcuaccacuucauacaggauccucagucacccugugguugggugguacuagacccacuugcugcauaucuucugucuugucacauaucucacauaccccugaauuugugaugauucuuuuuccuagccaugggguuuaccagucauggauuucugugggugaggauuagcauucagggcacagggaugaaugaaggccccugauaccacagugcugccugggagccuggcagcaaagggcuuugcucugauagccccaagcgccuaacugauaugcucccagcccugcugggaagugugugaagagguggcgguacucaguagcagugcugacucguguguggaaguguggcuuaaauggaagaauugcugacacuaccaauugagaaucugguuucgcacacuugcagcuggugugaaaauaacucccuggaugugauugcauuuaaaaaucuuuuaagugguuaacaugugaaaacguccaguucaauaggagguauuagguuggguuuaguuuugugcaugcauuuauuuucaguuguacugauuucuaauucacauagcauuuuuuuuuuuuuaaaacagggucucacucugucacccaggcuggagugcaguggcgugaucuuggcucacugcaaccuccgccuccugggcaagugauucuccugccuuagccuccugcguagcuggaauuacagacaugcacuaccacacccagcuaauuuuuguauuuuuaguagagacuggguuucacuguguuggccaggcuggucuugaacuccuggccucaagugaucugccugccucagccucccaaacugcuggcauuacaggcaugagccacugcaccugacugguuuuguuuuaaagcuaauucugcuagagaaaggucuucaaaaguuuuaaauugugugguguuuaaacuuguaaaaugaccccugguucuuacuguauuacaggucuggugcccuaugucuccugaauuuuaccgggaauauguggcaaucaaaaccaagaaacgaaucuugcuguacaccaugaaccccaacaaauuuagagcuugccaguuucugaucaaguuucaugaaaggaggaaugacaagauuauugucuuugcugacaauguguuugcccuaaaggaauaugccauucgacugaacaaguaagaauugaaaacuuggagcuuccuccaggccaguuucucuuccccauugagagugcagaagguggcuguuguuuuguuuuuuuguuuuucucucaggaacuucuugggcuccaaagaucuuguucuguggcccuggucucagaaaccagggaagaccugaaguaggugguuggagucagagguuagagcauagagaaaaggggggcuagucaccuugagcccaaagaacagggagcagagacuuggacugagcuggguggggccccauggaagaucugggcuccaaaggugggugggaguuggcauuuggagcuuugggcugugugagcucuguggguggagaggaggccagacuggauggccuaggggcugggaaggcaagaugggcugggcuggcaucccaaguacggacuggcaucuggaaggagcuuagaaaugcccacgcaguauccucaucaacccauggcuccacccaaauauuugugcuuaaaaccuggcuuuuguaaagcucugccaaguaaggaggaagaggucugcgcuugcuccuacagugacacaggacuucaggugcuguaaguguugcagaaggccaggcccucuauggagacaggucaagcuaugugcuauggguacuauacauagguuuuacuuaauccucacuucagccauauaaaauguuguucccauuuuauagaagggaagacaaacucauagaaagauuaaauuucuuaaguuucuaaaauuauaccuuuauuuaauuuagaaagacuuuuuaauccaagucaacauuuagauuauugugaaaaacagcaauucccugcuucuauuuucccacccacaauucuauuccuugaagacagccgcuuuugacucuuuuuuguuguuuaccuucauauuucuuucuuucuuccuuuuuucuuuuuuuuuuuuuggaguuagggugucacugugucacccagucuguagugcagugguguaaucacggcucacggcagccuugacccccugggcucaaucaauccuuccaccucagccucccgaguagcugggucuacaggcacgcaccaccacacccagcuaauuuuuguuuuuuguagagaugggguuuugcuauguugcccaggcuggucucaaacuccugagcucaagcaguuccuccugccuuggccucccaaagugcugggauuagagucaugagccaccacaccuggccagccuucaucuuucuaagcaauagcuuauguaguaauuucuugaugaucaguuauagaaauugccuauuaacuuccuacuguaggaguugaggguuuagcuuucuuacauacaccacucuccccacuccuguuuucucuccuaccauucucccaauaugggaauagcacaaguuggggguuacuuuaauauucaguuacauuauuuugacuguguaaguauguucaggcagagcuguagaguacuauuacauuuuccuuuuuuuuuugagacggagucuugcucuguugccaggcuggagugcaguggcgcuaucucagcucacugcaaccucugccuuguggguucaagugauucuccugccucagccuccugaguagcugggacuacaggcacccgccaccacagccuggauaauuuuuguauuuuugguagagauaggguuucaccauauuggccaggauggucucgaucucuugaccucgugaucugccugccucggccuuccaaagugcugggauuacaggugugagccaccaugcccggccuuacauuuucuuuuuuguaaauguuuuuuugccuuggaguuaauaauugccuugucauuguuuuugcuugguuuucugugcauugaauaauuauuccccuccaaagucuucacauaaccauaaacucaguagggucagguaauuucucaguucuguuuuucuguuuccccagugggauccccaccagcacuccauucgcuuacucuguucuggccugcuugcugucuaggacuagagacaccaccagcuguuaccaugggguuucccuuggacacuaccccaugacuucccugggccucuuuguuguguuucccacccugaaaucuccacccucuugguuacucauuuugauggagcacauguuccaguagguuccugagagaagggauguaggaggagaagcuuuggagacuucacauguuuacagaugucuuuacucgacuuuauacuugaucaguaguuuggccagguccuagaacuaacauuggagcuuccagugcagcaguuuggcagucugaugcccuuugcuuccucucaguguguugucugcugugguggcugugcguuuuccuucccuugaaaacugguaggaucuucucucuuuuuggaaauuugaaagugauauucuuaauguuuuucuuucaucgugaugggcacucaguauauccuuuccaucuggaaacucguguccuucaguucugagaauuucuguuuuuuuguuguuaaucacuuucucuauguagucccuucuuggaauuuugauucaucagauguuagauccucugaacagcuucuccaguuugcuuaucuuuuuucuacuuuuuuaucucuuugucuucuaacccuuguauugagacuuguuaauuucugagaguucuuuccugguaacuguucuuguuuuguuugugaauagagugucuucucggaggcuuugaaaacuuuugaagcuuccgucuguuuccugccaugucucuuuucuucauuuuuuugucuuaauuguuuuuaccugucuuuugagucuuucugaguuuugguaauccuugacuguauuuuauugguuuaaagucacugaaaaccuggcaggccuuucuguguggcuuaguggguuugccagcuuguggaccucaccagaguggcugggcagggccuggcuauuucuucaggagguugccaaaugccaguaucucuaggacuuuucucuugggcuggacgguuucuucagugaggaauuuuucaguccccugggcaccaccguguguuaggggaagaggagggcuuguggaaucuuugcauucagucuugccuuuucccucaucucugccgggcaucccuggagaauaagccuccagugccccaccaguggagguggccugccugcugccggccggacccaacugcuccucacacucacacacugccaguccuccugugcaccuccccaccuucucaggcaacuggugacuaguuccugagcccuccugcgugcugcagaggacacagaggcggcggguuuuguaucggucuucccuccugccggcuccagcuucugcuuucucuagucuguuagcucagguacugugccugcaucugucugcuuuucagcuucugaaauguuacccacuucucucaucugcuguuauuucuucuccuguuuucuugguggguuuguguucugucacauuagugccaauuugagcagggcaaugagacaguuccuauauuuacuuugccuuauuuaagaacuauucucuccccauccuuccucccacagcaaugcuccuccagucuucuggagccucacuccaggggccucccccaccuacauuugcagcacuccugaggcuugugccuuagccgcagccucccgagcaucugcuugggcagggacguuaauuugccuggcacugucaauuccaagccagucugucacagugaagggcagcagauuguggcugucuccuguguacuagaaugaucauuacaauguguacuuuuuaccuuuuuuuugugucucuggccuuuaaauguaugaaguaguguuuuuucuucuugguuuucucgcuucuaaaaugauccugcgggccaggcgcaguggcucaugccuauaaucccagcacuuuggggggccaaggcagaaagaucacuugagcccaggaguucaaguccagcuugggcaauauagugagaccccauccuuuaaaaaaaaagugauccuguggcucucgggcauugcuccauucuuugcucgugugugguggggauucuccaagcuuuuggcuccucccagccuucauaagaaaggcauugguaucaccaaagcacuuugcaagagaggcuuaggguuauauggcaguguggggcugugggcagagcaucguuuuugggaucagacagacuggaugugggaaaguuguuuaccucugaacuccuuuuguacuucggucacauggagcuacugccacccaauguguacuggguccuggugucccuugauggugggggguggauucuugugccuggcagcuuguaaguauuuaguaaaugugacauucuccacuuggagggugcuuuuccuucuauuucaucugugugggggaaccuuuagaaacugagggcuccccacugugcaaguaguuuuuccuggugaugggggaggagaaaaccaccuaaaaaccugggucucaagagucaggcuguucugacgaguggggcuucuaaccuuuuucacugcaugacaugcauagaaaaugauaaaauuaugugguggccgggacauucuggaucacggcaaggcagcuugugacugggcuaaucagaggccaucagccugggugugcagcugcccaggcccuauccagcuuccccacaggcaagggguuugcucuuugagguacauccauuaaugggcacugcucugggugcuaacgggccucggcaguggagcagccacucccagguuccaccugcucaggcuucugacccuugguuucccacauguaaauuggggaacaugaaaccugucuuuuacaaugcugaggaaucuuggcagggcuggcuggauuuuuuucuuuucuuuuucuuuuuuuuuuuuuucugagacggagucucacucuguugcccaggcuggagugaaguggugugaucuuggcucacugcaaccucugccucccagguucaagugauucuccugcuucagccuccugaguagcugggauuauaggugcccaccaccauacccagcuaauuuuuuuuauuuuuaguagagauggggucucaccauguuggccaggcuggucucgaacuccuggccucaggugauccacccaccuccgccucccaaagugcugggauuacaggugugagccaccgcgccuggcuggauuuuuuuuuuuuuaauguaauacucagcucaaugccugguguugguagguccugcguaccuguaguuugucuucauugucuuugcuguugucaucaucaucaucacuguuguuaugauucuugggaagcuacaaaaacuguccaccgucacauuccaagacagagggaaggagugugacauucccaaugcuaugggaugauaaccauugaguucauugauaggguuguacccuuuggcagggagcuggaaaauuuuuuuuuuuuuuuuuuuuuuuuuuugagacagaguuucacucuuguuucccaggguggagugcaauggcgcgaucucggcucaccacaaccucugccuccccgguucaagugauucuccugccucagccucccgaguagcugggauuacacacaugcgccaccacacucggcuaauuuuguauuuuugguagagacgggguuucuucauguuggucaggcuggucgugaauucccaaccucaggugauccacccgccucggcaucccaaagugcugggauuacaggcgugaaccaccgcgccuggcagggagcuagaaauuaaagagaaguuuuuaaaacuuaguguuaugggaaaucagcacaauaauggcugaagggcacuuuucuccuuucugcucaucucuuggagcaugccugugucuuggcaaacaguugcuuccagccuuuuuuuggaaauagcagugguuucuuugcaccucucuuugggcuucaugaaauguggagaugcuccuuguauagacucugugcugagaguaagagauguugaagcaggaaaaagcauaguccaaaaagaaaacgaaaaauggaaaggagggaaucccgaagagaauggugggccuaaaccuagaaucaguggggaaggcugggaggugcaucuguagccagucauuuuuuuggguguaacgauauuccuacaugacgagggcuuucuacuugagaagagcuagccugagcuccuuuuucccucugauguguuuucaagauaacugaggcauuauucuguggucuaacacagcuucauucuucucuagacccuauaucuacggaccuacgucucagggggaaaggaugcaaauucuccagaauuucaagcacaaccccaaaauuaacaccaucuucauauccaagguuuguguggcauaugggguggaggugaggccccuagcacucuggggaccugggggguacacuaugauuccuggacagugaauucaugucugcugaaggaacuucuccugcauguuuucauuuccgacauguccagggauagggggcacugccugggguuaguggaaggagcagacugaggauuugcaugcaucauggauaaucuauaaaggcuauuugagguuuuuccaguucuuuuggggauguagaaguuuuaaguuguauuuccuuauuuauaaaaggaaaaaaaguucauuuccuacucuggcaaaaguaggcauuuagaugaaguucucuuuacaaguuggagauccugugugucgcggcagccuuuguccugguuccuggugucccuugaugaugggugguggaugucagcacagacuuccgcaggcccagcucagggaugguuuacucugcaaucagaagcuguagccccacaguuuagaauagucauucagauuaagacagacccaaagcccaaaagaaaugagauuuuacaaccgggcgcgguggcucacaucuguaaucccagcacuuugggaggcugaggcggguggaucaccggaggucaggaguucgagaccagccuggccaacauggagaaacccugucucuacuaaaaauacaaaaauuagcugggugugguggcagacgccuguaaucccaacuacucaggaggcugaggcagcaggguucagucacuugaacccgggagguggagguugcaguggagcugagauugugccguugcacuccagccuaggcaacaagagcgagacuccgucucaaaaaaaaaaaaaaaaaaaaaaaaaaaagaaaugagauuuuaugugauuguggcugggcgcuuauaagcaccaaaccuucaugucuguggcugggaaccucgauguuuggagccccagagcugaggaauccaccuacagucagaauuccauauggggcaguuguuccucccaggucacaucccacgugugcugcuggugucaguggccaacagguaagaguauggaugguuuuguggagacauauuucuguagccaaaaaaaugaaugacucaaagucagucucuguucaagggcccucucaucucugggcuccuggcacccagcacugaaugucacugaugccugguauuaauucuucaggaugacucuuagcagaacucacacaagguccuggagacccagagaugccuuucugagguuuauugcuucaccucucucugccugcaucagauagacccugguauaaagaggagaaaagagugauuauguuucaaaauuaucuacagaacuuauuuaaauucuggaucaguugacuuuuuuuuuuuccucauauauaaaaaccuuccaacuuguuucuguagguaggugacacuucguuugaucugccggaagcaaauguccucauucagaucucaucccaugguggcuccaggcgucaggaagcccaaaggcuagggcgggugcuucgagcuaaaaaagguaaaguggccuuucaucuucuguugcaggaggucacuccucuuaaaccacuuuaguuaggaagacgauaggggugagagcugccaugugcccuggggcuaaauagacucuggagggagagaaucccaaagcaaagaccuagauccuuauggcccaucauuauuucucauaccuugggggugaauaugcagguguuuuccaugacagugucacggaauccacacagaugugcucuguacacugugcagcuguguugguagauggugagagggagccagggcaaggcagugcuuaugggguagacauggaagggagaaaacagagcugggccaccaguguaaguggaggagcuggaagcugcuucuggaacuugaucaggaggcagggaaagguuugguaggagcagcuugggcagacacacaaugggcacgucauucauaaccugugcagagugccgcccugguggcagcuugcagcaggggcagggcaagcucagugagugaggaggugagaauccucauugcaaaggcuuuuucugaggaggcguggcaccccugugcuugcuuacugcgguaaaagggcccagacugccauuguggacauggcagggacugacacucuugcuaagagauggccgugucugucuuacugggaccagggcacauccugagacaaggacacaagcccuauccucaaggagucugcuuauucaaggaggcaucuggacugcuagaauguuugaaaaugacaagauuagugggcaucuguuggaacuguacugcguucagauguguuuaagaagcgucuaguagcuuguauuuaaaauggagaugaggcagauagcauggacuagaaauagcauggacucaggcaccaagccagcugugucaccuuuggcaaauuauuuucuccucugagacuugguuuucccauccaaagugggggugacaauccugucuugccaagacugcugugaggauucagcuuauaagucauaaaauguagucggcuggcugggcacaguggcuuacaccuauaaucccagcacuuugggaggccaaggcaggaggauagcuugagcccaggaguuugagaccaucuugggcaauguagugagaccccaucucuacaaaaaauaaaacuagcugggcguggugguguguaccugugguuccagcuacuugggaggcugagacaguagcuuuuauaaacugacaggacuaugaucugcuagcaaaugugaauauaauucauuacuuauuccuuacucuaauuugaaaacuccuuuauugauugauugauugauugauugauugagauagagucuuauucugucacccaggcuggagugcaguggcacaaucucggcucacugcaaccuccaucuacuggggucaagugugauucaccugccucagccucccgaguacccggacuacaggcgugcaccaccacguccagcuaauuuuuuuuguauuuuuaguaaagacgggguuucaccauuuuggccaggcucgucucuagugauccacccaccuuggccucccaaagugcugggauuacaggugugagccacugugccuagccuuaaaaacucccuuaaaugugaauagaaggccaggcgcgguggcucacgccuguaaucccagcacuuugggaggcccaggcaggcagaucaugaggucaggagauugagaccauccuggcuaacauggugaaaccccgucucuacuaaaaauacaaaaaauuagcugggcgugguggcgggugccuguagucccagcuacucgggaggcugaggcaggagaauggcgugaacccgggaggcagagcuuacagugagccgagauugcgccacugcauuccagccugggcaacagagcaagacuccaucucaaaaaaaaaaaaaaaaaaaaaagugaauagaauuguuuucuuacucaaaacacuguuuaacaugacacuuggcuccuuucuuugcaucucugagcucuuguaagauuugagaaacaauuacauucaagggcaguaugcuuaaccuacugacauuugaacuacaaagcaaagauguucagauuuuccugaaggaucaagucuuucaggccacagaauuuucuguccuaguuuuuuaauacaguaguccccccauaucugcaauuuuccuuuccacauucaauuacgcauggucagcuguagucuaaaaauauuaaauggaaaauuccagaaauaaacaauucauaaguuuuaaauuacacacuauucugaguagcauccaugaugugaauucuugcuuugugcggcauauucaugcuuaaauucuccccacccauuagucacuuaguagccaucucaguugucacggacugucacuguaucucagugcuuguuuucaaguaaccuuuaucuuacuaauggccccaaagcacaaguguaaugaugcuagcaauucagauaugccagagaagcuguaaagugcuuucuuaaagcgaaaagguaaaaguuauuaauuuaagcaagggaauaaaaaucauaugcuaagguugcuaagaucgagggugagaaugacucuuccugcuguacaagaugaucauccccagagcacauagccgucagacuuuccaaggucaauacaaaagaaagaaucuuaaagacagcuagagaaagggucauauaacucaucaugcuaacagcagacuucucagcagaaacuuuacaagucagaagagauugggggacuguuuuuagcauucuuaaagaaaagaaaagaaauccuggcugggcacggcggcucacaccuguaaucccagcacuuugggaggccaagguaggcagauugcuugaacucaggaguuugagaccagucugggcaacaugaugaaacccuguuccuacaaaaaauacaacaauuagcuagcugggugugguggugugcgccuguagucccagccacuccggaggcugaggcaagagaaucgcuuuagucugggaggcagagguugcagugaucugacaucucaccacgguauuccaccuugggcaacagaacaagauccuguuuaaaacaaaaacaaacaaaaaaacaggccaggcgcgguggcucacaccuguaauccuagcacuuugggaggcugaggugaguggaucaccugaggucaggaguuccagaccagccuggccaacauggugaaaccccaucuccacuaaaaauacaaaaauuagccgggcgugguggcaggugccuauaaucucagcuacucaggaggcugaggcaggaguauugcuggaacccaggaggcagagguuucagugagccgagauugcaccauugcacuccagccugggcaacaacagcaagacucugucucaaaacaaaaaaacaaaaaccaaaaaaccauagugagacccagucucuuuaagaaaaaaaauaaaaaagaaaaauccuaaccaagaauuccauauccugccaaacuaagcuacaugagcaaagaagaaauaaaaucuuucccagacaagcaacugcuaaaagaauuuguuaucaccagacuggcccuacaagagagucuugagaguucuaaacauggaaaugaaagaauggugacaccugcuaccacaaaaauacacauaagcacauagcccacagacccuguaaagcaacuacacaauccaaacuacagagcaaccagcuaaugacaccauguuaggaauaaagccucaugucucaauauuaaccuugaauguaaacaaccuaaacaccccaccuaaaagacuuggaguggcaaauuggauuaaaaacaagacccagccuucugcugucuucaagagaccucucucacauguaacaggacucauagguucaaaguaaagggauagggaaaaaaaucuaucacacaaauaaaaaaaaaaaaagaguggggcagggggucacuauucuugcaucagauaaaagagacuuuaaaccagccacaguaaaaaaggacaaaaaggucauuacacgaugauaaaugguucaauucaacaagaagacuuaacuauccuaaauauauaugcgcccaacauuggagcaccuagauucauaaaccaaguacuuuuagagcuaggaaaaggcuuagacagccacacaacaaugguaggagauuuugacaccccacugacagcaugagacagauuauagaggcagaaaacuaacaaagaaauucuguacuuaaaauucaacacuugaccaauuggaccuaauaggcaucuacauaauucucuacgcaacaaccacagaauauauauucucaucugcccccagaauauacucuuaagauugaucacaugggccuggugccguggcucacaccuguaaucccagcacuuugggaggcugaggccggcagauugccugagcucgggaguuugcaaccagccugggcaacacggugaaaccccgucucuacuaaaauacaaaaauuagcugaguguggcggcaugcgccuguagucccagcuacucgggagccugaggcaggagaacugacuugaagccgggaggcagagguugcagugagccaagaucaugccacugcacuccagccuggggaacagagcaggacucugucacaaaaaaaaaaaaaaaaaaaaaaaauaauugaucauguguuuggccauaaagcaaugugagacuuuaugcucgacuuuauuaaagucucaauaaauucggcagggugugguggcuuacgccgauaaucccagcacuuugggaagccaaggcggguggaucacgaggucaggagaucgagaccauccuggcuaacacagugaaaccccgucucuacuaaaaauacaaaaaauuagccgggugugugguggcaguugccuguagucucagcuacucgggaggcugaggcaggagaauggcgugaaccugggaggcggagcuugcagugagccgagaucgcgccacugcacuccagccugggcaacagagcgagacucucucaaaaaaaaaaaaaaaaaaaaaagacucaauaaauucaaaaaagucgaaaucauaccaagcauuuucuugggucacaguggaauaaaaguagaaaucaguaccaggaagaacucucaaaaccacacaauuggccaggcacaguggcucaugccuguaaccgcagcacuuugggaggccaaagugggaggaucauuugaacucaggaguucaagaccauucugggcaacauagcgagaccucaucgcuaaauaaaagaaaaaagaaaaaaaaaaacccacacaauuacauagaaacuaaacaacuugcuccugaaugacuuuuggauaaacaaauuaaggcaggaaucaaaaauuauuugaaacaaaugaaaacagauacaacauacuaaaucucugggguacagcaaagguauuguuaggaaaguuuauagcacugaacaccuacaucgagaagacagauuucaaauuaacaauuugagauuucaccugaaggaacuagaaaaauaagaacaagcuaaucccaaaacuagcugaagaaaagaaauaacuaaaaucagagcagaacuaaaugaaauucagacucaaaaacaauacaaaggaucaaugaaauaaaaagcugguucuuugaaaagauagauaaggccagucgcaguggcucaugccuguaauccuggaacuuugggaggccgaggugggcggauuacaaggucaagaguucaagaccagccugaccaacauggagaaaccccgucucuacuaaaaauacaaaaauuagucgaaugugguggcgcaugcuuguaaucccagcuacucaggaggcugaggcaggagaauugcgugaacccaggaggcagaggcugcagugagccgagaucgcaccucugcacuccagccugggugacagagcgagacuccgucucaaaaaaaaagauaaauaagauugauggacugcuaguuagauuaacagaaaagagaagauccaaauaagcagaaucagaaaugacaaaggugacaucacagcugauccccagaaauacaaaagauucucagagacuuaaaaauaccucugugcacacaaacuaguaaaucuagaggaaauagauaaauuccuggaaacauacaacuucccaagauugaaucagaaauuaauugaaacccugaacagaucaauaaggagaaauugaaucaguaauuuaaaaaaaaaauauggccccaggcaugguggcucacaccucuaaucccagcacuuuggaaggcugaggcagguggaucaccugaggucaggaguuccagaccagccugaccaacauggugaaaccucgucucuacuaaaaauacaaaacuaggugggcuugguggcgugugccuguaauuccauccacguggaaggcugaggcaggagaauugcuuaaacccuggagguggagguugcagugagcugagaucgugccacugcacuccagccugggugacagagugagacuccgccuccaaaaaaaaaaaaaaaaaucuaccaacuaaaaaaguccuggaccagauguauucaguucuacugaaacuauucaaaaaaauugaggaggagagacuucuuccuaacucauacuacgaaaccacuaucauccugauaccaaaaucuggcaaagacacgaugaaaaaacuacaggcuaguauuccugaugaacacagacgcaaaaaucuguaacaaaaugaggacaaagcaaauccagcagcauaucaaaaaguuaauucaccacaaucaaauaggcuuuacuucugggaugcaaaguugguucaacauguggaaaucaauaaauaugauucaccacauaauuaaaaaugaaaagcauauaauuauccuaauagacacagaaaaagguuuuuuguuuuuuugaggcagagucuugcucuuguugcccaggcuggagugcaauggugcaaucuuggcucacugcaaccucugcuucccagauucaaacuauucuccugccucagccucccaaguagcugggacuacaggcacgcaccaccaugcccagcuaauuuuuuuguauuuuuaguagagacaggguuucgccauguuggcagugcuggucuugaaggccugaccucaggugauccacccaccuuggccucccaaagugcugggauuauaggugugagccacugcgcccagcccagaaagagcuuuugauaaaauucaacauuccuucaugauaaaaacccucaacaaauggcaucgaaggaacauaucucacaauaauaaaagccaucuaugacaaacucacagccaacaucauacuaaguaagcaaaagcuggaagcauucccuuuaagaacuggaacaagacagccgggcacgguggcucuugccuguaauccgagcacuuugggaggccgaggugggcggaucacaacaaggucaggagaucuaggucauucuggcuaacauggugaaaccccaucccuacuaaaaguacaaaaaauuagccgggcgugguggcaggcaccuguagucccagcuacuugggaggcugaagcaggagaauggcaugaaccugggaggcggagcuugcagugagccgagaucacgccacugcacuccagccugggcgacagagcgagacuccgucccccagaaaaaaaaaaaaaaaagaacuggaacaagacaaagagcccacccucaccacaccuauuccacauaguacugaaaguucuacucagaccagucuagcaagauaaagaaauaaaaggcauccagauaggaaaaaaggaaguuaaauuaucugucuucccuaaugaugugauucuauaccuagaaaacccuaaagacuccaccaaaaggcuccuagaccugauaggcaacuugaguaaaguuucggaauucaaaaucaauguacaaaaaucaguagcauuucuauacaccaguaacauucaagcugagagccaaaucaagaacacaauccaauuuauaauagcuguaaaaacaaaagacaaaaccuaggaauaacuacagaacacuccugaaauaaaucauaggugacagaaacaaauggaaaaacauucugugcuugaggauuggaagaagcaauaucauuaaaauugccaaacugcccaaaacaaucuacagauucaacacuauucuaucaaauugccaacaucauuuuucacagaauuagaaaaaaaacuuauaaaauucaucuggaaccacaaaagcaccugaauagccaaagcaauccuaagcaaaaggaacaaagccaaaggccucacaguauccaacuucaaacuaugcuacagggcuuacaguaaccaaaacagcaugguacugguacagaacaggcacauagaccaauggagcagaauagagagcucagaaauaaugccauguaccugcagccaacugauguucaacaaaauuggcaaaaauaugcaguggggaaaguacucccuauucaauaaauggugcuggggaaacuggcuaacuguaugcagaaggaugaaaccagaccccugccuaucaccacauacaaaaaucaacucauaauggauuaaagauguaaauguaagaccucaaacuauaaggauccucgaagaaaaccuaggaaauacaauauucacaaaguugugcaacuaucaacacaauucauguuuagaauauucucaucagcucccaaaagaaacccucauccaugcacagccacuccuaauuuccucuuguucccaacccccagcucuaggcagccccuaaucuacuuugaugucuguaggccuuuucuggacauuucauguaaaugcagucagaccacuuggggccuucugugacugguuucuuuucacuuagcauaauguuuuguuuguuuguuuuuuggagauggaaucucgcucuaucgcccaggcuggaguacaguggggcgaucuuggcucacugcaaccacugccucgcagguucaagggauucuccugccucagccucccgcguagcuggaauuacaggcaugagccaccacgccuggcuaauuuuucuauuuuuaguagagauggaguuucaccauguuggccaggcuggucucaaacuccugaccuugagugauccacgcccaccucagccucccaaagggcugggauuacaggacugggucaccacacccggcagcauaauguuuucaaaaagauuaucuauauuguagcaucugucaguacuucauucuuuuuuauugcuaaauaauauucgauuccauggacauaccacauuuuauuuauccacacaucuguugauggacauuugggcuguuuccacuuuuuggcucuuagaagaauucugcuaugaaauucauguacaaauuuuuguguggauauaguuucauuucucuuggauuuaugccuggaaguggaauugccaggucaugugguuauaacaguguguuuaacauuuugaugaacugccagacuguuuuccaaagcagccgcaucauuuacauucucaacagcaaugcaugcggguucuaguuuuuccacauccuugacaacaguggcaguuaucugcuuuuuugauuguagccauccucggagaggggcgugaggugauaaucucauugugcuuuugaguugcauuucccuggugauuaaugguguggagcaucauuucaugugcuuacuggcuauuuuuauauuguuuuuggagaaguaaucuguucauauucuucucucauuuauaauuaauuugucuuguuguugaguuucaacaguucuuuguauaaccuagauacaaaucccuuaucagauauaugcuuuccacauuuuuuuauucugaggauuguuuuuucacuugaugguguccuuggaagcacaaaagacuuccaaauuuugaugcaaucccaugccaaguucaggugguaaccccgagugcagggcuuuuccacuccagugcuugcuuuugagccugggacccuuagcucuuggcauucuaauggcuaauguugucuucuuuauugccguuucucauuuuuuccugcagggaugguugcagaagaguacaaugccuuuuucuacucacugguaucccaggacacacaggaaauggcuuacucaaccaagcggcagagauucuugguagaucaagguuauagcuucaagguacauauccauuuggcuucugguuagacuaggaccaaggccuucuugauacccuggccuccaggagaagcgagggccacugucagcaggcaggcaccaagcauuaggagauuagaggccuugccucaaacucccuuuaucucugcaugaaucucugagggcagcuguugguggaaagugugccguccuggcaggacugaggugccauggcacuaugaccagcacugugugaaucugagccccgcagggcugcuuucucagggaugccucucuagguagcuaggagagcucuuccuuucaucagcugguaagcuccaggccuuaguuugccucaguuugccucccagacaucagagcuauccuguacuacaaaucagguauuuuaauaauugggaaauucuaaagcuuuggcuaacuuucacuggcugaggcauuugcuuucuuuccuguuacacaaauauuacguuuaugucaguauuugguguccagagggcuuuauauuuuggggauagauggaggguucuagaaguaggggaauuaaauucccccuaugguccacuaaaaggacaucccuagaacauuagacucccagguucuugauugcaaaagacugcaauccaggcugccuuuugagauacguuuuuaaugugucucuuuaugcauuggugagaguucccauuauuggccuuaggaggacaggguugucugaccuucccucuuuuagcuagaggcagugacacuucagaccucucaugcuggccuagaggacaagaugcuuggguuuugagcccaguuuuuuggaggauuugcaucaugaccuuuuuauccauccaugaaaaucccuguugguaauagcauuccuaccuccugauuccugccgagcugugaggguaagaggagcaccaggucagaaagagcaauucuuugaaaggugaccucgacaaaaaggcacaaugccaugccguaguaguuuguguugguuggagcugugucuucggugcugccuguugaggagcagugguuggaguucccagagucaugacguggaguggcugggccugggcagaugugcacaucgucuguacucuggaucccuggcccagaaggacucagauccuuacuucuaggaauuuucauuuaaugaacauuaugagaauuggagggaaggagaauucccuuuacagaaucaacccaaguuuucugcagggauagggagcccuuguaguaaguuauccccauagaaaugaaaacccagucuccaccaugcuguucuuacucucucagagaagcucuauaaauaaucuuccugauauccuaucauuuucauuuucacgugcucauuccugcuggaagccccaguugcggagcacagcagaugccagggaccuucacaaagggccacagccugugccuuccagucacuugucccuuccuuugucugcuccaagaugugaaggcuacccgaaggagccuuuuaaaaucacuaagauucuuccuguugaucuuccauacaugaucauuuagaugcugugugcugggggcagauuucucugaaauuccugcaucccucuggucuugagaucauuagucaagcucccuguuaaaggcggcuccugaugcuggucucuggaaugcuagggaggagcucuccauuguuggccaccaggguggcugggccuggggagggaagugaccaaagcagguggacccaggagaaggcagaggagggcuggggagagagagcagaaaggggcaugucugcuggcuugggcuuugcaggugaucacgaaacucgcuggcauggaggaggaagacuuggcguuuucgacaaaagaagagcaacagcagcucuuacagaaaguccuggcagccacugaccuggaugccgaggaggaggugguggcuggggaauuuggcuccagauccagccaggugaguaaaugggugaggagguuccaggugucagugcucucacagggcagcguuuguagacacagacacagacauguaguccugccuggaugggcccaugggauuuuuuuggaaauguuggaaaacacggaagagaugaacagaaacaauccuuguugcccuuuuggugugugccccuuguacuguugcacacagcugagcucacaguggcugugacuggucuccugcuuugcucacacgaguauuuguuaaaucuugauguugaagcccaggauggcaagcaggugaccccagcucaccuugguggugacuggagggagcaugaugggcuggggguacguaguucccacacacagggcugccaucccuggcuguggccacacaguucuccucugguuccuccucagugauaaagcugagcccucuagccccuaagacugcucugaggaucaacucuugugguagcuucgauacuuaacuuugaaaaauguagaguucugugaaaauacucaaccuuucauuuauucuacaaauaugccugcucuaggccaaguaaauauauggucuaauuagugagagcaucauuauggagaauuagcaggccuguccaaggggagaagugcacuucagucaggugcguuugaaauucaguugccauuagagccggaaggugagcaacugcuggaccaaggcaagaaggaaacagcugucccugggaaggggcugcccucccuccagccuaaggcuuuccucccccgacccagggggcacucuccaugggaacccaggagagugcucucauugcucucacugguuuuaaggaggugccugguucauucuccucacaggauagcaaugucagcacugaugugguuauccccauuuuacagaugaggucauugaggugcagacauuaauuacuugccucaggguuacucagggacaggaggagccaagagucaagcccagggcuuucuguccuuccacuugauucaaagccuuaugguggugucucaggagauuuuaaggaacuuuugcccuaacuguuaaaaaauucuguucaggccaggcaugguggcucaugucuguaaucccagcacuuugggaggccuaggcgggaggaucaguugaguccaggaguuugagaccagcauggucaacauaucgagacccuguuucucucuuaaaaaaaaaaaguuuguucagaaguuguuauuaagugagguaguguggcauuaugguuaagaacagucugaagccaggcuaccuggguguucaaaucccaucuccuuaagagcuaugugaucuuggauagguuaguuaaucucucugugucucaguuuccucuucuuucagguguggauuauaguaguuuugaggauuagaggagauaaugcauguaaaaugcuuagaacaaugccugagacaguaagcgaucuguaaacauuauuaaaaaugauguauuaaauuuauguaagucuuauaaaauuugcugugauuauaaguauuauaaaaggaguaucuuuucuucuggagacuaacaugggcugguucccccuucccggcaggcaucucggcgcuuuggcaccaugaguucuaugucuggggccgacgacacuguguacauggaguaccacucaucgcggagcaaggcgcccagcaaacauguacacccgcucuucaagcgcuuuaggaaaugaugcuuaggcaggguacuucguucaagaccggcgcuuggcacccuuguuggaaagggauuuucagcauaacauuuuccuuccaccucuuugaccuucccuccagcguuggccaaauugugcugaggaagaugcaucaagggcuuggcugugccuucauaggucaucuaggguuuuauaaaggaggaggagacaauauuuuuucaaacuuuuuggggaguggggucauuucuguauauaaaaaauguuaauauuuaagguguauuuauguuaccguucugaauaaacagaauggaccauugaaccagu

SEQ ID NO: 192746 - RNA, 256696 nt, Homo sapiens
guauagagguauucaaaaaauuuauugaaagcacuguacuaggagcugagaacacgaugaugagcacaacacaguucuucccuuuggaaacauagauaaguggagggaaugucaucacaaauguaaaacuucacuaugagaugaguuccgugauaggauuuucuuagggaaaccugagaaagaguugagacuaaagguaugugucauauuuuucacaaggcaaaacugggggaaugacauauacagaggcuugggcuagaaaaaagauaccguuaguccacuuacuuuugagacaguuuuggcugcuuucccucuucagugcccuguuuuagaacugaguccuuacugaggcuuguaagauggcuauuaugggaggugagaguguuacaaaaugaggcugaagagguagguaaagaagccagaccacuucaggcucccucuggcuuuauuaaagcaagauaaauccaugguggaaaaucagauuugcaagaaaagguaguugaacuagguugcuuauuguugucuagacaagagaccagcuuggacuaguaaaauuagugaaauaagaucguuuauaguuggaugacagagccaacuagacgugguaauaguggagguguccauaacugcuagguguccagcuugcacacugaugagcauaaugacccuagauucagcuggggagcagcauuuaaacagcugaauuuuuaaauuaccuuugagaaacccaaauggucuuuuugcaguagcacauuacucaguagucuaaacuacagaaauaaaccuuaaggccauggguauaaaugagaucugcuggugguagaggaagagggccuagggucugaaguuugagaaacuccacuaauuaauggcaagguaaagcaugauaagccagaaaggauggucagugguaggagcaaaauaggauuauauuaaagaagcaaaagaauguccuaaaaauucucccugggauuaaguaacacagugauugauauuaguggaguagagggaaagauccauguuagagauagcuuaagauagggauuagaugaauugagggcaaugacuaaagauacugcuugcaagaaaacuggcugagaaugagaggaaaaucuuaguugcuuggcgggaggggguuugugguugugaaagauaguuuuguuuaaucuuagucuuaaauuuaaaaccaaguagcaaggaucuagcugagagaauaauugaauacauuaauauaggaggacagacaaagauccugaaaaggcugggagaagagcauccaaagcacagguggagagacaaaaagguuagggcugcuggcagcuguggagagaacuguacgugguaagggggagauauaagauguccugcauaaguauuuucccuguagauugcaaagucaucuauggagaggaaagguacaaaauagucacuggggagagcaggugaauuagauggccaagcaggguggauggaucauuugagguuuggggugacagaucaacugagauccacuuacacuucugaaaacgcaagaacacuuuagaaauuaacaacacuuaaagcuuuuuacaucauuuguaaauaacugguggaacuuaacaccacaaaauaaaguauuauaaagaacuuuauaugaauaaaaauauaugcagucugaaagugaugccucaguccuuuugcaucugggcacuaguugagaaccagcccagcccugggaagacguccucccacuuguacuauugcacagcaggcuagcugcaguucagaauuccagaauguucaucagaugcaucuggucuugguugugguggacacagacacaagauagaaaugaaugauugcuauccuguuccagaaaugaaaaugugguaucaagugaauuuuuacaaaauacuuauucuuccaguuaaaacaaaaagguccuucagcacaacugugcuguaguuaaaccauggccuauaaucccagcacuuugggaggcugaggcaggcggaucacuugaggucaggaguucgagaccagccuccaacauggcaaagcccugucucuacuaaaaauacaaaaagaauuagccggguguuguggugcacgccuguaaucccagcugcucgggagccugagacaggagaaucgcuuaacccaguaaguggaggcugcggugagcugacacggugccgcugcacuccagccugggcgacagagugauaacaucucaaaaaaaaaaaaaaaaagaagcaaaagauaauguauuuucucaugcugaagaaauacuugcaggucugagauuugaauuaagauaccuauuucacaguuucaaaaguaccaguggcgcacacaaccuucccaccccuacccuugacccuucaucaggaucaagucucugucuugaggcgggaagcuuguauaguuuuuauuguuuuugcuguguguuuuccagccagguuguuuguagaugucugagguuuuucuuccaucaggcuaucuuuagacccauuucuucucuaaaauauauuugaaaaauguagaaagauucagaagaaaacagccaaaugaaguauuuuaauuacaucagaaaccaagcugcucuuaaauuuaagauacugaguuaauucaaaaguuucauaauaccaaaagcuauucaauaaauguucccucuaaauagcugugcaaaauaaaguuuguauuuaaacuuuaauauacaaaguuagucugacauuuacaugcauaacgauuuuauucaugaauauuaggcauaauucacccaaaucagugucauuacuuuuguuaacaauucccaaaccaggcucucaaccucacucuuccaaacaggauagugauggagacuuggaggcaauuuauaauccccugauuauauuuucaguagucaaugaauggaacaaugucuugugagccccuaucacuugucucauacggagaaacagggcagcucauuaccagagccugggcaccacauccacuaguuuguaaaacuuagguuuuacacaucucccaucaucacugguggaggcucugagaaugacacuaacucacaacuacuacuucuuaugcgaaccccuccuccucuuacuuccaaggauggucuaacauugucaguguaucaggcuggcaagcauauuuccuuccccaaauguauauucccauaaauaaugggcuauaccgucccaaucuauuuugagauuuguuugagcuaaaaauaaauaaaucccucuuaaaaugcagcuaccuuuaaucuguuccuaugacuggcuuaauuuguuuuacugacauucaaaaagcacugauggaauaauuauucugccuaucaugggaagcaugaacccaucuauuugggauggaagauuucuagauagccagaggugggaagagaacaccagugaaugugagaggagaauacagcagaagaauuaccagaaaaaaagugcuaggagaggaccugaaauaaguacuauguuguaaguuugucuaggauugaaucuguccacucugcagaccuuaagaaauuaaguugcuauucuuccccauucuuagcagccuuugcgugaaaaggcaaggugagguguaaggcaggucacugccagaacucugguggcauugugguggaaauuagaacuuaaaguuguaccuuaaaaauguaccuuuccagcuuccacuggucacuccagccccuucuccgcuuggcagccagaugaguggcuuccuuuuagcacuuggaauaaaacaguaagauccaaacgcuucccacagccuuuaagucccuguguuaucugccuuuccccucaagcucacugcauguuggucuuucagcuccucaaauacccaggcccucuccagagucagcauuuucccuacauuccucacucugauuacaucagccuugcagccacucacauggcuagcuccucaccugccaggucucagcuuuaaaugccacucucugagauggccucugaccacccuaaacauguaaagugaggucacuuuguugcuucucuagcucaggcauuucuuuguaaugcauacuccuauuuguuuuaacuguuuacuuuuaugccuccaggucuaggcuagggucaucaaacuuuuuuauaaagagccagacuguaaacuacauccuguuugugucacguguuacuguuauuuuguuuugcuuuuaaacaacccuuuaaagguguaaaaaccauuacuggcuucugggcuguacaaaggcagcagacuagauuuggcccuuaggccaugguuugcugauugcucagaccagugcucaacacuccuuagaugggcucacuggauauuuacugaauucaaaaucaagaguguccuggagacaggcuuagaaucagugccacugaucagaagaugcaugugaguucuuguaucccgcaaagugaaagcuauucuuccaacuuagaauauguguaaguuuuuuuaauuccugaguggaaauaaaaauuacuacuuguauugaaaccaacuaaaauuuaagacaaaaaaaaaaaaaaaaacaccgaaagauaacugcuuauuaaucaucacaauaacccuaggagguagguuaucuacacuguauaaaaauugaggcuuagaaguuuagcaguauuaaaguuacacaaguaguacacagagaugaaacacaaaugauucaggucagucagaaugcaaagccuaaacuuaaucaugaauauaauuuugaaaaaguacugucaacuuuaaaccaaucgucuauuuggacaaccuauuagcucucccaggcugaucucaucaaauauuaugcagauuauaguagaagcugcguuuaccaugcagaucgccauucuagacugaggcauucauucucuagcugcugggaguguugccugccguguagcucaaaacugagccccuccccaggaacugcccucaguugaagagaaaucccccuucccagaacaucccuuacccagugacuucuauggggugagugugaauguguaaaaguucaacccccuugucccaaaguagaaugaauuugaagagccaucucagcucuagagcucccugugcggaucagcucuugccucugcccaaacccgucuuugacuuucuccccaacaacuauggaucccgugggcacuuuccaacaagcuuccugcaugcagaucuccauuucagaaucuaucuagggaaccuaaccuaaauuagcacaggccuugcuccagucauugauaaaaacaaaaagggccauacaugauagauacugcuggugucaggcuucuuacgugguccaaaaacuguacaugugcuuagaugcauuuuuaugggaugagagucaguagauacaacuggcuuuucuaaaggauccaugaucaaaugacacugaaaaccacaacacgacgaacaacgggcugacccugauccaucagacacaucaacuuuguuuuuagaguuuuacagugguuguuuaaccagauauaaauccaucuaacugucuuauucagcccacauuuuuucccaucuuauuaaaaaauacaucaugagaggcgguaugaaacucuuccugaacuauguuugcuacaguguuccccugauuaucaaauucagcuaaguguuaaagugauuuuguuaaggcagcuagguguucugucugaauuccuuuuuaacuacauuuuaaaaacauuuccagaauuaagguaauugugauggagaagacagaaauaaaacaggacuuaaguaauucuucugucugcuaucaguuaacaaagugagucuaucacuuucucuuuguuucucuggcucaaaauaccuguuguuacuaucgcuuuuuaauuagugaaacaauuguuucuuuauucuggcuccaaauggucuuacaaucuuuguuauccucagcugugccccacuaccucuaccuguuauuccuaacucuucccagauugugccaggguucuugaucaugcacuuuuccuuccaugauuucuccacguucuuuuaaaauacagaaucucagaaugacauuaagguuucauugccugcccuaccucccuaaaggaacuuuccaaagcacaaaaugcuucucaaaauugucaucaauacaacaccuucuucaaaccuuacuauuacuaaccugaugaacuguagcauccccagaacccugagcauccgaagaacgggucaccggaaguggugguacaagaucuguuuuugaacugcagagaaugaguuuuagaauuagugacuggaacaguaucuagaaucauaaauuaaguuggaagagaacuacaguguagauauaaaacauuuccaucagcaaguaaaguucuuuuagacugcacuguuuuggagccaugauggugaugguguacucuggccugcccacuuacuucacuuccgagagaacugaucgcuccccaucugaacacugggaccugcgauacuggcgguaacuucguggcgaaugagaaugccugaugcggauugggucaccuuguguccugaacaagcaaccaagaaacaugaaaacaaacacccaaagucagaaaaggaaaaguaggaguucuuaauauugaaaccgcaaaagaauaacaacuuucagaguuuuaaaaagaacuugacuccuaggguuugaaagccugagugacuuaaauuucacaagaaaaaugcucccuugacaauaugugaaaaugaagcucuuuaaaguauuuguguguauacauauauauauguauguauguauauuuuuuaacaaccaaauuuuaaaugaaauuauuccuuaccguggaauucuucuuaguagcguggaaguaaacaaaaucuauaaugcagacaaaauggcauuccuaauggaaaaaguugguccgcuguccuagcuaccaacauuaagaauucagucuuuacuugaaaauugcuaagaaaguagaucuuaaguguucucuccauaaaaaaaaaguaugugaggugauagauacauuagcuugacuucagcauuucacaauguauacauauaucaaaacaucagauuguauaaacauacacaauuuuuauuugucaauuauaccuuaauaauuaaaaacaaauaaauaauucaaaucuuugaccuaaagauggggacggaggguggcugggguguaccaaccugcuauuuaacuguggugggaaagcagcauagcuacagaagggaaacaaagcaggcacucacuuucucuuaaccaaguacugguaaggcagaaaacacagucaacagguacgguuccucuuacacuggugacuaaggacuccugcugugcuuucacgaagccugcucaaugugcugcuucuaugccagggaugggacugggcucauaugagaguuuuauggucaacauaauucucuugguguaaaauaauggauaaaaaacuuuaucagugagaaucucagaaaagaauuuauuuuaaaacugacauuaaucaggaaaagcccccuuguaccuaccaaguacaaagagguggcuaauaagagaugauagugauuauaguguagaauaaguagcuuuaaugcacacuuuucuuccucuuucgcuacugucaccuaguuuuguuuaaaauguaaagacaaauuaaagcacugucuggaacacaauugaagaauuagaauggauuacucacaagcacuaauaaagcuuuggugagaagauucugaaaggcacucacucuauuuuaguguauggaaucucuuuuaauuguucuucggacaauccggauggauccacaaguucuuuucuguaaaggaauaugcaagaaaaugauaguuguggugcugguauaaaugcuaguaucuuucacaaucggcaggugaguuuucccuuucuaaucuugucccaaaacaguguuaguaaaacuaaugaaaauuuauaaaaacuaaacguguucaaggaaaaauaggagggguaaaaccuuuucuguagcucuuuugccuucuuucaauucuucuacauucagacuccagucauuccccauuucccuauaaaagaucugcuucucuccccugugguaggugucuuuuuucuucuggauuuguuuuccuugguauuuauuuguaaacuauuggccugucugagguccauuuagaggcgagacuaaaugacccaaggugaggaggugucaggguugccuguagauagguguugauaugguuaaggcaccaccaccaugugcuccaugugccugccacacacaguggcaauggcuuuggcaggcaucacgcugaaguugccucucaguaucaggagucuuccuugcaauugcauuaaaacuacauggguuuuaaaacaauaagaaagaaaacuauuacucacugaaugugcuuccauaacucuucuuuugcuuggauaucggggcuucuccuauaaauagagaaaacaacauucaucucugcaaacaugcuucaucucacaaccuaauaacuaacuuuaauaguuuucagacugugaaguucuuauuugccagcugagaacagacaaggaaagacuggacagggagagccauugugaugguuaguauaaagacaccagcagcuaaauugcugcuacugccgcugaaggaaaaucauaaaacccagucauaaccagagcuucauuuaaugaaagaccucagaacugcagggucauaugccuccccauccagugguaacuguacaacgaagaaugauucagggcgucuguuucugaucuuuccagauauuuguaaguaaugguaaaagaagaacucauccugauucuaaaaaguuccaacaugaucugugauuaccuaggagaagcaaccaccaaaaggaaaaagcaacuggugggauggcccugauggcagacuguaccaaugacccaucuuucauguuacaucugguguugcauuucugcaacaaaacuugggccagcaaaugcuaggacuaucaguggccuuggcucaugcugccacccucuuuacgcccuucuccauuccuaacuauugacucugcaaaucuuuucuccaagaaguaugugagcagauauuauaccacuaucuuuaacuuccuagaaugaaaaauucagucagcauucaaguguuuguacucucuguaguaucaacuauuucucccauuguagcaaugaaugcagugaaaucuauuaucacugcaauuguugacacagaaugauuuuucuucauagugagaaaauaagcuuucaucagucccuuuaagagaacagagaucuaguaauaggccaaaagaaagaacaaauaauuaaaagccacugauccuauggaauuguaugugauuaaucuguauuagcauuuggggggcucaauaaugcuuuuaguguaugauaucauuaaugcuuucauucuucucgauucauaagggcaccacuacgguauucugguagggcuuccugaaccuacagaauacacuaagcuacuuuccagccacugaguugaccaaaugguuuuuccuuugugcagggggaaaaaagugaucugucuauaaagaccuuuuaaucaacucaggaugagacaaaacaugaaaaggaaaaagggaugaaaucuuggucucagaccaaauaugguacuguuaaauguagauguucuuuguuuuaagaauaagauuaggcugggcauaguggcucaagccuguaaucccagcacuuugggaggccaagguggguggaucacuugaggucaggaguucaaaaccagccuggccaacauggcaaaaccccaucucuacuaaaaauacaaaaaauuagcugggcaugguggcaugugccuguaauuccaacugcuuaggagguugaggcaugagaaucacuugaaccugggagguggagguugcaguaagccgagaucacaccacugcacuccagucugggcaacagaaugagacccugugccaaaaaaaaaaaaaaaaaauuguauguuucuuacaaaucauagaaacugcuuccuugguguccuguauguauucugccuuuccuacauuugguuggucugauuugcuagauaauauguuaaccccauuaaaugauacugucagagaaagugcuaauauuaaaaagcacuaagguguuauuccauucugacagaaugaugguucagcugugacuauaccccaggaucuauuucuuacagucaaccaagagucugaaguauuacauaauauccagguuaggaagcuauucuacugaucauuauucuuauuucaggaagguaugauagugggcauaucagcuucuucuaguuacagcaggguuucccacccuuggcccuacugacauuuucuauacuaauucugugcugcaggaggcuguccugugcauuguagcaugaucaguagcaccuguggccucuacccaacuagacgccaguagcaccuccccagugugacagccaaaaaugucuguagacaauguccccuuggaagcaaaacugcccccaguuggaaaaccacugauuaaggguaugaccuaggaauuaaguggcuaugguugggugguggaagccaaguuuuuguaaagauccauuaugugaguacuagaauagugcuggagagagugacaguacagcagaaccuaaaucuuaaaagaaugggaaaaugaccgagggugcaguugaugacaacuaccggaaguggugagugguaucaugugagggcaugcaauucaaagcugaaugcuuucaggguggacacggggagaaugaggaaaguuaugaguggccaggaggacauacaccccaugauaucaggccuaguggugagagauagugacuaugaacaauacauuaaaaaaaugauaacaugauaacaguggauaugucugagugcugguauugcagguaauuuuauuuucuuguuuaugcuuuucuauauuuucugaucuuuuuaagccaggagaauuucuuaccuuaguuaucaggaaaaaaaauaagaguguuuucauguuuuuuuuuuuaaauauacuauuauuguaauuccaaaggaaaugcuuuucauucccaucucagaagaauuagagaaauguuaucuuuguuuuuuuuuuuuuuugagagagagucucgcucugucacccaggcuggagugcaguggccccaucucggcucacugcaagcuccgccuccuggauucaagcgauucuccugccucagccucccgaguagcugggauugcaggcaugugccacccugcccagcuaauuuuuguauuuuuaguagagacgggguuucaccauguuggccaggauggucuccaucucuugaccucauaaucugcccaccucagccucccaaaaugcugggauugcaggcgugagccacugugccuagccugagaaauguuaucuuaaucugaacgagaucaucagaccuucuagccauuaacauugguccuaaaagauugaagaguuuagucuuuauuuuuacauucuauagcaccauaaaaguccuauuuuuaacuaaacuaaguucugacguggccaauaguuucaaacaguuuuaaggcgaggaaaaguuccaaagcuuaaaaaaugcuaauuuccucugauugcuagaccaccugugauuucacaaaugucaacacaagcugcauguuaaugaggaauguauuauuuuuaugcuuacaucugcacacacauuuaaucaauaauuuaggaugaauucaugaucugcagcucaguguuaucuuguggauuuagaaagcuguggaauuccagcagucauuuuucuuaauuugaggcacuuaauuaugcagauguuuuacuuaaacucuccaaauaaauuccuaaggaaaggaaauagaacccugaguuguccauagguacgacauauauagaaaauaaacaugcagcccaguauuaguccaguauuuuucaaaagcaucccuccuccacauacaaauauuccacuuuaaauuaaucagagaaauuaguuugaugacacaucauucacaaaucacuuucccuuauuccaaaacccugaaacaaacauaucauaaaucuacaaaggauuuaaacuccaucacugcauauaaucauuuuaaauaucccccaaacuauucaacuauauuaucuaaaaacauaauaugggcaauacauuauccaguaauauauuuacuauauuuuguauauuauacuaaaaaauauggcaguauuuuacucuuuuuuuguccaucuuuauacugaucacuccucugaaaggaaauuuagaguggaaaauauguacauuuauaaaacaucuuuauuuaaggaauucaaagcaccuaacaaauaucccagucauucuuugucacauuccugacgggucaaaauaaaucuaauuaggagaugucuuacucuucucccucccccuccaaaucaaagaagccuuaggaagccacugagaugaacaaccuagcugcugaagaucgcucaggaggcacuuccggguuggggguggggguucauguuauaucuucaccuaacacaccagacuuauauguuuuguguguaacugagaacaucgcccugacggccucaucuuccacaguaucaguacuuuucaauaaaaauaguaagauauuaucaccaccagagggagcccgaaccuucucuugcacccagguuugacccuaccaaaaccauuguuuacgcuuuaauaccucuuccaaauaucccacugaguaaagguucacccauguagaaaagcagguucaacaaagcuuuuuuccuagugauaaacaucaacuguagcugaaaaauguacuaaauagaacuguacuucccaauguuuuaacagagaucuaaucauauuucagcuuaacgcuuuuuaguagaaaacaguuuuguauuuuauacuacucuacucuuaugucucugguauuuaauaaugaauugauuuucuagcuauuuguugcggauaaaauacaaaaaugaauaaugguguaucauaaccuucugacccuuaauggauaccuaauuuacauauacugcaguaggaauuuaagaauaugggaguaauggagagaucagugguuuacuguacaucugaaaugccaaauauacauaaauauuuuuauauaguacauauauuuuaaaauauuuucuauauuauguauauauuauaucugaagauauguguguguguguguauauguauauauauaugaaggauaauuuugauugcuuuccuugaauacugcccuagccauguuuccacuuuuucuaagggaugcggucucacuauguugcccaggcuggucuugaacuccuggccucaagcaaucaucccuccucagccucccaaguagcugggacuacacauacaagccaccauacccagcuuauauuuccacuuuuaaagaaagcuguagugguuccuaaauccucacacaaccaaauucaagucucuaaggacuuuuugugaguugccuuaucuacucucuucauuucucaccaccuccucaucucaaggaaaaacacaaauaccuugcaguguuucuagagaauaacuaagaccugggggaacuuacuaauaaaggcugugacacaggcacaaccucacuuaaugcucagcaaaauccuaagagcgugguaccaucaguguuguagagauggaagcucauggggaucagguaauaagcugaagauccagaaugcaaacaacagcacccagcagguauuuuauuaauugucaaucaaucucaggcuuuuaacagucauaacucaaauaaaggacagagcucaguuugugcuauaugaaguaauccaucauccuuaagaguuacaacauuuguauucaguuguccaccugacauuuccauuaacugccuacuuggcaucucaaaccuaacaaagagaaaucuugauucucucccccccaaaacauuccuggcccaucccuucccaucucaguaaaacacgaugcuacccacucagugcaucugcucagaaacucaaugucauccauaauaccgcucacacuacaaaucugucagcuguacuuccaaaauguauauucaucuacucucuucauuucaccaccaccaucuuuucugagcuaaaagcgucucacguggaccacugcaaaguuuucuaauugcuuuccugcuuccuuucuuccucuuucucaaucugcuuuuuacccaccagagcaacuuuuuuuuuuuuuuuuuuuuuuuuuuuugagauggaguuucacuccuguugcccaggcugaagugcaauggcgccaucucggcuuacugcaaccuccgccucccagcuucaagcaauucuccugacccagccucccaaguagcugggauuacaggcacccaccaccacacccagcuaauuuuuguauuuuuaguagagacgagguuucaccacguuggccaggcuugucuugaacuccugaacucaggugaucggccugccuuggccucccaaagugcugggauuacaggcaugagccaccguccccggccagcaacuucuaaaugaacuacuauccacacaaauauauauauauaauuuuuuuuucuacuuuaacugcacuuuggccguaucagcugagaaaucugacacagguccuacuggacuaaaaucaagguguuggcauggcugcauuccuuucugcagacucaagggaaaauucauuuucuuguguuuuccaucuucuggagcugcccacauuuauucguucaaggccuuuuccucuauuuucaaagccagcaacagcagguugaguccguuucaaacugaaacacucuuccucuucugucaccucuuccacuuuuaagaaacuuaugauuacuuugggccuacuuggauaauccaggauaauaucucugggugagggucaacugauuaacaacagccuuaauuccaccugcaaucuuaacuccucucugccaucuagggucauauauucacacauuauggagauuaagccauggacauauaucaggggucauuauucuucccaccacaguaacuaagguuuuuccuccucuuaauuucuuuauauaaaaacucacuguuuaagcaaagauacauuaacauuuuaauacgaggcuucuaacaggcaaaaauaaaauauaugacaauagcacaaagcacaaguggagcuauauuuuuccaauguuucuaaauuuuaaauguuacaauauucaucuuagggugugauaaggaaccauacugauaagaaucauacuuacagagagaaagcaauaaauaaaaaaauaauaaaaguauagguaagauaucaguagagaaaauaaaauggaguaucaaaaaauauucaguucacacaaaauaaaguaggaagggagcaacaaaccaacaaaaaacaggcguaauaaaccagaaaaaagaacaagaugguagauuuauaucgcaaaauacaaauaauuauguuaacugcuagcaggcuaaacacugaacuuaaaagacagggauugucaggcuagaauuaaaaaaaaaaaacaaaaagaccaacuguacacuguuuacaagagguggacuuuaaauauaaagacauaacuaggcuuaaaguaacagauuaaaaggauauaccaugcaaacaguaaacaugaagaagguaugguagaauuuaugcgugugcauguguaguggacacagagaaaguauugccagaauaaagggucaucaguucaucaggaaggaaaaaaccauacauaugcauacaccuaacaccagagcuucaaaauaacuugaaguaaaaacugacagaauuaaaggaaaaaacagacaaauugacaaucacuguuguagauuuuaacaucccucucucaaugacuacuugaaaaguagaugaagaaauaaaaaaaaagacacaaucugaacacuaucagcuaacugcaucuauucgacaaccaguaacugagacuccucauucuucuugagucuacagauuauucaucauuaaaaaccauaugcuaggccuuaaaacaagucucaauaaauuucaagggauuaaaacuguucagacuuuuuuuuuuaaccacaauggaauuaaauuagaauaauaauaauauuuguagaaaauccugaaauauuuggaaauuaaacacacaacuaaaaaugccagcaucaaaaaaagacaagauacauuaaaaauuauuuugaacuguaugauaacaaaaacaaugucaaaaacaugugagauauaguuaaagcauggcugaaagggaaauuuauaaauuuaugcuuauauuggaaaaguagaaagguuuaaaauaaauguuauccuaagaagaugaaaaaagaagagcagguaaaagacaaaauaaaaagaauaaaaaguacagucaaugaaacagacaacagauagcaaagaaaaagcaacaaaaucuaaaauugguucucugaaaaaaauaaauuaaaaaaaaaugaagagaaaacacaaaucaccaacaucaggaauuaaaguggugauaucacaacagauuucacagauguuaaaagcacagggagaauuauaagcaaauuuuugcugaaagauuugacaacuuagauaaaaaugaaauuauuuuaaaaguauaaauuaucaaaacuuacacauaaguauaaaauaugaauaucucaauaucugucaaagaaacugaauuuguaauuuaaaaccuuccacaaagaacauuccaggcagagauuguuucacuggugaauucuauauuuaaggaagaaaaaaaugcuuuuauauuaacucauucagaaaacagaggaagaaggaauauuucucaaauuauuuuaaaugaccaauauaauauuuuuaccaaaaaccugacauuacaggaaaauuacagaucaauuuuucacaaaaacaaagaaaaaaaucuuaacaagguaaugccaaauagaauccagcuacauacaaaaaggaaaauacaucaugaccacaaggggcuuaugcuaggaaugcaaggaugugucauucaaaauugaauccauuuaauuccuccacgaacacaauaaacccauauaacaacuaucucaacagaugcagaaaaaguuuauaacaaaacucaagacccauucaugaucaaaacucuucacuaacucuuagcaaacuggaaauagaagggaucuuccuaaauugugcagcuagcaucauauauaaugugacauauugaaugcucucccuuuaugaaaaagagcagccaaggaugucugcuuucuuaccacuuguauucaacauuguaacucaacacuguacuacaugaucuagccaguguaagggaaggaacagaaauaaaagacagaaagacuagaaaucaaggaaaacuguucacaaauaugauuguaaccgcagaaaaucguaagaaacugcccccaaccaaaagcuucuagagcuaguaagugaauuuaacaaggcuuaugggguggcaggauguagcaucaguauuuuuaaaaauccuuuguucuucuauauacuaaaaaacaacugaaaaauaaauuuucugaaauauaacaaaauaaauuacuccguacugagaacuauaaaacauugcugcaagaagauaaaaacaaauggaugaauaagauauuuauuuucucaaaauugaucuauacauucaacauauuccuagucaaaagucuuugggggaaggcaguaaaaacugacaaguugauucaaaaauuuacacagaaaugcaaagguccuaauaaaauagcuaaaacaaucuugcauaaagggggagagggaaagccaaaguuggagaauuuacacugcuuuauucaagucuuacuauaaagcuacaguaaccgagacaacaugauggcuuagggauagacaaauagaucaaugaaacaaaauuggcccacaugugagcagucaauucacuuucaacaaaggccacaaggcauuucaaugaaaagucuuuucaaaaauggugguggaacuggauagacuacaggaaaaacaccucucaaucucuacucauccauauacaacaacuaauucuaaauggaacacaaaccuaaguauaaaagcaaaaucgauaaagcugcuagaaaaagauauaagacuaucuuugugaccaugagguaagcaaauaccccuuaagauuaaaaaaaaaaaaaaagccuuaacuagaaaugaaaaaaacugauacacuggucuucaucaaaauuaaaaagucugcucaucaaaaagcaauguuaagaacaugaaaaugcaaaccacagccugggagaaaguauucauucauaacgugcauaucugaaauugaacuuuuauccagaauacauaaauaaccuacaaaugaauaagaaaaaggacaaacaauccaauuaaacuggacaaaaaauuugaacacuuuaaaaaugaagauauaugaauaaccaguaagcacacaaaaaugugguuaucaucauuagccaugaaagaaaugcucacuaaaacuacaauggaaucucuacuucaugccuaguagaauggcgaaaauuaacgcagcaacaaacucaaauacuaacaagaacuggggcagaacaagacccucucguaucuuguuaguggaguauaaaaugacccaaccuuucuggaaaucauuuugguaauuccuuauaaaauuaaacauguggccgggcgugguggcucaugccuguaaccccagcacuuugggaggccgaggcgggcggaucacgaggucaggagaucgagaccauccuggcuaacacggugaaaccccgucucuacuaaauauauaaaaaauuagccgggcgugguggcgggcgccucuugucccagcuacucgggaggcugagacaggagaauggcguggaacccgggaggcggagcuugcagugagccgagacuggccacugcacuccagccugggcgacagagcgagacucugucucaaaaaaaaaaaauaaauaaacacacaaauucccucuaauccagcaauucuacuccuagguauuugcccaagcgaaagaaaacaaauuccacacacauacuuguagagaaugucuauaacgcaauggcaaaaacuggaaacaauucagcuguccaucaagaagagaaugaauaaaaauauugcaguauauacaaaaauuuaaaugaccacugauaccauggaugaagcucaaaaacauguugagugaaaguaguaguauuuuaaaggaguauauauuguguuauuacauuuauaugaaguucgacaagagagaaaaacucaucauagauaucagaacaguggaccaggcgcaguggugcacaccuguaaucucagcacuuugggaggcugagcccgguggaucacuggaggucaggaguuugagaccagccuggccaacauggugaaaccccaucucuacugaaaauagaaaaauuaguuggguguuauggcaggugccuguaaucccagcuacucaggaggcugaggcaggagaauggcuugaacccgggaggcagagguugcagugagccaggauugggccacuguacuccagccugggugacagagaaaaaaaaaaaagaaaaagaaaucagaacagugguugguugugggggugggcacugacuagaaggagcaugaaggaacuuuccgguuaauggaaauauucuauauccugacuggcaggauggauagguuauggauacauuugucaaaauucauuaaacuguacauauaagaugagaggaucuggcuguauguaaauuucaccucaaauugccucaauuuuaaaggcuguuaaaugaaccuccgaccacuugacuaaaaaauuauuaaauucccaggcccacuacaaauaauuacuccauaauauaacugaauuauaguaauaacaauuuuaaauuauucuauuucccaauuuuuauuuacaaaugaaugguuccauuuauuuacuauugccuccaggaauguuuuuugacuucuucaaaacuuauauauaggacuuuuucuaauuuuauuuuacuuuccccuuuuuaaauaaauuaaauguacuacuggcauuuaauugaacucagaaugcuuuagaaauaguuagaaaaacugaaugcuguuuuaagauuuaauaucaaguugccaaaccuuguguauaacaaguccuucauagaaaacuauuccacauggaaagguaaaaauaugguggcaaaagauuuacccgugacuacgcuguaucuaaucuuggguucugcaccuuuuggguaaaguccuucagugaggucugauucuuucuuaucuaaacuuccuuuuuuuuuuaauggaguugggggaaggugcuaucucacaacaaaggaaaucuucauuaacuucagcuuuaaauugacuaccaguuuaauuagguugcuaaaaaaaaauuacagaguaauuaauacaucuguaaggguguacaugguguagugacuauuugcagguuuucuauuacaaaagaaagucaucacucauaaugaugcauuacugauaaaauacacacauauacacgggguuaauuucuaauugaaagguaaacaucuaagacugagaagugucccuuagugucccacaguaaaaagaguccuggugugaaccccccgguacacuccagaguucuuuccuaaucucuuuuaaccugauguggcacucacagcuguccucuugucacccuccugccuggcucccucagagcucccuaccuaccuacccagucucuaccuccacuacccaacauccuuucauuuccuuaucauacacgacuggacuuaaucccuccuccugugaguaaucaacaucagacaucuaacuacccacgaucacaaaaggaucuguacuuagucuuggcucacuuuaaaaaggugagccaugguuuggcaaguggagugggagugaggcgucuaaaucuugauaaugcacagauuuaaaacacacacgcacagaaacuuuaccagcucaaagacaauuaauuugggggacuggcaaucacaccauuacgguguaauugugcucacacauggcguugccuagcaacaggaggagcacgcaaauuccaacacugagguguaaugaaucacucacugacuacuguucacaaauuguauuuugaugggaagauauucacaucugguucagucuggaacaagacuucagagaauugugcagacucaaacugagaagcagcagguauuucaccaacagccuggcucuacaacaaagaagacuauuccuauuuauucaggugaauguauacuuugguuaaaaacaacacaaaacaaaaauauggcuuugagggccuuguuuucaugacauuuuguuuugacugugcuucaacuucuauggcuucaaacaugguuaauaaaugucacaaauauuagaagguaaauaugacaaauaaacaaugaaauaauccuaguugaacuaaaacacuuuagaagaccugaauauccacaugcuacuucaaauucaguguuuuugaaucaagguauaaaaagaguccacauacgaacgagaucugugucuggaucgccuguuguuggggucggcuugguuuuuuuccuuuugucuccuuaauacagcuucccacugaggcgcugaaucaaccauaucauucuccugccguauucugaaaggaaagccaugcaucugaaguuaacaucuacauggauggcgcguuuuagguucauccuaaacuugcuuuuaaauguuauuuaagcagcagaaauuuuauuaugaucauuuauagcuaaagaugcauauuaacugaauuaauauauccauauguagguaagcauauauaaacccucagaaguaaauaauacucaugauauauguaaacacauuauuugcagacuucugauuuuaauuuucuaggaaaaagacauguaucaaaaacuuauuuuaaacauuucuaaguuucgacuaaagaaacucuggugucugcuauagagccaaucuuaaccaaugcuacaaaaucauuauuuuaaaugugcuagucaaaauaguaauaaauaguuuuacuuugaaauacucuuaaaaagucaagcuaauugucaaaguuuucauuaaaaauaggugccaaauauaauucccauuuuuugagagagaaaucuagaaguacaaaaaguuaaauaugguggcauaaugcauuagcugaauaagacacaccauucccaucauggcugcucacauguuuaagacggaaugacaguuggaugcuggaugugggcagggaaggaaugaaaaugaggaaaagagaaaggugggaaagacuuggaagcacaggcacuugacauguaagaucacaagacaguguuaccaaauccucucauuuuuuuaaaaaaagauaauccccaaaucuggauucuuaaagugaacucuucuaauuuuuaagucuugcaaccaauucuaaagcaugauauagacuuaacaaaacccauggaccacacucaaccugcagaaauuuuggacuuccgagguaucaagucuuucaaauaaugaggugcacuauuggcaggagagaagaaguacuuaauuuaugugaaauacugucuugaaugcaccacaaugaugcugugaagccuuuuuuuuuuuuuuuggcaaaacggaaccccuguuauuugaauauuuaacuucuaauuuauguaagcucuucagaaaacugcuccagaguguucaucucccaggguauacagagcggcauggaauugccaggcacucaccccaguacugcaacugcaugagcauaacugcuucgagacaaaaguaaaaagaacaggcaggcuuggaggcauuuccuucucugaacagaugucuuuugguuccucuguuauugcacuuaguauagacugugggcuggauaucuggauuugcuuacaggugcaaaucaguggaugggugacaaauauucauuucacauauaacuuagacauaauguaaagcaaauucaaguugaaaagaacagcacuuugugaggaagaaacuguuuaaaucucucuagauuaaagaagaauugugcuaaguaaaaaacuaucuguaacauacuccaagccuuugaaguguauguauuuccucacuaaaguuuucauuuuuaauaggcuauuauuugaagauuaacaggauacugucaagguauuuuucacagauuuaagagcauaauucuuucucucauugcauguacagaguaaauuuaaauugaacauauacugcuauggaccuuaauauuagaaauaucugaagaaaacuaugagaagguauacuacuugaggucauaauuauuaaucauucuuugaaacaaacacucccauuugaaaauggcauguugguaccugugugugcuguaaacacacacacauuuuuguagccagaaccuacaccuaaaagccauucuguguucaugugacagucagaaacccacaaggcuugcugguaggggagcaguccuggacacccccaggacugaggggucaggguuaggaagagacaaucacggggaaggugcugcgcuggcaagguggcaucucccuuccuacaggaacccacaccuggauugcugggcccaggauuggacacaaaacucaggucuccuaacuccuaacccuggagucuuuuaggaugcagcuuucauucugaacaaaaucacuguccaguugaugggcagaacgaaauuuuacaaugugaaauguuugugucaggaagucggggcgucuaaauauuuuugagaggucaaaccugcuaacaaagcugaggccuaacuugggcaaacacauacuuuuccuagaguaacagacacugaaaaggaagcacaguuacuguauguucauucucaucuauuguggaauucagcuggcuacccucauacucagacuucacucugaugauaaaaaauuaaaacuccugagacauaagcaugcguauuuccuguauccugcuauaauaguaauaaggaccaaaucagaaagaauucaagauuauacauguaccuuuaccuuuuuuucuaacugaaaagucuaaagugagggcagugaaacccugucaguuaauauccuugugauccacauguuucaaagacagaugcccucuacuggcgaugcuguuucauaaauauucuaacaagaugcauuaaaaauguaagagccuuuggagagucacaacagaagcacauuuuccugaguaauggguaguguggcggccuuggccuguaaugaaguuugaaauuacauccuuacaaaagaccucuaguuaauggugccucauuacaagaaugaaagugucauuucuuccacugcugaaccgcuccaaaaaacacaggugcuacuuggaaagaaaaaaauccuagcccuagaagcaagaauauuguagcacuuuguccuuaagaggcaggaguaacuauuuuguuuaugcaugagugaauaaagaaaucuuuaaaugaaaaagauauguuuacugugauaauucugacuuuuuaagucucauuuauucucagguaugggggauccaaauaguuuuuugcuccuuuccugcucuauuuuaaucucgauguauagauuuacaucaugaagaauaaaauaccacaaacauuguuuugacauaguaccuuuuaaaaagucaaaaugugcucuuacaucauagucaucaaagucucaaaaaggaaaaagaguccguugucauuuauguuguggaucuauuaauuuucaaauguugcaucuaaaggugaaccucaauaaacuaacaaacauuuauuuccaguacuaauugauccaauaagucuacauuuauccuauuuugucaauuucuccaucuguaacuauggagggucaacaacugugguaggaaguauaucauaacaagguuuuuguuuuucaguuaauguauaagggagaggguugcuuuagaauacagcaaauucuaaccauguuucagaacagaauucuaauguauuucuuccaucucuuaccaaacuucaacacucuacuuuuccagacuauccauacaauuuagauuuuaacugcauuugacauuuaauuaaggucugcaaagguuuugaagaugaaaugccauauaaucauuugauaacaaugaagaaaaugacuauuccuagccucuucuuuccugucuuaccaauuacaguccuuccucuuuugcaaaauucuucacauuaccaaugaauucuuacacaaauccccgaguuuuauuguguccucucccuuuagcaguuuugcuccuaacagaaccuuucuuuacauaaguucuuaauucacuucuaauucacugagauaaacaccaugcuuaaugcugaaucuaagaagucuuucagagagaauguaaaaugaagcuucaagaugauacaagccauaaacauugcuccugaguuuucuccauucccagcucugccauuaucugacucagagaccuuggacaaacugcuuaucuuuuuuggucaagucucagguuguucauauauaaaauuauggcaaagauccuuucuagcuuuaaaacuugauguuucucuauuuguauuuuauuuccaaaccagacagacacacugaaagaaacuuacacucuucaacuauagcauaacauuccagacaauugcuucacauggccccuccauugccaaaauuaaaucugcaggccccaacugauugugaacuuguguuucucaucaacuguacucauuuuuuuuggaucaccugcuauaaagcaaucuuuuuuuuuucuaguuuuucuucccuagggaaauguauguugguuccaggcaugugucgacauacucccuuaagaccagcaagcaaaaaguucauuugcuuuucccauugucucuaccaucaauaaauuauucuuauuugcucuuaaagguacuucugucucuuccacuuauuccuuacgugcccacuacuacaaugggcuaccucuggcgcaauuucccuuucaaacucuccuguuuucaugaauuuuuaaccuauuuugcccucacucaguaauguaacagcauuccucaguugcugcggcuuuguccuuccacagucaucucugccaaccuugauuauacucuggaagcccuaaaucaaccauaucaaaugucuaaaucuugauauauccuauuaaaguagaaaucagaaacccuugcaucugcaguacggugaacacuguuuccacuagcuuuguacgaacucuucucuccguacccaaaauuuuuaccucguuugcagccccuaaaucaggggcaggacaguaggcaguuccuggcaaggaagcgguuaccuauuuucaagcaagacggaagaaaugcccaucaguuuaaguuugcuaacaucccaaauauauuuuuucccuaggguacagggacaauaaaguucuucuuuaccacucccaaaacaaaauccuaccaaaauugugaucuucuagauuugcccuagucagauauauugucccucuuacagugccaaauuucucacacagaaaugugcuuccucauuuuagaaaaacaauauaaaagaccuuauggaacauaauuaaaauauuuaaaucugucuuaaucuacuauuuagauacuguagacaucugguagacccuaaaagacaucuaaaagaccccaauguuguuagggagaaacuagcaacauucaugccagaacaaacucauguuagaaaacacugacuuauuucuuguucaagggagcugguccccauuuuacagauccugcaggaacuucagaaaauacugagcagugcuggauguuaucaauuuaacagaacuugccugugcagggcacuuucuacuuuucaaagcacaucuauuaucucgggaacuucacaaaccucuagugagguaggcaggucagguauuauuccacuuugcaugugagaaaugaagauucacaggauaaaguaaccagcucaaagccacagaauucuucaaaguggguucaauuucauaguacaggcucccagauuugcauguacauauauauguacacaaacaugcagccugacacugacguacaugacucauguuuaugaugcaaacauccuagaauaaaauuagggaaacguucaaauaguccccuguugucaauuuccucuaguucuacuauuacccuaagcugcucucguuucucuguuuuaauacuugguaggcucccaaguuauuucuacuuuuaugcugauggaaaaaaacgcaccagacuaucucaugucacccacuccuccacaucucccacuuccaaacuucuaagagccuagaaacacaucaaagguaaugaaugaaugaguaauucaaagauucuccucagugaaugcucaaaggacugcugauuuucaucaauagcacaaaggauauuuuguagaaccuuuuccuugaaugucaaggauauuuuauuaagcuuaagacauauccagguaaagcuaguucaucaaagguuucacucuccuaagucuacuugcgagguccuccuucauccuacacccugggcaaguccagcacauggcccauggucucaaaccuacagcaauaagcgagcugcuggcccuucugaucucagggacgagauucaaaauucuaacuaauagaaucuaauauucauguagauuaacuuuauagugccuuguacuagguagguucccaacuucaagaauucaauagaaucaacuguuucacaaauuaguauagcaaaguaaucucuaaagaaaguuuaggcauuuuaguuuuuaauccuaccagugaauugaaacaccaauuucauuucccaguaacaauguaauccuucacuauuuagaugauaaaacuuuguaaguuuuaagggggggguguuacauaaacacccccuuaugaaucugauaaaaacuacagacccuaucuuuagaaaacuacgcacuugacgcccacauacaauuuuacauacaauuucaugggguuaugaaacccccagcaccuacccaugaaucacaaguuaagaauccugguguaaaaauaaccaaagguauaaaguuaggaaaggugggaaaaugaaacauaggaccaaaagaaaaguuggaagaggauggaggagaggacaggagaugccguagcagugaguaacucuggaaguggguauaggacuacguggcucuguacuucaaagugcucucacuucuuacauuucauuugaucuuuacaguaacucauucaacaaaauggaucaguuguuauagcauaccuccccccacucccugccaacuuuaaagagaaaaaaacuaauacuugaauugguuauacaaguugcccaaggucaaguaucagcacacagcaaaaccaagacccagucccaaguccucagguuauucugugucauaccauuggcuccuagggagagagggaauucaaaggaaacagaagaaagaaaaaagacuggaaaggaagcccaggaaacagaaaggaacugggugagaauaauaugauauaaaaagugaaaagugaagcaagagaauggagagggagaugaggauguaguagagaaacuaaaaggagaaauaagaacuuucugucaucuuaaauauuauuaaaaaaaacugugccuccaacuucuaucugguuauaaaaagagagugaaaaauuaucaucucaaaucucaaaaccuagaaagcuguaggauacccaaccggauuaugagaacaguaaagaaagaauaaaguggaaagggguaagggaaaacauaaacgaugucccaaauaaagaagcagggugaauuacucugguguucuaggaaacacgguaggaugaagcccuacaguuagggcacaauuaacacaagggcccuuacacacagagccuuguuagcucuggacccaaaggggacagacagauggggugguuauuuacaguuauauuuuccuaaaauugaaacuaaacaacaaucuuugcuucuaacauuagccuuccagagcugguguggauuauuauuuuuuaaaauuuaaugguugucaaaagccuguuuuggguaaaguugauucauaaauguuguuuuauuaacuuuucuuucucuucacacaaaaugagaaauguuuaaaugguuauccauggaaacaguaaagcagcuuaugcuccaauggguugacuucguggaaaaaagaaaacaauauuuccauggaguggccucaugccuaacagaaaagaccucauuuauguuuaaaaaaaaaaaaaaaauccugcaagaaggaguagcagagggagcaacaucccaaagaccacaugcaacuuccagaaaguaaaagugacucuguccggaguuccaauggauacaucacgggcuccaaaagagguucuaaaaagcaaauuugcccgguaguugucccucuccauaggcuacaguuuccuagagacaggaaagcagggugcaucggcgugcaggcuuuucuuggaaaguaacgaagcaaccuggggcugaguuuagagaccuuaugggcaagagguagaacaucagcauguacaagauucuguuugccccauuauuggguuaccggagugcuguaguaaaagcacaaaggacacugcugagaacuggcuggaucacacugucagccaagaaaaggaaggacgaaugaggcugaagagacugcagggcugcagaugaaauauccagaccuaugcauccucaugugggaugaguggguuccggcaaaauuuaagaggcuaaugaugggauggagggguuggcagcagcacagcauagcagguaaguggcaccaagagacagacagcacaaugaguuuccacccucuuucucuguacaguuaccuguugcgccagaauuugcagugguggggaucagaacugaaagcuauauuucuucuuccucugcccacuuuuugcuaugcuacugacaggcagacuuuauaccacaucuucuacagccauaggcaacuuagguauuccuagagcaauauuucuauacguagcauaaaugauugugaaggccuguuggauuuuuugcaugaaacgugucggaauguguuuugaaagcuauuucucauuacuagccuuacaaagugcauuaaacauucagaaucaccguuauucuaaaauauacuuuuuacacaguacaaagaaagccaaucuaaucuguccaggaaaaagggggaagaaacucuuaagggagaaaauaccuacaagaaauauuaaagccagugcaaccagaucaguaugagcaauuuaauuauuugauggcaaccuuucacuaguguuucauuuucaguagcgaaugguacugugagcaauuuuggcucccccaaaaauguuuuauuuuauuuauuuucagggccaccuucugaacaguugagaacagaacacuuaugggcacaauuuagaauauauuagguaaaacagaaacagacuuaaaauacuggcuugaucaauaaaaaguguuaaauaagaaaauaaguggguauuuuugcuuuguuuuguguuguuugcgcagaaauacugaauuuuuuaucagaaagaggauacuuaagaaggagcuaccucccacauauggguuuucaaagaagaaacugaaaucauuucuuugagaaaggugucguaacacauugagaucucccaucugucuaguguaauuccagccucagaaggcuccacauagaaugcuuuccuaaaaaaauguccacucuuacaaugcugucugggcuauuauuacacaggcuuuguaguuagaggaucacugauucaauuugugccaagcgcaaggguucuaagcauuaaagaaagaccuuggagauuauccaauccaacuuccucacuuuucuuucuuucuuucuuucuuuuuuuuucuauaugagaugaaguuucucucuugcugccaggcuggagugcaauggcacagucucggcucacugcaaccuucaccucccggguucaagcgauucuccugccucugccuccugaguagcugggauuacaggcaugugccaccacgcccagcuaauuuuguauuuuuaguagagacaggguuucuccauguuggucaggcuggucucgaacucccaaccucaggugaucugccugccuuggccucccaaagugcugggauuacaggcgugagccaccgcaccuggccuuccucauuuuucagaagagaaaaaaauuacccagaaaaguaaagcaaccaagccagagguccacauuaggugaaaacagguuucucaacaguggcacuacugauauguuuuuguacuagguacuuauuuguugccagguccuguccugugcaucgcacgauguuuagcagcauccuuggacaguugcaaucccccuauccaauugucacgauaaaaaaugacucuggacauugccaaauguccuuggggagaaggcagggaggacaaaacucccccaguugagaaccacuggguuaacaacuggcaugacuggcaaccaaaucccucugacucccaaggugcucuuuucauuaaugacacaaauacuucuuguuuucgagugcauauuuuggaacuagggauaacugauuaaugcauuaagccaccacuaauacugacuacaugucaaaugaugugauuaaaaauaucuuaaaaaucuaucuuacauauauggaaugucaggcacacacagaugaguaaaugcacauauuauuagcauauauauauauacauaagccugaaaccgcagaaucuaagaaacaaugaguuauuuuugguuggguaaaauauaguaaugccauugaaaagauaguucagggagaaaucuaucuacgaaugguaaacuuucuuaccagccuuagagaaauucacuacacauuguagcuauauacagaaucaucuuuuaaaacacacacacacacacacaagaagggaccucauugucaaguuguuuaaucaucuuauugugaagauaagaaaacuccacucaaagagcuaaaguuuccuaaacuaagugcuucaaaauagugccagauugcuucucagacucagauggaaaaaacagacuuacaaaggacacucaguuucuaccaccaagggcagccucugauuucagagugccaguuaauuauaauauugagauauuaccuguuucucuuuuuccgguauucucuauuagaauuuucugauucacuaccacugcugguguuacagcgugaacgugaccugaagacaaaaagguaagaacaaaagaaaaaacacacauuuauaacucacgaacaauuucagaaagguuuauauggguccucuggaauucauuuugcaguaaaauuaucaauccaaacaucaagagcuguauuaucccucuccaagucaguguuucugaacucaguaagacaucugacugagucuauagcucagggaaauggcaaugcaggggaaauauaaaaaccgauuaaggugaaugucaguauguucccagaacggaccgcaaaaucaaucacuuccaacagaacucugacauggcaaagccguaagucggugguggacuaaauauggacacaaaaucuuguaacccucccauccgccccacugagagacguagaguuuauuucccuauccucugaauuuacacuggucuugugacugauuuuaccaauagaaugagguggaagggauacuaugucaguuccaggacuagccccuuaaccgacugguagcuucugcuuccucccagccuaaagaaguguaaaagaagugucuacagaaguguaagcuagccagguggagaaacuaugcagagaggucccaggccuccagccuuucugccaagaugccaacacgaaagagaaaggcccccuggauaacacaaccucagcugucaucugaccacagccucaugaaaucgugaacaagacgagcuaaaaagcugccuguucaauggacagaauuauacuagauaaauagaguuguugcugcuuuaagccacugaguucugcagugguuuauaauauggcaacagauaaauaagacagcuccucugagacacaaaggagcaggaaacagcacagucuuaggaugcaacagaauggaagacugggaaucagcugaagacaaacuggcuuuugaaaguaaaaaaaauaaaaaaaaauaaugcccccgcucuuuccuuaacucugagcauuucuaaaucugcuaacccuucuucccucugacuguccuuccauuuuuguuuuuuuaccuccuccuuugcuuaagaucugaaucuucaccacuguuaugggcuuuccugugaaaacaaaugaagacauuuaagaaaacaggagauuaucaauuggcuaaggaaagcacaccaaaaugaguuucacuucaguuaacacauauuugucauacauucauucauuugccaaacauuuacgucauauguauaugccuaacccuacauacaacacgucccagaaauauaauguuaauaacaucaccuggccucacucuaguggaaccugcaaaccguccgaauuccauuaauccaaugaugagguuagucugcaguuucagaacugcaauccuccaagcugauuucugccauaguggaacugacaucaucucacuuggaugcccuuucccauacccugaggcuccaaauucucuuuaucucuucucucauaaucuccuccacuucaacucagcaaccuaccucauacuuacgacuuuaucaucuguaaccaccuccaaacacuuugcucucuuaccacaaucuccucuuccuccuguuuaccacucgccauuuacuuucaaacagcuucaauggggcauccugguuaaaggugcuggcucuagagccagacaacaugaaugugaaucccaucuucuccacugaugaguuaugugauuuaaauaaguuacuuuucuacucagugacucauuuuuaauagaaucuccuuuaaagucuccucuaaaggauaaaacgaauuaauacauuuaaaaugcauacacuaggaccugggccauuguuagcacucaaccaagauaagcuguuauugcuuauucaacuauuuccauucuuccuuuucuuugaccccaauaagacuaucuauugaccuggcuacucuccaccagcucuucacuucucuucacugucuucuguacucagcuuagauuuccuaauccaucauuucaauaacaugcaugcugauacucaacauguuccucaacucuguuuuucauuccaucuuuuuggcaaaaucccaggcaugggugaauccaacuaugcaaguuuucuggaucaguccuaaacagcuggcugagcagugcuggaaggagucacacaaaagcgguguauuacacuacaaauccauguucauuaacuucaaguggggccacaccacgguucagcaauccugccacuuuucacagaucuaaguacaaagugguuucaaacucuccacccugcaacccucugacccacaguacuccuguuucagcaaaugauuuuguuuucuccuuccgaaggaaaaagcagccuccagauguaacucuuucaucuuccugcuaccaaaaauaaaaacuuaccaacaucuuccucucuguuauuuauggauuuauccuuacuaccaagguuagucccuccaccagugcuuuguggucccaucacccugugucuuuucaaugacuuucauuaacuacccucccaccucucacacagucaccuugcccgucuagcagacucuuuuuacaagcuauuaacuuuuucaagacucuacuguuuaaacaaacauagaccuacuuugaguccacauccccccucaucugcccagucucuccucucuccuucaaagccaaacuuuuggagaguggugucuaugccccaugcuccauuuccuuacaaucuguaaucuagcaccuucccauucugaucucuuuaacguauggcuuacguuacuccauuuccuccaacacacuuauaucaaauaacaugaacagcaauauguggucucuguucuuacaucaaauuuuggggucacuauuuagcauaaacacaauuauaccgaaauuggucacagacgaucuaaauaguguuccaggaauaugauuccauucuuuuguagguuuuaaauuuucuaagagaagauacuugccuaaguuuuccauguacauaucacuugcuuaggguucuuuugcuuaucacuaauucuucaaacucugagagaacagcaaaacuccugcuauggauggauacucagguaaucugcaaguuccauuuaucccuccuggagcccucugcccuccugcucauaccuggaccuuugacuaacuccccuuuaccaugauccaaggaacuccuuuugcuucuugauaugauggacccuacaucuccaggucuuuuggcuacuugucuggguuuugguaaaguguaucuuuuaguugcuaacagaaaaauuugcaugacagauacacuuuuuuggaacccaaaauuucugaaaaugucuuuauucuauacaaacaauuaugguuaucugggcauagacuccuaaacugaaaauaaucuuucagacuucugaaggcaauacuucuuugccuucuuccucugauauuacuguuaagcagcccaauuuuuuuuucuuuuuuuuugagacggaguuucacucuuguggcccaaccuggaguacaguggugcgaucucagcucacugcaaccuccgccuuccggguucaagugauuuuccugccucagccuccaccaguagcugggauuacaggcaugcaccaccacgccuggcuaguuuguauuuuuaguagagacaggguuucaccauguuggguaggcuagucuugaacuucugaccucaggugaucggcccaccucggccucucaaagugcugggauuacaggcaugagccaccguacauggcucccaaugucauuuugauuugucacuauuuguacauggauauuuuuuucucucccauauucccaugcccccuccaaaucuuuagaauucuuuguuaaucuauaauguuuugaaauuuaguuauaaugaaccuucgaaugaaucuaacuuuucaaccgauuaugucaaaugcuuaguggguucuucucuauaaugucacauccuucaguuccggaauauucgcuuugcuguuucuuuaauaguuuccucuccuauguuuucucuguucuuuuuucuuagaaauuguauuaguugaauguuugauaucuagguuugauaauuuuauuauucuuauuuccauacauuuguuuuauuguggguuuuuugguuccguuuuggagaagauuuucuuaauguuaccuuccaaauauuuuacucauuuuaaauucugccacacuaauuuuaagccuaauaacucuuauuuauuaguucuuaccuuuguauugauagaaauucaugguuauauuuuuucaucuuucuaaauaauuaguuuuuuagaaauuuuuauuucuuauauugucuguuuccugugagaaugcccccaaccccacccuacaccccauuuguuuguuuuagucucugccuuucuagacagaagcaaugcucaaaugcaggcguucauggcucucucuuccuauucaagcaguaaguguuaaaaugacuggagcccuuuggauggugcagugcacguuaauuaauggccucacaguaauaugagggcagccucaaucauuucacuggaugauccuuugaaaguaaguauauguaagucuuuucucuuguaccuaguccauuuccugcagugagauucucuagucucaugccugggagauauaaccguuucaauggaagaugcuuugaaagcuaguauccauagucuuuucucuugucccuguccaucucuuacaaagggauucucuaauuuucugccuagguaauauaagccuggauucuaguauucugggaaugaagagagaagggagacauuugguaugcaaauuuucacucucuugauuuuuccauggccacaaucucucuuucuccuuuaccaguuaaucuucaauuaagccaaaugcuggagcuucuuacaacucugucauuggcuuugucuuuuugcauucuaucuauacuauccaccuaaacaaccuaaucucuauauuucaaguaacauacuuaagauuauauuucgguccauaaagcaaaucaagccccugacuuccauucacaacccaugugaaucccacacuuggacuucucagaaguaccauaaauucaggauaucagaaucuaaacuggcaauugucccuuucaagccugugaaguccugaugauucuacuucuacgcaacacaucgaauucaaaaaacugaacaagccuggguuucauucuggacagcucccucuccucuaccccucauacugauucuccuaccaauuuuaccucucacuggcuacugaaaccaucuacuucuuuauauuuccacaucaccaccuugguccaugcucccauucucuauugcuaggacucggacaauagccugcugccuggucuucugcuacuacccacuuucaccauuucuccacaggacagugagggucaucuguacaaacacaaaugugauguuauuguacuuccuguaaaaaaccacuggucuaaggaccaaaauccugaacaaaguccaggugggcuguaagaucagaucccaucuuucucucuaugcucauuucuaacacauuuuuauucacucucagagucugauaaacacuggccuuuuucguuuucaugaagguuuccugcuucuuuccauucccaaugcuuuugcacaugcuagccccucuaucugguaugauugcuccuuucuuuuagccuguuuguaucucagauccuggcgcaagcauccaaccucaggaaacuaaccccaaccucuuuggcucagugauucagcaaacuuccccuaacagugcucauuacacaggcaucuauuuauaaaaauuuaucaugcauuacacuuaugacacguguacuuuucuguaugcaugcuagguuucaauaaaaaguuuuuaaaauucccuuaaguaccacauagcuuaccuucauauuauguauuaaagucacaauggcacauauauuccuaugacucauguauuuaucccuuaacagcaucuaagcucccaaaggacaacaacuuugucuaauggcagcagcacacugcauggcauacaacaggcacccaaacauuuuuuaauguaaaauugaaagcugaggagugaaaauauauuguacuaccaggaaauaugcugacuuucuuuuucuagaauaggaacguuuaaacaagcaggcuucagggucuccauaaauuuugaaaauuauaugcagauguuuauauguauuuaaauaugaaccuaccuuucccuaaggaaugaauccaacauuucaccagaucucagaggguaguaccacccaaaaagguuaaggaccacuauucuggacucggccagaauuugauagcuuguauccaccucaugauaaacaaaauaggaaauuuugacaucuauugcaaaguguauuauccugguauccaaagcaaaauauaauuuccuauuauuaaauuuaaguccuugagauucuuccaugcugaugacaugucuugauuuuaaaugccaguguuaauccagcaauguagagguuugugcugagugcaagguaaauaugugugaagauaaaaaagacugacaaggacaacgacacuuauagggcauucauacugggaagaaacagagaagaaugugcuuuaguccuuuuuaugucaacaugcagcaauggcucauugccucaaaacacacguccccaaaagagaccuguaagugcaucaggcaaaaggcucuauggaugcucaggcaaaaagauccucuucccagcaaauuuaaauagccuuccccuggaauacgccaaugaaaggauccuguauccacucuccacaauuacuucucuguguuucacaggaagccagcggaaaaugaaccucaguguagaagucaagucuggauuugggaguguauaugcugcaaacuauuucaagcaauuauuuuguaugaaaauaugcaaauuuagccauauuuuagcaaaauguaauuaagcucauuuucaaauguauuaaaaugacuaucugcucaacauguguaauuauuuuauauagggagugcugacaaauugcacuaauuaauuaaggguagaaaacuauaaaacucuaucuacgaauaauauaugcuaaauucuaaucaucccugccaccuaugucgccucaacacacaauacacacaaaugcacuuuaaaguauuucccagugguguugcuuugguuuuaaguauuguccaaauugaaccaacucuugguguucccaaggagaaugcugaguaagggcugaaguacaguuuauuuaaaugagggcuaucacuaucuccaccuuuuucagauguacaggcugggauuccaaucccaugugugccacagaggacaagcuaccaucaucucccugagccucaguuuucucaucuguaaaacugagauggugauggugggcugaauauuuuucauugguacucagccucuacugacucaucuauaaucuacucucuacugcagagauagaaagccuggaaauuuuauauuccuggacacuuugccagcuggguucuaguuaagagagacuccaguuagaucugaaggcagagaacaggaaaaguuauuuuccuucuaguuguaccuguggcaucaacucuugcacuccugagaaguggggguucuuuguucggcuacaguggugguaucuccagcagugucagcaagaguggucccugucuagcauccaucacggugccugcagcauugucagcagcaagcacaggcucaggauugccugcucaaagguggaagcggcuucuggucuccagguaacacccacuucucucuuugcauuccuucaguccagaggcaguaaaagcagcuagaucucuugaguuacaccacucucugcuuuuugcaccuucaauccuacuuauaccuuugcaccaauucccuacuuaaucccccucugcuagaaucacaucaugccugaauacaaaugccauuucccaaaggguuauuauugggauuacaugagauaauauagagcaagcacuuugcucaguacuuggaauauggcaauaccaaacaaaugccuacuauuacccuauuauucugucuaaucauuguuggaccugaucuagcacccucaugucaguccuacuacaugaagguaauauagacccuucucuucuuaaccaucaaaggauuucagugaaguugaacuugguuucagaaagcugggggcaaagcucugggaaacuagcagaagcaaaagggaucaagcaggaaaaggccagcaaguguguauuaacuagggcauaggugaaagaagggcuuggcuuccaaaccugcagugugcacaaaaagagucuugaugguuaccugacaucaugaacugaaacuucuuguaaguauaaaagucauuuaggcugggugcagugacucaugccuguaaucccagcaauuugggagacugaggugggaggacugcuugaggcuaggaauucaagaccagccugggcaacauaacaagugagaccccaucucuacuuuaauuuauacauuuuuauuuuuuuaaaaaaggaaaaagaggccgggcgcggugacucaugccuguaaucccagcauuuugggaggcugaggcagagggaucacgaggucaggaguucgagaccaacguggagaaacccuaucccuacuaaaaauaaaaaaauuagccgggccugauggcgcaugccuguaaucccagcuacucagggggcugaggcaggagaaucgcucgaacccagggggcagaguuugcagugagccaagaucaugccacuacacuccagccugggcaucagagcgagacuccaucucaaaaacaaaaacaaaaaccacaaaaaccaaaaaaaggaaaaagucauuuauacaaugccaauuauguagguacucaaaauaaaacacagucccugccauguaggagugaaaagaauuucacugaugagucauuucuacaucuuccucucuuguaccugucacacugcccagccugcuuugcagagagguccaaaacuuccagcuaagaacuuuuuaaauuaagcauacacacacaaauauuaucccuucaaacacucuacccguauagguaaaauguaacaggauucauuuuuuucugugcuuuaaaaggcguuuuucagcuaaaaaggcuuaucuuuaaguguaguuuugucuucucagguagaaacacuuaauauguuuuauauauuaacauauacuaucucgucugggcgcaguggcuuacaccuguaaucccagcacuuugggaggccgaggcggguggaucaccugagguugggaguucgagaccagccugaccaacauggaaaaaccccuacuaaaaauacaaaaaaaucagccgggcguggcagcacaugccuguaaucucagcuacuggggaggcugaggcaggagaaucgccugaacccaggaggcggagguugcagugagcugagaucgugccacugcacuccagccuaggcaacaagagugaaacuccgucucaaaaaaaaaaagauauacugucucuacuuuguaauauacuauauauaauacauauuuuuauuauauauuauauacuauuuuuagacacauuauucauaaauagaauacagaaagcaaguuccugccaauauuuuaugaaauuauucucuaaaacucuggcuguuuacgauaaauacuucaggauuccuaacuuauuuuaugucaaaaagaguaagcugcuuguuaucuuggagagaaacaguaaugucgguauaagaaucaccuauuauaaagucaggccugggacaaaaugcuucuguugaaagcugcuaacagagagauuguguuccgcuuaccuccuccucacaggcuguacagaaucauugucacuuccacaggagggguuucggcgacgcguguaagggaacuuuggcgacuuagugcgaucacugggagaauuguagaguccacuggagagaaagaaaaauggucaaaaagagcccagagaguuccugggggaaaacacaccgcagcccagaccuauucauaacugcacagcugguacuuccagaggcacaugcaccaggggcacgugguucucuuugcugacaagauuuauuaaaagaaaagagguaagaucuggcaaaucaaaucauaaaggucauuauuuugcaggaaugccauuugucucacuagccuucaguaguaaaaaaugaacacacacaaauaacaauaacaauucauacauaugaugaauuuagcccuuucuaaacacugacucagcuaaagacuuuacauucauuaucucagcuaaucuucauaucagccuucagcacugagauacaacuauuaaaccuauuaaacagaaaaaaaauugaaauauagacuacuuaauuaaguggcccaaauaaaguagcuaggaaguggcagggcuagaauuugaacuauaaguuacaacacaggucugucacugguuugguaguugugaccagagauacacuagacauauccauauuuuuaggaauaaaggucuuccagcauaacuauucaucagcuauaguuuuugacuuaaguuuuuaaccaaaacuaugaaauggggaaaauuauuaauaugccauuuagaguuuucagaaauauauuaccuuacaggcaauuucauaauauuuccuagguuucccuuuugccuuuccaggaaaaaguuucauguuauaaaacauacuguugauuuccacuucagaaaucccagccccucuccccugggucacauugauuuagagucugcccacuuuauccacagcuagcugugaucagccacccagcagcuggauuccuuuauucaaugagcugcauguacuaaccccuuuucuacugucuccuuuauaaaaacaaugauucccuuuaccucugggggccauuuucuucccacggugcaugagauuugcuucuuuggguaucagggcuauuuucauucuuugcuuucuuaaagcuuuaauuuuaaaaaaaaguaugagaaauaaauuaaguagaaaauaaaaguaaacucacauacuuauuuguuaaguaaaacuuuuuaacaaauguuaagaugugcacacuuauuugcuuguuuauaccugugacucuaaaaagaacaugaagucgcugcccauaaaaucugucuccagcaaguaccuuugggucuuuccccccucuuucuuucuaguuuuacugcuuuagucaacagaugccagguccaucaauuguuaagaaacucuagaguccaccugcaggagaggcagcaaggggaaccacagagccaagaaaauaagaaagccaaggaggaaggaccugggcuacccaggaucuucagccuggcucccuuuuuacaacagugaucagagaagcccuuacuccaggcacgggucugaauccacacaggucggucagccccgggcagguucaggcuauucaaacugaccuuuuccuggcuuccgccuuaucuuggcuucaucccuccagaugagaaugacuuucaaaugcuauuuccugaccuaguaucaucuuucaguccuaagaauguaaauguaacugaguuguucuacccucaacaaauuguuuuagaaaccccuggggagacauggaggaagggacuaaucagaagccuccaggcaccaguggggaggggugugucaccucucacauccucaggagucuuagcuuaagauaaagauagagcuauuuaacuccaaauccacuuuuaacccuggcuuuuugaggaauccucuguauaacuguccuaggauagggucauagaggaguacuuuguaacagccaacaaagaggagagaggaaagaugacgagguauuaaaaaaaaaaaaagacuugcacccuaguauacuauccaugauggaauuaaaguaagccuauaaaauuuuguaucugacagaggcauauaacccauaguauuaguagauggcagcuuaguuuauuauuuuuauaaaggcuaaaaaccucuacagauucaauucccaaaguaaaagcuuaccuuuugaaaugaugaaaauuaacaaauauggcagauauuuaauacgauaguagaaaguguaugggaucaauaaaucagaaaaagcaaagagaagggagaagggagacuggaaaagaaauagggagauaaaagaggaacugagagaguauacaaaaguuaaagaauaauaaaauccugggugacaaguuaauugcauucacacccuaagguauuucucaucugaagcuugagaggaaaacuuugguggugcuucaaguaccaguaucaucacaggaaugugguugcaaaggggauugaaaaauauuguuaaaauggccauacagcccaaagcaauauacagaugcaaugcuauuccuaucaaacuaccaacaucauuuuuucacaggaaagaacuauucuaaaauggacccucccuccaaaaaagcccaaacagccaaagcaauucuaagcagaaagaacaaagcuggaggcaucacacuaccugacuucaaacuguacuacaaggcuacaguaacaaaaacagcaugguaugguacaaaaacugacaaaaagaccaaugcaauaggauagagaacccagaaacaaagucauacaccuacaaccaucugaucuucaacaaaagcaacuagaacaagcaauggggaaaggacucccuaaauggugcugggauggccagucauaugcagaagagugaaacuggaccucuuccuuuuacuauauucaaaaauccacucaagauagauuaagaacuuaaauguaagaccucaaacuaugaaaauacaucuuagaagaaaaccuaggaaauaucauucuggacaucagccuuggugaagaauuuauaacuaaguccccaaaagcaauugcaacaaaaccaaaaauugacaagugagacuuuaaagagcuucugcacaacaaaagaaacuaucaacagaguaaacagacaaucuacagaaaaggagaaaauauucacaaacuauguaucugacaaaggucuaauauccagaaucuauaaggaacuucaacaauucaacaagaugaaacaaacaaugccauuaaaaaaugggcaaaggacaucaacaggcacuuuuccaaagaagacauacaugcaaccaacaaauacaugaaaaaaugcucaacaucauuaaucauucgaaaaaagcaaauuaaaaucacaauaagacaccaucuccccagucagaauaccuauuauuaaaaagacaaaaaauaaagauguuggcaagauuguggaaaaaagggaacacuuuuacacuguugggggaaauauaaauuagcucagccauuguggaaagcaguuuggagauuucucaaagaacuuaaaacagaaccaccauuugauccaacaauuccacuacuggauauauacucaaagggaaacaaaucauucuacaaaaaaagacauauggcugggcgcaauggcucacaccuguaaucccagcacuuugggaugccaaggcaggcggaucccgaggucaagagaugcagaccauccuggccaaccugguaaaaccccaucucuaccaaaccuacaaaaauuagcugggagugguggcacacgccuguagucccagcuacuugggaggcugaggcaggagaaucgcuugaacccaggaugcggagguugcagugagucaagauggugccacuccacuccauccuggcaacagagggagacuccaucucaaaaaaaaaaaaaaaaaaagacacauacacuuacaugcucauugcagcacuauucacaauagcaaggacauagaaucagccuagaugaccaugaacaguggacuggauaaagcaaauauggaacauauacaccauggaauacuacacagccauaaaaaagaaugaaaccauguccuuugcggcaacacggacgcaacuggaggcuauuauccuaaguuaauuaacacagaaacagaaaacuagauacugcauguucucacuuauaagugggaacuaaacauugaguacacauggacauaaagaugggaacaauagacacuggggaccacuagaggaggagagggggcaaggguugaaaacuaccuaucacguacugugcucacuaccugagugaugggaucaugcauacaccaaaccucagugauaaacaauuuacccaugugacaaaccuacuggcacacguaccccuggaccuaaaauaaaaguugaaaaaauaaauuuuuaaaaggaggauuguacuccuucugcacauucuaaaaaagcgugggaucugaaucucauggaagauuccuguucuuaugcugaacauaccacaagcauacccuguacauacagaugaagcugaaucucuauccacagcuugagggugacuaagggaaauacaguaaacuaaaguuaugcaaugauaaagaacuugucauccuaaaaggagaaccaguaaaugucuuagaaccaaacaaaacauaggcaaaucccugcguaaaauauuaaaacucugagaaucuucagaucuuaaaguuaucuugcugagaaauuaugaacuauacuccucaaaguagccacaauacagcugaaugaagccacuauuauuuaccaaaaaaauaucaaguagaugaucuaagaagucuuugcaggucacauaucucugauugcugggauuuccccaugauguauggggggcaaccccuauagagaaagugagcucaugaaagcugcucauuguuguuuauaaugcuguuccgugaacauaauuggagagaagaaaaaaugacucugcaacagugucuuaacagaaaacaaggcuuagcucucagggaaacaauccauguaauauauuaagagaaggcuuuuccacuggggaaugcccccugggaaagcagaugcagaggaccaugacaagucuucauacauaugcaaucacugacuucugaggaucugaugccucuaaaugccauaaacccucuuuccagggcuacaguucagugcaccacuauaaugaacacaguacauuaaacaugaauaucaucuacuuuauuuuacaagucccucugaguuaguccauuauaucaugccauuuucaaaaucacaagaaauuuuuaauuuucugcggagaaugcagaccacagacaaucugugaguucaccuugugacaaaaagagcacuuucuucaaauaagagagucagguccugauguuuuauauuucauugguguuuuaauguauuauuuggcccagagauuuauuggaucccauggaucaaaaguauucauuaaucaucaaaguuaaaagauuuuuaaccuugucuacagaaaaaaagcauuuuuacaacagcauauaauuguacguuucuucaguuaacuucacugaccuuuuuacuggugaaggugcaauaauuuuaauuguuccuucauuuucuccauuuuccauguuugcaguuauccuacugaugcuguuugauucuagcagaggaggagaaggaaagauggaagagagaggaaacagugauaaggaaaugaaagaaacagaagacuuauuuuaaaaugcaauuuuagggacacuguggcacauuuuauugauaaauuauaaccccaaauaaauaaugaaucacccaauaaauuggagguacuauuuucuaacguguacuaaacccucaacauaacaauguccugggagucuaggcuauuuuuuucagacuuuaaaacuaagucuccacaucuuuagauguuaaaauaacauucacuuuagacuauuaaaaugauauucugagauauuuaguaccauauauuagaauauaaaacauaaugaucagguuuugaugacuacuugugaagaaguuucucagcauaucaugacaguccccauuugaaaucaaaccaaacaaaaaacuucaaaccugaaaauaucccaacucauaaugcagcugucaaaaaaagaguaauauacaugugaucuguaucacucacauauaaaaaaaagacauuuucaaauguguucuucaugcaaacauuccuaaaaaucugaaacugaauuuuuaaaaguuguuauuccauagauuugcauacacgcuagaggaaccagcagagggagcccauggcagacacaauguuggaagucaugaucgaaauaaagauaacugaagggucugggcccauguaggaggucaggcuuccacucucagggcagagguagauaagccugcagaagugaggugugugggcucugggaacaacucuucuccagugugcauguaccucacucaaggaggaggcaguuuagaugaucaggggaaaucagcaugcacagaugcccacaggcccuguucaauuaggucuaugugccauacaggugugucuuccucggagcuacuccugcagggguaauaguuacgguccuucaauccaaugcauaacggucacuaaccaccgagaaugucaugaagaugaguuuguaacauuaauaagcacuaauauuuauugaguacuuacuaugugucagguacuauuacaagcgcuucacaucuauuuacucauguauccucaaaauaauccuaugaaguagauaucaauguuaucucauuuuaaaagauuuaaaaaaaaugggccuuucucaaggucccacagcuccugagugguggggcaagcuuugaagaugggcagucuggcuccacagacuuagcucugaaccacacacuacuuccaccuguggccccacaagcagcucaagagucagucuagauuaggagucaacugggagagacagacucuuaaaagggcaagugggccaggcgcaguggcucacgccugucaucccagcacuuugggaagccgaggcgggcggaucacgaggucaggaguucaagaccacucuggccaacaaggcaaaaccccaucucuacuaaaaauauaaaaauuagcugggcaugguggcgcaugccuguaaucccagauacucaggaggcugaggcaggagaauugcuugaacugggacccgggagguggagguuguagugagcugagauugcgccacuacacuccagcccuggcuacagagcgagacuccgucucaaaaaaaaaaaaaaaacccacacagcaagugaaagugauguucaaugagaagaacacuucagagcaaggcaagaggacaagacaagagaaacaccugagcacccucaaaguuggcaaguuuccuccagagcaguugggaaguaugucuggcuuacccaucaggaaagauaaacauuaauaaauacacuuuagacagagaaaacaaagggugguuucagauaagaguuccaaaaacuguuacucuaaggcauuugacaugggauuccauaucugaauuguguuccuauuuuggaaucuugaaaugaaaaggugagccugaagacaccuguggcacaaaagguaagcucaugcuggagccacuaccaauaacugagcaacauccagaagccaggaauaagaaaagacuaauguuaggguaaauucugccuggugugauaaauggaacacaaccaauuaauucccuggaacuacuccacgugccaucaaacgucagcaguggccagucaccaucuuagucaauuuugccauaaccaugugaccauuaacaaaaucacaagggcagauucucaaaauugcaggcaaagauuugggaugaagcugcuucucacagguagaacuccaugugguacacgucuggggcaguggcagaagggacuaauucauuuagguccuagacaguaggugugcccuaccauuaguuguuuuuguuuuuuuuuuucuccugagacagagucuugcuuugucgcccaugcuggagugcagugacaugaucucagcucacugcaaccucugccuccucgguucaagcaauucuccugccucagacucccaaguagcugggauuacaggcgcaugacacugaguccagcuaauuuuuuuauaauuuuaguagagacaggguuucaccaucuuggccaggcuggucuggaacuccugaccucaagugauccacccaccuuggccucccaaagugcugggauuacaggugugagccacugugcccagcccccuaacauuaguauuuuuaauuguucuuaauaaccuuuauuuaaauguggugguauucuuagcagauauuacuaauauuuaauauaaaugaaaaggagcuucauguccuagggcuguuuuccuaggcugggagagggggccacagcagagagaccaauacccagugucaauaacaccaacugaaaaaagcugaguaaaggugaacauccuguuaaccaaggcccugaguaacuagcuuaagaaaagaccuagguuugcucccacccucauucucuuuagacugacuacuuuuuucuuagucuaacaaucaauuacuuuaggaaaagugccuaaucaccuucaccuguuucccuuccauccaaaaauuaacagagaaaaacagaauauuuuuaaaaagaaaaauugcaaacuauguuuauauauuugcuuaaagaaagcaauauuugguuuuucacaaugucugaaucauaauuuuuaagaugaagcauuauuuggaugguuuuccaaaagaauuucaggaaaaaaaaaucaugugagugcucuuugucacaaacacucacaaccagcauagccaaacuuuuucaaaauaaauuguucuacugucaggacuaauuuacuaaugugacagugcuauaacucucauauacccacuguagacgagauaagguauaaucaguaauaugacuuaauucaugguuccuuuauauucaaaaugguaaucuacuguucacuguuaacauguacaguuuuuuuuuuuguuuuuuuuuuuuuaagauagacucuugcucugucacccaggcuggagugcaguggcacgaucucagcucacugcaaccucugccuccuggguucaagugauucccuuaccucagccucaugaguagcugggauuacaggcaugcaccaccacgcccggcuaauuuuuguauuuuuaguagagaugggguuucaccauguuggacaggcuggucucaaacuccuggccucagguuaucugcccgcaucaccucagccucccaaggugcugggauaacaggcaugagccaccaaacccagccaacauguacagucuuuuuauaugaacuaaauaucucuucaucuguacuccccuacucuauaacaaaugugaacuagacaagccuggguuuuaaaagccuuauuaggaagacuacauggggaaaaaccacuuagaagcauuaacuuacugggagcacuucugaaguauccauucauauaauagucacaugccuucauuaggcaauauguuuuaguuuuaugucacuaaauauguaaucuaaaagcaguaaauauacuuucagaauaauauauuuuaaccacuguccaaauuaguaagauuuuaccauaccaccauuugagauagcuaaucaauucaguaaagcuagguuauauguuggugauugaaaucugcagaggugagaaauuuagguuaugcauuauuuagguuuacugacuuuccauuuuguuaacauggaccacuaaauuuuccuuuuccuccccucaucauaccaccuuccagaaucccuccuacaucagcucagacucgggcuacagagaaaagugaccugacaaauccaucccacuaaugggcuuaugucuucauguauuauguaccacagaacaguuccauuuugaagaugaguaaaaggaaagaccaaauauuaacuaaaauaauuaaccaauaacaagggaauuucaggcacuguuccagaaaauauuuggagguuagauaaaucuuuccccaccaccacugcuuuuucauuuaaauaucagacauaagaaaaggguauaacauacauauauaaacagcuuaacaaauaaucauacaguaaaccaccacccacuucaagaauuaaaacacagagggcagccgggcgcggcggcucacgccuguaaucccagcacuuugggaggccgaggcgggcggaucaugaggucaggagaucgagaccauccuggcuaaagcagugaaaccccaucucuacuaaaaauacaaaaaaaauuuagccaggugugguggugggcaccuguagucccagcuacucgggaggcugaggcagaagaaugacgugaacucaggaggcggagcuugcagugaguggagaucgcgccacugcacuccagcccaggcgacagagcaagacuccaucucaaaaggcaaaaacaaaagaaaaaaaacacagagggcaauuuuccugcacuucacaaucaucucauuuggggcaauucuuuacuuucuagauaaaguuaaacaguugcuuucugccuaaaauaucuggaaacacagauuauucuguguuucauuucauaaaauauuugacauauaaaacaaaauuauuuuuaaauuaaaaacuucauaaggccucaaaaucuuaauaaaaugaaggacacaucauugugcacccacauggcugccagaacagugcaccacccaugguagguacucaaugaaugucuauuauuagaaaggauguauuucuguuucuaccauuuuugccacuagagaggaaaauucaggauaaugaucuuuauuuaauaagugucaaaaguaaaacaaaaacuauuaauagauguggugguaccugagacgcaugucaaaaggacaugcggcaauauaccuugcaggacugggcugcuucuuagaauuuuaaaaggcagucuucugcaguagcacacugcuguuucaauucacagccacaggugaucugcaaucaagaucaguuauugacauauggcuauuaaggcuuugaaguaaaucuguauuuuacuucaaguaaaaauaauaauaacucuagugaggccacuuagaauuaaucaagaguguccaauucauuuuacauauuguucacauuaaaaagacaaagcuugcucgggcgcgguggcucacgccuguaaucccagcacuuugggaggccaaggcgggcggaucaugaggucaggagaucgagaccauucugguuaacaauggugaaaccccgucucuacuaaaaauacaaaaaauuagccaggcgugcuggcaggugccuguggucccagcuacucgggagggugaggcaggagaauggcgugaucccggaagguggagcuugcagugagcagagaucgcgccacugcauuccagccugggcgacagagugagacuccaucucaaaaaaaaaaaaaaacaaaaaaaacaaaaaaaaaacagacaaagcuuaauuccaaaaggcugcucguauuuugaagaguaugucagucggggagugcuaucauuuauuaaugagccaaaucuagcucauggccugugauauuuguuucugggcuguuagacaccacagcuuaauaugugcacacacaauucccugugguuuauacaguacugaaaugccagugugcaaagcuccaggguuucauuuguucguuuuuaauacacuauauccaaauacuuccauccuggugcaucagaccacuaccaguccuuugagugguuagauucuguucacauuugaguaccuccaucuuaagugauccuugccuucaguucaggaagugugacugucagaaacagaaugaacuuucccaggaucuauuuagcuacuuuaucugggggcaauucuuaaaagucaucccugugaugucaagauuuggugaugaauauacacguauuuucaauuacaaaaauacuuugcaauuaaauaggauuacgagucucacaaaauucauaagucaauuugacaccugucaacauaaaucaaaucuuugauguuacuuaaauguugccauuccuuuuaauuuuuagagugagggugaaggcugaaugugugaaauuaaaaugaaaaaaauguauuuggaaagcgagaauaccuuauucugauauguggggaaaauaacauacagcuaaacaaguaaaacaagguugugacauacacuuucuuuuaaaaauucucaaauauaaauuuauaaaccuucagguuaaaucuuguccuacuuaacaaucacauuuucuucccuuaacauaaaaaaaaacuguauaaaaugcuuaagacaaauaauaagauuauagcuauucucaacacaguaaguuauuagguuucaguuaacacaaucugauuugcaugaccuaacccaguucaacuuaucaaaagacaugauauuugugaauuaagaacugaccaauaauugaaaauauauuuuagcucuauuucucacauugacagcucaaagugacuuugccuuaauuucaccaacuuuagacuagguacuauggaaaaaauggcaguauagcaaauuagcaaaauaaaacauucuuuuucuauaccacaaauuacggccaaauagcuaaauauucaagaaaaccuuauauaauuuuccuaucaucauggaauuuuuuuuuuuuugagacagagucucgcucagccacccacucacugcaaccacagucucccagguucaagcgauucuaccaucucagccucccgaguagcugggauuacaggcacccaccaucaugcccagcuaauuuuuguauuuuaguagagaugggguuucaccauguugcccaggcuggucuugaacuccugaccucaggugauccaccugccucagccucccaaaaugcuagaauuacaggcgugagccaccgcauccagcuggaaaauuuuauauuuggcaaaacagaugcucauuaaauucuauaaagcaaaaauaaauauuaaaacauaauuuggaaaauaaagauguuucugcauccaauggcuaauuguuuaaguucaaacaccuggcucauccccaaaaggcagccagauuccugcuuaagaauuccugggcugaauacaguagcucacuccuguaaucccagcacuuugggaagacaaugcaggagggucgcuugaggcuaggaguuugagaucagccugggcaacauagugagaccuaucucuacaaaaaaaguuuuuuuaauuagccaggcaugguggcccaugcuugucaucccaguuauugagacugaggcaggaggauuguuugaacuugagaguuugagguuacaauaagccaugaucacaccacugcacuccagccuggugacagagugagacuccauuucuuaaaacacaaaaaauguuucugccuucuaaaguuccaagagugauauuuaagcaguugccuuuuuacuagauauacauagacuuuuuagacaccaauuuugcuacugcaagaucaaagaaggcauucuacugaaaagcuggaggguagauuauaaggaauggguguggaggagaaagaugcuaggaaaacaugucuaugcaugaaaggcccccuccugaguuguucugcuuccaauuuccucuucccagacccaguacucuccuggaucccucugcuuucgucauuaccaaaaugauaauuugggacugugagugcacauaaaggcacuuccuccucugcccuucccccagugcuacagaguguguggaggagcuacaggguguggagguacucacagacaguccuccuugugggucagaaugccagguucaaaaacaagaaagggauuugugaggcuaggaaggcaucugcucauucccuuagaacuucaaaggaguaggaugagagacuucuaucugaagauuuguaaucuacaccagcguggaaagacugccagaugugguaacaggagagggugcacauuguuccuucaagcccucuuggacccaaagauaacaccuaucuaugaauggucagcuggaaucaagaggugucacgagucacuuggauaucaaguuuuucuuccugugauacgaguuugagggaagagaguugagugaucacucacauccuucccagugguacuccuggugcccucuccuccaauccucuaucagggcuacacagccgacugacacacaccaaacauucuccagccaucucucaagccccacaauuuaugcuugcuuggucuagggcagguggauaguuccauaccuaaccuaaagcugguucugucucagaggagagugcuagaacacuacuuuugagguuuuuauuugaugcaauuuuaauaguaaauaaaguaaaugcaaauauaaacuaagcauaccuguauaucaagauuguuuuuaaaaugcuuauuuagcuaaggcaaaauugggaaguuuuuugucugcuuccacguuugagcucaucucaaggacucuguaguguuuuauuuuacgcaagcacucacuaaaagaauuuugaaaaacaauguaccuugugcuuguuucaaaaugauaccuaaaauuuuucaugaaaaguuuaaauaguaccaaaggauauaauuugaaguauaaauaugacauuaaaaacuagaacuguuucaugacucccuuaaacauauccaauguaauaaaauaccauaccgauucguugugucauccauuuuaaaaacauaugaaaugaguuguuuagcaguuaauaaauuucaucacauucuuuuuucucuuuguguuugcauuucaauucuacuucaccuacaaaauuuaucccuaauauguuuugaauuugaaaguugauaugguuuggcuguguccccaacucaaaucucaucuugaauuguaauccccauaauccccacgucgucgugggagggagccagugggagguaacuuaaucaugggggugguucccccaugcuauucucgugauagugagugaacucucacaagagcugaugguuuuauaagcgucuggcauuuccccugcuggcacucauucucucuccugccgcccugugaagacaugccuucugccaugauuccaaguuuccugaggccuccccagccaaguggaacugugagucuuuuaaaccucuuuucuuuauaaauuucccagucucagguauuucuucauagcaaugugagaacaaacuaauaaaaaaguuuuuauuaucaccuuaucauacuucucuaugacaaaauauaaaaauaaaguguuuacuucccaugaccauaaagcucuaaauguaaaaaauuucuucugaacuaaguuauuauaauuaguagcaguauauuaguacaccauacuaaugcugauaaauuauuaaauauaaaaaguaaauuuuuuauuggaaagcaauuuuuuuugagacagagucucauucuguugccuacgcuggagugcaauagagcaaucuuggcucacugcaacuuccaucuucugaguucaagugauucucccaucucagccucccaagaagcugggacuacagaugcccaccaccacacccagcuaauuuuuguauuuuuaguagagauaggguuucaccauguuggccaggcuggucuugaacuccugaccucaagugauccacccaccuuggccucccaaagugcugggauuacaggcaucagccacugugcccugccagaaagcaauuuuuaaugagguaaacagaggugguuuuauuucccuaaugauuacauguaucaaaucuauuuacaaauguuauuuuuugcuagaaugaaacaguuuagcaacaagucuauuccuacuuuuauuuugauuuucgaugcugugaacccauguucaaaauaaguagagguauauguaauguauucuguuauaaagacaucaccacugagucaaagaacuucuaaggaguuagauaucuaacagugauauauuauccaaaauuauucugaauguucuaucaagugacaaauccgcuggguccuccuucaauuuuguugcaaguaaaaaugagaaaaugacuuagaaaaggauaugucacuugauaauuagagucauuuaccuucccaauaccaaccccaagagguucaaagcuuauggacaaagcagucuaacagauuccagauguaggaaagggcucuuuucuuuugcaaaauggaagaagguccauugcaaaagggcaggcuggacagaagaaccaguauguauacuaccacaggaauaugccuuuuagaaaagagaaucuagaaauugauucaaugaaaacuaccugugcccaaguacaucuuagaaagccucuguguguugcccuccccaccugacucagaucaggacacgcuaccccaaacuauaacaccuuggcauuugagaaaacagcagaagcaagaaagccccucucaucucccaacccucugucauuuucuccugaaacaggucuaaaaccuagaagguaacucucugaccuucuuccuccuuuuuccccuggaaucccucaugugauagauauccugcuuuacccagagggaggggauaucauacagggaaaccaagaagaauccaaacaaccaaccuuugcuaagccccccuccagguuauuaccauuagaauauacccuuuuguccucuagucauacuucugcaugacuguccaugaauauacacauaucucauuucuuugggucuucauuucuaaaggcucucauguauauaaaacuuauauuaaacaaaguuguacacuuuucucuuguuaaucuuuuguuauggggaccucagccaugaaccuagugauaagugaggaagcuacuacuuuuucuccccuauacaauccacccuagcaguugcauacacgagccugaaaucuacugccuuaauucaccuguccauuaaaacccccuucuuuugcaauagcaucauggacugccucuagccauaagcaaauuauccuuccggacacuuagaacucugucagugcuccacucuaugccacuugauauguccugccugcauuccagcauugcuucucuagucuugcaaagcagcugguuaaguguacaagguugaaaguccaacaaacuuagauuuauuucucagcucugccaguuuacccauuguaaauugauccugugaucuuggacaaguuauuaaacuacuuugggccacaguuuucuccuguguaaaaugggaacaccacuaacuacuuauauagugcacagcuggauuaaauuagacaauuuauauaaagccuuuagcacuguguuuggaauuuaguaagugcuaaauaacugacggcuguguuauuuguauaugacuuaguuccuacagauuaggggccaagcuuuauuccauuuucugugcucuauaaaauagggucuuaugccaaagaggugcccaauaaauucuuguugaauaagaagaaaaagaaaaaaggugucauuuaugguaacucacuaaagcugugauuuuaacuugaauauauaauagcccuuucauuuugcuugcuuuucuaauuuucguagcuauguuuggaaugcuaaacacucccaagaagacugaaaacauuaacuuuuuagagaaaaucuaaccagacucgccauacauuaauaaaucuuuuacagauggaaaauaagccuaaguuucaaggcagaauagaaaaggaugccaacaaaggcuaacagccugcaacaaacauacaccugacuauauggucuaccuaaugcuccuugcaauuaacaguuacugccuuucccccucucucuuggcuagguaagaugccccaaagaacuuacacauuuucuucuaaaaauggcuuaaaguaaaaguaggcugacucugacuauaaaugagcagaauguauggucuucucaagaguauuuguugaaaacaaguuagagcuacugaagaaaucacacauggggaaaaaacagaaguuguauauuuucaaaucauucuagaccuuucaccuuucuuaacuuccauuuacuuuccaagcauguaccauaguaucccaaagaccuggguuaggauccuggcuuugcgcuuacugccuguguaaucucaaacaaguacuuaauguuuccaugccucaguuuccucaucaguaagaugagacuaccacccaucuuucucauggggauacugaaaggguuauacccaguaauguuauccacuguuuucaugcaaggaaaucagcucaaauuagaaaggaauucauggugaaugcacaacaggaucucacagacuucaguucauagcuacuaagccucccuuccccucucuucucaaagcugugugauucucacagugagccaacuccauucuucuuucucugcaaaccagcuucucuguucaaagcuguaccugguaccuggaccguaaagcagccccaaaaggcuugguuguccccagauaacugacucaucugcuggacugcacaucaucuuuucuggagaaggaaucugggcgguuuccucagaggccccauucuuaccccaggagagaagagaggagcaaguccacuguuacagagggcucuuccuccaccccuucuggacuccugcuccaaagaccagcacagugccagugacccaagggccaagcagggcaccugcuccacaagugaaacuaguuuuuuuuuuuuuuuuuaagauggagucuggcucugucgcccaggcuggagugcaguggcacaaucccugcuugcaaccucugccucccggguucaagcgauucuugugccucagccuuccaaguagcuaggacuacagguacacaccaaccauguccagcuagcuuuuguauuuuuaguagagacaggguuucgucauguuggccaggcuggucuugaacuccugaccucuggugaucugcccgccuuggccucccaaagugcuggaauuacaggauugagccaccgugcccgaccgaaaguaguuucuuucuucuuuaccucaccuaucucucccuauaaccuaccaaaauaacccugaacucugagaacccccaaaaucuuuaacauugauauuaauaaguaaugaguaacuuauggccaaacagagccaauaaaaaaaucaaucccagaguuuucaaagucugaagaaaauacuggcauagaaaccaucaccucagaacaaugaauucugauaguaaagcaaagguguggaauccucagaugccaucuacucaggaauaucuauccccaaaacagaaucccaaaccgcugacagacacacccuccagcccccaccugucaagaacaggagggguaaaaaaacagguaaauuugcccaaugcauuaguaaaaucaagaauugcaacaacaaacaacugccgagguagagccaauucccacugcugacuuccaaaagaaggagcagguucaagaaacgacuagucuaagguuguguucacacacaacucaaaggcagagacaaagcuaugcaaaaacuuucuaagaaggaaugucuucuuuuuauuuuuacccagaaagacagcacuuuuuaacuaugaguuaaccaaacaggcaaaaucucauauucaucucgucaguuuggacuaaaagaauaauuuuuaaacuguaauagagccaugguuaaaguuaacuuuauucaauuugucaauaagaguuucauuugaacuuuaggcuuuuuucuuuugagacggagucuuacucugucacccauacuggagugcaguggcgcgaucucggcucauugcagccuccgccccgcagguucaagcgauucuucugccucagccuccugaguagcugggauuacaggcgccugccacugcguccggcuaauuuuuguauuuuuaguagagacaggguuucaccacguuggccaggcuggucuuacacuccugaccuugugauccacccaccucagccucccaaagugcugggauuacagguguaagccaccgcauccagccugagauguuuuaaagaauuggcuagaagguuuuuccaaacacaaaaaguacuguguauuuccaauggcaaaacuacauuuuauaaucugggaagaucuuuuucacaacuuugcaagacuuuugaaaugguaaaaacccauauacuuaaaaaaaaaacuuucuaaaauuccacuguaucuauuuuucauauuugguccuuccaacucugugggcagguaagucagacagaauaaaggaauuuuagaaagaagaggaaucuuuaaagcuuacauacccaauuauuguauuuuauggauaaagggaugaaagcugagaaugcugaaugacaaguuacaggucacaaccaaggcagaccaggaauucagggcuacucaaaucagguacaacuuucacacucuuuuuuuuaagcuccccuaccaccccacuaagucgcuucucaauuaaauggcuuaaauaaucagucaagagguaauuuaaacaucccucagagcagagguucuuacaaaggagagagggagggaccacagacuuggaccauaacucagucaauggucuaauucugaucugugcacuuggaaaagaagagccacaaucacacuuuugccaaaacaaagcuccuccaccauauuuucagaaaucaucuccauagccacccauauaacaauucuaggucagaaugucuuguucuaacccuuuuguaugaaaauuuauacuaacuucuuccuuuuucugacccagaagaaauaaacaaaaacuucacaauacccgucaaaggccggauagaugugagagcuauuauuauguuacugucuuuucccaguuucuuuacccucucuuuucccaaacauuccuccuugcuaagugauucucauccagacauccuccacauucuagaacuugcuacaccugcaaaucaucacuucuuugggugaaaaacacaaagcguccucuacuucauuuaauccaaagacucuauaccaugagucuuccucaugaaauggagcacccucuggcuugaggacuuauaugccaucuuauguacuuuaauccuggacuuaugccccucuccuugaagacucugguugugucugcuauaacacaggagaaauuccuaacauuugaguuuuguacaauugaucuuauauugcucuuucucuguaaaucacaaugaucuaggguaagaacaaugucucagcucugagcuuauugagaaugucucuauuggaaauguggaugagcauuugugaacuucaugcauucaugacaguaaucuguagggcuuuugaaaagugcuugguaaaaauucaaaugaaaauaaaucucucucccacugccaauccccauucucucagaaacgcuucccaaaggccacuacuguuacuaguuucuaauguauccugccugcaaguauuaucugcaugcauacuuucccacccaauuugucuuuguauauaaugguaacacauuaaauacuaccgggccccucugcuucucugcccccaccauuuauauaccauauccuggagaucauuucguaucuguacauacaaauguaacacauucuuucuuagucuuucgucucuauauuguagacuguaacugaccuguguucauaucucagcuuugugacucuguacaagucucagccucugcuuucucaccuaaacauugagaauuacagcaucuucuaaaagaguaagcuacuaucugcagagugucuagcacagugccaagcacaugguaaugcucagcgaucauuaguccugacauuccucuccuuuggugggcuccucauggggccuggccuuucauagcagauacugugggacuauggaaucagauugacacaagcuccaauccugcucucagauuucuuguaacagagacaugguauuucauguggggcagaggcuggggaacauauauuacuuuauuaggccaguuucuuucuaauggauauuuagguaguuuccagucucugugaugacaaacaacacaggaguaguuccgcugauauuauagaagugacguauuugaucuaauaucuuccuggacaaacucagagauuggggacuugcuuuugaauucccugauccagagccacagcuucugugcgcuccucauucaacaauuuugcuuccccucugggagcccuuucagcuuugccuuuucuuugucuucucuguuccuauugucugcuuaacaugaaaaaugcacucagguaggccuggcagcuaauuacuucaaauaggggaaaccaccuuacauagaagauggaaugauuaacugugugaacuuuaaaauuaucacacaaugucaucacuguuaaugaacacacuguaagaaguuuguucuuuccaauucauagucauagaaaaucccaagagggcuggagagcagugaagaucugagguggggaggagaggaggguagagauguugguguaaaaaaaaaaaucagagaagaaaaauggcuugaacaaauacuagaugauuccauuuauaugaaguacuaaaguagucaaaaucauagaaacaaaguagaaagacgaucaccaagagcuggggagagcaggaagggguaauugguguuuacgggguauaguuucagagucauaagaugaaaacacucuagagauugguuguacaacaaugugaauauauuuaauacuauugaacuuacucuuaaaaugcuuaagaugguaaauuuaauguuaugguuuuaccacaaugaaaaaaaaaaaaaaggcuuggacuaaaugcuacucugaagaguagaaacauaguaagaaagacacuuccuaacucugugauccugauacugcucccaacagcugcccuggggugcuaaaaucuguaggcaggcaggacagaagaaaccuucacauaguaugcucugacuggcccaguucuucacacucgauuuauacugaauguucuagauuuaagugagaguguccaauuuccuuuccaagccccucucacuguacuugaauggccucuccuuaccccucacucucaaaagcccacagcaccucaacauaauaacaucauccuuuguauaugaaguucaugccauuacagcgaauauaccucagacauugacagauggauucacagugguccacacugugaauagaaagacauccuuuugguuuaggagaaggaaacuaaaguguaccaagccucuacaaguucugacaagauacucagcccauuucagacacauccccaugacagcaacucaucugacagaugaagaaaucaaggcucaagcuggcuaagugacuuuauaauauuacaugucuaguacauggauuacugaagcugaaccagcaaaguaccaggauccagcuuacuggaucgcacugauacauccgucucuauucagauaacucaccuuuccucugccuucaaaacacagauuugacugccacaagccacacugagguucugcugacuugcaucugacacaaugugccaaucagaggaaguguucaauaaauaacuauuguuuugacauugcuauuucuuagcagcccagagcuauacuucaucaaaugaaacuguacuucauuauaucgaauaauuucucugucuucccugcuuugacugcaccuaccuugggucaacaauagaugcugguuagcuacccucaggggaaucauucacuaugggggguccagagcuguguggcaccaucauccccuggaguuggcccacugaccuacuaacuacaaagugcucacgucuggaguaauggaguguuugaaucaaacauagucgugauugcugaggaugcugcagaaacauagugugagccccagggcagauggagucaccugucacaugguagaucaaccacucacaccagcucugucaagggacagaguuuccagggaagcagcccucaagccaaaucuguugaucagaaauguuuaacuuagcacacaaagucuucuuauaauaaaauuaauugcuaguauuucaaauucuaggaaguucacaugaacauccagauuuuguacuucucuugaaacacuggaagauacaucaacacuagguccacuccgcugcacagaaacaacuggcuugguccaagcgguaaguagcuguccucuugcacacugugcacaaaccauccucucagaaaucauuuucacaaccccuuaugcacucuguuugcagccccuuccacagaggcagaaugggaaugccaaaaaugucaucuuaucuugcuuugcaauaguucaaagauuaugcugcaaguauuuguguguucagugagauauuuuuaagaacuuaaaaugcugcaucagauaaucaaagccuuguguauccaucccaaauggcuucacccauuacuuuucuuauagcuaauuaugaauuauauccaaauauucugucuucauugccuacuuacagcagagacgaucuccuuugacaggaauccaacugugugaguugccaagaacuugucagagagaggguuguaacaggagggcacuuuuuccuccugccgucccuuuucuggcuuuacccaagcuccucugaggcaguuuagacuugcaggaaugcucuggcugccugcccugaugcugaccuccucuggguggggaagcaggcagcugggugcagggcacuugauucuggaauguacuuccucauaaaggugccagggccugcacuuggcaaauucuaaacacaauggcuuuuuagcugccagggcauuuauuacuccugauugagaggugaauaaacaugcuuuuuaaacuuacagacaacugggaugcaaguuaaggggacuagucaucuaguuugauugaauuacuuuaacuucggaauuaaaaagaaaggucuucuaaaguaaaaacucauuuaguauaaauuaaugauacaaacuaacaaaaaguaauaacccccaucacgacuuuuuaaaaaauuauauacaaauguuuuguguuuuuuuugaaacacaucacauuuauucauuugcauauuuucagugacacuauugugcuacaaauggcagaggugaauaguuacaucagaaaccacauggccugcaaagucuaaaauauucauuaucuggcccuucgugaaaaacguuugccuauuccuacuccacuaaauaacucuugugggguauuuuuauuuauuuauuuauuauuuuuauuucaauaguuuuaggggaacaggugguucuugguuacaugaguaaguucuuuaguggugacuucugagauuuuggugcccucaucacccaagcaguguacacuguacccaauguguagucuuuuaucccucacccccuccuacccuucccccaaauccccaaaguccauuauaucauucuuaugccuuuguguccucauagcuuagcucccacuuaaaaaugagaucauauaauauuugguuuuccauuccugaguuacuucacuuagaguaacggucuccaggccaggcacgguggcucacaccuguaaucccagcacuuucggaggccaaggcagauggaucacgaggccaggagaucaagaccauccuggcuaacauggugaaacgcugucucuacugaaaauacaaaaaguuagccaggcauggugguggucgccuguagucccagcuacuugggaggcugaggcaggagaauggugugaacccaggaggcagaguuugcagugagccgagaucacgccagugcacuccagccugggaggcagagcuagacucugucucaaaaaaaaaaaaaaaaagaauaauggucuccaaccugauccagguugccacgaaugccauuauuuuguuccuuuuuauggcugaguaguauucuauaguguacauaguaauauaaacaccacuuuucuuuauccacuuguuggcugaugggcauuuaggcugguuccauaguuuugcaaauacaaauugugcuguuauaaauaucgugugcaagugucuuucuuauauaaugacuucuuuuccucugggcagauacccaauaaugggauugcuggaucaaaugguagcucuacuuuuaguucuuuaaggaaucuccauacuauuuuccacagugguuauucuaguuuacauuccaaccagcaguguaaaaguguuacuuuucaccauauccacaccaacaucuauuauuuuuuuuauuuuuuaauuauggucauucuugcaggaguaaagcgguaucucauugugguuuugauuugcaauucccugaucauuagugauguugagcauguuuucacauguuuguuggccauuuguacaucuccuuuugagaacugucuauucguguccuuugcccacuuuuugauggguuauucauuuuuuuuccugcugauuucaguuccucguagauucuggauauuaguccuuugcuggaugcauaguuugcgaauauuuucucccagucuguggguugacuguuuacucugaucauuuccuuugcugugcagaagcuuuucaguuuaauuaggucuuaucuauuuauuuuuguuuuuguugcauuuguuuuuggguucuuggcuaugaacagcuuugccuaagccaaugucuagaagaguuuuaccgauguuaucuucuagaguuuuuaugguuucagguugcagugaaccaagauuggaccacugcacuccggccuggguggcacagugagacucugucucaagaaaaaaagucaggauaaaagcaauucaaaaaucagacugaaagguggucucagcaaagucuuaaauuuuaacacagcacuauuuaauccucuuuuuagaauaaaaaugaugaauacacaccacuguuuaaaauauauaaauagucaugaaugcuuaaagauaucacuacaagaauauucacuuuagagcuauuuaugguuuucaaauuuugaaacagcuuaaauauccaagaauuaaagauugguugaauugucacaucucuauaucuauacagcagaaaaucauacagauauuaaaauggcauuguuuaggaacauuuaaacauauccaugagguauuauuaaguaagaaaagcaaguugaaaacccaugauuguaccacuugugugaaaaagauauacaauugaccaaaaggcuguauaauacagugcuacuacaaguagaauggaguugaauauaaaaguuuuuuucuuucuuuuugggagagaagauucuaaguuuucuaaauuuuauaaaauaagcauguguuuuuguaauaauaaaagcauaauacauuccacauuuuaaaaagauccaccuggccgggcgcgguggcucacgccuguaaucccagcacuuugggaggccgaggcggguggaucaugaggucaggagaucgagaccauccuggcuaacaaggugaaaccccgucucuacuaaaaauacaaaaaaguagccgggcgcgguggcgggcgccuguagucccagcuacucgggaggcugaggcaggagaauggcgugaacccgggaggcggagcuugcagugagccgagauugcgccacugcaguccgcaguccggccugggcgacagagcuagacuccgucucaaaaaaaaaaaaaaaaaaaaaaaaaggauccaccugccaggcacaguggcucacaccuguaauccuaacacuucuggaggucaagauguaaggauugcuugaggcugggagucugagaccagccuaaacacagcaagaccccaucucuacaaaaaauaaaagauuaaaaaaacauuagccgggcgugguggcguaugccuguaaucccagcuacacagaaggcugaggugggaggauugcuugagccauaaguucaaagcuacugugagcuauggccacaacacugcauuccagacugggugacaaggugaaaccuugucucaaaaaaaaaaaaaaaagagagagagagagagagagagauccaccugaugcugggaggcuguccuccaaaaaggcugggcugugcauuagggggaccagcuuacaacaaauccuagacauccuuuguccucugaugcccauguguaaguaauacauaagcuucauguaacuuguugcauaugagcguguucucucucaauggacucaaacaagucaguaaccaaugcccaguaaaccuacuccacaguaguuuuagccaaacugccuuucacgucuuaguuuccucauuaccugaagggaggcaaaauaauagugauguggcaagguaaucuauugcaaauuuagucauguuuuauucuugucaguguagaaccaccagaaagaacuuuauuuccuuccagcccaacaagaggaggggaacuagagugagacuuaauuugacuuuagaagcaguaagucaggugacauucucacacacaggaaugguaaaauaaacucauacacuuuucuucacaggcuugacaaaaggauuaaaugaaaugauagaugucauaaugcuaggucaauuuucacacaauguuccaauguuaauauuguuacuaaaaauuucauuuacuuccuauaaugugcuagacccaggagaccugggcuccugucccagccacaccucugaauaacugcuagaagcacaucuuccucaucuguaaaaugguauguacucuuucccuugccccaccucacagggugaggcucaaacaagauaauaucugugaaaggacacuggagaguguuagacaagggugaucuauaagcaagccacaaacuaacgucagcaauauuacuucacaguaaaauucugugagcaaugagcacugaacauggauuaaagcugcuugauuaggugguuuuauuaaagacacagugucuucauuaaaaaaaaaucugaauaacccaaauauccaucaacaguagaaugaauaaauugucaaacacaagaauacucacagcaagaaaaaggaaugugcuuuaguacacacuguauauaauguuggcaggaagaaucaagacacaaaaaaagacauacuaugauccauucaucuaauguuaaaaacaggcaaaauaaacuaauuuguucaggaaacugacaaauuauaaugaaaagaaaggaaugaaauuaccacaaagucaaacagaaguuuccucuaacugaggggaggaaauggugagaacacuuaucagagaaaugcccauguggcacuuuugggaugcaggcuagauuaaacuuuguaugugucuacacacauauguauacauguauguauauguccauaaguauggauauuuuauuuauauacuuucuauauguguauuauguuacacaauaaaagaccaauaauaacaaagaaccaacuggauucuguacaaaugaagcucaaauuaaguuaccucaauagugcuccuuuuuuuuaauuuguauuuuuaauagauaggggccucacuuuguugcucaggcuauacucaaacucccaggcucaagcgauacuucugcccuagccucuugaguagcuaggacgacagccuuaccaucaugcccagaagugcuguuuuuuguuguuuguuuguuuuuuucaagacucuugcuaagaguuuuuucaauuucaacucaaauacaucaaauuaagaaauuacucaguuuagcauuuugucuugugugguuuuuguuguuuguuuuaagaaacagggucucagucuaucacccaggcuggaguguaguggcaugaucauagcucacuguaacccugaauuccugggcuccagccauccuccugcuucagccucccaaagcacugacauuacagguaugagccauugugcccagccaagauuuuauguaaaauaaaaccccuucaaaaagaacguauggggccaggcauggugguucaugccuguaauccuagcacuuugggaggcugaagagagaugaucacuugagcccaagaguuugagaccagccugggcaacauagugagacccuaucucaauaaaauaaaauaauauaaaauaaauaaaauuaaaauaaaauaaaauaaaauaaaauauaaauaaaauaaaauaaaauaaaaauaaaauaaccaggcaugguaguaugugccuauagucucagcuaccugaggucagaacaucacuugggcccaggaggucaaggcagcagugagcuauaaucaugccacugcaauccagccuggugacacagcaagauccuaacucaaaaaagaaaaaaaaagaaaguacagucauuaagcaggccauggugauucaagaugacuauaugucuucuuaaaauuacugucugcuugaacauuuccaagaucaaauuaaaauuucuaauauuagaaaauuuuaauauuggaaauuucaauagaaagacuguagaguuauagacaucaccugaguauaucuuacacuaccagccuaaaggaaaacaagguuacauagauaacucaggggaaccaugacuuaccagcuggcuguguuugugcuauucgcuuaggguaagucuugcuucgacuucuugucacauucugaucaggccggggaagcugaauagaaagaucucggcucauuugcaaagcuguccugccacuugagagugcaacauuuugauuagcaaagguaaaaccacacagccacaaaauuaaacaacaggucauucagaacaucugccaaauauggagagaagaaaaaacacacagacucccugguuuuuaauugauucucauugcaauauugaucaagggagugguuauuaaauucuaggaggagauuuacauuagauagaaggaaaaucuuucagaggaggaaacaggaagaaagaauuuauuaaaggaggaauuagauuucaguagaaugaugggcuagaaauaaagguugcugacagucuuuaaggucacuaaauaauaaagaaauuaaguugggcuaaacugugggaaggcaaugauuccacaugagcuccauguuguacucacacagcagguuguaaaccaucccccacaagaccacucgguaugauuuuauucuggacucugucauggcacaauuagccauuuacuaugcccacccugccugggccagaucaaguguccaggaagacugaaggcaggccuagaaccccaugcaaagcacugcugcucuauacauuccaugcagauuccagggcagguuucccuggggcugggccaaacuucucaaguaauuuucccaaggaaucaugugauuuaguuugcuggauuucagugaacauucaccuuacuaacaauuuauuccacaacugcugaauuugagcaacugaaugacccuggcuuucaugcagguaaauaucauuuagguacaggaaaaacgcauuucuacaagucuaguuugauucaccacaaguacagccaucuaugggaggaaaaaagucuuuuaauggccccaaauccuauucaucuuacauuuacaggauaaacacaggugaguguuuccccaaaaaacagauuuaacagacuuaaaauucaucuuucacaugcuucuguggaaguuucuccuccuuacuacuuccucuaccuuuauuaaaaaugaagaugccuacaaaacuuauaaaaaugacucugcaucaggcuaaguugggacgugugguaucagcuaccaggggaauaaagaugccagggcgcauccaugauuguucuucauguucaguaacaguucauggaaauucgggaggggagaggagcaaacugacagauuuucuuuugcuugaaauguaacuucuucuaaaaagguacacaggauaacauagauuuccaaaaagcuaaaaauccccauaaagugaaaaguuucauuauuauaaauggucuggaguaugaagauaaggccuacuuucaacagacuauuaacagaaagaccugggcacuguacacuucacucacagaggaaaaaauguucccccuaaaaauauaacccaauaugugaaccacugaggcauuucacagucagauuuuuuuuauuauucaaauuuuucucaugguuucucucuaggaacaaaagagaaaugagaaaaucauauccuaagauuaauaagaccaaggaccagaagcguaaagugaucugccauaggcuauacaggacccagcacuagaacaagcuuucugaccuccugcuggucaguauggcauaggcugauggcaugggagaaggaacagcacauguagcuguuggguuugaaguugcaagcccuguuuaaagcaaagcucugccuuuccccagcuaaguggucuucagaaaguuauuuguaaaaauccuugcagccucauuuuccucauuuauauuucuacuuguucuuacaauuuccuggcagaaguauucuuauauagcauccuauuuccuuguagcagaaaguaauugacaaguauggagauuuacaguguaaggugaugaaagucccugcacauguuugguggcucucuguuacgacaggacacaguuuuauuucugugaucacccacuucccugcugccucuggcauaaauacagcccuuugcaugcugaguggcacugccagcagccccuucagccucuaagugagacagaaagaaaagaacgagaguagaaauacucagguucaaaaccccagcuuugccacuuacugauuagggacgcuuacuuuacuuuuggaggcuccaauuucucaucuauauaaagggggauaugaaaccucuuuggcaggucauuguguggauuaaauaaagcugcacaugugaaagcaacugacacaaaggagguucuuaggagaacuuggucucucuuccaugcuucauagaaugugaaaucucaugacagcuccugugaguugaguccuacagugaggaucuggguucccaggggaguuucuaagccuucuuucucaauucucaaguguaaauucuacacaacucauuaaucaaaacuaggagcaccccacaacuuaaugacagguaaaggcaagguuaauuuguaaggggcucagagaagauagcaauguauaacaaaauguuuaaucaaagauuucuauuucagauuauuggucccugguaauaaaacaacaguaacaacaacaacaaaaaguacuggaacaucagauuucagcucagccuuuccucacaaauuuaauuuuuaaucuucauuuucccauaucacuaaaaaaaguccgauuuuucccuuaaguaagcacuaguuuucccaaaaagugcuaccguccuuggcauuuugcaagccuuaaaaugcaagacagaguaaagacuagaacucuugucuuccuccaucacauauauguauggugcacaaccacaaagacacuaacacaucacuauaaacacauacacaauuacacacacaaacacacccagauaccugcauucauacacugcagccaccuguuaagcuguucuuuauacccuauucuuuaaaagccugcagggugaaaggaagagaauguguuuccagagcucugcuuucauuccaggaugucuccggaaugucucaagaaaggggcaggcauauugugcugguuaaagucugguugcuugcccucuuuugacaauaaacagucugugugcuaaugaacccccagcaaucagagacccaucccugccuaaccucugggcaucgucuuucuuccaaggaugguguaauguuagugucuccuacauauagacauguagauuuaagauucauuaagacuuacuaggcaguuaacaucagccacaaaauuggaacagauuuagcauggccuccaauuuugcaaagguuacuuuuaaucacuuccuuggaagaaaugauacuuaauaugcaaaauccaauaacuuccuaauaauaauucccaguagccacaacauuugcauuucaauaaauuugagaaauaaaguauggcuaaauuuguggaagccaacaacagcguauguuaaagaggauaauuacaauuuuaauaguaugaacauuaagacagaugucuuucuaccagcuccuuuucagggacaaggagacauucucucuauaauccuggugauguuuuaugccacaacuggaagaacaguccaaguacugacuauuaccugcucuucucaauauaaauguaaacaauacuuccuuaaauucuucauaauuguaucacugucuacagaagaacagugaaaaccuaaagguuaaacauuaacauaucaaugaauaccuucauguaaauuccaagaauaucuauaauacaaugacacuuaaguauuuuuauucaugcaaugagcaaauuuucaacuaaauaauauauaaagaugaaugcacugaacguuuaauauucauuacucuuuuacugauaaucuuuaaucucaaauucaagacccaaaaagugcauuauaaaagagaagaauuaaaaucuagcauagaggacuauuguccugaaaaugcuugccuuggcuuuuuuuguaccucuuaaggaagcauuucauucagugaugucuccaauggaacugacaaaagugucccaucucugugacacuagguggcaucuccccacccugcuuggguuuuacaaggccuggggaccucccucacuguuugaauaauacuauagcucuuugaaggcagaaguggguagaucugauucuuuguaucucuagguaccuaauacuaugccuugcacaucacaggcucucuccauugaacagaaugaauugaaacaagacaaauucuuuuucaaaauauagaacccacucucauuuuuaaugcugguaucagaaaaagacauaagcgccugccuagcugcaugacaaucaggcuuuuuccacaacaggcuaacaguuugccuaaugguuauaaacaugagcucugcagcuagagcgccaggggauggaucccacuuccccgcuuccuagcuggauuaccuggagaagggacuugaccucuuugagccuuaggguccucauacauuaauggggcuaauauuacagaagauugauaacuaaaugaagcaaugaauggaaaacauguaucacaguacacagcacuuaguaacugcucaauaaaguugagauauaauugcuagcauuacuacaugcaggcuucauguugcagaaaaaacaagguuugaugcacaauauaaaaaguauagauuguauuaaaauaggggaucaacugaaugucuuaaaaacacaauuaguuacuauucagaaucuacauuguuucauaaucacaaaacacacauaauuaaaaauaagugauaacugugucaaaaugaauuucugaagauaauaaacuuuacuaugaucuaaaagcccacaacauagcuaaugcagacacuaaauauaauuaaaucuggaaaaucauguuuguugagaaaguuuuaauaaacuguuaugcuuacaaaacacauuggcaaugcaagaaaaaagaaaaaaauaaauaaauaacuucacugagcauguaugacagcugaauuaaguauuuauuuacaaacacauccccccaaggaaaaaaaugucauuuaccuguagcggugcuuauaacguauggauccaaacuugcugaguuuucuugacagugaauuggauucauuuucuggcauucuaaucaauuuuuaaaagaaaaucagacaaagacucaauguuauaggcauucugggccacccccuucuccuaacacaaacuuuauaaaggacuccagccacuuuauaagaauacuucuccaacaucaugcaauucauacuccaugaggaugaaacagggaagaacucaauuuuguuuccauuuaaaaaacaaaaccaaaaaauaaagcuuaauguaucaccagcuaaauuuuuguuuuaucuuuacaacauaaagaugugaaacaaagaaaaaaguauccccacaauccaaaggucauuucucuaguuucaucugaccggaccucccaggaggacugcaugcaguugccagcaccuuauucaucaagacauucccuuuccucguuucccaggauacaacacacucuucugacugcuccuucucauacucuagacuggcucauccugcccucuaaugucgggagggccaccaagcucaguccuuggaguucugcuucucucuccacuguuuccacuggugaccucauccagccacuucuguaaauaacuacuuaagugacuucaucaacuuuggucuuuccagugagccuuguacaccuaacugacuuaccacauuucuaccuagauggcugauaggcuuuucaaauuaauuaugcacagaacacuccauuuccaccaauacuacauaggugcuagcaauggcugcauguuuuacauaaaccuaaaaaauauuaccucgauccuuucuugcaguaucaaagauauaacuguaucuauguguauaagugccuauguguauauauaucuacacauacaugaaugugugcauguuuguauuaauauaauccagagaauuaggaauugagaaaauuaauaaaagggaaacaauuccaaauuucuguuuuagacagaauucuuuuuauaaaaauaaaugccauuuucauuuauuaagacaacaaacaaaauuuuuacaucaauuuaccuaaaaaauguaugauguuccacacugcacuuccagaggugcuugcaagcaguuuuacuccgagcuucaaaaaagaaugagguuucguuacacuaagagagaaagagagacagaauaugaauaaugaccagggaaggaagauagcauucuucaaauaacagcccccuuuaaguaacaaaaauucaagcagagagauuauugauaauauauaaauaauaacugucucuugguaacuauuuuuggagaggugcauuaaaaucaccuuccaucgauuaaaauuuuauaaauuacacuuaaaucuuaaagcaccuuuauuaccuacuuuuacauugccccaugacaauagauaguuuggacgguagaagugaaauacuacaaaaucucccucauaaauggccacuaauacaggaaaagcacggaccaugugaaaaucaacucccaguaaaaaaaagaugcccacaaauccaguccuuaaguguauuacuuucagggaugaacaagucacacauaaagcaaugaguaaagaaucucaagccaagaaccaccaggagugaccaccccagcagcauaaucugggaaaauuaaauaaugccucugaugccaugucucuccauccugcaucaagucacugaguggaucaaauucaacaauaugcauacauaaaauaucauauaauagguguauaauacaugcuaauuauuuuaauccaguaguuauuugauucucuauauuuaauaaguaagaaauaaaacaacauugaagguacaaaucagcccucuauauccacagguuccacauacacaaguuagccaaacuugaaucaaaaauauucagaaaaaauaauacaaauuuaaaaagcaauagagcauaacaacuauuuacauagcacuuagauuaggaaucauaaguaaucuaaaaaugacuuaaaguauaugggagaauguguguagguuauaugcaaauaccaugccauuuauauaaggaauuugagcauucucggauuugggaggaagguuucugaaaccaauacccuguggaugcugaggaacaacuguacaagcauaccuuggagauacuauagguucagcugcagacuacugcaauaaagugaauauugcaauaaagugaguugcacauauuuuuuggcuuccuagagcagguaaaaguugcuuacauuacacuguagucuauuaaguauauaacagcauuaggucuuaaaaaaacauauauacuauaauuuaaaaauacuucauuggugaaaaaugguaaaagucaucugagccuucaggaagucauaaucuuuugguugguggaagguacugccucaauguugauggcuacugacugaccagggugguaguugcugaagguuagaguggcuauaucaauuucuuaaaaugagacaacaaugaagcuuucuguguuaauggacucuuccauugaagaaagauuucucugcagcacgugauauuguuugauagcauuugacccacaguagaacuucuuucaaacuuggaguuaaucuucucaaacccuaccacuacuuuaucaauuaaguuuguguaauauuuuaaauccuuuguugucauuuuaaaaauguucacagcaucuucaccaggaguagauuccaacucaagaaccacuuuuguucauucauaagaagcaacuccuuauuccuucaaguuuuaucaugggauugcagcaauuaaguuauaccaucaggcuucacuucuaauucuaguuuucuugcuauuucuaccgcaucugcaguuacuuccuucacugaagucuuggaccccucaaagucaucguggggguagaaaucaucuucuuucaaacuccugcuaaucagaauaauuugaccuccugccauaaaucauaaauuaucuuaggggcauccagaauggugaauauuuuccagaaguuuuucacuuuguuuguccagauccauuagagaaaucauuaucuaucgcaucuauaguuuguagaaaguauuucuuaauacuugaaaguugaaguuaccucuugauccauggguugcagaacagauacugugauagcaggcuugaaagcaacauuaaucuccuuguacaucuccaugauagcucuagaguaacuaggugcacugucaaugaauaguaauauuuugaaaggaauccuuuuuuuucugagcaguagauaucaacauugggcuuaauauauucacuaagccggcccaggagugguggcucaugccuguaaucccagcacuuuggggagcugaggcaggcggaucaccugaggucaggaguucaagaccagccuggccaacauggcgaaaccacaucucuacuaaaaauacagaaauuagcugggcaugguggcaggcgccuguaaucccagcuauuucggaggcugagacaggagaauggcuugaauccgggaggcagagguugcagugagccgagaucgugccacugcauuccagccugggugauaagaaugagacucugucucgaaaauauauauauauauaucuauguauauauacacacacacacauauauauauguguguguauauauauauauauauuuuguuuguuuguuuguuuccuaagccaugcuguaaauaggugugcugucauccaggcuuuguuuuuccauuuauagagcacagaguacaguuagcaucauuuguauagaacccagaauuuucugaaugguaaaugaauauuggcuucaacuuaaagucaccagcugcaguagcaccuaaagagacagucacccuguccucggaagcuuuaaugcaggcauugacuucucguuauagcuaugaaaguccuagauggcaucuucuuccaacagaagaagguuguuuugucuccacugaaaaucuguuguuuaguguagccacuuucaucaauaaucuuagcuagaucuucuggauuacuugcugcagcuucuaaaucaguacuugcugcuucaccuuguacuuuuuauguuaucgagauggcuacuguccuucaaccuaaugaaccaaccucugcuagcuuccuacuuuuauucugcaguuuccucaccucucuuagacuucacagaauugaagagaguuagagccuuucucuggauuacagacuuugguuuaaggaaaugcugcagcuuguuggaucuucuauccagaccauucgaacuuucuccaaauuagcaguaagacuguuuuguuucuuauuauuuuuguguucacuacaguagcucuccaaauuuccuucaagaauuuuuucuuugcauucacaacuuggcuaacuggcacaagaggccuagcuuucagccuaucucacccuuuaagaugacuuccucacuaagcuuaaucauuucuagcauuugauuucaaaucacagaugcacaacuauuccuuucaguugaacccuuagagguuauuguaggguuauuaacugaccuaguuucaauauuacuguuucuuggaaacuagggaggccuaaggacagggagagagacagggaauggccagucuguggagcagucagaacacaugcaucauuuaucaauuaagaucgcuaucuuacauagaugcaguuuguggcaccccaaaucaauugcaacaguaacaucaaagaucacugaucacagaucacuauugaaguggcuacacugucugggguauauaccuugggguucauugucacgcauugagaaagaauucagguggguuaagggguggaaaguuuaauagagagaagaaaggagggaggagggcagcucccugagaaagagaaagagacgucugaaaaaggcugggaggccauggaccacagcagauuuuauaggcaggcugcagaaggcggugucugauuuauauagggcucacagauugguuucaucagauaugaugucuacauagugugcggggaaggcuggucacccuaccguaaucuucuuaugcaaauaggcuuuccaguugaucugcgccaucuugucugcuccuuuauaguauguguggcuggcagagaagggaagauggacccaccauuuugaaaaugucuaguccuuaguuccugcuggcacccaccugugcaagcuccuagcuugcagggugcucuuuguuagaaaaugauucaggacugcuuuucauuagaaaguagagccuuaucaagcgcccgugcccuuguuaucuaccuaauuccuucuuagcuccuguaucauuauaacguauguaauaauaaugaaaaaguuugaaauacuauugcaagaauuaccaaaaugugacacagugacacgaagugagcaugugcuuuuggaaaaaugcuaccaacagauugacaggguugccacaaaucuucaauuuguaaaaaaaacacaguaucugcaaagcacaauaaagugaagugcaaaaaaaaaaaaaagauaugccuguaauucuaauuuugcagaaaauacuauuuauauuuuaaguaacugaacagaaaacuaagcaaaacacaauaugaaugcuaacacaauaaaccacaagcucugugaaguuauauacuugcuaauuuaauuucaaagcuacaaaccaaacucaagucucaaaugcagcaaaugccucugaaaugagguuucuacggacucauaaacauaaaacaaucaaugcaaaagaauaauugaaaugauuugucuccuacuuuuaauaaggacagaauauuuauauguauaaaauuucucccaaguccaacuugaaugaugcugcccaacuuaggaguuuauuuguaagaugaagagaugugauggaaacaaagccaacaugcacacauuacagcaaggcuaucuguaauuccaaaaccuugucugguaaaaaaagaaaggaacauuuucagguuucuggcucgggugcuacuaaaauauagcaaguggaaaaaaugggcauuuggaugacaagggaauagacaauaaguucagguugaaauauucugauuuugaggucccaugggacaccuagagggccaaaggaugcaggucagagagccagagagagggcacaucuacucacacaggugaucucaccaagugaacaagacugcucagggagagugcgcagaauggaugaagguggaaucacugcaaagacgcuccugaagguggagugagagagguccaaacauaccagaaaagagugucagagaggcugggaagagagagugcaacucucaagugacccagaaaagucaaaucgaguuugaaaggagguuaccacauuucacgguaagaaaucuuccgaggccuuugugaaagggauagggauuauacaauuagaggugaggaagaaaagucaaugaauucagaaaguguuuuccuuagcagcaaaagaaacugguggcagagcugggaaaggggacacacagaaaaucacagaagcuccuccgggcagggagggaaagcccaggcuuuugucagaagauaggagcccuuagggagaaauuuuuuuuucuuuuaguuuucuuuuuuuaaauauccagucaugcguuguauaaggaugucuuggucaaugauggaucgcauauacaacagcgguuccuuaagauuauaaaacguauuuuaacugugccuuuucuguguuuagauguguuuggauacauaaauacuuaccauaguguuccaauugccugcaguauucaguacaguaacaugcuguacagguuggcagccugagagcaauaggcuauacuguauagccuagguauugugaaaggaaauuaaauuuggggaccccaaacucauuuagcuaaagggaaaauucaagcugggaacugggucacgcaaaccugccucuccuuuuugguuccuaaauaagauugcuacaagaugaaaagcuacaugccucccccauauuuuucucauaaggaaauuccuagugagcuguuaaaacuuuaccauggcaaugcaaacugauagcuuuaucuuuacagguacagucaccccagacacaaacgcauaucugacucuucccuuacccuauuuugucuguguuaucugauguaaaauacagauucuccacauuuuuccucugccccuuugugucauccuauguaaaaaaaauguagauucacugaggcagacaaaggcaugaaugacuauuuuucccuaccccccucuuacaugaaaacagugugcuucucaacucccaucuuuugcccuuuagauguagagcucucaaaaucaucuuuggagaaaggcauagaccugucucccuggcauguccuuaacuuuagcaaauaaaucuccuaaaaugauugagacuugucucguuauuuuccucgacugacaauguguaguaggcuagaccagccagguuuguguaaaaauauucuaugauguauacacaaugacaaaaucgccuaacgacuuguuucucagaacauaucccugucauugacacaugauuguauaacaugcacaugguauaaaugcccaaguuuucaaaguggguauacaaugacaacucaaucucccucccaccacuguccaauuaccuuccccagaggcaaucacuacuguuaagggguggguguuuuuaagggcacugaauuauuccaaaauagaauguacaaguuauucauuuaaaauaagucugcuugugacugcauucuaucaagauaaauuguuaagguaaagaucagaccaggacaggcuaccccugccccucuaccacuauguccuuccucacuacguggacccgccauuucccugugccuuucaacaauggaaguacuguguguggcaggacauacugagaauuaccaccuacuagaaaugauggcugagaaugacuucucugugacauagacauuuuuacauuuuuagcaaaaucauccaaaaugagguauaauuuaaguacuuaaauaaaaauaucaaaacuuauuuaauuacaugcuuccaaagacuuccaagacuuuuggaauucgcugauauaauacagguccugaauucuuacaaaugauggaauuggggguuugagucagguuuaccaugagucuuccaaaagucuuggaaggagaaacaaaguauuccgucuuaaaauaaaacauagucuucucuaaaucucaaacuuuucuuagucugguuuugaacuauuucuucagguaugugacuguauccuuuuacuuuucaaguacagaccuuaucacaggauaccuaacuuuuaauacuuuuuuaaaaaaacuaccaucacuuaaggaaaggauaaaagauauuucaaauccaaccagaauugaguuuuucucaaguuuccuuggguacaaauauauuaaaggaucaaaagugccuccccacuggcuuccuaauuauuucugccaaguacaaaugacaaguaugaacucacucuccacuuauagugagcuuuaggacaagcugccuauuuuuuauccuguuccuggcagagugauccaaauacuaaaaggaggcuuaacauaauugaaacaggagccagguauucugaauaaauucuguguacuuuugccauguagaguaacugcuggcaugaauuccacugccauggcauuucaaauaucucuuucuaccacucucacuuaccaaaccucuuccagauaaacauggccaauuagcacauuucuacucauucacacagaugaacagcugcuuaauuaaagaaguucauuccaaucuccuacuaaaauacuuuauccaagaauccaaugcuugcuuuuuguaaaauuacucaaacaccuuuacagcuuuggucauuucauaccagaagcaaagcuauucucugaaucuauuucuuuuuacuucauaaacgaaucaagauugagucacuucuaaguccaauaucauguggauauuacugcuccaugggucucuagaguaaaccugacucaaacccccaauuccaucauuuguaagaauucaggaccuguauuauaucagcaaauuuccaaccuaacucccucuggucuucccaguuucuuuucccauuuuggcuggcuaugucucucuuggcaagcuuaaagaaagaaaucuacuuucgccuagcuucuucuaaggguacugggauuacugacaggaucagugaagggcucacguugccagcagcacacccacuuuuucugccugggccuagucccauuucagugccucucccaagccuguauucuugacacaagaaugcaauccuguacucuugacaggcuccucccuguuuuuguuuugggaaacagccacaacuggacagucuaccuuccccaggcucccuaaaauuauggguaugaauaccuuucuuaaucccauuauauaccuggcucacauccaaggucacauuagaaguaacccaagauacacaguguaggucaucacugaagagcaaaagagaugaguacuucuaagaaaaguaaaaugcaaucauuauauaaguaccugaaagucuacagcagagagguuuccuacugaugcuccauagagguggggaagaggcuaaaaagaagugugacaauuacaagucuaaaguacugugagauuuuugcuuuuuucuuucuauccaauccacacaagauuuacauuaacucgcaaucauuaacucaguuuagguuccagggagagaaacaaaaauagucagacggcugguagcaaaugacuaaaauaacuuucuucuuaauuacugaucaugcaaaggaaggcaaguagucaaacugaaaucuuuauucuccaacuggaaauagauaccaaagaaagcuuacaaaauuguaagucuuuugaaaaauuuuaucuuucuaaauggugaaacugacuauaguuuuaaaaauuaaacuauguuaguacacaugauauccugggcacaauaucuguuuuaauggcuuuccucauauuuuuucaugcucucuuuucuaggcauccugaguuuccaccuggcuaaugaauuuagggugaguccugcaacaaaauucaccaauuuugucauuacuuggaaaaggaagucagaaggaaauguuaagacacugaauaaaacaugaucuuauucuuuccagucuuuacacaaugcuccccaaagagcauuucuuacaacacuaaggucuugcgauauuggcauagaaggguucuuugcucagauaaguaugggaaacacugggcuaaacacucagaccuuuaaugcgcuaauauguacugugaaucuccaagagcuaguaagguuguggguuguucuaauuuauuugaucaaagaacuuucuuucagggaaguguaugguaagcacauacucuaguuuaaaaaauauugcacuauacauaaacaacccucuacauauagauacacacacauuuuuuuaaaaaauuuugaaacguauguaauaugguuacguauuuuuuaacugaaaaaucacugugcauuucagcucagcaauugaagaauaaaacuaauuuucauuucugcauguauacuucacaguguaaaaauaaaaacagcaaaauauucuaguacucuuaucagcuauguggguuauauuucaaaacaugcuaaaugugaaaaccaucuuacccauuuuaaggaugaauaaguugauugcuugauaaauaauuacauacaaauauuuacaucguauuccaguaaacuuugaaaacuaucauguugagcuuauucuuauuauuugaaggaauucacagauaugaacauagaaguccaaauggauuuuucugugauaguuuucuaucuucuccucaucuguuuuguaguauuccuaaaaagucaguauuucucucauauacuugcagauugauuuaauuuuuguuuuaaugauaacuaacuuuuauucccaaucucacaguguuuuuaaaaagucuaauaaacauuaucaauccuguuaaaacgaaggcuuaugugguaagaccuacugacaaucaaauuuuuuacaggagaauuuucaccacuucugaauaaguggcccauguguuucaauuauggacaaaaucaacaaaacacaccaguaagugaagcaaaggaaaagccaugggccugaaaaccugggcuucucuuccugccauaacacaagcuauucagcagccaagaacaaggugauuccaugguccuuuccugugcaagacugcaauagcucuaaguggcccaauacaaaggcaguuccaacucagagacacagacugugugcccguuacaugcccaacuuugcacuaggugcuuguaaccucacagcagcaucauaaggauauuaucauccucacuuuacagauuacgaaauguagguuaaguguuguucagugaacugcccacaguuagugagcaagagaccuggacuuaaaacauuuauuugaucacaugucuaacaguccaucacgaaaucugaaagacuccaaacccaaaugucauguggcaucaggacccaaucauuacuaacagccacacuuaagaauaguugggaaaauauuaaaucuauaguuccaggacuucuauacauuguaguuggagacacaaaaugguacaacuacgaaugaagccugggcauaaggcaauaccaaacaaaacuacauaaguacuuacccuaugaccuagcaaucccacuacugggaauuuaacccauggauaucccuccaaaaacacauacacacaaaauuacugaaugaagaaaaaugugugacuguaaaauauugaaaacuuuuccuaaauauucaagcauaagagauugguugaauaaacugugguacacacauucaauacagugcuacguacaaaagaaugagaaagcucucaauaaacugauacagaaugauuucuaggagauauuacuaaguggggaaaaaaccccaacacaguacaaaaacccauacaguaugcuacuuuuaggaaagaaagaaugaagaaaaaaaugcuuaucuuuacaaaaagaaacacagggaggauuaaccagaaaacaaugaaguugguuaccuacaaggaagcauggcggaacaggguggaaggaaaaugggaguugaguuuuugaguaauuuugauuuuugaaagcaaguuaaccuucuacauauuaaaaaauaaaauuaaacaagaacgugaaggagagggagcuauaaccaaaaacaaccugaaacaauaaaccucaguagauuucaaacgaauacaugagcacaggaaugaagaaggaagacaugaaugauaagaaggagagaagggaggaccaauccaaguaaauuuugaacauaguauuugacucuuaggcccucugucuuggcaaaguggugcauguggaugaaaggacagcaaacaauuguccacuuuaguggucugaccaaagcaauucugaaacuaugugauauguguuacagaauugagcaaaugaguaaauguguggcuuuuuuuuggaagccaagguucucauggccaaagaaaggacauacaaauauaaaaugagggagaguaaggaagaacccuguggcuauggacagaacuggaaguaugcugugaacuccugauuucuaagcuauguaucaauauguguaugcuuauaugcacaugugcacauauauuucuauuuguauauauguguauuagggucuauguguguauauaugaaagcauuauucccuagcucugucaacugaaaaggccaagaaucaaagucgcccuaguagcaaugaccacaccuagcacccagaucuagaucauuuccuagucaaaggaaccagagcuccucggaagaauggcuaacacucaggguagggacaggguugauacaacaugcaccugaaauauauuauaccaaaaaaggaagauauuagcccuaaaaugaugggggcagaucccaaaggcaggagucagauugaaaggguucccaaugaccaaaugugaacagcaaaauaguuagguaccugugugaacuaaugcaagaacauaaaaccaaauaccagguguucucacuuauaagugggaacuaaacauugaauacacaugaacaugaagauggaaacaacagacacuggggacuacuggaugggggaggcaugggcugaagaaccaccuguuggguacuaagcucacugccugggugacgggaucauuaggaccccaagccucaccgucacacaauauacccauguaacaaaccugcacauguacccuuuaaucuauaauaaaaguugaaaguauuaaaaaaaaaauagguauguaauguauuuuaaaccauugaaaaaauagaaguuaauaaauacugacaauaaauaaaagggagagaaggcagugcucuuguuucaguggaaugcugagggcugacucauaaauguggagggaguacagagcuagaaaaaucagcguuuugcaaccaucuuaguagaagacgaucaggcaagaauccucaaugaaugcuaaauuuacagagaauuuuaaagaggaacuggguauuugcauugauuuaaaguaucuccccacagacuacuuauuaguugcaagagagaagcaggaauuauacagcagagaaaucaggcaacacuguaaugagugaucaaacuugacagccaacgagggacagguggucaccauaugcccccagaugagacaccugagagggacacuauuucaccuaugcagcuguacagcuaggaaugcauaaccuuagucuaaucaugaggaaacagcugaaaaacaugaaauaagaaacucucuguuuuaaaacagugggguauaacuguauucuuuuaaaaugucaauuuuauaaaagauaaaaaaaugcuaugaaaguguuccagauuaaaggagguuaucugaauucuauaccauaggggagaaaugcuaaaaaggacauuauuggguuaaccaacaaaauuggaauauggaagcuagaugguaaaaguauuauaucauuauuaauguauuaaguuguuaaccauacugcaguuacaucggaauaucccuauucuuaggaaauacacacuuacauauuuauagucuaugacauacguaacuuacucucaagcuguucuaaagagaaaggccuguguguguauggagagaaagaaggcacaaauaacaaaggaagugaaguaaaauguuaaccauaagugacucuagguaacaguaaaugaauauguucuucguaauauuuuaauuuuuacaacuuuuuaaauaaauuuugaguuguuuucaaauaaaaauacuuuuuaaaaaucuauauuaccauguaaaaugugaaaggaacccuuggcuuaacguaagugagaccucuugcgcuuguugacaaacagugaugacuccuggccaucaucgcuucccguguacucuccuuaaagcaagccggagaguucugccaaguggaucucauuacucacagccagaguugccaggaaccuuuugguucuacauccugucacacgggguaacuuuagcugagguuaguuuccugagguauuauacauaaaaguaagcacagcagcauuuauucauucuuucauuuauuucacaagugugcuuacuacaugccaauuucugggcuuaguccuguguuaggaauuacauccuccucuuguugccaaaaccaagaaauuccaguauuauccuaaauuccuauuuuccacaaaaacauugaaucugcuaccaaucagaaacaauuuaaccuccuaaaugcuucccaaaucugccgacuucuuuccgucuuugcagugaguccccucuugucuccccuugaucacaucuccuacucugucugccucugugcucacgucuguggcauguuccacccugcagccagagugugcuuucuuaaaugcacauccgaucauggagggugaagcccagaguuaauguaacacccaauuuccccgcaaguccucaauccauucucaagugcugagucugagcucaugcccacaguuaagagaggcccuccccuaagaagagucaggcugaaccaggcagugugcuggaaccaccccaccuucuuuaggucuucuaccccacaucuccagagggaauaggcagacauggaaacccaauccucacucccuucccaaucgacuggaccaauucucaugaugcuccuuaucucuguauaucucagucaccccccaguaaugcucagcauacccccucgccugucucuuucuucaucacuacucaacuccugaaacccuugcuuugugcccuccggaauucaugaccucucaucagcaaacccccucacuccucagucuguucucucauauguccuucaccuugcugcacuaggagaccccuggcucucucugaagacccuguuuccacuguagcccucgagggauggcugugucuucugucuccacuguucuuccaucucugaaccuaaaagugggaaggauccuuccugcuccacauugcugcuuucagaccguucucuuuccuucccccuaaaacucccagcuuuggaucucaucaguugaugaaauucugcagucuuucacggugggugucauccugaaagucacccuccucauauguugaugcuggcacaguaccugccagcuauauuucuguuuauuucccuugugccaaaacuccuccaaagaguuguccacacucaccaucuccaaaucuccaauucuuaucuuccuguuaccucucuuauggguuuuucuuaaugaauaugcaucaauuuauuuguucauucccccguuaauggaauucuggguuaauuucuuuuucugacuuuuacguaagugcugcacagaacaccucucuaggguacacauacuuaacaggggaacugcuggguugaagcucacucuuccaaucuacugaaacucaccuugucaaugaucuccuacauuccuaaauucaguggcccauucucagccuuuacccuguaugacauaucagcaucaucugacacaugcuuaauacaugacuuuuacuuggcauucagcauaauuacuguuccuucuaucucacuggaugauucuuuucagccuccuuugcugguucucucucuucuuuucucauuuauacucauucuccuagugauuucagguagucucguggcuucaaaaaguagcagaugccaauuuuauauauucaaauuuauauauucugcucagacguugguacuaaacuccaggcucacauagcucacuucuuauuuaauaucuccccuuagaugucuaaaggacaucucaaauucaacauguucaaaacgggacuccugaucuuccuccucaagucugcucuauccauagccuuccccaccucaccugaugauagcucuauacuuauaccuccugcuucucaggccaaacucguuuaagugaccaggacuccucucucucauaucugcccacauucaggaaacccuggugguaaaauccauaauccaacagcuucuccgcacuuuguugucacccugauccacugagauagagacacuaucaucucuugccuggauuuugaaauaagcuuaaguuguugaaugaguaaacaaguaacagccuuaguucucaagguauucagugaaaaucaaccaucugauaauaaacuuuaaaaaauuucagcaccuaguaaaaaacacguauuccuaaaaccaagaacuaacacauagugauaaaacaguagugauauuuucauuaaaacagaaagccaaucaaggaugccuuauacugcuauaacacuuaguacucuucuagaaguucggacuaauacuacaaaugugaaauuuacacaguaggauugaaggaauaaauuauuuucauuugcaagugauauaccuauaaaaauuuaugagaaucaaauuaagaacucagcuggaauacaagaauucggcaaaacgacuagauaugagauaaauaaaauuccacagcuuucaauucuccuaucaaaaaccaguuagaagagauaauagaaagaaaagauugcauccacaauagcaagaaaaaaaguaaaacacauaaaaagaaaacuuaucaaacaccaugcaggaaccuaugaauaaaauuagcaaaaaagggaaaauucuuaugauacaauauaaaauacaaaagcauguacaaaaccacauaggggauaaucuacauguauguauaaauauauauacauucacacugauagggugaaaucuagaagcaacuguaucaaaauauuaauauucaugaccucugaguuuuaggauaaugaauaauuuuaauuuucuucuuugcaggguauuuucuggauuuucuacagugaacauguacgaucuuuauacuaaaaguuuaguuuuuuguaaaaaauuauguaaacaacaguacuuauuuggaaguuuaaugcaugaaagcaucucugaauuuggccuaaaugcaaugaccauacuaagucuuucugaccagaccagcaaaccagcagaauaagcauuucaaccauucuucaugcugaaugugauuacuguuccaagugauggguuuuaaggggcuuuuaaauucaauuugugaguacaguuaggccuccauaauaaucaaccuaauucaaccauuauguaaaucacugccucacagagagguacccugguggagaaagagaaaagaccacaagcaagaauacuuaggaaacagaaugcuuugacuaaaugaaugugauacuuaacagcaauaaaaaaaaaccuuuaauucaagccucugaguuauaugaccugcuuugucaccuucuuaaagaucacugacauugagcuuaaugaccuagaagugugcagugccuugggccuccccagacauccauuucaucucaaagcugaggaaggaaugaggugggggugggagacaccuaagccgaguacacaggaaacagggucauucgauggagacugucauuugaaaaauaacaugaugauaucaauuuuguugcuguuguuuuugccuaaucaugaaguccaagaagaugaaaguucagcuuagcugggacuuugccaaauauuuauccugagacaguaguagacauauauuuuaaggcacuguaauaauaacaugaaagucauucaccagaggaccucacucacaaaaauaacuuauaaggaaagaauacucugaauaauaguaaugcuuccauaagucuuuugauuaucauauucugcuaaaaaaacuugaaacauuacuuucaaauauaucuaacagaucuuacuccuugcauuauuauuauuuagaugaauuauuauucaugugaaccuaauggcaacauagggagaaacuacaaaacccuccuaauuagcuacucuacuuuuugcaugauuuuaauucagucuuauauuauaaugcacaucuuuuaaaauugagaugucuaaucaggagcugaagaacacauuggauuuccuccaaacuaaaccauaagaacaacuauauggcuucuguacuaucauuucuuuaaaaaucuggaauuccccuuccuuacaaguuguuaaaacucauuucaaaauccaguuuuaauuguaucaguaaauggcagcaugccauauaguucaggaugagauaauguuuuuuuccuauuaggagaacaaagaguagcaucagguuuucugauguggcagcacacagugucucagugcaucagcucauugaucauucaacagauacuuaugaaguaccuacuacaugugaggcacucugccaaauaccauaccccaaauguagcugcagcucuccuauuccugugucucagugugugcaugcauaagcaccaauuuacuuuucuuuaaucaagaaaaucaauucaacuccacuuaguuuuuguucugcacaaaguuaguaucaaaaagacagaagaguagauucuccuauaucguguuuucacucauguaucccauaaauauggauuaaacaucuuauuuucacucauguaucccauaauaugugguuuacacuaguagcacuucaaugaagcauuauuuucacagguagaucaaaaggaagcuuucacauccuugccuucuuucgaccauuuuucucaaagacacacaucaaggcaugaaagcacauccaggcacugacaaguucugugcccauuacccaaauacucccagaggacauugccaaguugcaaagcaaaggccggcauuuuuacauucucccuugaaagcauccagaauuuccaucugguuugucuaucacacucaaugaggaaaagagcagaaguaagacucccaaaagguuguuuaauuuacauuagagcaaaauuagaaugcauuuuggcaguccugaaugcaggcuauacccuucugauuauaacuccuaccuucuacccucacagagaguacuggaaagcaaauugcacuaacaacaaugaucaccuccuauucucuccucugccuuagaaagguuuugcuuuccuuugcuaaaucuaaaaugcccauuucuccauuacccucucacucauuucuauucacuucccuuuccuuccuugagaaguugugcaugugaguuaauuaaccugguuccauguggaagcagcugaagaaaacauuucuucacaaugucuuuuaagcuacaaaugaacacacaagacaccccucuucuaauuuaagcuaagggcuuggaaacuuacaucuuuucccaguacucugaguucaaauugagucuccuugaagugaaccuuuguaauccgaggccuaaaaaacaaagcagaugguguugcugcuguuuuuaaguauuaaccuuucagaaaaucagggaaguauccaguggaaaaagacuggugaauacuggcuccuuuauauacugcuccauacccaguacauacagcgacagagagauuuccccauacacucuaaugaaaacuccauucucauuguccuaugcuucuccacuaaaugcacaaugaccuuagaaucccuagauuguggcagugcugccuucccaaacacagugcagagccaugggcuucccaaucucuccaacucauccccauuuggagcuaaaagucagaauaguccuggauccacagcccaccagcacauacugaaaugggugagaaauccuacuacacacagcucccagggaaaagagagucuagaaucacagugucugaaauuuacagagaaaacauaugcugaggugcaacaggagaaaacucacacccaauuucacucauuuauuuaucacccacuggaaauauaccuguuuucuuuuccccaacucuuucacugacacaggagucccauaagcccaaaacauagaaugccaacucuguucucaagccauaccuaccagaaauacuuccccacuugcuuuuuauucuuguacacaacaacaccaaccggaguuaauccuaagaaauacucagacuuguuuucucccugcaaaaacaaacauaugccuauaaccacauauucacauaaaaucucuuugucaaacuauaauugaccauacaaauauaauuuguuacauuaauauuggauuuaauuuuugaaagacaucagccuagaaagcuagauacacuaugauaguagcuaacuuguugcuuauuuuuuucaaaguuuuaaaagaaacuuucuguuggcguucuucauacuuguuacuucaguucauuaaaaugagccugggcuaccagucaggccaaugggacuuacccaacuuuccuuacacagugguguucaauccuagcaacauauuaacuggaaucacugugcagcuuaaaaugcugaugccugggcacuaccagaaacaguuaaaucagaaucucuaaugaagaggccaaaguagcagaaaaaacacaggacucccaggugauacuucuguacaguuaaagacugagaaccacuggcaucuaucaagggugcuuuugaauggcuugauuuaucuccgaugcggacaaucaugaaacccacugcauccccaccccaacucucucuagaaaguuuaggcagucacuagcagacacacacuugaauuuuuugaagucucuaucauguuucuuccuacuuccaccuauaacuuuaagagugcucaaaaauguaaaaguauaaucucuucugguaaagacuagagaaccuuuauuuuaaggcaauaauaaauccaaauuuuaaaaacaggaucuuaaaaugaaaaagucauagaguagauaccaaggacaugcacagcacuguuugugagaauguuauuucuacucuaagauaaaugguaaccugcaaaauuauauucacaaagaacauaaagcaauacauuuggaggaauaccugccaaugcccacuuucaguucuuaaaauucaaaucuuaaaggaaugcacugaagagucuaauaaaucuagcucauuugccauaaauuucuaccaucaacagaaggugauuucuaauuaggauaaacauuauacaaauguagaagcauuuugcagaagacucucuuuauaaauuuccuauggaaaguuuucuuuuaaaaacugaaaaccuaacaagauuaauguggcuaaagggagggaagguaaaacgauaaugauucuacaguuuuagcaguauucuuaaaggacagugcuaugaagcauuaaugaccuaaugaaauuggaaucuaauauaucagggaacuacuucuuccccacaaucuauagcuuuuauugccacauuaaacaggaaugcuucuaacuguaaaaauaauaugagauuguuucuucuuggaggaaaugcuaaugagcaaaagacauauacaaaaugaaugcaugaguguuauuugcacuagauaaaguuuuauuaggguucuuuaaaaacugaguuccauaauccaauugauuaaaaaaaaucagucuauaaauacucuccagcaauucauuuccuauaaagaauaaaguaccuggcucauuuccucaaauaaaauuuaacuauugcuauccacauuccucuuaauucaaaggcaaaggcuuucuaaucucauugacauagaauaaucaauugguagccuaagagaaguagcucaaagguuaaaacccggauccagaacacucagugcagauucaguguaauugcucacugaugacuauucagcaaguuuucauaaaccacugaaaaaaaucugcaaaaauauuucuauuaaugcagugauaccuacaguaggugguaaccuucauauugacagaaucaacaguaguugcaccuggccuauugccuaacgcauccuuuaccuggcaagugauuguauuuauguuuugcugccauaaaaucuauuuuuugaaaaauccuccuguuuucugucuaauacagucaauuacacaccaauuuuuuuuuuuuuuuuuuuuuugagauggggucuugcucuguugccaggcuggagugcaguggcacgaucucggcucacugcaaccucugccucccaggugguucaagccauucuccugucucagccucccgaguggcugggauuacaggcgcccgccaccacguccagcuaauuuuuguauuuuuaguagagucaggguuucgccauguuggccaggcuggucucaaacuccugaccucagaugauccacccaccucugccuccccaagugcugggauuacuuacaggcaugagcaaccacgccuggccuauacaucaauuuuauauuguuuugauguuuagcuaagcccuuuguaucuguuauccagauuguguuuucaagcccacuuaauuguuuucuacacauggaaauauaaucacagauuuuuaugcaaaacucauuaggguuuaauccacacgagagcugcuuuguguuagaaaaacagauaaaaaaguaucaucugcuugcuaaacaacaggacugcagcuuuccuuugggagucucagugacuuuuuaagaaaaaugucaucagcuuaaaauauuuuguguuaauuaaauguuacucacauagacgggauggaggucaacgccauacaucuccagggauuuggcaguccucaaguaauucagcucagccucagaaggaaucugaccccuacacccagcacaaaaacaaagagccuuauuuuacagcagcuacugcacuuacagggaugcaaacuaucuucauuguauucaaugggaaaacaaauaauacuuuuuacuaaugcaaacuuaaguccuuguauuucaagaaggccuuugcuucuuggugacaaaauuuuauacucugaagugauacuuauauuaauuucauuuaccaaauccauucuggcucauuauagccuauccccaaugucccagcauauauuaaaaauucucaguuucagaaaccccuaaagagguuauugagaauauaagcacucaaauuaaacaccauccccuucacaaagaguaaaaugucucugugcaccagcagcucuccauccaaagcaaagggaacuagagcaauggucagcaggaggaagagaauggggcugccaccacccaacugggaucauaucgagaucuccugaccacauguguaguuugaaaauacauugauuaacguacagagauuguaaaaaaugcuugucauuuucuuaauacacaguacagaauucuucccaaaaucuucauuggugguaauauaaagaaaacagcauucauuccugaugagggugagcaucagccagaaaucugcacagaagaguuaaauaugcaugugcaagcgagugugugugagugugugagagagagagagggauugagauuuuaauagauaaccaaaggaggucaaaucucaaaaauuaagaaauccugcagugacauauuucauuucagucacaaugcacuggaaaaccaccaacguaccauacuuuugaaauccaugaagaauguucaucaaauuagacacaccacacuuugaucaagcuuuauucuuagaaauaacagucacaaugucaacacuaucaucuaaaacacaugagagccuuuacccaaagcuccuugauaauuucaauauauaauugugcuuugaaaucccuaguagaaucaguacucucauaaugugccaaacacauugcccuuccuaauguuauaacaagcacucucugaccaucuacuucagcagaaucugaaaaugaaggacucuacaaucagguuggagagccuucuagugcaugcuaauacaacauagagggccucuuucucugacugcaauucagcagcugacuucugcuucuacacucacugaaacggauccuuuaggcaaacauuuuuuugugaccagauuaauucuacauuuuuuucuuuuuuuuuuuuugagauggaguuucacucuuguugcccaggcuggagugcaacggcgugaucucggcucacugcaaccuccaccuccaggguucaagcgauucuccugccucagccucccaaguaacugagauuacaggcacaugccaccacgcccggcuaauuuuuguauuuuuaguagagaugggauuucaccauuuuggccaggcuguucucaaacuccugaccucaggugaucuaccugccucggccucccaaagugcugggauugcaggcgugagccaccacgcccagccauguuuuuuuuccuuaacuauaauagaucugaaaccaaguauauucaagaggaaguguuacauaacagggaauaaagcaauguuaaccgguguaaagaauuuaaccaaaauaacuauaaugaaauuaaaacuucagugcuauaggccaugaauugaaaauccuacuaggggagcgugucuacucucagaaaugcaugcaguguuaucaccauacccucaaagguuucacacuggcaucaucacuauuuccagacucguugcuauggccugaauaggacuuggcuuauaaccgugaagaacugggauacuucagacagaggaaacauugaagaauauauuaaugcauuuaugguuaaaaauuguugugauuaaacauauuuauagcugaaagauuaauuucacaagauacuggugacugaaaaaaaaaaagacugcaaaaucuaguauuuacagaaugauuccacuauguaauaucauaaauacaugaaccuauguaugacaaauuuucucugggaaauuguacauacaaagagaugucugaaaggccauugaccaaaaaaugguaacuuuacauauugaaauuacuuucuccuuuacacuuuuuaaauuacugaaguuuucgaugagcauuuuagaguuaaaaucaguuaaacuauacaaagaggaguauuagaauauuaaaugcacaggugaagaauuuaucauucuagaaacuuuucuugugaauaucagaagaugaugacugauggaugaugcaauaagacaugguguaaugauucuuacauuagaguuuuaugaauccuuucuauggcuucuucaaguucuuccuucugaucaggaacaaaccgguacucagauacauauccugcaguauguuuauaugggucauaaucuccaagcuccgcuaaaaaagaaagauaacauaguuuuuuccauuuuaggaaaauaguccuuaaaacauagaaauaaaauauuccuaacaugcuuaaacauuuuuucaaaugucuuacuaaaauucacauauaagacaacuaaauaauuuuacuaaaacaaaucugaugagcauauacggaugguagcaacaaauucuggacuuaaaaacagaaguucuuuauuuuugcauucccaaauacuauaauuauaucaucguuuuuacuucaauuacucuuaacaacguaugugaaguaaaauguuguaaacagcauuucaaguacaaacauuagaaaugcuggaagugaaaaacaaccaugaccucaauauauccucucagauaaugacaccaagaaacagugcaugugauucaauacaccuuugccugaaauaaugaucauggaaaugcaauacaaugcugcacauaucccauuacaauuuacacaaagaagcaaaaugauacaagaaagcccacuauauuacuccuauacaaaugcuucuuccuauguuaaucuaccuugcaagccccaacccacuucaucuaugacauuuuuccuagcauauuucuucuagauuauuuuuagucugcaagugccacaagggcaaggaccaugcuaucuuauucuccccacaucuagcuugauucuuagaaggugucuaaucgucacuggaaguagucucagccucagucuccaaaaugacaaugcauccuggagccaccccacacagccaccguauuaacaugaagagcugaagagcacugagcucaacacccaugccacaugcggaaccuagcaauagcaccuggccaugcagacucuucacaacagcaaugcaggagcaaugggaucucugacacauagaagcuugggagaggguguggggaggaaaaucaauaaacucagaugagauguagauagaacagauuguuagacccuccacuuaaucaagaaucaaugcuauuccagugacuaaaccuccauacgaccuaccauaagggauuuguacuaggcuccacuuuuaccuguuccgaaggaacacugaacaaaacuugaauuccaaauaaauucaauuucuuuuuuuugcaaaaucucauggauaagaagaguuuuaguauguaaacucccuuuuaaaaaugcaaauacuuucuccagacauuucugaggcaaauaugcuuaaguggcaccuacacuggauggcauacgcucccagcugagcagcaguguugacgggacagggcagacggcccugaaggacaucuugcuucaccugcaagaaaaacugauaucuaaaagagaaacaaaaagagagauuaacgaucucuuacacuacucaaaccugagguuucggacccugauaaucaagguuaacaaccaaucaccuucaauuaaaauaaagucaccccccauucuugugugagggggcuguugagugaacaggaacuacuuaaacauaccuuacagaggcaauacacgguugucgcuaaaaagugcggcuuucaaguucaacugcuuggcuuacuucccagccccagcauucaguaccucuguagccuuaggcugcugcuuaaccucuacaacagccagccuccccaccugcaaaacuggaacaguugacagcauccaccucacagggugaaugcaaaggauaacuccaagcucuuuuaagcuaucauuacugccacugccaccacaacaugcucuuacugggaggaagaaaucacaaagacccaaccuauauuacauaacacucugccuauuaucugcucauuccauguugccaaaagaaaaccuguuauaauaguaaugucaugcacuguucuaaacacuacacgguaacucauucuaaguaauuuauguauaacaacuuagguuaagacuuuaaaaaugaagacaguauauuauauucuccauugugcagaugagaaaacugauagacucaggggugaaauaacuuguccaggaccucacaacaaauuaagcagcagaguuagagcuagaacccaagcaaucugacccuggaacucuaucaaucaggaugucauguaacuuugauuaguuuuauuuuuuuucuuauucagcuauucugcuaguggacugagaggggccagagguuuaugaaccaacauaauuaaccauccacaucauccucagaugcuagcacuuacacauaugcacacacacucucacacacuucagccuguccuuuugugacuucuguuuuguaaggugacucgaugucacugggaagggaagaaaaaaaacaaaggaaaugaacuauaauaaucagcuauauuaaauaucucuucuccaaaugcacacaaccaaagcacuuagugaggaaauguuacauguguuagauaucagacaccacauugauuauuucaggaagauuggcaucaacuuuuauugcaaccauauguuucagagaaaauuugcucaaugucccauguuuccccacugcccauuucaguaaauggcacccccgccuucagauguccacguaaaauaaaccugggaacaacguguaaucaucccuggcacccacauucaaucaccaaauaugcuguuucugaaaucuauacuucucuccauccccuacaccaggucacucucuccuaaacuucuaaaaccuccuccuaacuguucugccaucacucauacuuacuuuccuuccaauccucccaagagguaagcaggauucuuaagauguaaacaggaucaugucacucuuucaguuaaaaaaaaaacaacaacaacccucaaaagacuucccuuugccuuuaggauaaaguucaagcuccuuaagauagcuuguaaaacugacuucuucuuacuucugcuuacuucuugggucacuucuugcugcugaucagugaccacccuguuccauaauuuacacaccuuuuuccaacccuauuuaacuauuuucaauucccugaauguucaccugagcauuaaauccacuugauaaugaucaucugugcuccucuuggaaaggagaaaagcagagucaaguaaaauuaggagaacuuaaaauacaaaaccuuauaaacaagagugggcaugguggcucaugccuguaaucccagcacugugggaggcugaggcagguggaucaccugagaucaggaguucaacaccagccaggccaacacagugaaacucuuucucuauuaaaaauacaaaaguuaggagugguggcgcaugccgguagucccagcuacuugggaaggugaggcagcagaaucacuugaacccaggaggcagagguugccaugagcugagauugcgccacugcaccccagccugggugacagagcaagacccugucucaaaaaaacaaacaaaaaaaaaaccuuauaaacaaaagagacaacugugagaauuaucacugcuugcugcuggaaacuugcauuuuacuacacccuccuccuucucuauuggcaucuucaaauuucuuuuccugaaguguauuuuuuuaagaaaugggucagagaugcaaauuucucuuccucuauuaagacuuugugcacagugguucacaccuguaaccccaguauuuugggaggcuguggaaagaggauugcuugaggccaagaguuugagacaagcauggacaacauagugauaaccccaucucuacaaaaaacaaauuagccagccagguacaugcauguagucaccgcuacuugggaggcugaggcaggaggaucgucugagcccagaagguugagguugcagugaaccauaacugcaccacugcacuccagccugggcaacagaauaagaccuucucucaaaaaaaaaaaaaaaaaaaaaaaagacuuuaacaucugacuagacaaucaaaucuuuugccaaauacagaaaugacagacaucugauucaaagacaaaaggaaagaggaacagaggaacagagagauuaaaaauauguauuagaaaacaaagagcugaaauacagacaaacacauacaaagaaacaggagccacaucacauuaguaacugcauucccaguaucuagggcucagcacauaguagcugcuuaauaaauacuucuugauuugcaaguuggauacauggauaaacagacaaaauucuaaaaacugguaacaucauuugcugucucugagaaauucauaaagaaaaaaaaauaucuacucaaacuucccuggauagccugccuuuuaaagauaucacagaucuuuaacucacugcauuaaaaaaaaaaucaaaaacugaaggcaaacaauuuuuaauuuaaaacuugauuuuuauuauagcaagcaucuuaguagagucauaaggcaaauuugugauaaaguaaaaucauauuuucauauguuaaacauuuuauagcgucucagggccuauuuuaaaguaacuauauauugcuuauuuuguauauuuuaugggguuuauaguaaauuuaguauuuuauuuaaauuagaacaaguuagaguugcugagucuuuccuucugugucacucugauuaaagcuaugauggaaugcuugaguccucauuuaucucugguuuuaauuaggaugaaccuaugugccagucugccuaggagaguacuaauuuaugccuauuaugaauauauaauuauuaauaacucacuucaucauucucuaaagugucaggaguuuggacaauaaauuauacugugacucuaguuacauuguaccauacuggggaaaaaugcuaacuaaaaauaucuacuuaacaaggaaguuuccagaauacauugugguacacagcagaggcuucaugaagcaguuucugguuaccuccuuauguaaacuaacaaaccgauguauaugcacugccccugagauuuugaguuauagguggggaggagcauucugucuuccacucuaucuguacuuaacacacugccaccaccaccagcacaacacgagagacgggccugaaauauuggccucacaguuuucuauuuaucuaauguauguugaaacgagcuaaauugacaccaaggauguacaaguuguugaggaccauuaacaauuuagcaauuagaggcaagaagaacagaccaggacuuucuuaaagaaggggcagagagacagaagcucaaaacagaaggcuccuguaagauuccuggccaagaacagucaugaaugcuuacaccaaagaauccugcagugcaccuucuaaugacuuaagacccugcugagaaaacugaaggauguagggacagggaggaguuugauuuuaggugcuagcugaaugugaaacaggagaaccuagaggagaguaccaaccuacacagagguaauaaggagugugaucguuaccuucaucccacaaagagcaggaacacagcauuuuaucuaaccagucuugauaaaacuuaaauaugagagucaaagggaaacauuuaaaucauaacaugauauuaaauaaugcagaaaaauggcacauaugacucagcagaaaaacaguagagaaaaucauaacucuuuaaccucuaaaguuuaaaaccaaugaugaaaauauggaaacaaauagcaguaacaucaccuuacauuuauauaguucuuuaaaguucacaaaguccuuucgcuuccauaaugacauguaacccucaacucugagguagaugaggaccauuaccuucagugaaaggaggagacagggacucaggaaguaagcauaggacugaaggucacacaggaagugaggaagccaaauaaaacaaacccaucuucaccaagggaagauucuggguugcaaaaagaagacaugaacauaauaucaauccucagcaaaaugcugugaaauauuauuuuaaaagcuaagaaaaaaaucgaacaccuguuuugagacucuaaaaaauauuaugaaugagucaucuggaacuaacauuauuuucuacuuguagaaagaguuuuaagauccuuaaaaguucagggacauuccaauggcauuucagauagggcugucagcaagacaacugacagauucucucuucgggcagacugaaaccagaucuugcccuggucaccacugaaacuccuuuuacucagcacacuguaacaugguacuccagauaguuacugaaugaaguguaagggcauucugucuugacauacaaauucaagaaaugcaggcuagaggggauaguaaaaugauucauaguuaaaucagcaccuacaauaagaaggauaugauuacuggauugacuuaaacaugcaagaagaccuaucucagggcuccaagcuggucuuuuccaaauguuuuaaucaauaauuugaaaauauaaaacaauaaccauuauuuccaugucagcuaccuuuaucauuauugaacacuuacaucuuugcauuaugguaaguacuuugcaaguacacucuuacauauuccuccaagcaucuuuuugaagaaauacuguaaucccauugcacggaugaaaaaacugagacuuuacaaaaggcuaugcaaucuucucaggauuacagaacuagugaaugacaaagcaaggaugcagaccucacucagccuuucugauucccaagccugucuuuuaaacaaauguauguauuauacuuaucaaaucuggaagauacagagcuaugaaggacacacaauacagggaaggaugucauguuuugaaucagaacugaaaauaaguuuaacagcucuccugaggacacgaauuaucuacaguacuaauaaagaauagagagaucagauuuauucugcauagaccaucagggaauuauuauuucuuauugaauuucuuagugcuuuucaaaggagcuuuccuaccuaaaagugcuuaauaggaagcuggcugaugugucagaaauguucuacacggguggaguucagaauauacgaccugaaaguccccccaguuucauuuacuucagaaaacaucuuagaacacaagcggggacuccaaguugaugauucuauuaacguacauuuuucauaaucugaaacuuuauuuuccuaucacauucauuccagguauuuuuuccuacaucaguguccuucugaaauacugcauauauuaauaguaugaccauauauaugcacgagaaguucccuguagcauuauuuguauuuuuuuuuuuuuugagauggagucuagcucugucgcccaggcuggagugcagugccgcaaucuuggcucacugcaaccuccgccucccggguucaagcgauucuccugccucagccucccaagcaggaguaaccgggaguacaggugcccgccgccacgcgcagcugauuuuuguauuuuuuuaguagagacgggguuucacuguguuggucaggcugguuucgaacuccugaccucgugaucugcccgccuuggccuccuaaagugcugggauuacaagcgugagccacugcaccuggcccuaauuuuuuuaaaaaaggaaacaaccuggauggccaaagcauauaguuaauuauggaauacaauguaggaguaaaaagaccggguuacagcacuuugggaggccaaggcagguggaucaccugaggucaggaguucaagaccagccugcccaacauggcgaaacccugaaucuacuaaaaauacaaaauauuagcugggcaugguggugggcgccuguaaucccagcuacucgggaggcuaaggcaggagaaucacuugaacauaggaggcaaagguugcagugagcugagauugcaccacugcccuccagucugggugacaagagcaaaacuccgucucaaaaaaaaaaaaaaaaaagacuggguuagauggcgaaagaggccauacaauauguaugaaauaguaacaugucaaaaaaaauacauaaaagauuauguauaagcacguuuaugauagcaugaucauucauaccaaaaaauuacagacaaccuaacagccaacgcagaguaggcugguacaauuuuccaaagaacuaaauuaagauaaacacucaacuugaaaaugcuggcagaaguaugcucuuccuuaaauagcauauaucuggagauuuugcuuguugguuucaguucuugcuuuugccaaaauuaucucaugugacuccucuuuuucagguacauuaaugguaauauauucaugcaaaucaauaauaaaaugaauaaugugcauauaucaauguauuaaacgcacauuuaacuuaccuaaauucaaccauauguuuuaggcaacaaaucauggacacuaauugcaagccaucuaugucacuguguucuuaacuacacaagcuggucuaaaacuuucaauacaacugguuguacugaaaauauuguggguuguaaauuauacaaaaauccauguauuccguuaaugagccaucaguagauucuguugggaaauuccuguucauguguguggugaacagaggugaaguaaugcauuauaaaacaaugaucuuuuuuaucccuucuuaaaauuaacucaaguauuuuuggacccuaaccccuauugaagauauaauuccacuauacaucuagaaaaaggauagaaugaaauaaguauuagcauucaucaaacauaguacgagacacggacaaucauaagagcuuuauauauauuauuccauuuaaugcuuacaaaaaccuugaaacagguacaucuccaguuuuacaacugaggacacuuaggcacaggcagagauuacucacaaccugaauaugaaggacuuucauuuuauuuuuuaaaaaaugcuguccccuugcaauucccuaacgaguuacagauauaaguguauuuuuuuauaccacuugaauucaguuucccucugaaacucuaaugaaaauaccaucccuccccucaacauauccuccccauccuaauggcccuuuacccagaaagaugugcucugcaaaagcuuaaacuggcaugucuacuuuucaaagugcucauuaacaaugugauaaugaacaaugugaaugcagacaucugcuugguucuaaaaaugaggucuacgcuggcacagugacucacgcugguaaucccagcacucugggaggccaaggcaggaggauugcuagaagccagcaguucaagaucagccuggccaacauaacaagacaaaaaaaaaaaaaguauuagcuagguguaguggcacacaccuguagucccagcuacuccugaggcugaggcgggaggauucugugaacccaggaguuugaggucacagugagcuaugauuacaccacuacacucuagccugugugacagagcgagacccugugucuuaaaaaauuaaacaaauacagauuaugaaauauaaucuuuucaucaaucaaucaaucauuagaguucaaaagauuauaucuuaaguugagggauaaaauaaaacaaaguaaaaaugaggccuaaauauggcacuucaaagugggaugaaaaagguccaauuagccuacccucuucuuauucuucugugugcaguccagaauaaagaaaaaagaaagucugagacagaugaaagcauggaauagaaacaaaaccacaggcuaccaaagacaugauuuucaacuuuuuuaaaggagguauuaggcuuuauuuuagccccuaauauggguucacugggaaaacugaccaccuacgguuaaguuagggaauauacuuuuguuuuuccuaccacaugcagcuaggucaccagcagaauaaguuaaaauauaacuggucuguuccuuaugagcccuuucaguuguugacauguacuauuuugacaaccuaauuaauaccaauaggaaauucugucuuacuaauaucaaauauuuggugacaaaggugaaguaaugcauuaaaacauugguuuccauccuuaauacuaaaagcaaaauuaucuucucauuuccuauagagauaaaugaaacaccuggagagcuaauauuuaagcuacaaccaauuaaaaagaaauaccuggcugggcaaauguauauuuagaaguacaaacugaacaucaaaauauccuuccuuuaggcaguucaaauaacuucgauaugaauacaaaggcugaaugcaugcuuaacaauaaugauacagaaauauuucaucacagcagaugcaaaauguaucaucaugucacccagguucacgccauuuucaaacacaucuaucaucagacacugaucaacuucaugcaaugcuaguuuaaauuuuacccucuaaggagaugcguuacaaaaugcagguagacacacauccaaacguuuagcccaauuuuaauuuguuuuaaauaaagcuuuuuguauaugcaaugcauguaucuguucaaaaacaaagucaauacuauaccugguuauuucuucuuuaaguuuacauggaucuucagcauagaauuuaauaccaaaauacaaaguauauggagguccagcuaaaauaagaaauagaaauuaaauuucacuaaaaucauaaauuagucaaaguuacaguauaauauuauacagcuauuuacaauuacacuccaagauugucuaaagaaacaagaaaacauaagauaaaaacagcaagguucagaacugugacgauaggaccucgacacauacacacacacagauaaaagacagggccaaauacaccagaauguugcugguucuuaugucugguuggugagguuauggacaauuuuuauuauauauguuuuucccauuuucuauaguauauauguaauuuuucauagugaagaaagaaaaaaaauaaaugguuuaaaaaaccacccaccuaucauuucauuaaaaaaaaauaguuuuuaaaccuaucugcaaaaagcugaaaacaacuuaaaugcucagcagcauguggacuauuuaagucagccccagccacaggacauauaccaugcaaauguuuaaacagacagaagggcaucugcaugugcucauguggaaaagaccaacuaucuaaauuuccgagcacagaaauaucauaccuuuugugaaaaaguaucaguuaauauauauuugaguuuuuuuuccuggaagaguacaaaaaaaauuacuaaauggcaaacucugggaagaagggcuagaaacauucuauccuuaaacuaauucauuagaauuuucuuaugauaacucuuaccuuuuuuuacaggaaaaaagucaucagugaggcuacauaauaaaauuagggacaauauuuguuucauucuuaaacauuucugaaucuaaaaauguguucucacguauuuaagaaaaccuuucucaucucauuaauuuaccaaagaagaacuaugccuacaaacuuuuuuuuaaaaucagaaacaaagccuggaauuguauguacaugggcaaauaaaaaauaaacacucauauugugcaagaagacacaaaccccuugggugcugaacacauuauauuaugcuuuuacuagaaauauuuuuauuucugaggguaucaaucuaaucuguacuguuuccaaaagugcauauuuccaagcugugcaguaacuagaucuaauacacuuuguuuuuaaaaggauuuguuuuguuaccugguauaccaauuagugguuacggguguuaauuuuguuuuccaacaaaagcucucccacaaauuaaaaagaaaagaugugaagcaugcaucucaguaaaagucuucgauacuaucuaaacugauaaaguaaccccagucucgcuauucuuaacugaauaaauaaagucacaaauuuagaaacuggggaaaagaaauuaaaaugaacaagaauaaagguaucauguauuuauaacauaugaacuauguuacuauuuauuaauauuacauacacauacuuaugugugcagcacccuggaacccuguuccuggcaugugggagaccaucaagaugaggauccugccccuccccucaucugugccuuccuguguaaagacacuccuuaugcuacagcuuuuuuaaaaacuaaacuuuaaaagaaacugcuagaauuucuuauuauuggaguugauuccuuauguuuaacuuuuauguuuguuuaaccacuguguuuguauuucugacaaauacaccucuaucccugaacauagaugucagggaggcacagacuauuaaauauuuagaagagccaggaaguccacccucagcuuauccgucugugucaaucaagcuccauguuccugagcagaugggucugccugugcccgcaggcagcugggguugguaccuagggggcggggaggagcacagaugcugcugagauggugcacaaagggaagaggccuucuccaggccucagagcugcuucuauucuuuggaacaugacagauuacacccuauucaccaagcccacgcauuucaaauguucaguaugaacaguuaagcaaaaauguuaaaaguacacaguuaaaaacauuagguuuuggcuaauuuucucuaaggucuucuggcccaaacuagaccuucauuucccauucacauauaaaauggcuguguucuaaauauaaggcauuauuaccauuugguuacacuucauaauguacgaaaauguuucauaaacauuugauucucaacaacaaaaacuugggaacauaugcaaggcacauuaaacuccaaggaguuaaacaacuugccuaaaaucacagggaagaaaaaaaaguuugcuaucaucuagggcucagcacuuuggggugcaccauucuauacagcuucucagggaaauacaaaauaauaauaccuuuagagugagauaauacucucauaugcaucacuguuucagaaagcaaucaaaggcuauagaaaugaacauuuuggacaaggauaugucuagccagauauuuuuuggcucccuauucuaagacugacuacaaaaaaguaaggugcugauaauucaaauuacaaaauuauugucuugaauccacaucauuccauggacucaaacguuuaagaaacucuuauguaaagugaaguuaauauuguuucacuuuagcaaaaaauacagaagccaaaaacugggaauccucuauauuuuguguagacuaauuuugaggucuuugauaaggaguuucucauuaacucaaggagaaauaaaucaagauuaacuauaagcauucugguaacuagcaaauguucugucauuuuuauagauucucuuucugacuaaucuauuagagauuugauagccauuuuccuucacuaucaaauaauuucaugagauaaaauguaaggauucuucagucacuaacguuucgucaauuauaauaccaguuguuuuauucuuacuauacaucaauuuuuuuuuuuuugagauggagucucgcucugucauccaggcuggagugcaguggugggaucucaggucacugcaaccuccgccuccuggguuuuaagccauccucucugccucagccucccgaauagcugggauuacaggcacucgccaccacaucuggcuaauuuuuguauuuuuagcagagacgaggcuucaccauguuggccaggcuggucuucaacuccugaccucaggugauccaccugccucagccacccaaacugcugggauuacaggcauaagacaccacgagucuuaugcaaauuuuuaauauugcauuuuuagaaugaaaaagugacugcauuauagacugauacuuaaauaaaauauuucauaccauguaaauaaguagacacuuuaaaugugcuuaggaacacuuuaauaaugcaccuuaaaauaauuaacauuuuuucaucaccuugauagaaauaucaacuuuuccuauaaaagaaaccugugaguuuauuuuaaaauaauuggcugggugcaauggcucacaccuguaaucccagcacuuuuggaaggcucagguggguggaucaccugaggucaggaauucgagaccagccuggccaacaaggugaaaccccaucucuacuaaaaauacaaaaaaaaaaaaaaaucagcugggcaugguggugggcgcuuguaaucccagcuacuugugaggcugaggcagaagaauugcuugaacgcaggaggcagagauugcagugagccaagagcucgccacugcacuccagccugggugccagagcaagauaccgucucaaaaaaaaaaaaaaaaaaaaaaucauuccugaaauuuuucugguuuuccaacugguauuuuuuuaaucgguucaaauaugcuagagcuguaacuuguaaacuccagugguuuccacuacagagguggaaaggcgaugagaaacaacaaugaugcugacauucauagaaacaggacuuucggauggcuuugcaguccagguuuccaguuccuuuuggaagcagagcuacauuccugcccuuggauccauggagcaucgcacaaccaauacuaucacaggaaacaagcugacaugcacagaaaauacagacucagaauggggauaaugaaugccagaagaauccacuccguuuugauuagcaauaauucacacaguucagcaaaaugcuuuaauggggaacagaguuucaguuuagggagauuaaaauguuuuggagauggacagugaugaugguugcacaacaacguaaauguaccuaaugccacugaauugcacacaaaaaugguuaaaaggauccauuuuauauguuauguaccuuuuauuucaauugaaacagacaauuuuuuuaaaaagaguauuuuuugcgcacuuaaggagccucuguuugugcuuauaaauaaaaacuuggguucuggaaauuaagauuaaggaauauauacuuaauuauauugcaucuccuuauaauauuuguauugauaaaaccaaaaagcuagcucccaaaaauggucucucucugaagaccacuuuucagaucacaaaggcaccucuuacuuacuggcuuaggaaacugaguggucugaauggcaaaaccaugccauaacccaagaaacucaagcucuuuaaaagcuuggacauuaugacccaucccugcagcccaccuaccacccccguuaaugucuauuugccuuuuuuguuuuaaggucaaauuuuaaagacaagcauacagaaaaaccacagacaaaaucaaggaaagaccugccucuaggaaaaauuccauacuaagauccacucagaaacugauuaaauuuaaucugacuuuggagagggccuagcaaugcacacaauacacacauucccauauucugguacucaaguacuaguauucacuucuuucuccaguacuaaagcccacuucugcacccaacuaaucauggacuuugucaucguuuucaagccacccuuuaacaaaguaaaagcuaaauaccuacuguugaucaguucuuuguguucagcaaggguuuuugcaggauccagccaauacugugugaggaagaaaaggacaauuaaagaaauuaguugcuuuucauuagcuuuuacuucaagaauauuugcaaaauguuauuuaaacaacauuuuaaaacuuggucaguuaaacacuucucucauauacacacacaaacauacauaagaguuuucugcagcaagaacaguaaaagaaaaaauaggccaggcacgguggcucacaccugaaaucccagcacuuugggaggcaggggaggaaggacugcuugaggccagaaguuuaagaccacccuggccaauauggcaugaccccaucuuuuaaaaauaacauuaaauuaaaaauaaaauacaaagagaaagaugaugcugacguuggaagagaggcaaagaagagcagcaguacuugcugggucccugguugaauuaucauacugauuauaaugugacauccaaaugcuuacaagugacuucuauuuuuggugggaaaauaauggccucaaaaaaaauguccuccaagucucuuuccaaagucuccaucaucccaagcacugcuccccuuagagccaugucucuuccuaauacguccucaccaucuuugcuuccagucucaucccuacagguauugcugcuagguguuaggaagaaagcaaucaaaucgucauuaaggauccaggagagcaguucagcacaguggcugagggccugaaucccagggcagacccauagagagucuguucugacucuccccaugucauugccauguaacuuaggacaagcaacuggacaccacuggaccuuccucauaagguuccugugcagauuaaauaaguuaauccagguaaagucuuuagaauagccccuagcucaggcuacacaugcuaagaaugauuagguuaccucuaauaacugccuuuggccagucuaagauaccuacuuauuaauucaaauuaacaguuaaugaacagaauuucaagugguggcaggagaauucgggguccuggggagaggccuuccuuuaaaucucacaauuauuaaguagaauuaucgaaggaaagagaugagguaagccucuagcuucgccucuccaucugugggaagagcagggcagaagccaaggaagcacagagggcacuggaguucccacaaaagcagagucaaagggauaagggcugcccuggagggucaggggagggcagagauggaaucgcucccacacucuccuagccagaugcuggggacccccagggccaagccacucaguuuccauuuccucgugcuccuuaaugaagaaggggcaauucccaccacagcgagguaggagcugacccacuuugagccacguuccauccagcacucaugcgcuggcgcaguuccccacuuuccuuccccucaguugagggcagaaugcuuguucugcuauguaacgguagcaauaauuauaaauggcaauuauaaugcuuuaugcaauccccuuacccuuuauuccuaauuaugaaugcaauuauucauacuaugaauacuaugacuaugaauacaacuguuguagucauuuuacuguaagauuuuauaacuauacuaaacucuauucaugcauauauaagcuucauuauuugucacucacagcaguuuccauuuuuugacuuuuuuuuaaaaaaaaguagaguaaccaacauaucuaaguguagcaacuaaaaacuaaaaauaaaaacuaaaauguucauuauucugguuuucaucaugucuuauuuuucaaaggucuagaaucacucacuuuuaaaacagaaaguguauuugaggcagaggaugugucagugaaaugcucuuggagcccacagcgacuaaaaaugaggcuuugguguuaaaauuaugauccccagggaaaguguagcucauucaaguagaguaaaaucaauccaaacguuaagcuguguguuggacacaacgcagacccaucccuuuacauauauaaagcuguggguucuucaugaaauggaaacaugaggugaggggacuguuucuugccauucauguuaaacaaaaagguuuuacuauccccugaauuuuccaaugaagagaaaaccaaggaaaacaaacgcaaauacucauuaacacuugcauucgguuuccacugcugccguaacaaauuaccacaagcuuagaggcuaaaacaacaccuguuuauuaucucagagugcugaaaguuagugucuuucuuugcuucaaauuucacaaggcuaaaaucaagaugucagccugcuggggucuuggagagcugguugguuaggggaccguauucccuagagcacaguaagggagagggcuuauggaugcguuauuagaggcucucccaguuucuccaggugucaaggcacauguaacauugggauuuaauuucacgcccuacgcuacacuuacacaugaagugucaauaugugcuuguggcaagaagggaaaaaaggaggcuuuggucuuauuacugucugucuaaucuuguucugaaacuaguaaggggcagaaaucagaguuuuaaauuucuccuccuaucaucaucaucaucccaaaagacaaccuuuguaauuuuuuuucagauuuuuugauucauuuuguuuuguuuugucuuuguuuccuugucuccagaaugcuuuucagucacuaaagccagcuaaagaaaauaggaagaaaaaauuuuaacuacauauaaugggaaaaacugguuaaucuaucaaaaauuuuacauuaaugauaaucuguucuauuuuaaaauaaaucucuuuccuugagagugauuaaauuugagaggugaaaaaaguaaaauaacaguuucaagaaaaguuagaaauuacaauucugcagcacgaagcagcagcagcaagacucagucaaaggcuauucaaucaacucacugcacauuugcuaugcuaagcaucacccuagagccggccacacacaaaucucauuugaucaaaauggaaaccagggguuacagaggucagacaaugauaaaugcccaagaacauaaauaauaaacacaagucaccagguuucagaagccaagaucuugaaauguaaaacccacuuacguucaaccaagggaaagaugugaccuuggaaccaaagcagccaugcuaugauggcacuugucaccauucauuaucaacaagcaaucaaacagagcacauggaagaucagagugaaacacagcagccuguuacucuauaguuuaagagaaaaaagggcacaaaaaauugccaaugaacacaauaucccuguuuuaaggaauacauccagaauacuggucauggagugccaauauucuagagguagacucuaaaacugggauaucauucauucauucaucacuuauggauauccacuauacauguucuuuacaugacaugucagacacuguccuuaguaugggaacacaaaguugaaugagacccgugacuaaccucgcacucacagcccagcaggagacacacagccauguaauuacaauacaauguggugagacaauaauuacuuauauaagaugaauacauaugagauaauaaaaucauguacaaggaaaauuaacugcagggugaguauacaauggcuuuacuaaaaaaaucguuaaauagcauguucaaaaaaacuuucucaaaauacauaaaugggagauaacagagccuuaaaucuguauaaaguacaugucuaucagcucaacugcucuuaaagcaagugaguaaauuuccauguaauaacacagaauguaauacucuaaguccuuuacaauugaacacccuauugaagucaguguugccuaacagcuaacaaauacucagcuaagcaaucaauauucauggagaacuuccagaaagggaaguaguccauucagucuuuccaccugccccacgugaggggaaagaggagcagagagcugagaaucaugcaguguggugcccuaagagacuguucuuuuggagucuccuagaguucuaauagaauaaacccuaaauuuuuuuaaauaaaggacagcaugcaauaauuggagcugugcugcaucuuauuucacacuggguccaauguugauucagagaaugguuucucugaauuguacccuggugugcugccucuugcauagccagauggucacgaggagaaauagcccuaucucucauucccucucaacauucaagcuguccauucucuaggauaaucacucaaacacuuuccccuuccccacuccccucucucuccuauuucaaauguauacuaugcagucuguauaugcugacaagcuggaugagaucccauuuuguaggaagguaacaaugaacccaaacagacccugcucucugaugucgcacaguccacuccuaacauacuguauccuaaacacuccaucacugaggagucagggugacaguccucucggacucugccccuuugccagaguagaagagguaaagcaguuagacagccuuaccacuucaggccugucaaucuuaaucacagcacugauguaacccggagagcaaugacagacccuucuuacucucugacaguccuggcuaaaugcccuuggcugcuuucauccaccuuggcugauaacuucucaauuucaucaauuuccuugguaacagucucagaauuagguucugaaacucuaauagugcccagccaaucaauauccuaaucuucaaaagauauauauuaaauucgggguccaaccuuucauuugucaacuguucuuucagagucuccuagaguucuaauaguagaauaaacccuaaaaaauuuuuaaaaagaaaggacaccaugaaauaaugagaguuugcugcaucuuauuucacccagaguccaaugcugacucucuuuuggagaacuuaagaauguuacauugacauuuaauaaaguuuccuguaggccaaauaaaaggacuuaaaagcacacacaguuuucauuaauauagcaaaacaaccucuugaucuaagagaguaaaaacagaguuggucauguaccauugacaacagagccacaaagaucucaaaagugauauaacaggucacuccuggggaguucuaggacucaacauaauucacauauauguuucaaggaauccaggacuuagguuauggcuauuugugcuuuucccacugacccuguaaacagaucuauggcccucuaagcaacaucaagaggacauggcuuuaauuugcuccuucauaugagucacagaagccuuaggaccucaaguaaaaccaccauaauagagcuaucuugcaguggcgacaaaaacaagggccugucacuggagugaucuacagggagggagagauaauuacaacuggccccguuuuucagcaaaagugaauuucaagaaaucucugauggaccauguggcuucucauaaagugucacuggcccugggaauauuccucauuucucauccauggacccugacaccacucuaagguuacagaaaugcaauaauaacagcuagcauuuauuaaauguuugcaaugugacaggcacuguugaggacucuacauguguuuacucuuuuaauccucuuaauaacucuaggaagaacuauuauaauuaccauuuuauaaaugaggaaacugaaacacugaguaaacaacuugcccaaaaguacagaacagcagcuccaacgaacugaagccauuccaucuuacacucgggccaagcuacuuucuaaaauauugucugagaaguaaugcacaacuuaaauuucaagauucuuacucucaacuaauacucuucucccaacucacuuuaauauucugacuccaccaagacacccaauucauugacccuacuaccuuuucauugucccucgcugaugcccccaaccaaugucauuucccucacuauucauuauaaucauucacuugcaaguguccucaauuuccuugcacauccuugcuuccauaauaucuacaggaaaaaaaaacacccauggguaacuccaauuccccgcauucuccaugcuagcacccaaggagcugaacauaacuggaggcucacauugcacaaccauaggugggcuugcuuuacauucauuagcaauaacccaagggaacccuugguaucacgcagaauccuacauuuuauuccgucauucuccuuaauaauucuugacacuuucuccucuguccuuaaacuuccaacaacuccuuucccuuccucacucucagcugaagaucuucauuacuucacugaaaauggaaacaaucauaagagaaaugcguaugcauccuggccccgucgaccaaccugcuugcaucugagcuuguguucugccuucucuccuguugcuguggaggaacuguccauguuccacuuaggcucaucccuuucucaucuauucaggaacaugguuccagcaaccuucuguucucuuuccugcaucaugaagguuucccuuuugacagaaucauuguuggaagaaugguggcuuuauuucucccaucuucaaaacaaaaccaaaaaacuuugacucccauaccuguccauuucacuucugugcuuugaaauaaaucucuggaugagaaaaaaaaaaaaaaguuguucuacauucucucaucuccucauggucccauuuuaguauuuacugcaauuaccuccacguuguuccaucauccauguucuugaaauacgucacacgcuucuaggacacuccucaaucuugcuucuccucccgucucacuggccacgucuucaaaaucuguugcugguugcucauauuucccugaccaggaaaggcuggacugcuuaagcucauaccucacaucaaggcucauggccuuaaaugccaucuauacacugacaacuuccacaguuauagccagaccagaauucccuguuaauccaacugccuacuuggcaucuccacuuagaugccuguuagaaucucaaacuuuagauguccaaaagaaaacugaugauucuacccccucaaaaaaaauuguucuccugcagucuucaccaucucaguaaauaguacagcacuuuuccauugguuccagucaaaaccucuuuaucuucuaucucuucuauccaucugcaaaucuuguuggcucuauguucaaaauauaaacauaaaaggucaaauucucaccacucucagguccaagcagccauuaucuuuuacuuggauuucuucaacaacucuuuuaauaguauccuugagucugcccuugcaguuagagaaaaucauuucaacacggaucaaaucaguuaacucuuuucuucaauauccuccagugguuuccuuucgcacucaaaguaaaacacaaaauccuucuaauaaccuauaaggccuuccaugaucuggccccacucccucuacuuuccacuguguguuuuugggaugaaguagcaagaaggaccuuaaggagaguauugguagaagccugagggcuugcagggaggcugucucuaagagccucaauuaaagcagagaaagcuauuggaaacagaaaaaaauguggaauaaaaaauguaccaaacgaacuggaugauucagauaaggagguuuccagguaaacuguugaaauugcugauuggcuucauuuugcuggcuauaaaugaaauguaagaagagagagauaagcuaaaaagaaagaagaacuauuaaaauauaaaggagccaggacuuuuuacugaguuugaaaauaaaacuuucgcauuccuaguccuaucagaaggcaaacaaugcugcaauuaagaaauggcuucugggcaaagaaugaauccagcaugcugucagguaaacaugcuauaacuguaaaauccuuuauuagauguaauacaauuuauaagauuuaacaccaugccucauggacccuuucaaaacaagauccucuaauaaucuuaacggcaccgugucccaacagccuuacagggaaucuaagguacagaagagcuuauuccagagcaaucugugggugcugccuuugucuaauaaaguuaauuaaagguugauucauuagaaauccacaaaaacuuuuagaagaauuauaccagcuugggcugaaagggacagagauacuacaaacugaaaagaggccuuugaacucccaaucuuccuuaggcaaaauccaggccgagaacacuacuccaccgcaaauacacacuacuuuuuauuaaaaaagcaagcaagcccagacaacagaaccaagagccgagaagacagggccaaucgucauagugaacaacuccuaggcaauaggaccaaguccuaaucagagaaaucaccacaugugucuggcuagauuucaaaacuaguauuauggacuaguaauuguugugugccuccuguuuugccccuuucuaacuggaagcauuuauacugguuauccuaugcauguuccaccacuguauguuuggggcggguaggcaggaaacauaucuuaucaccuuaauucacauaucuucagaucaaaaggaacuguacucaaggguuaaacuucagggaaaauguucgaagagucugauuagaggagaugauauaucuuuuuuuuuuuuuuaugauggagucucgcucugucacccaggcuggagugcaguggcgcaaucucggcucacugcaagcuggagaugguauaucuuaagcucaagucccaugucacaauaaauaagaauauugggaggccuugggagggauaagugcauuuuauauguaaaaagaauauaaauaauuuuuggucagaggaaucucauguauuaaaacaugucuuuaaauuagucaacacuauuccuaucaaaagguauaauguaguauuccuccccuuuaaauguuaccugaccaagaguaaaaacaguauaugguguagugauggaagagaaggcuagagaaggaucuacagauuauagauagggcccagauaauaaagagucucguaugcauaauagaauuugaauuuaagcagaauacuauggauacucauugaaaucuuauaaguaggggagcaacuucauaauauuugcauuuuaaucugaucaccuugacagcaaguaaaaggagaguggguuaaaguaaagcaaaccaggaauccaggagccuaaguagccuacucagguaauccaggaaaaacuuugagaggugcaaacuugagggaauuugaguggcaggggguuuggggggaauauugccuggacuuuacuuugaaccaauagaaugccacagaaguaacacugugugguggcagaaguaacugccugucuucugagacuuggucaugcacagugaccaugcuccuucugguauccuucccucccuuugcccucuggauguuuucccuugcgaggaagccaagcaacaacacagagaguccacaaguaggugcuccauccccaguugaagccccagccaaugccaacaucaaccagcacacacaugacugagacuucagaugacuccagccuccagccuucaugcugcuccagcagacacuaaguagaacagacaugagcgggcccucccaagcccugccaaagucgcagauccacgagcaaaauguguguggcuguaauuuaaagccccuacauuuugagagggcuaguuacacaacaaagaguaacuggagcacuucccaauuuauccagaccucuuuuaucuucauucuuguauucaacaaacuugcuauuccuccuguguuuaugccaucugugaaugugaugugcaugcccuuuaugucuucaucccagguacuggcauagauguucuaugcccuggaacauaccuagaaaccucccuccaucacaucauucaagaaaccagagaugacugugaaaagccauccuaacuaauuaucuuucaauuuagcaucauuuuuccauuuaguccacaaagacaucauacaaacuuuucuguguaucuuugacuuccaaacauacuaguuuuauuauuaauaaaguggucugaugaaagcugcuuuuuuuguuacugaaaauacacuggauucuagggaccuacuauuauaugucuucagagcccaccaaucauuuuuuaaacaugccuuccugccaacauaugccugucucuaguggagcugcccuacaguugcaucuaauaggcuguuucaaaucucuuaggaccagggcacauaauaaccaauguguucagauuucuuccuaaaaugaaaauaaacaugguuuuagggaucacagauuccuugagaaaguccugaaucccgugaguggacucuaaaauaaucaaucugugcugcuuaagaaaccuuagaucucuggaaaguuucgacuacauuuuggguaagugaaguugcaacacauuuuuaaaauguggauaagugaggcaucacuguauacagacuaugagaucauuucaucuugaaauaaaauccuaaauuugccaugucuugaaacuguaguaauuuaaaauauacaggugguuaaguuaggguucauuuaaacucuguccuagaagcugaacauaaauguaguuuuagcuaaccaaguaaucuggcacaaaggagcaagccagcccagggagcugcaaaguaagcaggguccaggugcccugcucagcaccacccacacaguuacaccuacuccagcauguacaauucacaugguuagcacagcugcacacugcagccuugccccuucucaucugcaauuacagucuguuucucccuaaaugaccuuauuuggucucaugacuuuaaaaaccuagagacuccuagaugugacuccagccuacuccccuacuccccuaaugucucugggaugucaaauggguguuucaaacccaacauaugcaaaucagaacugacuucccaaacugaaaaaccagcucccuaucacuccucaucuugacauuuccaacagaaauguacacagagccuacaaaagccugcugggcccuauguuaugggggcccugcccaccuuuccacuucaucacccucuuucuuacaacucuagcaucacuggacuccucucaguuccagaacaccucgcaucugucucugccuuaaggcccccaugccagcuguuccuccugccugccaugcuccuccccuuaucacuccagccucgguguaaauaccaaagaggucucuucuaaccaccugugguguuuaugauauauauugguuuucauccaugguuccugguucauaacucccauagcccuuguuagucuuuuguugaaauguugggaguguuaggccucaggacacaaagucucucuccugcccuccuuucaccugccccuagcaggacucuaaucuucucccaccuuucugacugugggucuuaagaccuuucccuguguucauacagaucaugggggaaugaggaacccuccccagagaaagucuagcccuauacaccuggaaaaggaaugcugacaucaugacacuuccacaaagacucaagaggacuugguccagggagcuucuagguagccgaacacaugcagguuccuggaggguggcgugcccaggagggcauagaaguuccaugccccguucccccauaccucaccuuacacaucucuucaucuauauauucugcguuucugaguuuuguaagcugcucuagcaaauuaaucaaacccaaagagaaggucaugggaacuccaacuugaagccaguuggucagaaguuccacaggccucggccaggagcaguggcucacaccuguaauuacauggguagagacuuuuucucuacauaccacccaauggaagaagccuucacaaaacucuagcauaucaucuuauuuucaaagcauucaguaccugauauuugaguaucuuuuuauggucugucucaccccuggaaauaaacuccuugagaccagagaccuuggcucuuacucaccauugugccauacuuccugagacacaguggcugccugguaaguaucugcuaugugauugaauggagaugagcaacagcaaaugcucaucuuuccucacagucccaguucaggcugugcugauaugaguaaggauauaacucuaaaaaauguuaaacaagaaacuuccugaauauccucuauaaaauauccugcggccuccaauacugauggguaucaugaaagaauaaacuaagcuccuacagaucaucagcuuuuaaaggcccacuucuguuaauucauaaagcagcucucaaaacucauaguccagaagggaaaguagguaacucccacuuucccaugaaacaaaaaagcaccugcacagcuuuuuaacaauuccaagaacaucucucuuauuggaacagguccuaaaaugauagacaaacuagucacuuagcuuuuaguacaugcagcaaauuugcaauuuuauaaaauauaaguagaauagaaaauauuccauaaaauacauuuuauuaguaggcuacugacacaucacgauuaaacuguuuauuauauucaaggagaaaauucucuuaagauucagaauaagguuaaaucaagguuaauuuaucagagcuuugugucgaaacccuaaauuuaaaaaaaaacuaguuuucuaaugucuaaaaucauuaacucuaaaaucacuguuuucccauuaggcaaucaaucaacugucugaaauuccuuccuuuauggcucauucugauuuaaccggggagaaggacagucuaauuuaauaaauguucauaguaaagaaaucaauauuccuuucacuuauguauauaacuaagaagguaugggucacagaaauuucucagguacugcauuuauugauaagaacaccuagcauaccuacguaccugguuguauauacaaaaauauaaauguauauggauauauggauauauauauacauguauguauauguugacauuucuaccauuccugauaguuuuguuauuaaguacuuuguaccuuuauuguuuucaauuguuguucgauggaagcauuuuuuuuuuuaacuuuuaaauucagggauacagguacagguuuguuauacagguaaucucgugucaugagggucugcugcacugauuaauuuugugacccaggcauuaagccugguacccauuaguuauuuuuccucauccucucccuccuuuuaauuuaguuuaauuuaguuuuggugaagaaggcauugggugccauuaacaaagaaaacuuucucuccaagauagaauucagcccuucaccucccuaaaccuagaaaccgcaggauaaaauauuauacaugacccauggaagaaacauucaugccuacugcaaucaaccauuugagggaaagaaggaaaaaagaacuaaaguucaaaaugugccauggaggugauccuacacaaaccuggguccuucaagagccguuuuugaguccgugucaaaaucaacaaacugaagaccaaucagucaaagcaugcucugcuuuucccgaugccgcagugaggaaagcaugcagugcaagaagcgacuuugggggagccguuugggaggcuccccucucagcacuucccgggguuauuucaggcaugucagcugcugaauucucaugguguuucacaugacugugcucagaagagggcacacccacucuaaacagaaaauguuccagaagaacaucaucucuuccuuuccuauuaaacacuguuuaaccaagaagaaauagaaaaaucuacuuuuagaagugcuauuuauuauaaacaauuuuuuaaaaucaugggauccaccaucauacaguuacacaugacauuguuugaacucaaauccucauauaauaugccuccuuuuauuacauacuacaccacuauaccucuaaccagacaagaauauucuaaacagcaccuaguagcugccagcacauuaaaaauauccuguaccuguuguuucuuauaaucccaauaagaauuuucaaucuaacuuccuaauaucucaguaaagcuuuuucuuuuuuuuuaaauguaaguuaaaucugguuaaaaugaacagcaggagaggccuuucauaagagaaggagggagcaugcaggcgugggaaggggaggugugggaaugcucuugucaaggcccucgccucccagugagcggcccacacaguccaggcgagaguucuuucacucaguaacauuacagaucacuuguuuugcagugacagaggugguaagaaaguggugaauaggauucaaugcuucccuucaaaaaguauccgaucaaaugguauuauucaauagacacaaacaauguuguauuuguaauaugugauacaagaaggcccaaaauauuucuggggggucggggaaagcuucaggaagcaggagacaucagaaacaccacacucuguggaugguaaugauaaacaagauuuaaacaaggaaaaaugauggaagggaagagaacaagaaggguguucaggcaggggaggcagcacauacaaccccccgagacacuaugguacagcuaaggagcugcagguaguucaguggagcuacggcguaccugaaguacgcauuuggguggggaacugaaaagucauguugcaagaaaaggagcucaagauaaccaagggccacguaucuuaaaggacuuuguaaaccauguuuaggaguuuggauuuucccuuagggagccauuaaauaauuuuaagccacagaaggagacaccaucaaagucgccuuucugaaagaaaacugcaauugcaguggggaaaacacuggagggaguaagaccaaagacaggacagccagucaaaaaagcuuuuauagaaacccaagcucaucuggcacugaaacuaaaauucagagauggagacugauucuagagaggugaauagaugaccacaaguccuguuuacaccaguggucccagcuuaguuauuaacagugucccuuuucacucucaaaaguauccuggauuagugagugaacuguauggucaaucuaggaauuaaggaguaaagcugccaggacuuggugacuggcuaugaggagaggugagaugauguaguugggaaugacacccaagauucuagcuugagcaauuggguagaugguguugccauucacuaagcuauuguaacaaaggugcaggcaccucggggaugcuaugugaggacuucccaaaggauacauggguaaacauaguuuuaagaacucaauucccagauucucaccuuccauauacacucuauuccaaaacugaucuaccaaagaauaagcccaagauuaggacauuaugcuaauucuccuuuccuacugcacucuccuuucaaaauucuccauucccaauuuacugaaaggcaccuuucagcccugucaagcugcuauagugcauugcccaagggcacgaauaaucacaggagaagcauaggaagacuuuaaaauacugauguuaacaaaguugucuuuaauaaagacacuauaaaucagaaaaacauaguguuauguauuuuuccauuuuauacauauuucuggcaaggacuaugcaaaguguuagaagcaugauauuuuggccuauacuugggugguucuaaaaucagauacauuguaccauagggcagcaccaggagugaugauuuuuguuuaaugaucuugcaauuuccauacucuagcuacugucaguuccuuaagaauaagacaaaucaaagucuugguaagugaaagcagaccuaucuuaucuaggcaacaaaaugcuuugccuuaucugucuuaggaauagaauuccaaaaugaaauacuuuucauggaacucaaguuaacauuuuuauuuaaauugacaaaaugacagaaagcaaguugguuuggcuaaguggcuuaauaaugacuggcuuuguccaagaguuuuauguuggagacuuuccauaagccaaaugaacuaaaucugcaauucuaagauucugaugaaaauauaaaguauauaauuagauaaaagcacuuuauuaaaaaucuuacauuggcaaacuuauguuaaaauuaaugauuuuaaaauuuuucuaaaucccuucuauuuuuuauuuaauauugcauuaaaucaggugccucuaaauaaaaaaaagcauaauuaauaacauuuugguaaguguugacaaagcauuuuuaauacauuuccuagaaauuguggaguugaauuacuauaauaaucaauuaagaaauuuuaagacagguggucuugaauucauugcuuucaacuaaagaaaaacccaacugaauggucugaaaaaacacugcucucagauauauaagaaaaagguagaguuggaaucauuccaggaauauauuauaauggacuaauuggaaagaaaaagucccacucaccucauuaaaagaugcgcuuccaauaaauacuuauauuuuauguuuaauaauuuuuuuccauagguuuuuagggaacagguuagguauugaguuacaugaauaaguucuuuaauggugauuugugagauuuuggugcaaccaucacccaagcaguauacacugaagccaauuuguagucuuuuaucccucacccccuuccuaccccuucccucccgagucuccaaaguccauuguaucauucuuaugccuuugcauccucauagcuuagcccccacuuacgagugagaacauacaauauuuguuuuuccauuccugaguuacuucacuuagaauaauagucuccaauaucaucaagguugcugugaaugccauuaauucauuccauuuuauggcugaguaguauuccaucacauacauauauacauacauacacacacacacacacacacacacacacaccacaguuuauccacucguugacugaugggcauuuggguugguuccacauuuuugcaauugugaacugugcugcuauaaacaugggugugcaaguaucuuuuucguaugacuucuuuuccucuggguggauacccaguagugggauugcuggaucaaaugggaguuauacuuugaguuccuuaaggaaucuccacacuguuuuccauaguggcuguacuaguuuacauucccaccagcagugcagaaguguucccuuuucaucauauccaugccaaaaucuauuauuuuuuuauuuuuuugauaauggccauucuugcagggguaaggugguauugcauugugguuuugaugugcauuucccugaucauuagugauguugagaguuuuuucauguauuuguuaccauuuguauaucuucuuucgagaauuguccacucauguccuuagucuacuuuuugaugggauugcuucuuucuuauuuguuugaguuccuuguagauucuggauauuagucccuugucagauauauagauugugaagaucuucucccacucugugggcugucuguuuacucugcugacuguuccuuuugcuaugcaaaagcucuuuaguuuaauuaagucucaccuauuuaucuucauuuuuguugcauuugcuuuuggguucuuggucaugaaaucuuugccuaagccaaugucuagaaggguuuuuccaauguuaucuucuagaauuuuuauaguuuuaagucuuaaugauuuaggacuuaaaucuaaguccuugauccaucuugaguugauuuuugcauaaggcaagagauaaggauccaguuucauuuuccaucaugugacuugccaauuaucccagcaccauuuccccacuuuguuuuuguuugcuuugucgauggucaguuggcuauaaguauuuggguuaauuucugggcucucuauucuauuccauuggucuaugucccuauuuuuauaccaauaccaugcuguuuuggugacuauggccuuauaguauaguuugaaaucagguaauaugaugccuccagcuauguucuuuuugcuuagucucacuuuggcuacgcaggcucuuuuuugguuccauaugaacuguaggauuguuuuuucuaguucugugaagaaugauggugguauuuugauggaaauuguaaugaauuuauagauugcuucuggcaguauggucauuuucacauuauugauucuacccauccacgaacaugaaauguguuuccauuugcuuucaacuuuuccccguucauauuauguuggcuguggguuugucauagauggcuuuuauuacauugagguaugucccucguaugccaauuuugcugaggguuuuaaucauaaagggaugcagaauuuugucaaaugcucuuucugcaucuacugagaugaucaugugauuuuuguuuuuaauucuguuuaugugauguuucacauguauugacuuguguauguuaaaccaucccugcauuccugguaugaaacacacuugauuauggcggauuaucuuuuguauaugcuguuggauuugguuagcgaguauuuuguuaaauauuuuugcaucuauguucaucagggguauuggucuguaguuuucuuuguuauacugacuucacagaaugauuuagggaggauuuccucuuuaucuugaagaauaaugucaauaugauugguauuaauucuucuuugaaugucuggcagaauucaacuugaauccaucugguccuggacuuuuucuuguugguaauuuuuuuauuaccauuucaaucucacugcuuguuaauggucuguucaggguuucuaauucuuucugauuuaagcuaggaggguugucucuuuccaggaauuuauccauauccuccauguuuucuaguuuaugcacguaaauguguucauaguagccuugaaugaucuuuuguauuucuguggugucaguuguaauaucccccauuucauuucuaauugagcuuauuuggaucuucccucuucuuuucuugguuaaucuugcuaauggucuaucaauuuuauuuaucuuuucaaagaaccagcuguuuguuucauuuaucuuuugcauuucuuuuuguuucaauuucauuuaguucugcucugaccuugguuauuuccuucauucuguuggguuugguuugguuuguucuuguuucucuaguaccuugaggugugaccauagauugucuaguugugcucuuucagacuuuuugauacaggcauuuaaggcuaugaacuuuccucuuagcacugccuuugcuguauccuagagguuuugauaguugugucacuauuaucauucaguuugaagaauuuuuuccacuauggucugagagaguacuugauauaauuucaguuuucuuaaauuuauucagacuuguuuuguggccuaucauauggucuauuuuggagaaaguuccaugcacugaugaauaaaauguauauucugaaguuguuggguagaauguucuguaaauggccaggcgugguggcucccgccuguaaucccagcaccaaggcagguagaucaccugaguucaggaguuugagaccagccuggccaacauggugaaaccccaucucuauuaaggaauauuauguaaauaucuguuaaguccauuuguucuggaguauagcuuaaauccauuguuucuuugcugacuuccuaucuugaugaccugucuagugcugucagugcaguauugaagucccccacuauuacuguguugcucucuaucucauuacuuaagucuaguaguaauuguuuuacaaauuugggaacucccguguuaagugcauauauauuugggacugugauauuuuccuguugcacaagggcuuuuaucauuauauaauguccuacuuugucuuuuuuaacuacucuuaaaguuuguuuugacugacauaugccugcuuguuuuuggugucuauuugcauggaauaucuuuuuccaucccuuuaucucaaguuuaugugaguccuuauauguuaggugagucucuugaaggcagcagauaccugguuggugaauucuuauccauucugcaauucuguaucuuuuaaguggagcauuuaggcuauuuacauucaacauuaguauuuagauaugagguacuauuccauucauugugcuauuuguugccuguauaccuuguuuuuucuuaauuauauuuuuguuuuauagguccugugagacuuaugcuuuaaggaaguucuguuacugauguguuuucaggauuuguuucaagauuuggagcuccuuuuagcaguucuuauagugcugucuuaggacuggcaaauucucucagcauuuguuuaccugaaaaagacuaucuuuucuucauuuaugaagcuuaguuuugcuggagacaaaauucuuggcugauaauuguuuuguuuaaggaggcugcagauagggacccaaucccuucuaccuuguaggguuucugcugagaaaucugcuguuaaucugauagguuuuccuuuauagauuaccuaaugcuuuugccucacagcuacuaagauucuuucccucaucuuaacuuuagcuaaccugaugacaaugugccuagguaaugaucuuuuugcaauuugccagguguucuuugagcuccuucuauuuggauguuuaggucuuuagcaaggcuggggaagcuguacuagauuauucccccaaauauguuuuccaaacuuuuagauuccucuuccuccucaggaaugccaauuauucuuagauuuggucacuuaauguaaucucacauuucuuggagguuuuguucauuuuuuuaaugcuuuuuucuuagucuuuguuggacuggguuaauuugauaaccuuaucuucgagaucugaaguucuuuauucugcuuguucgagucuuacugcugagaauuucaagaacauuuugcauuucucuaaguguguccuuuauuuucugaaguugugauuguuuuuuauuuaugcuaucuauuucacugaagauuccuccccucguuccuuguaucauuuuuuuugauuuccuuaaauuggacuucaccuuucucuggugccuccuuaauugguuuaauaaucaaucuucuaaaugcuuuuucaggucaaucagggacuuuuucucgguuuagauccacugcugaugagagaguaugauuuuuugggugguguugaagaacauucuuuuaucauauuaccagaauuguuuuucugguuccuucuccuuugaguaaacuauguuagauggaagaucuggaacuuaaggcugcuguucagauucuuuugucccaugggguguucccgugauguagcacucucccccuuuuccuaggaauguggcuuccugagagcugagaugcagugacuguuauuuccuucuggaucuagccacccagcagggcuaccagacuccaggcugguacuagggguugucugcacagaguccugugaugugaaccaucuucaugucucucagccauggauaccagcacaguauuugcagugucucuggguuccugcaggagcaaucugcuuccuucaaagggucuguggauucucucagcuuucuugguauauuucugcaguaguucuggagcaaaauuucacaaugcaagucucuacacacugcacgauccguccgagugggaacugcaaucuaguccugcccccugucugucaauuuccauagaaaauauguuuaauaauuauuaaaaugcauaguauuuugcuguuuuaauuaauuguauagugacaaccaugguaauaacaacuacuuuuagggcucaacaacaauuagagccuuaacaucuuaggaaauaaacuuuuaaaauuccaauuuauauguauauuauggauauauguuuuuuauuaauaaaaauauaauaacauuuuagggagaaaguagaauaggaauacaaguuuaacgacauaaaaggaauaaauaaauguuucugauuuuuaaaaaagagcuuguucauaaauuuuuauaaagguagaugaagaguacaaaauugcuaugaaauauaaauucauaggauacauuuaaaaggaauaugacaauuugauuuuacaaugucaguauuuaugauaaaccaaagaucuggaucuacuaaaacuuacaaaauuucaauucucaaccuaaaauuacacacgaguacaugguuuuuuaaaaaaauucauagaccagguaugguggcucacaccuauaauccuagcacuuugggaggcugaggcaggaggaucacuagagcucaggaguuugaaaccagccuaagcaacauagugugaccucaucucuaaaagaaaaaaaaaucuugaaaaucacugaucucagaaacauuuuuuaaaaagagcagauuuggaggggaagauggcuucaguuuugaauauguuaccuuugagauacaugagaggcauccgaguagugaacaacagcuaaaacauuauguggaccacacauguuaaagcacuagucuguguauuuuuuauagauuccuucaaucaucacuaccacccuaugaagcugguacuauuacuaucuucacuuuauaaacagaggaacugaaguauagaaaaguuagggagacucacucaaugccacacagcucuccagguagacugugguuugaacccauacagucugaauccagauuuugaauuuuaacacaguguagucccuccugaaacaucuggguugaagauaggaaucugaggcucagucuuucaauauaauuuaaaccauggaacaguuaccaaggaaaaguaacacacauucgucagcaggaaacuuagaccuucggugcuauggggcccccuauagaugcuuccggcuuccaggccguggacucuugaaaagccaccugccaucauuguuucccagauacccuucauguguuguugucagcccucccaggauacugugcuucucaugaugcucuucauaaagucaaaggguuaccuaagaggaacuuucugcuucuugaucuuuccccucuguuccuccaacaguugcuugaagacaucucacauaguaaguuucauucuguaauaauccagcaugacaaucuuccuuucuuugcaacaggacucacauuaucacuuauacauauuuuaucagucauuauagguacuuuccagaacauauaaucacagaaugugaaacuuuacacguuacaaaauacagcaucaggaugaaaggaagaggggccacuacugacggcagagaggacacacuuaagcaugccugcuagagcucaauggaugaggauuuuuguucaauacucagaguacucgggggcagggaagagaauacaaauauuaacacauacacagcuuaguuuagaugguuaaggaaauuaucucagagguaaacaguacuagcaaagguagcacuaaaugugugggccugaacagaguuagagccuaagagaacuaaggacaaaauccuggugaacaccaacauuuuauggaacaggcaguggaaucacaaucguagagaagacugaacaggaauaacuagagaaaacaugaagagagagaaacaaaaagaauauagugccagaagaacaaaaugagaagauuucaagaaugggcaaguuguuagugucaaagcaaaagaaaggucaaguaagacaaggacugacagagucucuuggauuuagcaacuggcaaggcagggccaguuucagugaugugaucgggaaaaaagcugcauggugauauguuuaggaaacaaugggauuucagaagugaauguaagaaacuuagacaagguuuucugaaguuuacgcgugaugcagaaggagccaaagacagcagcagauaagggagggcaaaggaggaggggaacgggagguucuaaaugggaaagacuugaacacacccaaacacugacuggaaagagggagcagguaggguacagagacacaaaacagaaaaagcaaggugguaagauccagcucacagacacuggugacaggaaaggaaggguaugaagcaacuaaguguguuugggggugggguggucaagaaagugggaaguuucugauugcuuuuauugucuuagcaagggaaaaacagaguucacuggcagaagacaguguuugcaugcugucuucaucugugugcuucacacauucccccuccuuugacuucugaaguaaaagggcagcagacccaggaccuaauucucaaugccacguugauuuccauauucugagaaaagcccuaauuauauacaacuucugccuuucaaggaguaaucuguaaaggagccucaggugcuaacauuaaaguaagacauaacuauaauuucugggaauuuucuguaagucaaaccaaggcccuaauaugagagaccuacauccccaaacacaccagucuggaucaagaacgaaccugacuggcacaagccagaguggaacagaaaauaggcucuagcccaggcuaagcgcuuucccuuucaaaacuaaucuuaaaaccagaaguaguauugagauaucacauuuauauuuauuacugcuuucaguaucaacaaaacucaucuucaaaaaucucaaagguauuuaagaaucuacaguuuauuuaauuuuuucuuuucuuucuuccagacuuuuuccuucuuccuucauuccgcugauaucaccagcaauauuuucucccauccuaguuucaacaggaaaggccuuuuacauguucaaugccuuaucaucuacaaagagcuaucauguguucugauuuaguccuauaucaauccugacaguugaggagaaaaagcauuuuauugucaauuuacgauaagcauaucaagauucagaaaaauuaagugauuucaccauuuuuuaggagcagacacaggacucaaaccuaucuugugacucccaaggcagcuauccauuccaccagaucacaauccauuuauaguaacuucugaaagccuagaagauggcucaaguuccuuccagccucuaauuaauuucaaaaacaccaguuccuuaaagggaagacugcgcugcugcaauuucaauuaucuugaaagucaggauauuacaguguuugaaaggucuuggagacacucagacuugggguggaauucugguccuaauacgugcugauuaugcgaacuugggaaagaugcuuaaccuucuuaguuugcguuucaucaucuccaacagaaagauaauaauacuuuagagaacuuuucugagcauacaauuucaacaaacaaaaauauuuacagucgguggugcacugaugaugauggugguaauaauggagaaugaugaguuccgggguucuagguucuccugguccuccagugcagacaacuucucugcuaugugaggucccgaauguacaguaauucaaucaacauucaugaaaaccauuugguuuuuaagacaaaugcuucuaaaugggaaaccauauuugguuuuuaagacaaugauuuuuuaaccauacccuguacuauuuucacacaggguuuuuuuuaaauccuuauuuguuuuaaguaacugucagauaugcaggauugcuucuaauauacuuuugauaaaacuguuaccaagaugaaguacaaaauuucauuacauuauucucagagccuccuacaauuaaaagauaaucagacaauacaugugaacaugcaaagacuaagcaauguuuacaaaucaucucuauuuuagcugaguuuaccauuagaauauaacaaaaacagggaaagaauacuuuuuucaugucauuugcacaccugauauucuuaucacaucaaaacaauaugacuuaagagcuuucuccuaaaugugucauuucuccuaaaaccuguauuauaaacacuaugauaaaugccaaaccuuuaggaguaaaaguaagaggaaaaaaauguucuuaauuuaaacccuacaaaacuuucaauaaacuagcaacacuaacugcuacaguaggggccauuguuuugaaauucucuagcuuuucacauuuuuccuuugcaaaguuuaaaaaagguaagggggaagauagagaccgacaaggucuauauaacuuuagcaagacagucaaucuuuccaggcaaagucugacauaguagauaagaucagaaaacuguaguuuucucugcuaggaaaaaaauguuauuucaaaaauaugaauguagcacaugacaccuucuuuagccuucaauuuaaucuuucuguauagauuuacaguacugcuauauuuauucauggucuguacaagauagaauucaguggacuucuaaacaugucuguuccccuuuuuugcaacaugccauaaugaccacuagccuuuagaaaguuauuccuuucuaugcaaagcuauccaacauacccaauuuuucauuccaaccuuaugaaauccuccugugaaacagaaaagauuaaggaaccagcucaagaaaagucacaagugaucaccaucaauaguggaaacaccacucagaaaaucauguucuucacugaauguaccacaaaugacccaguggaggaugggagaacaaaugaaggaagaggaggacaucucuauuucaacagcaguugaguaggaugaaaaauaaaaggcaagucaaauaggguauuucugagauaagcaugugagcauucugcauaaugaggcugugccuaucugaagcuaagaucuuuacuuucuuagacuaaaccaaaagucacauuaauaaauauccuuucguccuucaaaaucuucaucuccaaaguuuuuccauuguggugaauuucuuaguaacucucuacuccggacuggaagacccucugaauuaaccuuugugaacaacugacauaagaacuaaaagcuaaguugccuuuauuacucuuauuucaucagguucaugaacaaaaaaaccucuacuuauuuuauuuuguaacagcucaucucacuuauaaaacuuagguagucacuuuuuuuuuuacacuguuauuucuucucuaaccauucccuuucuuaaaaggcaauuaauaucucucaccucaagagacuagccacuugccuucuaacacauauuaaacgacauauucaguccuccauguucacucaugcuuugcauucacuaugauaagguugcaaaucuggaaaccacauaugccaucugcaaagacgacuacacauguacagaagcugugaauccagcaacucuacagacuuuuggcagaagaggaaaaaaugcaaagaaauuaucaggggaaaacauguuugagauuuucaaagucuuuuucagugacaaagaaccuaaccaccuaaaaccauaucaggaaaagccagagauagagugaaauuuauaaccagaaaaauuuaacacaaagucaccuuacucaccgucugauggcuucugucacaguaacguagcccaaaauaaucuaucuccacaagguuuacgugauggaauacguggucaaggacaacggaaccuuucguugacuucugcaaaaauaauucaguuuuauauuuuuuaacugcccuuuuguuccuaaguaguacacagucaugguucucaucuuuuauuaguuucacucacaauagcagcaauuguaucagaccaugguucuucucuguaaguugugccucaauuaugaagaaaaaaacgugauuuaaagcaaaauguauuauagaaauugcuuuggaaaauacuuuuuaaaucgcaguggguuuuaaauuaauauaagcuucuuucuucugggauuauaaauuaucuucaggacaaaauucuucuuuuaauaaagauaaucuuuuauaugaagaacaucuaauaaaugcaucaaaaaaacacuuuguuuaaaaaucccaccauucccucauuuuaaaaagcaauuuucaccuauagcauuacucucacaaugaauacagaagauauauaaaacuaacaauagucaaagcuuuuaucuucaauccucaaauaauaaacccauagauuaaagcugcuaaagcuaauguucugaaaagccccugugaagauauuucacuuuaucucuuucacauaagcacagacacaaaacuuuucuuuuggcugcuuuuuaaacacugauaacuaccuaaaaagcuaaucucuucucuccccaccuacuacauauacagauucuuuaaauuaagauucuuaucaucugacauacuaaaaaucaauuauucacacauguaagaaacacuuguauagauacagccucuuccuuucucucgccccaucucuggcugguauaauaagauaauaaaagaaaucccacaacaagucucacauuaugguaauaaaggagggcuuuuguucaguuucaucuucccucagaaaauugccaggaugcguuuauccacauauggugagcacuuaauacugcacugcuuuuagaaaauggauuguuaacaugagagaaauguuuuuauuaaauguauuauaaaaugggcaauaugagguuauaaaaguacacaccaggguguacacaccaagaacuuucuucaaguucuuguuacaaauuccauagguauuuuguuuuccucuaaauuacuuugacuaacuuuaacugguuccuuuuucaaaauccauuaaauaauuuauaaacaaaaagcccuuccaugaugaaucuuuagguuacuggacauuuucugcaauaaucacaaugccacaguggccuguaaaugucucugugcucauguacccauguauuucucagagguaaaaaucuugaagugaaauuacucaucugaaggauauguauacucauaauuacagugggcacugccaaaaagaccauuacaauucauuugaugagaguauauguuuuccccgcacccuugccaacauuuggauugcaaaacuuuuuuccaaucugauugagcaaaaaaagaggggaauaaaggaaauguuuuaauuuacauuuuccugacauuaauaaaagcaagcacucuuucaugugcuuacuagucaauugcauuuccuagccuuugaguuaggcauucccuaacccaaaguuuaugagcaaauucuccuaaguacuucuaaauacuuguagaauuuuacuuauacuuagcucuucauuccaucuggaaauuauuuuuguucuugggauaagggcccaacuuugcuuccaaauggacagacaacugcaccaccauuuaccaaaaaaagccaucauuucccuguugauuugaaacaacuuuaucaucuauuaaaugaauccccaguauucuaucucauggguuacuccagaaccaauacccccaagauuuugauguauguaguuuaauuuguuugauauccaucuuucuuuuucaaaacuaucuuugcuacuucuuaaacauuuuucucuacucagggacguuaagaaccagcuacccaauugaauaaacaauucugcuggggauuuaacuggaauuaaauuuaauugacagaccagaugacgugguagguggagguguagauacuaagauauuuacaaagugaaaccucuauaugguugucuuuuauauccuucgaggaaauuuuacacuuuugaugugggucuuacaaaauucuauuuaggcuuuguggcaagcaaauuuaccaaaugcccucccucccccaaagauguccugcccugaccucuggaaucugcaugaugagaauaccaccccuauaauuguguuaugcuauauggcacaguugacguuaagauagggagaucacugaagugggccuaaucaaaugggcucuaaaaagcacagcacuuucuccagcagaagggaaaagcagggggaaagucaacuauauucaaaccaugagaaggguuccacccuucccucucacuugaaagaugaagggggcuaucugagaagaaugagaacagcuucaggaccugaggggagcccccagcuaacagccagcaaagagaugggaaccucaguccuacaaccacaaaagcgggauucugccaacagccaacaaggguuuggaagucgauucuuccccaucauccucagauaagugcucagcugacuaacaccuugauuucauccuuguggggcccugcagggaagccagccaugacauccuggacuuguggccuacagaacugugaaauaauaaaugacuguauguuuaaaccacugugcuagugauaauuuguuaugcaacaauaaaaaauaauacaggcugguucuuagcuauuuuaguuuuauugcuguuauacuuucugacugucuauugcuaaugcauuggaaagccaacuaauauucccuaucggucuuauucccagccgucuugcuaaauucuucuuaguuugucuauggagucuucucagauaaucaguuuucaaaaugcuuuuucaaaaugcuccuccacauuuauuucuucuuuucuuacugcauuggcugggaccucaauaaaagaauaacuaguaguuuugagaacaugcacccugucuucauccugacuguaauggauugcuucuaaaauuucaccacuaaguauaauggcuuguguauggcccgaacgcauauccuuaaucaaauagaugguuccuucaauucugcuuuuuuuggucuuauucuguuuuggccuuuaaucaaugacuaacaguuuuaucaaguucuuuuugggaauaaaagaugaguauaugauguuuguccuuucagcuuugaguuacauuaaaagaguuucuaaugccaaaucuucuuagagaaauucccgcuuuaguccuuuuuguucuggguacauaucaaaccuucugcuaaugugcaaacaaucccccuauuugagucuugguggaggcaggaaucaggcucccagaauaacugacagccaggucacaggcauaugaucugugguuucagcaaggacuuugacuucucagcaagaguuuaggauuaauucacagaguagcucccaagaguaagggaguauccaauagcaaaggcauccaaagauggaaucagcugugacaagcaguagaaaugacugauuccugagucagauuuuccagcauucuuaucuuuuuccugagacagggucucacucuguuacccaggcuggaaugcaguggugugaucuuggcucacugcaaccuccaagugauccucccgccucagccuccugaguagcugggacuacaggcaugcaccaccacacccggcuacagcauucuugagguacaaaauaggaacauucaggcaaucuaccaccuucauuuucugaauauguauguuuggcucaagaggcaggccaguaucccaaguaaaaauccugaguaacaguauagaaaauuggauccaacuguauacuaaaaauaucaugaugaauacaaaaagcuuauccuuuuuguaagugcauccuugguguaaguacaucaagcaaggauuccuaaaauaaauucuauccaauguaacuaugaaaagaauuuacugaaaagauacugaguaucucacaggcucuauagauaucacacuaaugguuucccagagcuuuuuaugauucccaucuaucuacagccacuaagcuuggaauacucaguccaucacuacaaccuuucguaguucuuuugcucauguuuugggcugugguuuacaccuccaauuguuucccauuugccuuucaggaauuuuucuuaucauuucugguccacugagaccagaucgcacugcugcaccccagccugggcgacagagugagugagacucugucucuuugaucuaaaauuuuagaucaaacuuucuuacuuuccagguuacuguagaaagugcacacacaccuuuccucuuacuucaaaauauuucuggaaugcuggcauaugaagauagucuuccauuuugaucuaaucucacuuauggguccuuucucccaucuaggcacagagagaaacagauggaauaacuagagcagguagagccacacaacucuaccuaauucuucuaucccaaacagguaaacaagaagugguucgugaacaaagaggaaacaauuaugccugaaauuacguaugacaaugagaagguacagauuuuaaaaauauguaaaucaaaucugucuuuaugcaaacuauauuugugcuucuguguccagcagaaauguuaggguuuucaaauaaagauaauagauuuauaaagcauaaaaaggaucuaauauucuacccacaaagauuauacacaaaagcaagcucagaaaaccagcucgggaguuuacaaaguauacagaaacucuaaaauuuucaugcagaggaagaaaucaucaaauuugaaaauuuuccaaaaugaucauucccaaacuaccagaacaugccaaucuuuugugacaauuuugcauuuauauagaaucuggugcugcaaaugcuuugcaaauauuauccuuuagcaucuuuuguuacccucuaccgagaggacacaaggaaagcauccaguguuaugcaacaaauccagugcugaccauaaaaaaauaugacaucucgugauucccucuauagcuuucuguauagugcaggugugucuacacaggcaccuggagcagggccaggagagucucagaaaugcuguauuucugucacuacuucaagcaaauacacacaugaaaaccucuuaacuuuucaucugucauacuguaauaugauaagacuuagagagcauggaugccagagguaaauuagcuauugggguggagguacauaucaccagcucacacuucuguccauucugcccuaacugaccucuuccaauaacccuuugcccaaucaguauuccauuguuaugccuccugcccuuauacacauggauaauuucauucuucuuauggguacuuuguagagaccaccuaugggccaauauuuugcaguucagguguaaagucuucagguccagaagaaaucaucuuugaauaaagaaaugaagaacugacagagaacugacauagaaccaaagugcaauuaaaguauauuuguccaggaaggggccaguccuaggauuuauuacaggaaaaaaggguauuaugaaacacaugacuucauucauugaaauauuuauuuauuuauugccuaauaccagcaaaugcuuacucucuagaaaaugggaaaaguacacuaauaaaugccagaagaaaggaggaugauuaucuuucagaauuccagaauauaaugcaaagugaugugaugcgggaagucuuugaccagccuauuagaaucccugagaagcccuagggcuaugaagcgacuaagaaacuucuaaaaagugacuaaaaacuuuauugagaaagugagacagggagagauuugguuaucaucaaaaguccuuuuguagggugggcgcgguggcucacgccuguaaucccagcacuuugggaggccgaggcggguggaucaugaggucaggagauugagaccauccuggcuaacacggugaaaccccgucucuacuaaaaauacaaaaacuuagcugggcguaguggcgcgcgccuguaaucccagcuucucaggaggcugaggcagaagaaucgcuugaacccgggagguggaggcugcaguaagccgagaucaugccauugcacugcagccugggcgacagagcgagauuccaucucaaaaaacaaaaaaauccuuuugugccuuggacuagcaaccaggcacacauauaacuugcaauucuugaaaagaaaaggcaaccaggcagaaauuagucauuaccuuuuuuugcuguggaggcaguuuguuugucaauuugguuuaugcaccgagaaguguuagguaaggaaugcauagaggaauauagugaugagcuguuaauuuguauacuauauuuacauauaaacaauucauacuccccaaccgcuccaaaaaaagguaacuuucuuuuuuuuuuuuuuuuuuuuuuugagauggagucucacuguguccccuaggcuggagugcaguggcgcaaucuccgcucacugcaagcuccgccucccggguucacgccauucuccugccucagccuccgaaguagcugggacuacaggugcccaccaccaugcccggcuaauuuguauuuuuaguagacgggguuucaccguguuagccaggauggucucaaucuccugaccuugugaucugcccgucucagccucccaaagugcugggauuauaggcaugagccaccgcaccuggccaccguguaacuuucuaaucugaauuauuccugagccuuuugaacagguagaccaaacuauuacgggccauuauauaccaauguggaagcuaugcacccccauuccuuaacaugcugaaaaggggcuucauuucuaagucagauggcuaguuucauuugaaauuuaaugaaaucuugauucuuaaccuuacuucuuucaauacuuugcaaaagaaaagauauggaagucagccgggcaugguggcucaugccuguaaucccagcaauuugggacgucgaggcggguggaucaccugaggucaggaguucgacaccugccucaccaacaaugugaaaccccaucgcuacuaaaaaaaaaaaaaaaaaaaaaaaaaaaaaaaaagaaaagaaauuagccaagcaugauggcaggcgccuguggucccagcuacuacaaggucaggagauuaagaccauccuggcuaacauggugaaacccugucucuauuaaaaauacaaaaacuuagcugggcauaguggcacgcgccuggggaggcugagacaggaaaauugccugaagccaggaggcggagguugcagugagccgagacugcgauacugcacuccagccugggugacggagcaagacuccaucucaaaaaaaaaagaaaaagacaugcaaaugauauuaaugccauuccaguuuucuucugaccauuuccagaagaaaccucugccaaaauggggaauucacaagaugccacaaaauaagguacaaugauaacaugcccaaggacuuucugaaaucaauaaauaaauuaaaauuuugucuucgauaauaauggaccuccacuaaugagacauuugagagaaugaacuggguaacaccccaaauaucagggagggauauuuggaaaccugaaagaaaugcuucccauuucagguuucaggaggucucccugggauaucuuuccugcucuaugucauggucaaaauccuacuuauccuucaagauccaguuaaaaugccaccuucuucauaaagccuguccaaauccucucaaucucauuaugaccucucccuccauugaaccuaccaaguuucuuauuuuugccugucucugauacuuacacucuugcacucuuaagauggccauuuauuccuucuguuaacuuuccuacuuauguuuagacauuuggaaagcaugugcugaguaucacacaccacuuacuuucuaugcaguccaauaacuuauucucaguaagagcugccuaaaaguucacugaauuaauaccaagggccaauaacauggugucuauaaauugaaccuuucuuccuguuucuuaugaagauuuccauuuuucuugaccaaucagacuuaugaaauuaaagaaaaagcugaccagauccauguauuuuguuauaucaccugauacacagagauucaguuuacuuuuaacuuuaaaauacacauuuguuucagugacauauaauuccaauagacucaauauauucuaaagguagcauaaggaauaaauaucuuauauuuaaaauggcuaaaacaccaaaaacugaggaagccauauauuacauuuuuauaccuaaaacuugcauagaaauuuuuaugcaauaaaaauaaagauuaugcaaaaaaaaucugacagaaauuugauuuuccaucaucaaaaaaauaaagaagacuugauaugagacaguuaagaaaauaaaaauaaagggagcaccugauuuuuuauaacuaaucagcaaaacuucaucucaauguaacaauauauuaauuuacuuuuaaaaugagaguaaaugccuauuacauauuucuggauugugaauuguauuccacuuaacucuuagcaaaugagauagauuacuuucauuacugacauacuagcaacauuccagaaagaauagagcuacaaaaggcuuauaaucguagagaaagacucacuaguaggacaaguuuauuugaaaauaccaucaauggagcuuucaaccagaacaaagaauauuucaaaugaguaauaacaccuuugcagauuaacaugacauuacaaaccagaaaggcagguuccugccagcuucacagaaugauaacuauuacaucugagacaaacagcuuacuccuucacaaaggggaaaugaacucugcaaaaaauucuuauaacguuaugccuuuaaaaauucacucuaucuuuauuuaguauuuugaccacaauacauuccuaguucucugggaaaacuuaaaauuacauuaauuuuuuuagcuuaggccauuacgauaaggcaaagugggcgcacggaggagacauucuucagguaccaaagguaacuccuucccaggggaggcacuguucacccccauugucuggcccccauuguuuaugucuaagaguuacccucacccuccagaugaggaaaauccucauuuaaucauuaaaaaaugaguaaaauguauuuuucuaggugcaauuaauauuuauauuuuucauauauaaaaguuucuucacacugauaagcuuuucucagcuaucuauugcuuuguaacaaguaacuucaaaacucaguggcuuaaagcaacaaguugccuauaauucuaaaauuuagccagggcucagaagagacagcugguaucagcuccaucugguguuggcuggagaggucuaccugggcugaagaacccaggauggcuucauucacauauugacaccucaccugagauggcuggaauggcuggaagcuggcugggccacucacccucuaagcaagguaaucugacuucgugacauggugacuuagggcuccaagagacaaacaggggaagcugccaaguuucugaaggcccagaucuggcacagcaucagucuugcuacacucuauugaucaaagcaagucacugagucagugcacauggaaagggagcaaaaacagaucccaucucuugauaggaggaaugacaugaacauauagugagcgacuggaagaaucacagguggccaucuuuguugacaaccuaccacaucuuuuuuuucucucuaaacuuguuauaugcuuuauguuuuucuucacucaucucuguaauauuucaaauuagagcaaaagaaagaaugacaguaaaucaucuugaucaucuauauaaaaagaacuaugcuagaugauuucuuguacuuuguuucauuuaaucucuacaagagcuaugcaaacuugucauuuuuuauuccugcuuuauaaauaagcucaaaaagguugggaaagaauagcaguuuggcuagaguaacacagaaagaaagggaaaaggcagagacuccaacccagaaauaucuaacuuaaaauccugagcuccuucuaauacagcagugauucuugaaggcuggagggccuagagacccuuucaauggugcaugaagucagaucuauauuccuaauguuauuaguuuguuauuuuucauuugcccuucucucacaaucauagaguuuucuagcggucacagggcauaucacaacagaugaugcauaaaguagcuaugacaauccagcuacuuucuguuaagcuagauaucauaguugcaaaaauguaaaaacaaggucauucuucuaaaauuguuauguuuuggacaauacaucuuuuuuguaaaaauauaaaacuauuuuuguugacaaguaauuuuuuaaauagguuuuuuggaugauuucaaaaaucucuccacuuaaugguaaacagauacagagauaacccauaugaacaaaaguucuuccagguccucaauaauuuuagaguguaaggggcuccuaagacugaaaagcuugagaauuacucuacuauacuaaaaaacaaaggaauguccuugaugacauagauugcaaaauaggcaauucugauucuuagauaccuggaaagccagucuuuccucauuuuauagaugaggaaacucagagccgagagaugagugacuugcccacaggucacagggcuggcuaacuaaaaaucuagaaauagaaucaaugcagcaucauugccacuaaccaagcacuugccuucucuuuuuuuccuaccaauuuugauaggaguucacaaaaauccugucagcaacaaaauaaaaccaaaagaaaaaaacaaagcaguccacaaggaaggucagagauuaaauaauguguaauggcauucuuuggcaacagaaaucagaauucccagaguagagagcuauuuucaagacuaauuuaaaggauauucuuugguuucaucacugucuaggaucccugagccaccaugaaagaagucuaacuacucugcuggagaaaccauguggagagaccuugagaauacauaagaaguuggacucaagcccaaccuuucagacgcccuucuaaggcaucaggccugugaaugaacacauuuuuggcccuccagaucacuccaacugccuaaucaauaccaacgaguguucacagucaacaucacauggagagaaguugcccagccaagccuugcucacuguccugaccaacaagucauaagauauaauagcugcuguuucaagccacuaaauguuggguaguuuguuacagagcuacacaaccacagauaaccagacuaagacucaaauguucucagcccagaaauauggacucucacaaagaagaguuaaagcagauaccaaacauuaguaauuccugucuuccuaccuguuucaagauagguaacauacguauguuacacagaaaaaccucaagaauuuccaguuaaaugcuauuucauacuccccuucaaucucccuauacuguaacccuuccuucaacccuuguuuauggguuaccaugaagcacguccccagguauugucacauuagcuuguuauaggaaacagagcaacaacaccucaauagcaaugaccacaucugguacccacaucuuugguuucuaaauaucauucuccacuccuuggaaaacagacugauuccaaggcugagacaggaaaguacaaggccugaaauaacuuacugcaccaaaaauggaaacaguguucaaauaaugauggaggcauuucaaaagaacauuucaaaagcuaggagccagcuugacaggacucucgcuaaucaaauuugggacaaucugaacaacaacaaaaaaaaugauagugucagauuacaaccccuaugagaaaaaucuaugaguccaagugaauauaaauacaugugugaauaaauaaaaagaagagaaauguguccuuacaauaaaaugccaacuaauaaauguagaaggaaugacagaauaagaaaacuaccaucauuaaguacaacugauuuggucaagaaucaucaguggaugcuaaaaugaguacauuagggucaaaggcagaauagaauuuacacaugaaaggaugaaccaacaacagcaaaaaauacagaaucacuucuaaguuuuuccugcuaaaaaauagauaagaugaaauuaauaaugaagaagcaucagacaagccgaaauugagggacauugugcaaaauaccuggccuauucucuucaaaaauaguaugguuaucaaaguaucaaguaacuguucuacaaugaaggagacuuuuaaaacauaagaaaaugcaauaaauaauucuagauuggauuauuuugcucaaaggacaaccaacauuugccugggguccguggauuagaugagugugcuuugccuccuucccugauguugaauaguucugccaugaugauguacuagaggauccuuuugggguauuauguauuaaagcauuuagggguaaccagucucguguuuucaauuuacucacaaguaguucaauaagagaaaaaaaucaucauaaagccuaugugguaaaacguaagcaacugcaucugugagugaaggaucuaaagaguuguuuguauuaugauuacagcucuucuguuaagcuugaaauuauuucaaaaguuaaaugaaaucacuuauccucuccuauucaaggcacuugagaaguuccgggccuugcucauucuuccacccaauagaacucucuuggucacccugcaucuugcucucuucuuuccauccugcccaacucucucaguccuuucaucccuuuuucagagaccagugaaggaagaaagcugugugagaaaagaggaaggagaaggcugugacccacucuauagcagucaucugcauuccaucauacaacauaauccaggauucugcugcaaguauggguuuuaugauacauuauaacuuucccccuuaacacaaaagcccucuaaagugacccaagaaacauuucacugaagucauuuuaacauuuauaaccauucuuacuuuuguuaucacuaaaguguucuacaaaaggguaauucuuuaaaauugcaguaacaguggggcaggggauuggcuuauguccuccuguuaacagccuguuuccgauucuacaagaauagccugggaacuuaaguuaucccacaugagagauaaaagcucuggagauagagagguugaaggggaguauggacaaaacaagcuacuuucucauuauuuauuuccacugacguauuuaagacagaggucacaaacagaagcccacuuuuuauucaguggccuacguagugaugggaagaucaggaaauguuauauucugccucuuccagcaacccaaagcacauggcaaaaaucagcaggaacaucccugcagcuucccugcuaagugggaaaugggcucuccagcuuacaggugucuuccacucccuguggucuaaaacucugcuacuucauucauuuaagggaacuccccaacccaugaaugugucugaguuggcgcccccacugugaggggccaaaaguaaaugacuucaaguuuccugaaagguugaaagaaagggucgugagauuacaggccaucgagacuucaggguguucauaucuugccuggucagaugacaguauguaggaaauucauaauuaugagccgguuuacaucaggaugcuagauggagaggcaauucuaaaagcuugggaucacagaggagagaacacgacaagagucagagaagcuacaagaggagagauguugccagaucaggacuggaagaccaaugggcauugggguugggguagaagugaaaaggccacaagaaaaugacauucgcaagauauauuccugaccugcuuuucuucucaccuuuccugcaguaacacaaugaccaaggugagcauucugugcaaaggaugcauuccuuaagacauuucauaauccgguacuuauuuccccacaggaaucacaggaaagcagagggaugcucuuuuagggcacacaaaucugcaacugccuuaauacugcuuuauuugauggaaaaacauacugcauuauuauguacauuauuuggcaaaaugcucucuccuaaauuaauaacagcauagcuuauuaccauggcaguugcugagcuauuuuaauaauguuuaugacaucuaacuucugcuucaaguuacucauuuggggagcauuucugcccuggucuuaauguaccacaaccaaaagaauacugagagaauacuuuuuucccaaauaaaaagggcuuuuuaaaauauaauaguaaauguucaaauaauagcauaguagaugccaaaauuugcugcaaaaguuccaaugcauagguguauuuaaccuauacuaacugaagauggugcauacuacuuuuugccaggcaaagcagccccaugauguggcuguggcagaaacacuguuuauaacucagccucccaccuuuaaaccuguguaauuuuugaaaaaauuucuuuaaccugggggaaauucuaaguuuaaaagauaaagggaggcuucauuaacauuuuuaugucauaguucaacauuacauaagucauaaucagauaaaauaauaaaaccaguaacaauaacaucuaucagcacauauuauacuuuacguguacuaacucauuuaauucucagagcagcccccugaguuagagauaagaauaacagcuaaauacuauuuguguguggcaggcacuguuauaauagcacugcaucuucucauaaaugugaaacuuauuuaaccaugauagcaauucaaggaagaagguauuauuuuccucauuuuagagacaagaucauuggaaaccauaggcuaacuuagccaagaauacgcauacagagccaggauuaaaauccagacuagcucuagaaccugugcucuaacaugcacucauauuuuacugggagaacuaaaguuugaguaugaggccaaagcucuaucaaaacugcuacuaaggagagcacucucaaauucucugugucagagcuaaaggacccaccuggguaaaccacagauuuuaaaguucccuaaagugcccuagccagaaaucuaagucgguucuacuuaggaaggcacugggguugaugcuuggaagaacugucuaauccuaccgaccccagcagaccucaaaggucacugugccggugagccaaacugcucuugagaaccaagccuccuccccauaccucagcugaugggucccaguuugacggcuuauagccauccacuaugagacacacacacacacacacacacacacacucacacacacaccccacacacacacaccugucuuccacuacuugauguuuugccacugcuccagagugcucuuagccugccugauaaauaggaacccaucaaagacaaagaaaaauaacaacccauguaaggggucuccgcaacuugaaugagagagaccaagaugaauaaccagaacaaauagggccuaugaaaaagacagaagaagguaaagggggaaagguaauggggacuuucaagaagauacaauuagaagacaagaaaggcuuucuaaagcuauuugauuucugaaauuaaaguuucaauagacaagaugaaaaaaguauagucguugccaagaauccauucagaguucugaaagaucaaacaaacauuguagguaaaaauaucagagauguggaagauguaaccagaagacaaaacaugcagauaacaggcuuuccuggaggacagacaacaacaaauaagacauaacuggaaaggagggaagagggaaggagggacaaaauaaaagaaaaccucccugagaugaaagaagggauaauucucuagacugaaagggcucccagcaagcuuaggcagcaauaagaaaagacacaugccuaggcuugguaaaauauuuaaacugagaacccaaauuaucuguaaccacacaucuuacuaucuauacuagcaugacuuuacuacucaacugucuacauuaacaugacuucacuauuuaagggaacucugacccaagaagaugaaguuacaaauaacuuuacuguuucuuacagaacuuuccaaaaacuuauuuaugugaacaggcaacucaacuacuccuuauuaaguaaauacccucuacucagucccacaaaucuuauuuuaucaaaaacguugucuaauuauaugucccugcguugaacaacguaccuuaaaccagacccuaaaaagucucauaaauuccccaucuuugcccuccuuccucugaaauggucaguguaacagucucccuuaccacaguaagcaauaaacuggguuuugcuuuauuuagagguuauucugcaaccuuuuuggggaaucaguagucacagacuaaagauaaaaaggaaacuauauagucaaacaaacugaacaguggauuuauagaggaaaaagaaccagauuagcauuagauuucucaaaugcaacacuggaaacuagagcacaauuaaacauugacuccugagagaaaacucccagccaagauguuguucaccugucagggcaagcaaaaggccuuuuuucaacaugcaagaacuuagaagcuacuuaaccaaugaacccaaucuaaagaaaucuuugaggauaugcucuaauagacagaguucuaaagauaugaaagaucaagagagagaaaaguggcacaguguaucuaaaugaggccaacauaagcaggaauuuacaauuuaacuauuguuuuaaggagaagagacauacaggaagagaaaacuuaacagaugagaacgaaaaauucuaaacuaucucaguaaaacuaaggggggauauuuauuuuuaauuuuuguaaucaauauagaauuuuaaauuacagcuguucugaaaguuucuagugagaaaguaaccacaguaggauuuuuuaaaagguaggaaauucuguguuaaugaugaagugauacaaaacuaaagcagaggucaggaguuugagaucagccuggucaacaugguaaaacccugucucuacuaaaaauacaaauggugccuguaauccuaacacuuuggaggccgaggcgggcagaucacgagguaaggaguucaagacuagccuggccaacauggugaaaccccaucucuacuaaaaauacaaaaauuagccaggcgugguggaacgcgucuguagucccagugacucgggaggcugaggcaggagaaucacuugaacccaggggcggaaguugcagugagccgagaucacaccacugcacuccauccugggugacagagugagagucugucuaaaaaaaaaaaaaaaaaaaauuaaagcaguaugacucaaagaugucacaaaaaauaaggggaggggacagagaauugaagagaaauuugaccaugcagcaaaagaguaaauaauaauaaaguauaauaaacaguaaauuaaaaacaaaugaaaagaauaaaauaaauaaguauuuaugauacuaaaugugugguagaugagcuacaacaaucuuuuugaaaaguaaugaaacaguagcuaucaucauacuuguaacuagcuaucucacuuaggaagaaucuauucuauggaaauaaaagugccagguauacauacaaggauggcuguuaguaguaaaaauaaaauccccuaauuuggaugaccaucaauagaagaauuguugaauaaacuguagucauccaaacugcgagaaauuacgcacaauuaaaaagagagucagggccgggcgcgguggcucacgccuguaaucccaguacuuugggaagcugaggcgggcagaucacgaggucaggagaucaggaccauccuggcuaacauggugaaacccugucucuacuaaaaauacaaaaaauuagccgggcguaguggcacacgccuguagucccagcuacuugggaggcugaggcaggaaaauggcaugaacccaagagguggagcuugcagugagcggagauagcgccacuacacuccagccugggugacacugcgagacuccgucucauaaaaaaaaaaaaaaaaagggagagucagauaaauguguguugaacucaagugaugcccauaaaguacuuuagcuauaaaagcagaguagaguuuuaaaugggugguaagaagcuauuauuuuucuuuaugcaucucuguauuauuuuuaacuuguuaacaucaugcuuuaguaauuucaaaaaugucuuaagaaaagguaaugaggaggucauuucaaagccaaagaacagcacagaccaauguucagagguagcugaagggugaguuggggacguagguuucauccagcccuacuugcaaccucggcaggcugcuuaaccacucaguuucucaguuucuucauuugugagaugggauaacugaacucaguaaaggucauccccagcucugguauucuaugaauauguuaagaaaacuacaggacgggcacaguggcucaugccugcaaucccaacuacagcaacucaggaggcuaaggugagaggauugcuugaggccaggaguuugagaccagcuagggcaacauuguaagacccaucucuaaauaaauuuuuaaaauuagccaaguggguggcacacaccuguauuuccagcuacuugggaggcugaggcaggaagauugcuugaauccaggaguucaaggcuagaguaagcuaugaucauaccacuguacuccagccugggagacacagugagacuccaucucuuaaaaaaaauuuuuuuuaaauuaaacuauacaccaaaccauucgaaaucuuccacugacugccucucuuuccuaacauuaacauccccaggaucagguggagggucggugcccccaauccaccucaaaggcaugccaaaccccgcauccagaaggaaauuccaucacaggguuauaacugccagaccuacacacaaccacaacacacaaauaguucaccagagccuuuuugucaaacugggcccucccaguuucauggcagaggcaacaaacccccuuaaggaauuaugggcuaagcaguaauucaaaauaauuuuaguaaaaaacacuuuuuuccaucugaaauuucuauaaaauauaaaaaggaaagauugcuauuagaacaaaaguucuaccaaugggcuuuugucuuuguaagcucucucaacucaucaugccucugcugugucuuguuccagugcgcugcuauuucauuuaccauugcuuacuucggcacuccuaaaaaggauguuauguguggcaguucacacugcaaaaugccaguacucuccugaacucgcccacugucuucuguuuucauuacuacuuccuuuauuccuuucccugcuugucucuacuuuuaagaaucaaucaaaugacuaauagccauuuacacaucuacaccauguaacuucuacauucaaucaaaucuucauaggcagcagagcaauaacagucaucacagaauccuuuaaucauuuaacaaauugaacucaggauucauuaaaaaaauauucacugaucaccuaccaaucacacugugcuagagacuuaacacuucaauuaacccucacgacuauacuagagaccuuuaauacugagguacuaaaucuuacaaaccuuacaauuguguccccacaaggcaagaguaaucucaauuucacaaauagggaaaacaaggcugagaaaacucagcugagcgaguugcaaaagccaagagcuaaaacccagauauaagcccuggccuucuaagugcauggucuuuccuggacaagacauuaagacucaaaauaaugaacaacauuucucacuaggaugauuagaaaaggcuuuguuaaaaaaaauucaagacauuauauacucaaacaagacuucuauaaagaagaagcuccucguguuuaaauuaaaugauucuaagaaauaaauauccucuaaaacuaccuuuaaggauguagcaaugucaaaacuaccuguaccuacucaguaagacauaccuguuucucuugugguaagaauugcaacuuagacugggugcaguggcucacaccuguaaucccagcacuuugggacacaaaggugggagaaucacuugaggcaaggaguucaagaccagccuaggcaacacugcaagaucccaucucuacaaaaaauuuaaaaauuagccagguauggugacauacaacuguagcccuaacuacucuggaggcuggguugggaagauaauuugaaagcccaagaguuugaggcugcagugagcuaugaucacaccauugcacuccagcuugggugacagagugagauccugucucaaaaaaaaaagaaaagaauuauaaacuacaaacuuuagcuacaaauagaagcacugcaccuacaguaaacaucucgcaaguaacagaaagggagagagggagggaagugggcaagcagaacuggauuagcaaugggguuugguuguccagucaaaccauucuucauguucacugcaguucuaccauacauuuucacuacaugcugccuccacuaugaauucauuuuguuucuguucaucccuuuucauuuuguucuaauauuugggcauuacaguccuuuaaaaagaugcuauaaaauauugggggagaaggccggacacgguggcucacgcucguaaucccagcacuuugcgaggccaaggcaggcagaucacaaagucaggagaucgagaccauccuggcuaacacagugaaaccccaucucuacuaaaaauauaaaaaauuagccgagugugguggcacacaccuguagucccagcuacuuuggaaccugaagcaggagaaucacuugaacccagggggcagagguuacaguaggccaagauugugccacuguacuccagccuuggugacacggcgagacuccgacacaaaaaaaauaaaaaaucuugggggagaaagaugugagaaguuaaaauaauucuaguugcacuuggcuuucccaaagaaagauuauuacaaauaaagaucuguauuuuugaacaggaagggauguauaucugauaaccacuuuuccaugguuauaucuaaacucauuuuuaacaaaugaagugauuugggauauugcuauauaaauaauaaaauagaucuaacauaagaaacuugccccagaguugauuaauaaccagaguggaggcuagaacccauuucuccugacagcucacucuucaucaagcucacugauuuaaaacaccauucagguuaacccucuguaaguaaucaauacgcaccuagaaguuuuaaucaaaucagauuuuaacguugacacuuuuauuccugaaauggcuggacuuaauacucaaauaacaaagcuucuaguaaaacuucucaauuccuugcauuuuuugguuaguugauacauuagaaugaaacacaaaugugcuaaaagaauuauuuaaagucuacauaaugaauuaccuuaugugaaucacuaacuccuaaaucacaaguuuugaaaacagguuuucuugcaucauucuuaaaccaaaguucauaguuuuuccauucuaagaagguuuaaccaaaauguacagugaaauaguggcaaaugcacagugaaauguuucaaagcaacuugaacaguguguguuuaaccagcccuuaaccugagagcugugcaguccgauacgguagccacuagccauguguggcugcuaaguccuugaaaugcagcugguccaaauugagauguacuauaaauauaaaauacacacuggauuuugaagaccauauaaaaacaaaauugcuaauuuuuuauugauuacauguugaaauaauauuuuagauauauugaauuaaauaaaacguuauuaaaaucauccuuuuuacuuuuuaaaugcaacuagcugaaaauuuuaaaauuacagauuugguucuuaucauauuuuacugaagagcaccauagugaaguuuuucuuaccaaaggaacacaacugcugauagcuggcugccugaguuggagaaaggacacuacuagcucucauuacuaauucucuuaauacaaacccucccuauuuaguccuggcucugcuauuaacuagcugggugaccuggaacugccacuuaaucucucuggcccuaaauccucaucuauaauccuagacaacaucuaauaccaagucaucauuuuaaacaaugaagaugcugagacuccacauuuccugccuuccgguucauggcucguuucacugcacuacugcaccauacacccuuucugauuuuaucuguucaguggcuccacaauacaacucuaaucccagggacugcccugcaaaugaaauccaugucacucucuacaggaaaaagggggugugaauggaucugaguacaccuaagccauugugggggaaauacuuucagcaccccacccccucuucaguugaagguagcaagccauucccacaguggguggcccgcaggguuaucugccacaucaaaaagagaggcuuuaugguacucuaccaagcauccuuacaggucuccacaaggcuaugugacugucggcaagucugcugaaucacuuucaaaccggauguccuuauuugcaaaacaaauuaauaauaucugcccaacugcaccacagacuggcuugaaagaucaaauaaaaugaaucuggaggcuuuaaaaguauaaaguauacuuuauacuuuuaaaguauaugguagcaagaacggcuugcuaccuucagcugaagaggggguggggugcugaaaguauuucccccacaauggcuuagguguacucagguccauucacacucccuuuuuccuguagagagugacauggauuucauuugcagggcagucccugggauuagaguuguauuguguauaaagcaccauauggauaguuaaggucucauucuuaccauaaaaugcuagccuaaccuguacacaaucagugucucgguuuugcacuaaccagguucugcagaacugaaagaugacaauaggauacauuuugguaauuugcuaaauucauuucuuuuuuaagggaaaaaauaaggguugauguaccucucgcauugucuuaaguuuuaaaaaagcaggaugcaggguaucaguggcuugcaugcauccuguauuuauuaaguagcagccauuguuccaaguuauuaacauuaucagauucaaucagaagaauccauacugcagaugagaaaacugaggaaugggggguaacuagcccaaugccuuaaacaugguaagcagaagacgcagaauuugaacccaggccagcuggcuguggaacccauguuugcaacugugcuauccugccucuagugugcagaguauucuauucuaucuuugguauagguuuaaaaaaaaaaaaggauuauacuucugggucuguguaucaauauauguuaauaugcauauuuucauauagauuuagaaaaaaaucaucaagagugauuaccuucggagacagcaguuaggaggauggaguguggacagggugaggaggggccugcacucuucauuguguaaacuucaguacuguuuccauuuccugaccuuacguaucuuguugaggucaacaggccaucuuccguaacagaagucaucuuuaaauaugugaaggagcuaccuuucucuucuuaaaaauccuuacccaaaaugguaaggaagccacagauucugugucaagcaagccugaguuccaaucucaguucccacuucuuaauacucacacaaauuuggaaaaguuucuuaacucucugugcccagcuuccucuucuaauggagggcauggagggacaacuccaucuuccucacagguuuguugugaaggucaauuugugccaaaaacccgguccagaacuggugcccugcuaucauuccaacacauuaccuuccaacccguccucuccuacaacuacccaguucugcugguuuuacauauaaacaaaccaguggagaaguguugaccaugcuauaccagacaaaaggccccaaacuggaggucaaaauucacuuccugcuuuccuuguuuauaacacacagugggcacacagccucagggaucccccaacugaguguucccugggguaucagagggcuggcaugcccugcuccucacugauacuuuguauauagcauugucugccaucugaaccacagaaauacuuggugccuggggccagagcagcugaggguaccuggugaaggcugcccaagcggggccuucuggguacuauugcugcaccccaaugaaugucagcaaaguucucaguccccacccugacacuguauaagcaggaugcaggaucuucgcaaguccagcugauggaguugggaggcaagggcccucggcccccagaagcaaguggccaccagucccuuaaccaacaugagugacagcagcuggaggcuaccaacuccauaagggauaugcuguccauggcccccacaaggugccugcuucugagggcguauuagaacuaccuggguuuuuucaaugcuaaucccugaccuuucacccugcgcuguccaagugacucccaagaacagccagggguuagaaucauaggagcauuucuuguuaagaaacaagacuacuccaaaaagcucccucucagaccaaaugaacugggaacaggaacagaaaccgaaggaaucuaagggaucuggugugugaaccaagaaggaaagcaaagguuaucuggacuuccuccucuauccucaaggagggaguuccaacacugcugcagaguccugccucuauuguuccaauuccagaaucuuaaggauagugagaagaauaaaacacagucuuuuuguuuuuaguucucuauuccuaacuaucaucccaucuuucuuuuguccacuuuuucuccuguuuaaauuauucuugaugaaacauacacccuuagguggguaguacuauuugcauuauuugaaguaauuauuuggcuuggggaccacccaggaccuugacuccucuuuugucuuugucacugcccaugucaccauuagugguauuucagagugugaaagggucugccaugaaauacaugcguauugauuuuuauuuuuuaaagaccauaauaaaacucuggcugaagagagaugcauggcaccaaugcuccugaaugacaccccagacucucucuggagucagucuucuacuccccaaccuggacaaugauuuuucaucccugauuuucuuucuuuucccucuuccuuugugcauucuuuuuuuccuaagccuuauauuugacugacaccagguuauauuuuaguccccccugcuaauucucggaauaacagaaguuaccaacaauacaguuacaauuagcaacugaaaauaugcacagauaugguggaaguuuggcuuuuuaaaaacucugccauaucuucuaaaaagcacauuauucuuuuuguagaauugcuuauacuuuuuguggcuauuuauaaauaguaaaaggcuuucuuccguuacuguuuugaaagcaacacaacauaccaucaagacauuagugcccaagguuugcagaaagguucucagacacucagaucacacacagcaugugguauggaaagaagagagaaaugguggguauugauuuauaagcauaaauugcauuuaagauauuauagaguucccaaugccucuaaaaaaugugaagauacugcaaucauuaguagcuacucugcugcucaauagcucccuuacugcaggacuauuaucuuucucuaucgguuuaaaauggaggcacccaaagggcuuagagcagaucacaguugagucucuggcugagaagcugcacccugagcagguuucauuucuuggggcaagcuccuaauuccuuucugcuggcccuccccucuaggaaauauauuggggggugggagagggagaugucaaaaaggggggaagggaaaacggcaggaaugugcaugucaacugcaugcugaccuuaccagccaauuaaggaaaugcucggcuggucuccgcaggaagcugcagccagucuccgauggaaggauaaugacugugacaccaagccccaggagaaggagugugugugaauauuaaguaaacacacauauugacagacaaagcagagacaauccaggaugcuguguuugcagccccuauucucagaaauggauagguuggucaugaggagagaaugcugucuucucaauugccugacucucugguccuguuuucucccccacucucuccccuccacucacacaccguaugaguugcagucucucucucucuguuacauacugacagcagaucuaaugccacuuuuccaagacacaugucaccaguucucuuuuugcauaaaugcuuuucuggcaacccggcugucugccagggccucugauuagccaggagggauaucacauugaauuauucuauguucacacuugauacuguuaccaucaguuucccccauaaauguaaagaagcagcuagcucagcaccaaccuuagaucaucuaaaggacugcaguauacuaucaacagcguaaaccaaaaauaaaauucuaaguuucccaaacugauggaauggacccuccucucauccaaggggacccagugaaaccugaaaaacuaguucaggccaugaugggaacggguugcggggugagggcagucagacagucagaugugccuuauuauacgcuccucccuuuggaguucaggcacacagccaaccauuauuaauauuaaaauaaagauccuaaaacugacaaaacaaacccuuuuuguagcaacaagauaccaauuccaaccugacuuugguauauaacaucacauacaucacauaacaaauagcagacccuaaaaggaaaucaaaguauuuuaccccaaaauauauuucuuugacauauuuugaaauggcccugcaaagcugucucuugugggggaaauuuacauucuguguagaaucucuuucccaagugcuuuucugauccugaagagauuagcugagagucuagcaccuuuuauauaucucaauaggaaauauuugccaucuauugccucuaaagauggccacauaugagacuucaucuacauaauacaaaccuuagucuccacaaccccuuaucuuaacccagacacuccuuucuauugauuccaggucuuuauauaauaauuuaucucugucuaccaacugccagucagaaaaaucuuuaaauuccccuaugacauguaaccccaucauucccuuugugcugucccaccuuucugggccaaaccaauguauaccuuacauguauuaauuuaugucuuugccugacuucugucucccuaaaauguauaaaaccaagcuguaacccaaccaccuugggcgcauguucucaggaccuccugaggcugugucaugagucaugauccuuaauuuuugcaaaauaaaccccuaaacugauugagaccuaucugagacauguuuuggauuacaacagugaguauaagaaaauaaaaacugauauaaggggucuggguauuucacagauguccuaccaagcaaagaucaaacuuuaggagagaacacaacuuuaggaaauguuucacaaaacacuggccuauacuaggguacagccucaccccgaaagucauguucauuuucgugaagucaauauggcccaggaauaaccacucugucaaguagaggaacaaagccuccuggcuuugcacugauugggcacaaaggagcccuggacacaggaugucucgucagguccuggccagggcuuggcacagaguacaggagggcaggggagagauuuccauugccaagaggcacaaaaacaaaagcaacugugcuagagucuguaucuauuaacacccaagcaccaacucacagaggggaucaguguuaaggacccuccuucuugaacagucagacaccuuuuaagccuuauaagaggaagauuaaucgauuuaacagaaaaaaagugaaccuaauguagauguauaagcagaaaauguuuaccacuuucuuugaaaucuuaccagaucuauauaguuuaagagauacagaauaugagaaaaagcaguccaguagguugaaugcuucuagacauucaugucuauuaaaucaggcccucaaacuggcauuuuccagauggccauuuuaccaaauuacgccagucagacauuuuuacgacuagaacaggauuucugggcaugaaccugaccauggcucuccaccuccacagucauugccugauaggaggcaucuccacuacugcaagugccuccuaacugguguccccauaucuacuucugcuccugucuccacagagcagccagagagagagaauuuuaagaugcaaacuuaacaucuucugguuuaaaauucuucaauggcauuccaauauaauaaaaacaaaaaccaaauuaucuacaccuugaucuccaagcccucucuccaugaucuagucaugacccaucacagcugguguuucucuccccucacucugaggguccagccacucuggacuucuuuccacugaugcuucacaccugcuaucuccuucgucuagaaacaguaccgucccccagucuuuuuuaauccaucaggcaccacccucacacgcccucaaaguuguguuucaugauucccuacaccaggcaaggaaaggccuccuggaggaaaugagaacuaacaaaugaggaggguuuggauaagugggaugggaagggucuuccaagaaagagggaaacacaagugaaggcacaaaggaguaugagaaagcagucacacauuacuaguucaaggagcaguggcaaauccagaaacaaacacauuuuaaguuaauuuuaagaccaaagauggauggggagggggcaguggaaauugaaccugcaucgacuuguuugagaaagugcaggucaaaaagcuucaaagugggcuguucagaguuagguggaguaaggcgcuuuccucugcaugucacugguugggggcgggaguucaauuccagaguaugaaauaggaggccuguggcauuauucuuuccuguguuccagaaggcagauuuccucaucccgccaaccccuuuaaaaggcuucaaaguggggugauucuuuacccuguacacauuauacugugguggucauuagagcuguucgccaaauacuuccagugguacaagagcacuuuccugguccccuugugauuggguggggcccuguaauuagggcuuaccacugaguggauccaaaaugcaaaaccaaaaaguuagucagggugugagaggcaaaaguacagaaaggagaugaugacaacauccaaaggcuugguggcugugccacugagauacaaggucagaaagcuagaaagagaagauuuuuagcugcagaaauaaugaguaggugauagcuuucagaauugacaaauguccuagagguauuuggggucaauuacaugucuuucaacuuucucaaggccaugucuaaaaacaauuucugaucucucaagagcaaaagcaucuuuucauuagagacuucccuuuuacagucuguucauauaccuugcucauaagacaacaaauacaaccugucuguaguuauuucacagugccauugagaacccaaacaacaacagcuaccugucuguauagaaacaauaugcauuguggacauuaaucauuaccccucaguguuuaccuuuugagccugucacgugaagguuuuguaagaugcaauauuucaucauuaauacugauaaugcauguguacuggggcucuucaaccauauauaaaugaaauuuuaucagcuuuuccucuguaauuaaugagauaucuagcuacauauaaguuucucugaaauuccauaauuugaucauuacaaagcccaaacccaucuguuauagucagcuuugccacaauucagucuggucuaacacaaucuacuauaaaauccgguaccacauccccuaugucaaacguuugcuggguaucuaccauauaucaaccaccguguuaagcacuguuuuaucaguaaugcuacuaauaauugcuaacauuuauugaacacuuaagauguucaggcucuguuugaacuguuuccaugcaguaucucagucaucacaagauccccacagacuggugaaacuccugucuccuuucauagacaaaaggacggaggcucagagaagcaaagugauugaccuaaggucacacaguaagugggaggacagcauaacccccgaguucauauucccugcuacaccauauacaaggauccuaauuucaauaaagcaucuccugcccucaagaguguuacaauacauaagaagugauaagggcaucuaaacaaaagcccuaucugacccauauuguaaaaaaaguacuggggaaaaggugcuaggaaaauugagaggagaaagugaacucuucuaauaugaguggucagggcaggcuucucacagauggaagccuuugggccauuccuuggaagugaaagucaggagcgggcaucccuggaggacagaacagcagaaacaaagguaccaaugacugcaagaaggcacugggcacauggaaagacaaaagaggaccccauuugucugagggugagauaucuccuaaaucgcucgccuugccuccauccccuuagguucaggucaggccuucaaccuucuucccauccacaucccugccucuuacccuccaaaaugccaugugucaccuuuucuaaaacacaagcaguguuccuugccuuaaaaaauaugcccaugaauacagugaaauuccucuggcaugacauuugaagcugacuuuacuaaucucagucuucucacaccccugaguaucccaucucaucugcucucuagccaaacuaaacugcuaccuucccauagcagaucagcuucucagaccccuucaaaccuucaaagaagcuacuuucuuuguggggagcccuuucucccugucugcuggugaccccccuaccaacucuucucucggcacugucucagacugccugcccaccugcuccggcucucuccagcauggcuggcucccugcuguuaaccugaacaagcccaauacauggucauaccaggucgcugcaccugugcucccucaccaggaaggcccuucaaaccaucagguauccuaugauuuguuucccccacugucuggagaugggggaggcuuccucuaccagcguauauaaaaaagaacaccccccgccaccacacacaaaaagauaccuagcuuuccauucucuucguagcaguuauaacuugacaaacacauacacacauuguguauuuguuaacggccucccucacccucuagaacaggguuggaaaacuacaacacaugggccaaaucugagucacugccuaagcauuuauuagaacacacguccacuauuguuuuacacauugucuguggcagaguccaagaggugcaacagagaccuaauggcccacaaagcucaaaauauuuauugccuaaucauuuacagcaaagguuugccaacuacugcucaagaauggcuaucucccucugucuccugcugugcucacacuuuaucuccagaccauuuuggcgccuuaccuagcaugcaguaggcacucagagaacauuuguaaauaaaagaaagugacagggugggggagaaugaagggagaagagcauaugaaugcaagagauacuggagggaaaaaucaacaggccuggcgacuggguuuaggugccagcgaagagagcaggaauugcacaauaggagcuuuucaaauguggcuguguuccuuggccaaaggaugagauucuaaucaucaaaccauaaacacaagcugugaaucagggcuggcuaucacaccacugauggguuuaaaauaacagugucaggcuccuugacaaggucagucaaggccugacagcacugcccccauaaauaaacuggcuccauuauuauaggacugaaguauacaguggagagucaaaguuuugguaaccacaaauaacacacauaaaucuaaguagcuaacaauacaguaacaaauaaauauauuuaaacaaggagauauauagcuauagauauauauauaucuauauauauauauauauauaucuauauauauauauagauauauagauauauaucuauauauauauauauuuuuuuuuuagacagagucucauucuguugcccaggcuggaguacaguggccugauaucggcucacugcaaccucuaccuccuggguucaagcgauucccccgccucagccuccugaguaccugggauuacaggcacacgucaccaugcccaguuaauguuuuuguauuuuuaguagagaggcgguuucaccauguuggccaggcuggucuccaacuccugaccucaaguaauccaccugccuucgccucccaaaguacuaggauuauaggcgugagccaccacgcuuggccaagcuuauaaauuucaaaugcauaaauauuuaagcaaauaauaacuucagaccucauggaagagaccuuuuaauuauuaauaaauaucacucucugggcucacagaugagaaaaccagggccuagacuaguuaaucacucacgucaugucacccaguugguuaauaagagaaaguuggaacagagaaccagaacucccgauuagggccccaugugguucccucauauccaaugcucacagcagcaugagaaaagucacggaggagagcccaucgaccccgcccuuucaacaaaguguuaaggucagagucaagucugcaaaagauugagggagugacggaaggaaaggaagaucuacccaauuaggaaccccagugaagauuucuggcucuuauccaacuugaccucucuguagcacagugguucuuaaaacuuuaggaugcaucagagucaaccgauggccuuguugaaacagacugcuaggcuccacccccggagcuccuaauucagcugaucuggaguggggccccaaaaugcacguuuaacaagaucccagaggaugcugaugcugcagguccagagaacacauuuugggaaccacugcuguagcauuuaaccaugaccccugcuuuggcuuuuaucacacuucuuaucugccucucuggccaacaguuugagaagggugggaagucuuacuuagauuacuuccuucaauaaggaaauauuuucuaguucucauauaaagacuaaauagcaauaaaaacagaucccugcucuguagaacaucaauuuuuaaauggauguauaauagcauauuaagguauuauuuuuaccuuuuauauucgcuaguucugauguaacuacauguacguuucugccaauuuucuuucggugauaugaauuuuguuuauaaaugauccauuuaaaaaggacguauauuguugcuccuaugucuacucccuggauagagauucaauuucgacagcaagcccaaaacauucacucagcccuauuguaaacauaaauauauuucauacauaaguauccauuuacauauacccuucgaccuuuccaccuacuguucacaaugcagggauuuuucuuucccucuaucaaacagccacauggcuuagucccuuacuucauucagauuucugcucaaauguuaccuucucuggaagguccucugcaagcaccacuccauaauagcaauccuccccacacgccaucucuccuauccccaucaccuacuuuguuuuucuuuacguuuauuguauauuaauguuuucacuguuuaauuggucuccuucccaugagaaugaaagcuucaugggaacagggacuuuucaguucauugcucuguccccugagccugguaugcaggacacucaaauuuuaauuaaauuguugaaugaaugcuuaucaacuuccaaaaaucccacauauaacuguguuugauuauaaugccuuaaccuuccuaaaacugauacaaauguuucuuacuccucucauaaccaguucuucaaugaauaauuuuccaaaaacauacuguguguguauguauuguauucgguaccguugguccaaaaauuauuuuaauagcagggaucaucaaauguagcuuuaaaguaucugaugcuuuaacugucaacugaaauaucacagcaauaggauccucugaaaccaauuucauaaccucacaaaucagcaaggcagaugaaccauuaaaaacaucuuuguugaugguucacauccaacaaucccaaaagaaaguaauuuuaaaaauuaaaagcuuggccaggugcaguugcucacgcccauaauucuggcacuuugggaggcugaggcagguggaucacuugagucuagaaguucaagaccagccugugcaacauggcaaaacccugucacuauuuaaaacacacacacacacacacacacauacacacacaccccaaaaguuguauuguucauccauaacuacgucuugaauaacacucuaaacauagagcccuguaucaaaaagaaaaauggaaaaaauauuuuuggacaguaaucccaaauccuauauauaaucuuagcuuaugagaagacaguauaacaguauuaaagguacaaauuaaauguggggaaauuucuucaaauaacuauauuuaaagucaaauaaaaccauuuccuccuauagaauggaucaagagaauucacgaaacauuaugcaacuagaaacuguaaaacucugucacagaaauauauucuugggagacacaaacuaaaacauauuaaaaucuucccuuuuauaaaaaagaaguuaacaaauaaccauuuuuauaaaagacaagauacuggguaaugaagagaaauacuauacacaacauguaugaucagacaaccaugaugacuggacgugauaacaugcuaucccaaguggcucaccaauuuccauuccuguccugucuuugcuccuuuucccacugaauuacagaaacaugaaauuuaucuuaucacuggucuuuccugauaacuuuucuaaagcauucacagaaugcuuuauucauagaaauugugcucagcacaauccaguguggugggcuggagguaacaggcaguccugacaaguaggugugcugguggcagauuuuacagaguugcaaaagcaccaggcacauuuucaaggcccuuuuaucagccaggccaauuuccccacgugaugcauuaguuaccaguuuaauccaauacaugugaaaugcauuagagcugagggucuauuguuccuagucgagcaagagcagucagcagucagcagccagcagcaggagcaacugccuccauggccaccuggguugaagaaguaagcagaucagacccaaagggguggacuucauaagagagcaccacugagacucucguaggucacuuuuaugcugccaguuggcagacuggcauacaaaguaagaaaauuccaucgugcacagauacacacguuuuguaguaaauugcuacacuucugaggcauucacucccaagcacacauuucagcagucaaucuugucaccauaaacaaaucccuuauaaccuagaaacuaugcaaaguacuuuggauagaacgguuucuaaacagguuucuuagaggauuucuauaauguacaacugacuuuaaaugaaaagugucauauucagaauguggccgauagaaauagaucccauuuggaagcaacuagcauacaaagcacaaauaagaauuugggaauaacagacaguuggcuuuacagagagguauacacuuuccauaacaguuuuuuacauuaaggguucucaagugcuuugaagcauuaauugauuccauucucccaacagcccccgaaaaacacuuggucaaauuuagguucauaauuucaaacacauccuaagaggcagcuaaaaaugaguuucucaguccuucugcuuaagaagaaauauauaguauggagacaagguacuacagugauuaagaauucagauucuggauccagacugccuggguuugaauuucaacuuugguacuuaccagcuguguuauauuggggaagucauuugucccaucuguaagacgggaauauuaacagcauguacaucacagggccacugugagaacugacauaauguauguaaaguacuuagcgaguucccagcacacagcaaguacucaaguuuagcuaugcuguuguugguguugccaucaccacgaccacguucaccaccacugucuucaccaucaucauuaccaccaccaccaagaccaccaucauuucagaacagagcuuagguucugaagccagacuuggcuuuuaacucaguuuacaaaaccaaaccuucacaaaauaaucuaucaaaugaguaggaguaucuagcaagaauaaaaauccaauuuuuuucaacaaauaaauagcaagagagagagaaaaccacuguuucugaaaacagacucaaccaauuacaaugcacagcccucuuuuauauucugauucaaacuauuaaaaauacauaaccauuuaucacacuuaugaaacaacauggaauguuaaaauugacuggauaagccagguauggcggaaugcaccugaagucucauauacuugggaggccaaaacaagaagauugcuugagcccaggauuucaagucuguaguaugcuacgauugugccugugaauagucacuguacucuagccugagcaacauagugagaaccaaucuccuuuaaaaaauugauuugauauuugauaauauuauaggaauuauuaaacguuccacuagauaauaggauuaugguuuuuuaaaaaauaaaaaaaaggcuaaucuaaguucaauaucauaaucacuacccacaugaggcuaucuaaacuuuaauuaaacaagaguaaaaauuuagguccacagucucacuagucauauuucaaguacucaacaucuacauguggcucaaguccuguccuuacagaaaauucuguaggacaucccugggcuagaaauacacacuuacuagaacauuaauuuacaaugaccaggauuugcuucaaaauaaaauaggaaugagagaagcagauggagauguggaugaggcaagacugguuuauaguguuuguuguacauggggguucacugaccaacucugauaacaguuuuaagugaacuugguuaggcuaugcuccucaguuauucaaucaaacacuaaguguuucugugaagauacuauguaggugugauugaagucuauaagcuguuuacgagauuauccuagacaauuugggugggucagauucaauccauuacaaggccugaagggcagaauugaggcuucugggagaagaaauucugccuguguccgcagcucaacuccuguccaggagucccaggcugcccucccgaggugcugcccuauggaagucagacucacuggcaagcccacacaaucacagaagccaaggacuuacaaugaaacugaauauauagcaccuacugguucucuuucucugguagaaguagacuguacaguacagaaagagacuggagugcuugacuuuuauuuaagaaugucuauuuuacaaagccacugugacaaacaacuauaaauaucuuaacauagugccugccacauaagaagucucaauaaaugguaacuauauuauuuccucauuuauaccaauauaaucuuauuuugccaaaauuuacaauuccugagacacaaggcacucacauauuauaaugacuugguauuacucuuuucauuucaaucuugccuaucuggcacagccugaccacaggcucccuuuggggcauggcugaaauggcccacagcauguccagaguuggcccccaagcauagauucucgaauuaaaacugaguugaaucaaauuaaauugacacauacacaaaaaauccacaacugagaaaaaaguuuuaugcaauuacauuuguaagucuucaaccuaaauaugaaauaauagggaacugacuauauaaaauuguaguaaauauggauaauagauauacaguggcuguuacauaccauguuugaacacauauuuaaugacacuuagauaugcugaagauauguuaauuuuuuaaaguaggcugcaguauucuguaagaucucuuuaaaaaaaaagauacauuagacuagaaggaaauauacaaaaauguuaaccaugguugucccuggguacugagauuguagaauaauuuuuuauuacuggauugcaauauauuauuuauacaaugaaauguacaaaucuuaagaauacaguuuggugaguuucaauucaccaucaccacagaauguuaccuaaugcccuuuuacagggagggcauguguguguacguguguguguuuaugugugcacacgcaugcaguguuguaggaugugcacaaugcuacaggaugcauauauauauauacauauauauauauacacacacacacacacacacacacacacacacacacacacacgcacacauaaagccccagcaaccugggaugauuuuuauuuucuuguuauacuacuacauuuuccaaauuuuccaauauaaacaccuauguauuuuauaauuuagguaguuuugauauuuuuuaauuuuuaaaauagugaguugaaaugggauauaguuaauugauuucacugacaaggacaaggcagaucaaugcauuaauguaauagucuuagauuacuagaaagacuaagaacaagacuguuagccacacacuccacaauuauuuuugcuguuuccaagacugccaucguuuugggaugccacaucauuuauucacaaagauauaaccauauguuguaauuccaugaaacacaccugguagaaaaaaauucuuuaaaguuagguacauugcauuuuuuuuuuuuuuuuuuuuuuuuuuugagaaggagucucgcucugucgucuaggcuggagugcaguggugugaucucggcucacugcaaccuccgccucccggguucaagcgauucuccugccucagccuccuguagcugcgauuacaggcaugcaccaccacaccuggcuaauuuuuguauuuuuaguagagaugggguuucaccauguuggucaggauggucucaaacuccugacuuugugauccacccaccuuagccuuccaaagugcugggauuacaggcaugagccacugcgcccagccuguaugcucuuaccuaacaaaagaaaccaaaagugaaagaacuaauaaaaugccuagagguuacaaaaaacugacagaagucaaacuuugaguauagaucauucugguucucaccaaaaacguuagccccaguaguucauaaacagaaacauggcaaccauagaccacacugcagaaauguacaagacuaucaacccuuuguaauguuguuuuauagucauaaccuaaaauaacuaaaacuaggcuucaguaaaacagaauuugcauuucauuauuuccuuauuucagcagucaauacaaguuuuagccacagaaauccccucaagcuuuuugggcaauggcuuugaaagaggugcugcaugucuacaugguuucuuaaguccccagugcucauuacagcuuucugaacacccaggagaaggaucugggaguaggcgcccaauauuuagcauuuugacaguuagaguccaaacagccagcuguauaucugacccuaaaagccaauaaaccaacuguguccugaaccacaacagugcucagugugcuaagaucuacacaaaauucugugaggaaacagcaaaugucaaagcaucugaaagcuauaagcaguaucagcuaaccacaaaagugggcuacaauaaccaauggauggaugcacgcacacacacaugcacacacaugcauuuucagaaugugauccauuaggggauccaugaggucaaaacuaugcuuguaauaauaccaagaaguuaugugccuguuucacuguguugacauuugcacugaugguggaaagcaaugguaguuaaaaagauaaggaaaaugcaguagaauuagguugaauuuuaaauaacugaggaacaugcuggcaauuccccaguguugaucauucauaucugcucacuaaaaugcagaacuuaggcuagugcucacauuuuaauuacagguuuuuucacucccccacaauuccauauacuaugggcaugacuuuccaagcaucucagagccacaacauggacucaccuaagaacacacgguugcugaguuuguaugaaaacuugcuuuuagauguucaugcagcuuuuaauuauucacccgguaacagaauucucuucuuccucccuuucacugucugagcuuugggcuucccuuuagaacauaauugaauauuuguggaauacagcagugagaaagaaugugaacuaguggaaaauuagagaaaaguuuaagucaagcaccugagcagccacaguaaaggggcauccccugugucuuccagcacucuaaagacaaagcuucagcauuaccacucuccgguccagcuacccagccacaggggcccugucucgaccccuccaauacacccaaccuauugcucacugccagauccauccucccaggacccaauccucacauccuuccucuacgggaaaccuucaaaggcucccuacugcuuaccauaucugcacuguuuagguuagcauuugagcuucucuacuauguggcucaauuccucagucuauguuuaucuccaaccugccuccacuccagucaaacucaaaugcucaagauaagccaacaugugcccuaccuauuacacuuuucucuaugucacucccuccaccugaauugccuauccucacucuauagucucugccaguugaaguccguacccagcuuucaaaguccuccucaagucuucuccuucaugaaaccaucugcgacaccuccaccuuuguccauuuaccacaucaugccuguauuaaaguuaugcaguauauaugauuuuuccuaguagccuauaaaccucucaaaagccauggcuuuuuauuucuuuguaucuccaagaacacaguccucaaauuucuaaauaaucauuuucagauaugauaaauaauaacguagccaaaaccuacuuuaugggaagccauuuuguuagaaaguucgauuuuaaaacacaguaauucugaauguuucuaguugcagacaaaaccuaaagcaucugggaaguccccugaaucacacugcaggggaaggggaaacucacauagggaagcaggugggggaggggugagcucacggcaaaucugcaaaguaaggcacuucagggugaggaaugugaucagacacuaaugaaguauucagguguuuuauggagagagaaaacgaaccucaacaguaaacucccaaauaucuguuagggauuccauauguccacucagaaccacauaugugcaaaucaaaacuguguuucaaggaauucccaaacaagcuauuuauuuauuccuuguacaaaaucucacuagagcccaucccauucaauacuguuacuacgcacaauguugacaccaaauacuaggcuugaugcugaggaguuucaaaugaagaagacaugacuaagacaggguucaaaucaucaagggcucuggggagacaauguacagagaauucugggaaauaacuggaaguaaaaaggagaaugcagagcacagacugucauggacccaacagagaggaaacucccaggaaaguaggaguagccacaacuucaaaugacaccgcagaggacaaaucuggcaucggaagguuggugaugacacagaggggacaguuucaguagacuggcaggugugagugccagacagaaaacaguuuaaaaauguugaagucugucaaaaugggaaaagggggaauaaggacaucauuuuacagguaugcagaggucaagaaaguauacuuuuuuuuuuaggauaggagacuugagcaaaguccccugguacaggaagacagggcucagauaaccaacuggagaagugaaccuuggaaagaggcagggccucugcacugagacaagggcaagaauagaggugaagggaaggaggugcaaagaguuugugcagcauugccuguagaucauuugcugagaccgaggaggagugggaagaccaggauaccagggagcuuaaaagccuauaacagcugcuauagggacaaacagagagcugccuaagaaugagugagaguacugccaugcagauuugaguuucggaaugagacugaaaaauuaugcugacacuguuagaugauuuucuuuagcaguaaugagaucaaagaagcagagaauguaaauggauucacauucagcacaagagacgcccaccauggguguggugagaaaaagaaagacacugaaggagauguccagaacaacaugggguccaaaauggcauggaaaagauaaaugaaaccuagaggaagcugauagugggaaaacaggcagagagggugacauuuacggacaggacagaaaguucuggucaaagaggaaugaugaguuaaaaaaucuugcaaagcaaaacaaguuccaggugaugacauggcccaaaguuaggccaugugaacaaacugcuauaaaaaguaguggcaaagaucauaggggcgaagacgacgacagugugaaggaugggagacagcaugguguagaacagcauugcccaaccgaacuguugccaugacagaaauauucuguaauaugcaguccaauagagcagccgcuagccacacaugucuacagaguacuugaaaagugucagguaugacugagggacucaaucuuuauauauuuuguuuaauuuuaauucauuuguuuaaauacgcauauguggcuagaagcuaccaugcuaaauaguacagauguagaacaaugguucucaacuuuaacugcacaauggaauuaccucagaaggcuuaaaaaauacagcuaaggucucacuccccagaaauccugacuuuaauuaguugggcauguccuaggcacaagcaucuuuuuuugauacauaauagcuguacacauguaugggggacaugugcuauuuugcaacaugcauaaaauguguaaugaucaagucaagguauuuaggauauucaucaccucgaggauuuaucauuucuguucugaauauuacaacucaucucuucuagcuauuuugaaauauacagcacaauuguuaacuaaagucacccuacuaugcuauugaacauuagaaguuacuccuuccauccaacugcauguuuguacccauuaaccuaucucucuucauucccugcaagcuccaaauacaccauacugggccuccaguaucuaacauucuacucucuacuuucaugagaccaacuuuuuuagcucccacaugagucagaacaugugguaucuuucugugccugacuuacuucacucagugaccuccagcuccauccaugaugcugcaauugacaggauuucauucuuuuuuauagcugaauaguauucuauuguuuauacauaccacauuuucucuauccauucauccauuaguggacacuuaggaugauucucuaucuuugcuauugugacuaauucagcgcugcaauaaacagagagauacacauauccuucugguauacugaucgccuuucuuuuggauaaauauccaguagugggacugcuagaucauaugguaguucuauuuuuagucacuugagaaaucuccaaggaagagaaaaaucuccaaggaacuagaaaaacaagaacaaacgaaacccaaaaugagucaaaggaaagauauaauaaagaucagagcagaaauaaaugaaauugagacuagaaaauacaaggagcaauaaaaugagaaguugguuuuuuaaaaagguaaacaaaaucaauaaacugcuagcuaagccaaccaagaaauaauaugcaaauaaaaucagaaacagaaaaggagacauuacaacugauagcacagaaauacaaagaucaucagagacuauuaugaacaauaauaagcuaacaaacuggaaaaccuagaggaacuggauaaauuccuggacacguacaaccccccaagacugacguacgaagaaauaagaacuugaacagacuaauaacaaguaaugagauuagaucagaaauaaaaaaucuuccaacaaagaaaagcccaggccuggaugguuuuacugccaaauucuaauaagcuuaugaagaacaacuaacaccaauucuaaaacuauuucaaaaaccugaagaggagggaauucuuccuaacucagucuaugaagccagcauuacgcugaugccaaaaccagacaaggacccagcaacaaaaagagagagacagagagagacagagagagagaaaaacuguaggccuauaucccugaugaacauaggugugaaaaucccgaacaaaagacuaaaaauccaaauccagcaacauaucaaaaaaauaacaugucaugaucaacuggggggauuucuccuaggcaugcaaggaugagucaauaaacgcaaaucaauaaaugugauacguuccaucaacagaaugaaagaaaagaaccauaagaucaucuugguagaugcagagaaagcauuugauaaaauguaacauucuuuuaugauaaaaacucucaacaaacuaggcauagaagaaagacaccucaacauaauaacggccauguaugacagacccacagcuaacaucauacugaauggggaaaagcugaaagcuaucuuuuuaaaaaaaacacuuucucauuucauugguccuuguauuuucuagucucaauuucauuuacuucugcucugaucuuucuuuccuucgacucauuuuggguucgguuuguucuugcuuuucuaguuccuugaaauacaucauuagguuauaugaaauauuucuacuuuuuugaugcggguguuuauugcuauaagcuucccucuuagcacugcuuuugcuguacccauagguuuugguaugucaaguuugaagaacuuuuuaaauuuccuucuuaauuuccccacugacccaauggucacucaggagcauguucuucaauuuccauguauuuguagcauuuccaaagcuccucauguuauugauuucuggcuuuauuccauuguggucuaagaagauauaugauauaauugcauuuuuuaaaaaauuuguugggacuucuuuuguucaggauagacuauaugugaagccacaaaagaaucagucuauaucuuaaguggaauauucaaucuguuuauauucaagguuauuauuaaugugugagaauuuauuccuguuguuuuguuguuuuccguuuuguuuaucuuucauuccuuucuuccuuucuuauuauuaucacaguuuggugguuuucuguagugguagcagcuguaguuguaguuguuaaauccuuuguauuguugauguguguuauaucucaccaaccuucuucaauaucacuacauugaauacucuuuaaagcauuucauagauuuucauaggaaucuguuguggagaauucuucuguuccuuuggagggguccuguuuccuugcuuuuccauguuaauuguauucuuauguugacaucugcacaccuacaguaacagcuucuucuuccaauucuuuggauuggcuuucauagggaaggcuuuuuuccuacagauguaucuauaguguugguuagguaagguauuauacuuuggcuuugauucuggauacauacagcaguguagugcccauauguuuacuucagcaguaaucagcagcaguaaugucugauuccucaguggcuuaggcuguuauuagugaagacuaugguaaggccuugcuggggacaaggacaccagcuagaccaguccucaggccucagcaguggcagcagugaaccaagcaugccuguuggcaugcuugaaccaagcagugaaccaagcaugucuuuggacaccuggguggcauaugcaggcacuaguguuaguggguccaagcaagcugauucuugggccuccaggcaacuugcuugggugccggcaguggcgggcugagcaggcccucagggcacugggcagcgugcaugacauggacaauggaagcaguggugguagaacaacacuuggcuuccagacagcaugugcugagguuaguggugguggugaugagcugagcaggccaguccccaggcagcacagguagguggguagcguugguggggguggggaugguaggcucggugggcccauuuucagaccugugggagguguguacaaaucccagcagugguacacauggcaggguuauccccagguuuccaagagguauaauuaggcaacagagaggucuguuucagguggggcaggccugucuucaggcccugauaguuugcauggguauaggcugugguggguggaguggggaauccuuggguccccaaacagcacacuugggugcuagcagcagacaggcuggaucuuuugugaggcauccugauggugcacacacaugccuaggacaacagaugggacaaggcaaucccgaggccccugcauaguuguguuugggcacucggagagguggcaccagguaaugcaggccuguucucaggagcccccagugauguacacggcagcaggcugugggcaucagcauuuuuuaaaguuuccagacacaggcaacuuugaaaaccauauauguaguaaagagcauggacucugaaaccagaugaguucaaaaccuagacuugauuuugaguugucugacuuugagcaaauaaccucaucugcaaaacaaagauaguaagaguacuaaccccacaggggcuauucugagcauugauguguauacaaaggugcuuuauaauagugccuggcacauaagaacucauuauacguuccucaucauuauuccaaauggauguuggagaguugcuaaggcuuaugacagcuacaggggaaaacaauggguaugacucgccaaaggccuaaaucuauguugaggugggagcuagaagucaaaaauuaacaaaguugaguguauggacaaaguaaaauaaugcaauaaguaauaaagggaaaauaaacaaccuggaacagauagugauaagacaagaaaauauagacucagcucuccggcaacacugcagauaggcauagaaaaaugagggaagcucugugguaaggagaaagucaaaauuuaguuagauaaggaaggguguggaggaaucauuacuucaguuuuauacaacccccaccuuaccucgcuuccaaaauuuaacauaaguuaucagucgaguaauguuuuucuguguuuccccaugccaucuagcuccccauuuacaaacaccauccagaaaagauuuuucaugaaugaaaauagcauuuuugaaucuggauuccacaguaauagucauuucuccacagauuaacaguauauacuuuaugauucacaauugaucuaguucaaaccuggcuuaauugauguuguagucuuugcaaaccauaugccaagacucuacuagaaaaccuauuuaauuugcauuuuaacuacaucuuuuauuagucucagagagcauuaauagcauuaauaaugacaguaugcuacauuuauguguaacucuggaaagaaguauuuuaucugauuuuuuuuaaaguugccaaaauaaacaaaaggaggaagggggaaaaaaauugaaauaggaccagaaaaaggcaggaggaaugaaaaucugaccaacaaaugccuuagguugcaguuuuguuguuucucuaaaauuucacauaaagacaugaacacagauuuauacucaaauuucauuugucacuaccaaauauaaucuauuucauuaacuugcaaaauaaaauacaugauaaaguauucucacuuacuuggaacuuguaaaccacuagaaaccgaaagcuauuucaaagauaguuucuaugcaacuaaaaugguugaaauuaagcaaugcagugcaugcagaucaaggguuucagaugaauccacuaucuucagauuuuuaccaaaauaauuuuuuaaauuaaguaugaaauuucuucacagacuaaagauccuucucaugagaaaaagaaacaccuauaaccuccuuuccacaaacauguuucacacuucaaaaugagguuucacaggcuucuggagcgcuaaauguguuuaucuaucagcacaaguugaguuucacaguuggaacacaauuuccaauaugaugaguucauuucugguuccucauuagaagugagguuugagaccacuaagaauguggaaaacaauacucuuccgaacccucucccgauacaaccacaaacucugcaggaacuauguuuugccgaagaacaccacccauggagaauuccacuccuucaccucuucucccucagugaucccccagggaugcucuucuuagagauauacugagagaucuuagaacuggaaacaaagccauaacaaauacacauucuauuugcuuuuacugccucagagaauccuuacuuuucuacuuuuaaaaagguugaguuucacuagauccuagggaucuaaaaugccucuaucagucaaaguaaaguuuacuguguucaagugauucaugaagcuuuggccucucgcaucucauggauccaguaaguccacgaaccccucuuaugguuauuuugcaguuuuugaauguauuauugcaguaaauacacuccacuuggguagcuggauuauguuacuugacugauuacuugagagauaacuuauguuaaauuuuggaagggggguaagguggggauuguauaaaacuuaauacuccacuugacaguaaacguacuccacauuguggguagaagucccacaauggcucccugacgauggaauaugggcuauuacaacagauaggaaugaccaacuggaagacugaacuuccccucccuaccacaacagaaaaccaaaauaaauacugcauccaugggagaacuguagagguuaauacuaucaucaaaaacuugauacuuaagggugguaacuccuauuacaucacugucuaacuuaccacuuuggucuaugcagaaagcagacagauuggaaagugacuggauuaacacaaacccauucagacagugacucugauguggcugauuuaccaaaugaaguaccuuuucuagagcgaaucuagccucuagcaccugauaugaagauacuaugcuagaaagugcuuuaauaauaugcaagaaacauaagaaaacaucugcuuuuauuucaaaagaucaaaaauacacuucugcauuauugcccagagcuguaacaacucuccccucugccauaaucuagucuccagagaccuuaaucaccuuaacauccuacagacucucaugugggucuauugcauugaguacacugugcugacugcaacugaugaaauggaaguaacaaaucugacagcgaucucaguaacacacaugcaagcuugauggugaaaaagaaaaaucaaaggcugcaaccucagcauuucuggggaugcaguggucuggaacauguugaaauaucaccuccaaagugacauacaaguugcugcaucuugaacugcuuacuacuaaaauaaaauagacacaauauuucacaggcugcuuuacauuuuaaagacaauauauaccagucuaagauauccugcucugacuccuugacuagguaaccuauaagauggccggugcugaguagggcccagagcgagagaugguucugcaacaaagauagacugcagcacaaacuacuaccccacucggucuugugaugcagcagauccaaucaguugaauccaacaagauccagagaaucacagcacaaaccucugagguucugaaauaaaagccauaccccuuuucuggaaauaauaauugucauuuugagaaauggcuccuagcuugcaaccaggcucuggcaaagccugauuaaacgauuucaaaugaacaugcgaccugagcugcccauaauaaucugaauguugccugacccaccaagcuauaagguugggccuuuacagaaauguucuaucaaaaggcaaugguauaaagagauugggcucaagccaauauacaaggcacaagaaauugcaagagcagaugucucagguaucucuaacaccuacuccuagcauacaaccacaccuguggcuucacaaagauuuccuuaagaccaggugccuggaaaggaaacuugggcccgguuuagagaagguuuguauaaugucugguaccaagcaaaaguggacuucuacagcaugacaucuccaauaaugagcaucccucaaaugugaaaucaucccaacagaacuguaacuaguacauuugcuuguccucuuuaccuacacugagaaauggccagaauuauggcuuuacacugaaucaugggguaaagguuaacacucaauguggauggaugguuaaggacuuggaagaaaauaguauaggaacagagcauacaagaacaucuagggaagagcuauguggauggaccacugagaaugagcaguauguaaaaauuauuuuugucccuuguaaauguacaccaaaggcauccacuacagaugggcuugucaauaaccaggugaacaaaauuacaaggcuguggagaaguuauccuuuuucaucagucacaccggucuuccucaauaguccaagaacaagugaccaugguggaaagaguggaggcuacauacggacucagcaaaggacuucuucucaugaacgcugaccuggccuuugccaacaaugagugccugaucucccaacagcagaagccaauccucaguccaagauggcaacauuccccuggaagaucagacagccacuuggcagcagauugauuauauuggauccuuuccaucaagggagagguaaugauuuguccuuacuguauauguccagcugugaacuuacacacauauauuacacauacacacaugaauuuauuuuuuacucucuuacuccauguuuuucagggauugguuauggugguuaacuuuauaauuuaguuucuauguuacagauuaguccuauagaacucuggauaaacuggaaaagauaauuucacaaagacuguaacugucaaccagaaaagaauuucuuaaucuaagauccugauacguacccaugguugauuauuaggaaaucuagaauccccuugcaaucacagaaaaaggaucacccaucaggacagcaaaaguuuaacagcuggaugauacugaguaauggcaaggaugcagagcaacuagaauucucacagauuguuagcuggaguagaaacugguauauccacuuuaaaaaauagcugucaguaccuucuaaagcuaaacauacaccuacccuaugauauagcaauuccacuucuagguauacacacaaaagaaaugagugcauauauccagcaaaagauauauacaagaauguucagggcagcuuuauuugugauagcuaaauacuguccacugacaguagaauggauaaauuauaguauauucacaaaaugaauuaccaaacaaaaguuaaagaaaaaaagaacuucugccacagacaauaacauaaaagaaucacaaacuucaaugcuaggugaaagaaaacagacacaaaaauauauauauuguauuauuccuuuuauacaaugucaaaauaggcaaaauuagccuaaagggcuaaaauucagaagaguaauuuaccucuggguagguacuguuugaaaagggacccaagggaacuuccuggaguacugaaaauauccuaccucuugaucuggaugguguuuacacaacuauaucuauauguaaaaacucauucagcuauguauuuaagauuuguauacuuuauauucuacuucaauaaaacuguuccugaaagauauuauguauauguacacaugucuuagaagagaauccagggguguguuuucuuucccaauuucucuaauaggucugugauccaacaaagguaaagaacacaaauaagaaauucacuaaauuuucaguugagugcuugcuuuccaacugagagaaacugccuagccagaggcacccaauuauccaauauauagcugauuucaaaagcuuuuucuuccuaaugcucccccuaagguuaauaugguuggaauaacaacuguugauugaguuuagaauaugaaaaaacucacuuccugcuucagauucaaggauacauagaagaaauauccuugaaagucuucuuuuuuuuuuuuuugagacggagucuugcucugucgcccaggcuagagugcaguggcgcgaucucagcucacugccagcuccgccucccggguucacaccauucuccugccucagccucccgaguagcugggacuacaggcgccugccaccacgcccagcuaauuuuuuguauuuuuaguagagacgggguuucaccguguuagccaggauggucuccaucuccugaccucgugauccacccgccuuggccucccaaagugcugggauuacaggcgugagccacugugcccagccaaaagucuugaugaguuuauuuuaaagguaaguuaucuauuacuuuauucugaauaauuaugauacagcauuuucacuuuccaucucaacauacauguugcaaaacaaaauuuucaucagaacucuauaauuacugacguguaugugcuuuuuucauuuuaaaaaauauuuuauccaggcuaacagauucaacggaaauccaauaauuuguaaaaguaacuaucaggccaagcaugguggcucaugccuguaaccccagcuacagauucaauaggaauccaacaauuuguaaaaguaauuaucaggccaggcaccauagcucacgccugucccagcacuuugggaggccgaggcaggaggaucacuugaguccaggaguuugagaccagccugggcaacacagcaagacccugucucuacaaauaauaaacugacccucgacccucuccccucuccccuuugcacggucucccucugaugcugagcccaggcuggacuguacugccgccaucucggcucaccgcaaccucccugccugauucuccugccucagccugcccagugccugggauugcaggcgcgcaccgccacgccugacugguuuuuguauuuuuugguggagacgggguuucgccauguuggccgggcuggucuccagcuccugaccgcgagugaucugccagccucggccucccgaggugccgggauugcagacggagucucgcucacucagugcucaauguugcccaggcuggagugcaguggcgugaucucggcucgcuacaaccuccaccucccagccgccugccuuggccucccaaagugccgagaaugcagccucugcccggcugccaccccgucuaagaagugaggagcaucucugcccggcugcccagucugggaagugaggagcgccucuucccggucgucaucccgucuaggaagugaagagcgucucugcccggccgcccaucuucugggauguggggagcgccucugccccgccacuccgucugggaugugaggagcgccucugcccugccucgacccagucugggaaaugaggagugucucugccccgccgccacuccgucugggaggugaggagcgucucugaccggccgccccgucugagaagugaggagccccuccgcccggcagccgcccugucugagagguguacccaacagcucauugagaacgggccaugaugacgauggcgguuuugucaaauagaaaggggggaaguguggggaaaagaaagagagaucggauuguuacugugucuguguggaaagaaguagacauaggagacuccauuuuguucuguacuaagaaaaauucuucugccuugggaugcuguuaaucuaugaccuuucccccaaccccgugcucucugaaacaugugcuguguccacuaaggguuaaauggauuaagggcggugcaagaugugcuuuguuaaacagaugcuugaaggcagcaugcucguuaagagucaucaccacucccuaaucucaaguacccagggacacaaacacugcagaaggcggcagggcccucugccuaggaaaaccagagaccuuuguucacauguuuaucugcugaccuucccuccacuauuguccuaugacccugccaaaucccccucuccgagaaacacccaagaaugaucaauaaauacuuaaaaaaaaaaaaaaagaauaaaaagaaaaagggauaucauuuaaacacaguauguagaaaagaauaauuauugaaucuguacuggucuuuaacuuuuacacuuugaucuuuaauucuguuauugugauugaguccaaagaaaaauaguagaaguaaaauaaaaagaacaccaaaaaugcuaaaaaaaaauaauaauaauaauaauaauaauaaacugacugggugugguggugugcaccuguggucacauuuacucgggaggcugaggcaggaggaucaacugagccugggaggcagcaguugcagugagccaugaucaugccacugccuucagccuggucaacagagcaagacccugucucaaauaaauaaaaauuaaaaguaauuaucagagaaaauaagagaaucuaauucuaaaaagucuuauguuagccuuuuuccuuccuucuugauaaaccaagccauugauauaagcuauuuuaaauucuuggucuuguuggcaauaccaaccaaagggcuagucuaccauuagacaaaggaucccauuuuaaguauguaacacaaucauagcauuaauuuuauuuaguuuucagagacaggaucucauucugucacccaggcuggagugcagugguacaaguacaaccauagcucacagcagccuugaauuccuggccucaagcaauccuuccaccuuaagccuggcaacugguugggacuacaggcucaugccaccaugcccagcuuagagcauuaauguuuuuuuuuuuuuuuugagauggagucucacccugucacccaggcugcagugcaguggcaccaucucggcucacugcaaccuccaacucccacauucgagcgauucuccugccucagccucccgaguagcugggauuacagguaugcgcugcugcgccaagauaauuuuuguauuuuuaguagacacgggauuucaccauguugcccaggcuggucucaaacuccugaccuuaggugauccgcccaccucagccucccaaagugcugggauuacaggcacgagccaccgcacccagacuuagaacauuaauuuuaaaagucaaccaaaacauuagccucacuuuaucauuaauagcaauuccauaaaaguuaaugucaacagcacacaaaauuaaaccuugaggaacaacagauaaaagucuucugugccaaacugaaguucucuaaaguaaucauuaacaauacuuuacuguucucuuaaauacacugacauccuaaagacaaaucauuuuuuaaauaaaugcaauauaaauaauaucaagucugacgauucaucucaaaccugaucugauggcuuaugauguuuccuaaaaguagcagguagcuuuauauguauuuuuauuugauuauuauuauuuuuuuuuaaaggcaagauuucagaaaccuuuauuuuggaaaauauuuuuggucaagaaacccugcccuugaaaucuauuacuucaggaagccaauuccuaccugaguccugacuucuuacaaugcaauuggccauaucauuuccauuagccacuuucaaggcuugaaaauguccuguacacaaguuucagcuggucuagucagagcccagugugagugggacauucaggggcuaaacccugcagcaccuccuggccuaaucaaaggagguucugcagcuggguaauaagagugguaacuuuauuauagaagaauuuuauuccuuuauguuccccauauaacuuauaaaagacaaguuauuucauauuauauauuuucaauucaaacaauccugacuggugauguaagaaacaaaaaaaucaugcccaacacuuugagaggcugagguagaaggaucacuaagaccagccugaggcaaauagugagacccuugacucuacaaaaaaaaaaaaaaaaaaaucagccaggcaggauagguaucuuguuuucaccuuccaguucuuccaccucagucuguguuauaagggagaucuuugacguuuuucucaagaucaaugagaguauucauaucaucaauuuuuccaaugaucuggucagacauguucugaaacuuauuucacacauguugcaggaacaucuccaccaucaaugugagauccugcacaaucuuggggucagucucagccaccucaccaguuccagcuucauagugaugucucaaaccaucacuuaccauuugaugauucugauagcuuaaauuuuuaaauauuaaguuuacaguuuaagauuauuaaccaguuacauaacacagcugcaugcacauucagcgguuucuauuaaaacuguagguuaguguuuucccuacuucaaauacucacuuaaacacugaaaccauucaugccauauuuucauguaaguuuauagaguguagcauucaaaaaauagucaauaaugaaguuuacuuuccaaaaagcaguaaauucaguaucaacucuagaaaagguaauaaugauccugugccaauauuugcuuucauucauuuauucauucauucauucauuuauuuuuagacggagucucgcucuguugcccaggcuggagugcaguggcgcaaccucagcucacugcaaacucugccuccuggguuaagcaauucuucagccucagccucccgaguagcugggauuacaggcacccgccaucaugccaggcaauuuuuuguauuuugguagagaugggauuucaccauguuggccaggcuggucucgaacuccugaccucaggugauccaucugccuuggccucccuaagugcugggauuauagacgugaaccaccacacccagcugccaauauuuucaugcaaauauuuguuauguguaaaacauuuauugauauucacauuagaguuacaauauuuaaauuucaguuuuauugccuugaucuggaauugcugugaguauuaauuucucgccaguaauacugguauuacugccaaauuccuacaugauagacaccaugacaugagcacauuuucacuggaaguaagauaaauacuuguauucuaauggagaaacucaguggggcaagggggcuuucuuauuucaugaguguuucacucaaaagaaaaucaugcuauaguuaagcauuuuuucccuccuaucaaauuaaugucuaaaaaguuuaucugauuucuuuaaaaggcuuucucuaaauccuaacaaaacaucuaaaaacucuuuucagccuuuaagugcuuuuguguacuaaguacugcaaauaaguuuacagcacaaauauuucccaguucauaauuugaaucucuaagaagaaucucuaaauccaaccucauuucuuaaauugaacaaauacugcaaaauaaauaugcagcauaaauauuaggucuaaauguaauuuauuacauauacccuuauauucauagaaccauaugugaguauacaguauuauuugaugggguaaaauaaaucuaagauuaagauaaauauccuggaaaauuaauaaaagauaccuauuucucaguugccaagaaccuugccugucuuguuugaccgcuguguuuccaaagcuuaguucagcuucuggcauaaagcagauacuaaaucaaugcuuguugaauuaugaauauuccagacaaaaacuggggaucuuaauaggccugaauuauaaagauuauagcaucaauuuuuauuauuuuaaguguuucauuuuacagagagggucucgcuacauggcccaggcuggagugcaguggcuauucacaggcaugaucauagcauacuacagccucaaacuccuagacuguaauccucccaccucagccucuugaguagcugagucuccaggcacaccuagcuuucaugaauauuauacuucauuuuguaucucuuccucaaauacugggcauagggaaaaaguauguaaagguuuuaauaaaauauuucugauuuaauaucaacuccccuagacacuaaagacugauuuuuuuuaaaucaacuuuguuuuagaauaguuuuagacuucgagaaaaguugcagagauaauauagaguuccuauauaccuggcacccagccuccucuauuaaugucucacauuaccaugguacguuuguuacaacuaaggaaccaacacuggcacauuacgaugaagugagcuccacauuuuauucagauuucacuaguuuucuccuaacguccaagacccuagcuaggguaucauauuacauuucaucaucacauuuccuuaaccuccucagaucugugacauuuucuuacacuucccuugaguuugaugaccuugaugguuuugagaaguacuggauugagagaugccccucaauuugaguuugucuuaagauuuucuccuaaaacuugauuuagaaaacaucggauuucaaaaugaucagcgcaaggaucucugauaagacaaaguacaagguaagaauguuagccuuuaucuccccauuuauucaacaacgaaaaaagcccuaugcugggaagagaguaaacuacaaguuuaauaucaguacuacagagacucuacgcaauagaaaacuaaacuuagcagaaggacaauucaaaaggaccccagguaaagugacccagagacagacuaaggagcuaaggagcaaggcauucuugucccaggcaucacucagcagucaguucaacacagaaacuguagugacuacugccccugccaccugcaaccacagcuccacucuccucuccuuuuuuauucccaguuuuauuuguugugguauacuugcccauguuuguaaauugucucuaaucauuuuuagaaaaaaaaaaagaaagaaagaaaaguauauagucaggucccaggaggaaacagcauuaccagcaaagcaacugaggagaguuaaucuaugagguuaacuaucuacaaaggcaaaggcagacagcccaacaagagaugguggaguaccccgaggcuggcaacaacagggagcugcucccaacaccacacuuggaagagcaaggggugggagguaucaucagaauccagggagaccagugauugugaaagggccaugugauaggagccguggccucugcugagacacagcccaccugcagggaggacaccgagaaauaagcacccuaaccucacuuuuccucuugccuuccaacccugcuugugucuuccauuggcuacaaccagaggacuuaauguuguccacagaggucaauaucucaaggcacagagcagcauggguuaggauggacaauacaaccagggggacaaaugaaaggugcacugcaggaggaagggcaagccaaaccuguaccuucagcuauuugcauuuuuauauuugugugucuuauccuacuguacuaugaacuccucaaaggcagcaacagugcuuuacagagucugaggucacauacuccuaguaagcccucaaaguauaucugaaagaagacauggaacagagccaucuccgccacuggucagaacagaacuuggguccuucacaauguggcucugcugcagggacaacacacagaggacacaccuuugagccugacucuggcagagcaccagaaacaggcagaugaggcuagcccuuuccacauuaaagacagggacaaucaauacuugcuccagaacuagagagaggcuccucuuucaacagccggaccaaucucucagcucugccccuagaggaaagaguuugcaccuguagucacaggcaagaaccuaacuccuggaucaucuugcccaauacuuuguaagcuccaguacugcaccucauaucugcucuugacagauggagaauaaaauaaaaccugacauuucacuccauuucuucaaauaaguuaucuuaagagccgaugcaaccucuugucuccaagaccuuuaaugaagcacuagugcuucuguuuauacaaaugcccuaucuucccuuaucacucacugcuuacacaaaccucccugggaaauguucaaaucaucccuguggaggccucaucuccucuccuuccaggucuugaugcucuugccaucuuuauggaauuucccacuccgcaucccccaucuggcagggcuccaugaccagcuccuuccaggacagggaggugccuuccuugauuuccucccaaaccaacaccauccugggcaacacagcaagugcgucacaaauucacaaauccaacaugcugugcgcaaacgccucugcauuuaauaaaaacauccauuccuuccucuucucagaaagacaaugaaaauaugaaagguugaagaaucacaggaaugacauuugcauuucauuaugauugugcugucaauaaaguccucaguaccuggcugaacaaacugaacucaguacccggcugaacaaacugaauugccugcuccacgaaauaaagaccaccaaauacuauaacccaaaauugaaucuuugcagugcuguggcaacgagcuacuauguuuaccuuaccaggaagaugaagcaaaugauuuaauauuuuuauaaaaagaaggugaucaacaauuguacugaccuuaucaaaauggguuuguacagagacuacuugagggaaaaauaacuuauaaagcuuacaauacaaaauaaucgaaaugcagcaaaggaaacacauuuucucguagcuuuuaagucuuuuauuauauuauuacucaacuuauuaucuuuaaagauaugggaaguaacacuugaaaacagauugccuucuaaugcaaagucuucauauuuaccucaucucuuugccccuuacuuguaaaauauucccucauccccuugcacuugagagcacgaauuaucuugucugaggccauucuuuccaccguaugugugacgccacucccucccaccucuucugauaccuaccccaucuguuguccccucuccccuauugccaccuuggucccauuagcuugcccuuucauacuagacaauauauaccuuagucacucaaauccuuuuaaaaauaaaagccuccaggucccuauauaagucuuuccagcuaccacccacugcuucccuccucauuugagacucuugguguuccagccucucugcaucucuaauuccagacgccuccuuuccuugagcccaggcccaaaaccacuguucuacugcaccugcucucccaaagcccaccacuuucuuggagcugccacauccacuagauacauuucagccugugucuuaguggaugccucugcugcaucuggcaucauugaccuguccuccccacaacuauuagaugcuauuugcuuuucugguucuucuggagcucucucaccuuuccugcucacucuccuuucuucauuuuuuucugcccacuccuucaaugcugcugucccuaaugguucuaucuuuuguuacagucuuugucuuucacucugccuucucacuccucugucuccaauucucguccacucccacaacccuccagcccccguucucauacucuccaugcucuccuuggagcagaaaguuguaucuccuuccacgguucuaacucuuaccuuucacuaagggauccaaagucuucucuccagcuauagauauuauauuuagauggcuguuugguuuccauaguauuaucggcucaacacaaaggucccuuagccaccacaagucucuugagccagcaaccugaagucauccuuaacucaucccccuuucucauuuccaacauccagucauuaccaaaccuuacaaguuuuaccuccuaaaugcuuuugacaucauucccuuccuuuccacaccaacuuccccuguaccaguucaauuucuuauuaucucuuguguggaccacagcagucuccuaacacagcuuccugccucuaguuuaagcccacucauuucacuucccugacgcaauccagcaagaucuauugaaaauacaaaugucuuuaucacuagccuaguuaaacccuuaaaaagaucuuucauuaauugugcauacagcauguaaaaauucuucccuuccaggucccaucuacuuauccuaucuuauaugcuauguauucuauucuuggucuucacucucucaauuaccacuuauuuacaauaauggaaaccaugcacuaugcugguuauuuuuuuaauugacuuauugaauauuuauaaaacucuuaagauaguuguuuuaucuccauuguauaacugcagaaauggugagaauuuaccagguugccacuaggaagcaggaggaacuuggugagggaggugguguagcuuaccaccugggagccccuaccuuccugggugauacaagaugacagcugaacacaguccccuuggcacuacuucagacuggaacaaaagccacugacauauggagaaggcucacuggccuccacacucugcauucacucagaugagcacuccaaggcaccaaccugcuucuggugcuucccaccucugagguguaggucugaagaacuguuuccaccuuuauggaaauccucugcucccgauuuuauccacuuguuucuauacacaacuggcaacuuuucugucuuccaaaaaguacucaguugguuuuugguuugagacagggucuuacuuugucacccgggcuaaacugcaguggcacaaacacagcucacugcagccucagccucccgggcacaagcaaucuucuugucucagccuccugaguaacugggauaacagguacacaccaccaagccugucuaauuuuuuuuuuuuuuuuuuuacauuuuguaaagacagggucuugccauguugcccaggcuggucucaaacuccuggacuccaguaauccuccuaccuuagccucccgaaguguugggauuacaggugugagccaccacauaugaccaaauuacucacuuuuaaucucucgaugguauucuauaucuuucuugaauuuuaaagaaauuuuucuuuaaaaauauuuuuccugucauuuugauuuuugauagcauuuuaagcauaugaugguaauguguccaguuuacaauauuuacaaaacacccuccuaaucaaauuagacauuuugauugaugauaaccaauccagucaucaacuucaucuauauuaaauaaaaauauacauggauuuuuagaaaaguucgauuuuccaguuacaaacccucaacuuaaaaguaaguaacgaggccggacacgguggcucaugccuguauucccagcacuuugggaggcugaggcgggcagaucaccugaggucaggaguucgaggccaaccuggccaacacggcaaaacccugucucuacuaaaaauacaaaaauuagccaggcaugguggcacaugccuguagucccagcuacucaggagccuguagucccagcuacucaggaggcugaggcacaauaaucacuugaacccaggagguggagguugcaguaagcugagacugcaccacugcacuccagccugggugacagaaugagacucugucucaaaaaaguaaguaaaucaugcuaccaaaguuuguaagcuguuguuuagaacauggaaauaaccucacucauucgugcaauaccuucuaugcacuaagcacuauuuuaggugguggagagacuguagaaauaaaagacaagcuucccauauuauauaauuucuguaauuuaauuuaggaaaacugugguauaaacaauacauauuauguguguauacccuuguguguguauuuacauuucagaacuuaucaacgcccuagcagcuguuagcuagcauuucuacuacuguuaucaggagcccacauuccugcuuagcguuuuaaauaucauuauuuacaaauacaaaagauguguuaguuagcaaaggagcuauuagaaauaauuuucauuugugaaaugaguguucuccaagacaucugguugguuaaaauacuggacaggccccaccaucucugcaaaaacaagaccaaaacaucugguagcaccaaaaaucuaaagcugcagugcaguacuuaagauauggaaucccuuggccccacuucccuccguuccucagaggacucaguugccugccuugagccacaucuggcuggucuugcugucaggacaucauuauuguaacugcauuggaggaacccauucaugcaacucccagucagaauguccaaggacaaacaguuugacuuguccaaaguggcaagacugucuguggcucuuuacugcuccugcuugcuaaaagaugacuauaaacguggcagaauucagacuagaaauugcucucauuguuuauuuaccagcugggagcaaaagacuauaaaggaaaggaugaagaacacucaccucuuucuaaauucuggaagcuaccaaaauugaacaaaagaacucaacaaugcuacaaggccagauuggguuaagucagucugcaacacugcccucaugaacauuauauucuaguagaggagauggacaauacagggugugguggcaugcaucuguagucccagcuacucagcaggcuaaaauaguaggauggcuugagcccaggaguuuaagaccagccuaggcaacaaagcaagacccuacuucugaauguuuuuuuaaaaaagacaauaaagaaguaaacacauaucaacagugauaaguauuaggaaguguauuagucuguucucaugcugcuaugaagaaauacccaugacuggguaauuuacaaagaaaagagauuuaauuugcucacaauucugcauggcuaggaagcccucaggaaacuuacaaucauggcagaaggcaucuuuucacacggugaaaggauagagaaugagagccagcaggggaaaugccagaugcuuauaaaaccaucagauuucaugaaaacucacucauuaucaugagaacagcauagggaaaaccgcccccaugauccaaucaccuccaccuggucccacccuugacauggggauuauuacaauucaaggugagauuuggguggggacagagagccaaaacaaaucaggaaggaaauaagcaaacuguuacggaaggcucugucugagaagauagcugaacugagagcacuaaucauaagagaaggagaaucuuccagacacagguacaaagaccugaaggcaggaaaguauaggauacauuucagaaaugaaagaccuaagugacugaggaugguggguggaggggaaagugguccaaaguaacaguggaaagaggagaaagaaccagauaauaccuuacaggucugucuugauagguggcaguaaggaguucagauuuuauucacaguguaauggaagccacugaagaauuuuaagaaccugacucacuaugguuacuauacagagaaaugaacuguaauggucaaggaaauagaggaaacagauaggagauuguuacagcaauucaggcaagagaugauggugccugacuaaaggguggaagcagagauagagagggguagacagauauuuugaaaguaaaagugacaggguucagcagcucucaauuacuuaacccuuaaaauacgugacauaugacacuaauaguuccauauauucuuuuuaagagcaaucgcuauuuagcaaccaggaauaacucugucuauucuuaaaaauguauucagauauaaacucagggcccaggaauacagauccccacacugcagacugagcaggaacuccugcucuauccaccugcucaauaaaggaaggcaagugaggaugcucccauuucuaaucuccuggcuguggcucugcuggccuggggcaagccuuaugaaggucaccaacagugagggaugggacaagaccccagaaggguuaagagcugacagaaccggaaguugcuacaauguucccuucaggccaguccccugucaacaugguucuucuuuucuccucagacuccaugaaccaaucuaucugcuucccuucccacugccagcacuagcuccucugguaugguuuccucucucccuauagcccaaccugaaauucaacucauuuucacauaaaugacaaagguacagaaaccagcaaccaccuauaucuuauuuccauuaaagcaaaaauagcuaauuuaucaaacacuuguuaugugucauguguuauuuuagagcuuucaauguauuaacucauuucaugcucauaaaaauccuauccccauuuuacgaagaggaaacugagauacaaagaaguuacuaaacuugcccagccagcaaguggcagagccaggguuagaacccaggaagucuggcugcaguccccacuuuugagcuacacugccacuagaguccagcuucaaagucaggugcuucagggagacagugaaacaacugcagucaacaucagaaagguccaagacucaauuuaaagauaguaucuaacacauauuuuaauggagaaauguucaaguauauauuuuuaugguuuccacagugcugaaauuacacaaguuuguuuucaccaaguuuuggaauacuuccagaaaaucagauuaauauaugaagaagagaaaacauucauuuuucaugaauacgugguaaaagagagcaacucauguauacacuugucaguucugucagaauguaacccugcaggguaggaagcacccaucuucugugagaacuucccacaaagagaauuauuaguguggaaugagugcucaguuuagaaauaaauagcauucuucaaaugucagaggcauccccauggaauaacucagguccccaacaagacuauuaagcugauauuacaaaccguagccaugaagaaaggaguucaucuaugcugacagugauugggaguggaaacaaaaaggcugagaauguucucauuacccaacaguuuccuggauuaaucuucuaagaaugaacagaaguuuagaauucagagccaugggaucacccaaagcuguagaucaaaaagaagagcaaaaagcagcauuauaagaaauaucuauagucaggggaauaaauacguugacaguuaaagaugaugaaaagaaguuaaagucuucuaaauaaaaaugauucgcacuauaaaacacucuggcccaaucaccuagguuacauaacaauaagaguuauaaauauuacucagcaauauuuugccuuccaggucuucauggugcaucuuaauacaguuccaaaguuaccccagcaaaagaacucugugaacgcacacuccuagugcuggagcucaccacaaacgugugcuuucucaagaaucauaccugguuuggguuuuauuuuccuucuuuaaaagugcaugcaaauuuuacauucuauucuauaaaagaucgguuuugauuuuugccuggggaaggggucagaagguaauuuaaaacauuauuuuucucaggcaagacugucacuacuaaaagaggggccaagucuauccuguggccuuucacauuuccccaccaucaccuagaauggauguagaaaacucugaguuugacagcaaacuucuacguuuuuuaaaaaccacaaggugauguucaacauucagguucucuuugucugcagagcagcagcucugaacuccagcuacacguaacaaucaccuggaaggcuuuuuaugaauaccagugccuaaucuccaccccagaucagcaggaucagaaucuccuagugcaggaagaaaccauucuguuuugucguugcuacuuuuagcuccacugggugacuuuaaaggacagaguugagacuuacuugcucagaggauccaaaagaaacacuacggucccagagugagcccagaguggugcaggaacaccagagucaaccccuggggaugaucacguugucccuuccuaaaccuaacuaucuugaagacacugacccacagaccauaacaaggucagucucucucucucucgcacacacacacauacacacacacacacacacaccccuuccucuauuuaaaaaaaaaagcuaccuaaaacagaaaguuuacaugagauccagagucucaaacacaaugcaaaaaauguucugguuucaaugaaaaaaaucacaccaagaaccaggaaaauccauacugaaugagaaaaggcaacagauuccaacaccaagauggcagagauguuagaauuaucugauaaagcuuuuaaugcagccaugauaaaaaauucauaaaacaaaaauucuucaaugaucagucauaaacaugcuaaaugaacuaagagaaaugccauuaugcuccucaggcccuugagguaguugcacugcuggcccagccaggacuguguaggucugggcuggugaagguugggaaguuuguuuugguggugggagcucauggacccuaauuacacuguacauugcaaugacgaugaucugcugguagauguucacuguaauuugccuuuggauugauggaucuaaacugacuucacgaauuagaguggucaugagccaaagacaagaauccuuagagaggagcaacaucccuggggagugaaugacugacaaugucugugccuccaagggguuaggguaugaaaaagaggcaagauaacuguccccagggguuggcuuuaauaauaccgaaagcauaaauaaaaacaaaaaccaauacacuggauuucauaaaacuuaauaacugcugcuaagcaaaaacccuaggaagaggauuaaaaagacaagcuacucagagaaaguuuucaaacuacauauccaaagagaggacuaacaucuagaauauguaaagaacucgcaaaacucaacagcagaaaaauaauacauuuagaacaucagcaaaacacauaagaggauauaugacacuucaccaaagaggauacagauggcaauuaagcacauaaaaagauguuccacauaauuagccauuagggaaaugaaauuaaaaccacaaugaaauaucacuauauaucuaacaggauggcuaaaaauuuuuuuaaauagugacgccaccaaauucugccaaggacacaaagaaauuggguaacucauacauugcuggugggaccguaaaaugguaucgccacuuuggaaaacaguuuggcgguuucuuaagaaauuaaacacacaacugccauauaacccagcuuuugcucucuuugguauuuagcucagagaaaugaaauuuuauuuuuaaacauaaaaccuguacaugagugaucacagcagcuuuauucauaaagucaaaaugauaaacaacccacacauccuucagcaggugcaugguuaaguguuaguacauccauaccauggaacauuacucaucaauaaaaaaggaacaaacuguugacacgugcuacaaacccuggaacugcugacacauggaaccaaccguggaacuaugauaaguuaaaaagcaacccaaaagguaugauuccauugauaugacauucuugaaauaaaauuauagaaacagagaauagauucuugguugccagaguuuaagaggugaaagaggcaaggaagagaguacgucuauaaaagugcaacacguggcugggugcgguggcucauuccucuaaucccagcacuuugggaggcugaagcaggaggaucacuugaacccaggaguugaagaccaaccuaggcaacacagggagaccccgucucuauaaaacauaaaaaaaauuagccaggcacugugucacacaccuguggucccagcuccucaggaggcugagaugagaagaucacucaagccgugggggucaaggcugcaaugaaucaugaucaugccacuguacuucagccugggugacagagcaagauacuguugucuguuuguuugaaaaaaaaaaaaaaaagacaauauguggaaucuuugagauaauggaaaugcucuguaccuugaauauaucgauuaucaauauccuacuugugauaguaaauacaguuuuguaagaaguuaccauugagggaaacugggcaaagggacacaggaucucucuguaugguuucuuaaaauggcaugugaauuaucucaaaauagaaaguuuaauuuaaaagaaaugaaagguuacuggcccacugaacccugacugcagcaaacagcaaguacuuggaagugaccuuuaagugugcuccagauuuucauuuacuggccauuuucagcucuaccauuucauccaugauucaugaggcccagcaacucaaccaauuuuauucaauaaaaagggggcauccuguaguuuugccaagaccaauuauucccauggcgacccucaacauaauauuaacuaucaaaccuagaaaacaccacagccuggaguggaccacuuucucugcugcuacucucuuuguucucuugcaccucuucagagaaaggugcuaaaauaacucaaaccccucucuucccaguaccauuaccuuuccagagcugccuuccagaaacuaacuuaaucuucacacaaauugggaagagaaaaaaaaaaucacacugcuaaccccccaucuuuuacauuacaacaaacccaguucucagggggaacaaaaaaggauacuacucuacagcauaucuaggacaagaagaauccaccugugacuuaauucauauuuggacaacucugaaugcauaaacaccagguccaaaaacaaaauaagaugcaaccuugguuuucuaccuacaaaguacaguccuuaaaacagauauaaggauucauguuuccaucugcacggagaaauuuauuucaacauaaaaagaugaaaaucuauccuaaauugaaagcucuccagagauggaaaauucacaaucuauccugauacuccugguauuucccagccucugucaggccacacuaccaucugcauccuaucuugguaaaaauuaugucuguuccucucaugauuguaggaauuggucuauauagcuugcaaaauuuuagucacuccuaagaaugcaaguuaccuagagcagagaguaguuucucuagcccuguaaucuacccuuuaauuuauaaaucuuuucuauccgucagaauucaggaguuccauaguugauauaaucuuaaaaagcaaaaaauucaggaugaucaggauauaaauuauaucuuaacaauacagauuaacagccauaagaaauauagagaaaguuucccagacauuguuuccucgauaaauuaacaacaaaauuuguaacacagagaagacaucacacaaucauuuaacucaugcaaauuaagguagauccacugggguggagggcuguggagaagacagggaaacuccagaagucauccuuauucccucaguuucccugaugcuuuccugaaaugcacuuagaaacacugagucuucuucuaguucaaguacauuuuuugugcauguccucuaaaacaaacuucuucacuggaugcucaacugaacauacagucguuauuccaggaaggaggaaacaugggcuguuugaauggcugguaggguggccuccauaguggaaccuuucuaaauggcuuaagucuaguucuaacccacacuauuuuuguaucaagggcugaauuuggaagccauuccacugugauguguucuccagcaguccauguccacucuccugugaauuaguuauaugcaggugucuaugagcgugcagggguguacagaugugcacauacacaaacaccuuuacaaaggugguggaacacacugagcuaauaucaaaucagugcauucucucaguggauacucauuccaagaggcgagcacccugggggggucaagcuagcccacuggcuuucagugggcaucaaugaaggcagaaaagcauauacauguccccccauuuagaauuuuugcuuaaaauuaauaacugcaaguuuuuuaaacgcuuccuuuuauguacuaaaccuauaaaacaauuagaaguccccaaaauuuuccccacauaggcugaacaucuaaaaucccuucauuacaaaauaaagucuuguaucccacaacaaagccugaguauaacaucaaaauacuuuugaaaauaagaguagaggucuaaaaucauccuuccuaagggcagauuuugaugaaacaagagguaaggaacacaaaggccagccugaacauugaagaaaugacagggaagaggagaaagguuauuagcaggagaccaagucugugacagcacucugaucauccuggaguuuggccauaagggagaaaacacuaaaaugcuuacaugccuaaucccuccugcuuucucaucugcaaaaggaagaugagaucucaccaacagcaaacugcauaagaagacgaccaacacuuaacauaaaaccucagccauucugagaaguccuggccagcauuuaccaaacucagacuuugaucuaaggcuuacccgaaggcacaauacauucccuagcaguaacagagaguugucaagacaacugcuuaauggaacauguccaaaucuagaaucaagcacuuuuugccaaaauaugauuaguuauauguaauccuauaagacauaagaaagacacuaugagccaccuuuugcucaaagcacugaccuacucaaauuuaagacgacuauuuuaaggaaauuaaaagccauacaauuucucuauuuuauuaucugagguaggaacucaaaacuuaagagucaaaauggaaucuaauuuucugagcagauuaaucauuguuacccaaaggagaagugcuaggucaucagaugucucccugcucuuggagagcuuagcccuacucccagagaacagcugcaggagugagggaccacacaggagcagucagagggucagaaggucugacaccaaaugaagaaacucgugcuaccaaauccugagaaaaacuagucagauuuagaaggaacugaaaacaaggaucagagagaaaagcauacaaagguaucaaccuauuuauaaauaacguuuccucucccccugcuuguucaauaaaacuauuuuauuaaaauguuuuucauuaaaacaaaauaguacuuaguuguaacuuuauucuguuaaauauucuacagaauuaacauucuacagaauauauguuauauauucuacaaaaugauaaaauaacucuaaagauagauaggaauugaccauagaugcuacuuuuucucauccauaaugcuacugcuuaaaaauccuuuaaccaagagauaaauuugugggaaaauacuugaauuuaccaguuacaggggaagauuuaguucuucaagucccuagagaauaacuucaaaaacagaaaaacuaaguuuuuaauguauacucuuccaagcuuucaagaacaguuaagucucugauuauauauuacaaagcacaggggaaaaaaaugaaauguccccaauuauaugaugcuguuauaacuucaguaccaaaaagagaaacccauccucugcacaucacacacauacacacacacacacacacacacacacacacacacacaauucagccaaggggaaaggagagcagcacauaucucagucacccagaagccacugauauuuagaaaccaucccccaccagaccauucuuacauuccuucugguugcaggccaguauaugucaacaaucccucacaaaucccuuacccaaaacucauggggccagauguguuccaauucaaaaauuuuuaauuucagaaaggcaccuucuggggauauccaauauauuucacauaccaucagagagcgugaggcggcuaugauauucugccguaaaaaugcaugaacaguuacacuaaaugugaucaagacuauaauacugcuucacaacagagccagguaguuuccucagauauacucaagucuggucagguuuuuaaaucaaaugagauauuaaaaaauucaaaucagaacuuuuggauugcagaauuguaaggaauuauuaaccugugauagaucacucuguaaauaauaaugauaauugcuuauaauucauugacugccuaguaugagagauuauauguuuggcauacguuaucuuuaacccuuucuaccacucucuaagguuuuauaaaugaggcuuagaaagguuaagugacucacccaaggccaguuacugaaagcagcaggauuugaaccaagaucuguuuauauuccauccagugugcaauucuaacagguucuugauugcaagcuacagaaagcaugucuagcaaacauaagcaaauaaacaauuuucuggaagcauauuaauaucucacagaauggaugggaaaucuagaaaaccaagcucacaaagugagccaaauccaaacaaggcugaguugcagaagcaacgacaaaggucaaguccugaagcugggaugcugccuugacacugccaacagcaggacacacgucaucauggccacugggcucccacaaccagacacaguugagaaaacuuucugaacucuccccugucuucguaagaaucaaagucccacagccuuccauaaugugaaaaugacaguaugucccaccaauuccacacugaggagggggcuccucccaaagugaaggaggaucagaagacuggguaaccucccccuuucaggugacaaauaucuacugcagccacucuaauucuaaaaaugucugcaaaucacagucaauggcauguaauaaaguaggauuucuuccaggaauggaaguauuuuuucauuuuaagaaauuuauaauacggcagugcacaucaguuagucaaauuuuuauuuaaaaacucaauuagcacuuuuaaaagguacgugauauaacuuaacauccauucuggcuuuuaaaauucuugauaaauuaggaagagaaagcucuuuccuuuaaucuauuuuuuaaccacaaucuaaacauauuuuaaagagcaauauuucaauuagucaccaccauuucuucacaucauucgaaaguucuaaccuaaguucaggcucaagaaaaaaaaaaguucuaaccaauaaugguuagaaaagaaaggaagcaagugucagaaacuaggagcaaaccugcuguuauuugacagaugauaugacuauaccugcaaugacgacaaagacugcagcccagaguggaggcucacauccauccuugggaauggccaaugguaaauccugcaugugugagucaagcaccuggcuacucuuggggaaauucugacccaguagaaaaauucaaacguagcuauucaaacugugguguuaacuguuucaucaguaaaaauauagcaggaauaucucuuccaggauaauuaugacaccuucugauuguuuuggucuuuggaggauucagcaaggagacagaagagagcacugucacuugaugugggaggguugggggaacagucccaguaacaggacugcagaaggggaauuagggagcagcuaaaagauacaguauauagguagcaggugugucugauacccaguuguggaauuuuccuuccuggcuucuaacucuuuccacauuccuaguuacucuccaaccucuuacugggcaaucacugcaucuauuauuuguuauguuuuccucaaaccugagaaauaaaucugguuacauguagcccagacuugaauuggaacuguguggaaaaggaaaaaugcuucggagcaaacaaguuguaagaagccagcaaugacccuuugagaagcuagaaaggaaagaccaaggcaagagguaauaaaugccaaucaagacaagucaaggcucuccccagaggauccucagaagugcaugugaaggguuagaugaauacucuccagucauacaggacguguauuccauuuaauguaacuuaggcauuuaaagaaacaauggcucccaaaggcuggggaacuuggaauagucaagaaaucucaaaggagucaacuaaagauuaaguggagccaauaaugaaguuuagcaaaauagagaaauacaagauaaacuguuuucuuuagcuuucuuauaaacuagcaauaaacuguuuuaaaagaaugaaauaaaaauagcauuuaaaacguaaccaaaaaaugugacauugcaggauaaccuuaaaaagauauaagauuucaaugacaaaagaccguaaaacuguacugaaagaaaaauuugaacaaauggagaggcagagcauguuguuggaugcaaaagcuaaaucuggaguucuuucaaaaugaaaugacagguuuaacacaaucagauugaaaucccauuggcaauuuuuauaauggcaaaaauuaagucuuaauuuaaagaaaaaggacacaagggaacuacuaauaaauuaaagagcaauacaaacaagugaucaggaugggugcuggccaaaucaaagaauaaaagcuuuuauaaauuaauuguauucagacaacuuuugguacacuaacagacaaaucaauaaaaugggggugggggaaaagcugaaauaaauccaauauauaagaccuuaaaauuuaaacaaacaaaugguaaaugaaaaaacagucaacaaacuauauugggacaaaaaguuaucugucaauaaauaaacaauuuccauuuguauaucucaagauaaauucuagauagguuaaaaguuaaguguaaaaaaauaaaguuagccauaaaaaugaaguacugauaccuauuauauuaaaaacucugaaaauauuacgcuaaguaaaagagcucaaucacaaaagacaacauauuauaugauuccauuuauaugaagugcccagaaaaugcaaaucuagagagacaggaaguagguuaggagucgcugguggggaggaugggggugauagcuaaaggauacaagguuucuuuucaaggugauaaaacaaguuauaaauugacuguggugauggcugcucaacuccaugaauauaccaaaaaacacuaaacuguacaccuucaguggguagacugauaugugaacuccaucucgauaaaacugucaacaaaagaugauaauauagaugacuauucugaaaaggaagggauuuuaacuuaaaaacauuaagaauccauuaaaaaucauagauuuaacuacauuaaaauuagaacuacuuuaaccugaguccaaaggcaaaaaguauauaacauucgcaauuaacaaggcagaccaaaggcuaacuucacuauuuuuuuuuuaaugcaaagaugacucuguugcaaccaaucaucaguaaaaucuccacucagagccugagaacuuucugccgcagccaaacacauauuuuuccuucucauggaaacagaugggagcagaagguauguacuacccgggaagauaguuuagacaugggcauauucaaacuaaagaagaugaguaccugucaaaaucaugcuugaagcuucuuuugaggaagaaaggaaggaaggaaggaagggagagggagggagggaaagagaaacaaaaagagaaagagaaacaaggaaagagaaacggaaggaaggaaggaaggagaagaaaaaaaggaaggaaguuaaaagaaaagaaaagaaauaauggaaucacaauggaauuuugccucuguuuuagagacauaauuuuuuuccuaggccucaauaucugcugggaaagauaaugcaaagagagcugagcagccccauccauuugcuaggguugccaguccugaucacugcacaagcaauucaggcucagaggcccauggccccacuucaggaagacacuggaaguagcccgggugacccuuggauaugguuucagcuuuaucuuuuuuaaggagcaggcgaagcccuugccagcagaagccuccugccaccagagccugcuaaguacucccuccucagccuacagccugacaaugugaccccgauccugaccaaaaggaccagagggaaagcaaguccaacggggaaguggugcuuccaggaaaaaugcuccccucugauaaaaagaugcauagcuguaucaauuggggacccggaaagaaacacauagauucaacuugggaaguuuggaaaaaguccaauaaaaggcauaaaaaaguaugggcauaguauggaaaaccauuacagagagggcagaaucccagagcugguaacaaguuuuuaaucaacacuaggcaaccauuuuuaaaaaggccaagaaaaucacagaaaagccaauccagaguccuacguuguuaagccucugaacugccagccuucauacugguuauuuucaaaaaaaaaaaaaaaaaaaaguaaaucccauuaccuaaagccaaaagcacaaucaauuaaaaaauccuuuaaccagucugucuuguaauccacuaaaauuaucuccuuauugaaauuagaagaauuguaguucaagucagaagagauagccucaaaucuggaacauguuaagagagacuccaauagaccaaaggacacaaaacucaaauggaaaccgaaaauuggucauauccaaccuccccaauauauuuuuuuacaugcguauuuguaccucucaaauauucaaauacauagcacuagagauaauaagguuucagucucacaagcuccuaguggguguucaaaucgguaggauguuucuggaaauaaugugggcaacaugcacugaauuacuugaaacuaggacauuacuccuuucuuccucuaagguuuacuguuucagaaauaguugugagcucauuguuagccaaauaauuaaauuuuuaauaugguuuaauuaguccauucaacuacucuuauuucuaacuacuuuaaaaauuaagcccuagcauucuaucuuuuuaaaggcauaauggaaugaagugaugcacugcauccuuucagccuguuagucacaucuuuaauaagcacagcuguuuguacugagacauaacgaaggcauuaucacccacugaggggcaucauaugcugaauccuggaaauguacagugaagaaauaaucagccucugaagugcuaaccuuguaaacccagccuacaaaauggcucaaaccuuacauaaaauacccuuacagcaaauuacuccugucuaaugcuaaaucauuuccaaugggacaucaaaccuucauuaauaaauuuucauuggcuuaaaaauuaauaauguugauuuccauauauuuuaaaagguuucauauuuauaguaauuauuuuaagaaagaaaaaaauaauucuaauuuccucuacauggcccaauacuuauuaaaaaggaugcucggggaaugagguuuucuggguaacagaauauuucaguuuguuuuaauucaaaauauuauuggauguaaccgucaggcucugaucugcaaaagauguaagauauuggaaugagcacuaacuucaggacagacuauagaagaaaguuuuaaaugaaucgauuguaucaacuuucuuuuuaaucccauauuuaggauaauaaauacaggacacagcucaaaauuuagguuacagauucagucauuuugacuggauauuagaguaaagaaagauacuauauacaugacacuggaagacugaauagauggaaaggcacaacgggaauagaaagugauucuccagcaauaaaggcaaaagcuauccagugaagaggaaaacagaccagauggugauggucgauccuuucccuucugcuauccauccccacucccaccgaccucaccacugacaguguuccuaucugugggucccugcuuuagcugaguugcugccuucagcuuugucagcaagugcugccaccuuuggauacugauuuaaggccucuauugcuucaaagugaagcucucugaaucugggggccugcacacuccccggccucuccagucagauggagccuaagaauucugcucaaaacaauucccagagggcuacuggugacagcgccaguuccaucguggccagauccagcuucagccaggauguaaggcagaugcacgaacuccucaugucugagagaccacguccaauagagcugcccucccggacccugugcaaaccaccauuccagcuucccaucaauuuaaguaucuauaagguaaagaacugccacugaagaacugcauggaauggguugggcacgguggcucacgccugaaaucccagcacuuugggaggccgaggcgggcagaucacagggucaggagaucgacaccaucccggcuaacacaguaaaacccugucucuacuaaaaauacaaaaaaaaauuagccaggcaugguggcaggggccuguagucccagcuacuugggaggcugaggcaggagaauggcgucaaccugggaggcggagcuugcagugagccgaaaucaugccacugcacuccagccugggagacagaaagauuuucauaucaggcagcaauaauuuaaaguaacuguauuaaauaauuuccaaauuuuccuuugagcugcaaaguaauauuuacagcuaucacaagaccuccaaagugcagaguugggaaguuucuacauuuucaaauauacauuaucuguaaaagagauuguauauaaaacagguuuguuaauuguccauuuuauuaaaaugcuaaggcacuaguauacaaucauauuaaagagaaaaaagccuuacauuuaugcagaagucauaacauacacuuucuaucuuccucacuuaaaaagaaauguaaaaguuacccaccaaguuuuuaauaacaauaaaagaaaaaggaaguaaaguaucucaauuuucuaucacuguaggaggacugacagaaauuuuaaggcaccaaaccccaaaaguuccucucuaggggccauggcacagagaagacuuagaaauucaaguuguuucagcagaaauucacagaucauuaaauuaauucaaaacccaacaaggcggcaaacuaacaauuuacccuuacaguaucugguuacagccagcaauuuuucacaaaaauacgcuuaucuccucccuucccaucauuuaaaagggcaagcaguuaaggucacaguuuaaaagugcaaugcaaagcugaugccagccagagucagccuuaaauauacagagcuuuaaaggaagugcggugaggcaagagagaaggaaucuggaaacagaucggcagaccuacccaccuggcccaggucacuuggcucucaggcuccucuauguaucugacucagcuaauggagguuuuuaacuuuauccaaacucagaccccacccagaucaccuucaauuagaauuuauaguuggucacuuucauagcucccacaggugacuguaaugugcauucaggggucagaaccacugaauugaagagaccgagagagaaugggagagucaggauuauggauagacagccuguguaugaaaaaccucaaaugcgaaggcugccuugacacaagacacugcucugugccccaacuuugcaguggacagcuaucucaaagaucugguccaggcuucccauccaccugcucaacuauuacaugcagggauagcucaggggcucuuuuuucuccccgcacucuaccucuaucauuauuugguuugcagaacaaacugucuuuccuuuucaaaauggaaacuugguuggauaacuggucucugagccagccaggcaggagacagccuccacacuaacaagggaguuuccaagcccauuaacucuccccuuuagcccccugcuaugagcucccagagguaaauacacacuuaagaguaaauuauugguuuacaggccucuaaagcaguugguucuuaaauuaauuuaaugagcugugaacuuaugcuaaaguaauuucugaucccaggagaggaauuguuggacguggaaaaaaaaaauucuauggcuuagcagaagauucggagaacaacaacaggagaaaaaacaaacacaugaucauuuaaaaagcaaaucucuaauauuuucaaacacaagaaaauuauuucauucaaaauuuuuacuccccuguauuagaucuguauuggcauuuuaaauauuuuuuaauguauuaaggauuuuauaauccugacacuguacuaauaagcauuuaauauuguuaaauaaaaaucauaggaggccacuguuuuggacuaagcuccuacacuaggccccaacagaccagacugaaaaaucaaaacagacucauccaugcuaaaguuccaggucaccaaacaaaacagaguuguuaucugaccuuuucagaaaucaggagagacagaaaacggccaauuucucaaauaggccaguuucaaucuuacacuggcauaauaacgaaguuccucuguuuuaauccuuaacccaaaguaaccugauguuaaccaguuauuuuuucuauuauacuaucucucugucccacuuuacaaggaaaguaacuuugaaaugaucaacauuuuuguuguuucugccuucuuuagcuuuuuuucccgucuauaaaggcaacuuccucugccccacucauuggaacacuuacucuacuuauggaaggguugcccaauuccagaauugcaaauaaagcuaauugagaccuuuaaacuaaauuuguuauaauuucaucuuuugacaauguaauauacguuaucucacuugauccucacaacaaugcuagaauuaggagauguuaccaccaccucuuuacaaaagaggagccugaaggaaacucggaggcuacacaaccagggcaguuucacacaauaaggagggauggcaugaagguauaaaggcgguucuaccaaugccaaacuuccaaaaacuaagcucuaguaaauaaauucugcaugucucaaugccuacacaauaugaaaaauguuagaaaaccauuucacacuuuaggaaaaagaaguaagauggcugaauaggaagagcucuggucugcagcucccagcgugaucgacacagaagacgggugacuucugcauuuccaacugagguaccugguucaucuauuugggacugguuggacagugggugcagcccacagagggugagccaaagcagggcggggcaucgccucaccugggaagcacaaggggucaggggauuucccuuuccuagccaagggaagccgugacagacuguaccuggaaaaugaggacacugccacccaaauacugugcuuuuccaacagucuuagcaaacagaacaccaggagauuacaucccgcaccuggcucagugggucucacacccacggagccuugcucacugccagcacagcaguccgagaucgagcugugagcugacagccugggugggggaguggcaucugccacugcuaaagcuugaguagguaaauaaagcggcccagaaacucaaacuggguggagcucacugcagcucaacgaggccagcgugacucuguagacuccaccucugggggcacggcauagcugaacaaaaggcagcaguaacuucugcagauuuaaacauaccugucugacagcucugaagagagcagugguucucccagcacaguguuugagcucugagaacggacagacugccuccucaaguggaucccugacccccauguagccuaacugggagacaccucccaguaggggccaacugacaccucauacagcugggugccccucugagacaaagcuuccagaggaaagaucaagcagcaauauuugcuguucugcaauauuugcuguucugcagccucugcuggugauacccaggcaaacagggucuguaguggaccuccagcaaacuccaacagaccugcagcugagggaccugacuguuagaaggaaaaguaacaaacagaaaggaauagcaucaacaucaacaaaaaggacauccacaccaaagccccagcuguaggucaccaucaucaaagaccaaagguagauaaaaccacaaagauggggagaaaccagaguaaaaaagcugaaaauucuaaaaacuagagcgccucuucuccuccaaaggacugcagcuccucgccagcaacagaacuaagcuggacagagaaugacuuugaugaguugacagaaguaggcuucagaaggcugguaauaacaaacuucuccaagcuaaaggagaaguuccuugcaaacccaucgcaaggaagcuaaaaacuuugaaaaaagaugagaugaauggcuaacaagaauaaauagugcagagaagaccuuaaaugaccugauggagcugaaaaggccauggcacaagaacuacaugacgcauguacaagcuucaguagccaauucgaucaaguggaagaaaggguaucaaugauggaagaucaaauuaaugaaaugaaacaagaacagaaguguagagaaaaaagaguaaaaagaaacgaacaaagccuccaagaaauaugggacuaugugaaaagaccaaaucuacgucugauugguauaccugaaagcgauggggagaauggaaccaagggggaaaacacucuucaggauauuauccaggagaacuuucccaaccuagcaaggcaggucaacauucaaauucaggaaauacagagaacaccauagauacuccucaagaagagcaaccccaagacacauaauugucagauucaccaagguugaaaugaaggaaaaaauguuaagggcagucagagagaaaggucggguuacccacaaaggcccaucagacuaacagcagaucucucggcagaaacuccacaagcgagaagagagugggggccaguauucaacauucuuaaagaaaagaauuuucaacccagaauuucauauacagccaaacuaaacuucauaagugauagagaaauaaaucguuuacagacaagcaaaugcugagagauuuugucagcaccaguccuggcuuacaagagcuccugaaggaagcacuaaacauggaaaggaacaacugguaccagccacugcaaaaacaugccaaacuguaaagaccacugaugcuaggaagaaacugcaucgacuaaugggaaaacuaaccagcuaacaucauaaugacagaaucaaauucacacauaacaauauuaaccuuaaauguaaaugagcaaaaugccccaauuaaaagacacagacaggcaaauuggauaaagagucaagacccaucagugugcuguauucaggagacacaucucacaugcagagacacacauaggcucaaaauaaagggauggaggaagaucuaccaagcaaauggaaagcaaaaaaaaaaaaaaaaaaaaaaagcagggguugcaauccuagucucuaauaaaacagacuuuaaaccaacaaagaucaaaagaaacacagaaggccauuacauaaugguaaagggaucaauucaacaagaagagcuaacuauccuaaauauauaugcacucaauacaggagcacccagauucauaaagcaaguccuuagagaccuauaaagagacuuagacucucacacaauaauaaugggagacuuuaacaccccacugucaauauuagacagaucaaugagacagaagguuaaaaaggauauccaagaauugaacucaccucugcaccaaguggaccuaauagacaucuacagaacucuccaccccaaaucaacagaauauaguuucuucucagcaccacaucacacuuauuccaaaauugacgacauaauuggaaguaaagcacuccucagcaaauguaaaaguacagaaaucacaacaaacugucucucagacagcagugcaaucaaauuaguauucaggacuaagaaacucacucaaaacugcucaacuacauggaaacugaacaaccugcuccugaaucacuacuggguaaauaacaaaaugaaggcagaaauaaagauguuccuugaaaccaaugagaacaaagacacaacguaccacaaucucugggacacauuuaaagcaguguguagaggcaauguuauagcacuaaaugcccacaagagaaagcaggaaagaucuaaaaucgacacccuaacaucacaauuaaaagaacuagagaagcaagagcaaacacauucaaaagcuagcagaaagcaagaaauaacuaagaucagagcagaacugaaggagauagagacacaaaaaaaccaucaaaaaauuaaugaauccaggagcugguuuuuugaaaagaucaacaaaauugauagaccgcuagcaagacuaauaaagaagaaaagagagaagaaucaaacagacgcgauaaaaaaugauaaaggggauaccaccaccgaucccauagaaauacaaacuaccaucaaagaauacuauagacaccucuacgcaaauaaacuagaaaaucuagaagaaaugaauaaaucccuggacacauacaccuucccaagaugaaaccaggaagaaguugaaucccugaauagaccaauaacaggcucugaaauugaagcaauaauuaauaaccuaucaaccaaaagaguccagaaccaaacggauucacaggugaauuuuaccagagguacaaggaggagcugguaccauuccuucugaaacuauuccaaucaauagaaaaagagggauuccucccuaacucauuuuaugaggccagcaucauccugauaccaaagccuggcagagacacaacaaaaaaagagaauuuuagaccaauaucccugaugaacaucgaugcaaaaauccucaaugaaauacuggcaaacugaauccagcagcacaucaaaaggcuuauccaccaagaucaaguuggcuucauuccuggaugcaaggcugguucaacauacgcaaaucaauaaauguaauccaucacauaaacaaaaccaaagacaaaaaucacaugauuaucucaacagaugcagaaaaggccuuugacaaaauucaacagcccuucaugccaaaaacucucaauaaacuagguauugauaggauguaacucaaaauaauaagagcuauuuaugacaaacccacagccaauaucauacugaaugggcaaaaacuggaagcauucccuuugaaaacugccacaagacagggaugcccucucucaccacuccuauucaacauaguguugaaaguucuggccagugcaaucaggcaggagagagaaauaaaagguauucaaucaggaaaagaggaagucaaauugugccaguuugcagaugacaugauuguauauuuagaaaacaccauaaucucggcccaaaaucuccucaagcugacaagcaacuucagcaaagucucaggauacaaaaucaaugugcaaaaaucaaaaccauuccuauacaccaauaacaaacaaacagagagccaaaucaugagugcacucccauucacaauugcuucaaagagaauaaaauaccuaggaauccaacuugcaagggaugugaaggaccucuucaaggagaacuacaaaccacugcucaaugaaauaaaagaggacacaaacaaauggaagaacauuccaugcucauggauaggaagaaucaauauugugaaaauggccauacuguccaagguaauuuguagauucaaugccauccccaucaagcuaccaaugacuuucuucacagaauuggaaaaaacuacuuuaaaguucauauggaaccaaaaaagagcccacauugccaagacaauccuaagccaaaagaacaaagcuggaggcaucaugcuagcuaccugacuucaaacuauacuacaaggcuacaguaaccaaaacagcauggugcugguaccaaaacagagauauagaccaauggaacagaacagagcccucagaaauaacaccacacaucgacaaccaucugaucuuugacaaaccugacaaaaacaagaaauggggaaaggauucccuauuuaauaaauggugcugggaaaacuggcuagccauauguagaaaguugaaacuggaucccuuccuuacaccuuauacaaaaauuaauucaagauggguuaaagacuuaaauguuagcccuaaaaccauacgaacccuagaagaaaaccuaggcaauaccauucaggacauaggcaugggcaaggauuucaugucuaaaacaccaaaagcaauggcaacaaaagccaaaauugacaaaugggaucuaaugaaacuaaagagcuucugcacagcaaaagaaacuaccaucagagugaacaggcaaccuacagaaugggagaaaauuuuugcaaucuacucaucugacaaaggacuaauauccagaaucuacaaagaacuuaaaacaaauuuagaagaaaaaacaaacaaccccaucaacaagugggcgaaggauaugaacagacgcuucucaaaagaagacauuuaugcagccaacagacacaugaaaaaaugcucaucaucacuggucaucggagaaaugcaaaucaaaaccacaaugagauaccaucucaugccaguuagaauggcgaucauuaaaaagucaggaaacaacaggugcuggagaggauguggagaaauaggaacacuuuuacacuguugguggggaauguaaacuaguucaaccauuguggaagacuguggcaauuccucaaggaaucuagaacuagaaauaccauuugacccagugaucccauuacuggguauauacccaaagauuauaaaucaugcuacuaugaagacuuaugcacacuuauguuuauuguggcacuauucacaauagcaaagacuuggaaccaacccaaauguccaucaaugauagacuggauuaagaaaauguggcacauuauacaccaugcaauacuaugcagccauaaaaaaggaugaugaguucauguccuuuguagggacauaaaugaagcuggaaaccaucauucugagcaaaaugucacaaggacagaaaaccaaacaccacauguucucacucauaggugggaacugaacaaugagaacacuuggacacagggcagggaacaucacccacuggggccugucgugggguugggggaagggggagggauagcauuaggagagauaccuaauguaaaugacgaguuaaugggugcggcaaaccaacauggcacauguauacauauguaacaaaccugcacguugugcacauguacccaagaacuuaaaguauaauuaaaaaaaauuaaaaaaaagaaaaagaaaaccauuucacuuuuauacaaaggcuuuauccauauugcuucaauaugcaguuucuuccagauacauacucaguuuuagacuaugucauauugaguuuuuacuucaguuuuaaaugaauucacacaucuaucagacacuggaggacaacuacauggcacuacugcuguauaacaaauuaccccaaaacguaaugguuuaaaacaacaaacaucuaucucacacagcauccaagagucagaacuccaggaguaucuacaucaagcugagugguucuggcccauggucucuugcgacguuauggucagaguaucagccagggcugcaguccauugaagggucaaauuccaaaguaguccagguaccuggcuauuggcaagaacucucaguuccucaccacacaggccucaccacaggucagcuggcuuuccacuuagcaaggugaugagagagagagagaaacagacagacagagacagacagagacaccaccgugccuuguauaaucuagucuccaaagcaaugaguccagccuauacucaagggcaggugaauuagcuuuuaccuucugaaaggagaaguaucaagaaauguauggguauacuuuuaagcugcaaugaccaacauggugcaaguaauaugauuuuucuuuucuuuguaaaauauuauuuuauuuuaaauucaguagguacaugugcauguuugauucauggguauauugcauacccaugggaacugggcuucuagucugcccauuauccaaauacugaacauuauacccaauagguaauuuaucaggccucacccccuuucuacgcuucccucuuuuggaguccccagugucuguuauuuccaucuuuaugacuauauguacccauuguuuagcucccacuuauaagugagaaaaugaaguauuugguuuucuguuucugaguuaguucacuuaagauaaugaccuccagcugauuuuucauaagaauucccaaggaaauaacuuugagaguuucucugaaaaguaaaaauacuaauuuuauaaagaauucauagacuugaucuaagaacagaaacaaugauuuuuaccauagcaaaauagccuucauauuauacauguauuacgucuuaaaaauguacacaguaucuacuaagcaccaaacugugcauucuuagugcuguguuugaugcugugcagaauaucaagugcauguaaagugaguggcagaugcaauaugaauaugaauuuagagaagagaccacuacuauaauaaaguaguaauucugaaaaaaaauuuacaaaaaaugaacauaacccauacacaugaaaaaauacucaaccucaacaguaaucaaaaaauauaaauaaaacuuuacauuuucuuugucaauuugaccaggauauuuuauaugcuaauauucuacacucauggaaaucuaggauuauaaaauaaaauagcaauuagaguacauucucaguuaaucuucauaaaagcccuauaugauuauuauuccccauuuuuuauaugaagaaaugaagagagucagggacuaaguaaauccucaaucacacggcuaguaaguggcaggucaaggauuugaccgcaguuuuccuagcucaaaaagcuaaccauuaaccauuauucuguagugcagccugccuagaaaacauguggccccacauaucaaaagcuuuaaaaaucuccaugcauuuagauccagaaaucucccuucuaugguacucaggcuggagacaauuguaagcuaagccacuaagcuaagaaaugcacacagcauguucauacaaugaugcauaaaacaagcuggcgaaagcacagcauguagacaggaagaggaucacacagcuuucgagauggaagguagucuuagaaauuacuuaguccaacccauucaauguguaacaauaaucauucaauauauuaaaaaaaaaucuuuuuccaaugucagaaaacacaagggaaauuuuuucuuuuuuaggauuuuccuuucuuuucucuaggccuaccaaaucucuauccuggcaguuaguaagagugaagcgcuaucagccuccauaauaaacagccccauaauaaaugcuucuuuagaaugugggguuuuuuuuguuuguuucuuugucuuugagacagucucacucugucguccaggcuggagugcaguggcaccaucucaucucacugcaaccucugccucccggguucaagugauucucaugccucagccuuccgaguagcugggacuacaggcaugcaccaccacacccgcuaauuuuuuguauuuuuaguagagacgguguuuugucuuguugcccaggcuggucucaaacuccugagcucaagugauccuccugccucggccucccaaagugcugggauuacaggcuucugaaccaccaugcccagccuagaagguggguuuucuuucuuucaccugagguccucccagccugucuuugcuauagacucagguaucagaucagcuagccccugugaguauuaacaaaauaagacugccaaucuuauucgaguucauaggcucugagugaaauguauaugggcuucaaggugacacguccagggccuuaaagaccuuucuuucacugccaggauguuuucuggaagaagcuaaggggagucuauccuagaaaaaaaaaaaaaaaaguaugacauuaacaucuuaauuagagccagagaaaugagaaguuagccccauguuaaaaagagguauucauccaguaaauguacacugugagaccaacgugcggagcggugaauccaucacccucgccaaaaucaaaccaucuaaaccacccacuuuccaccaauauuccucucaauacacccuccccugcuaugaucaucacauaucaccagcucuuuccuuucuccuccuuauaccccagccacacuggguucuuucuguuucugccucaggaccuuugcucagguugcucccucugccuugaacuucugccuccugucacccccauucagcccaaacaucccauucucaggaaggcuccccucccauucaaucagauuccccuguuguauacucucaugucaccacaaccauauccucccagaccuguguaaucaccauccagguuccccacuaaguuguaagcuccauacugggaggcagugugucagccggcuucauggcugcauccagggcccagcccacugccuggcaccuggaagguucucgaaauauaucuguuuaaagaaugacuauccaaaacauccucacuaucuuuuuuucucuacuccacuuccaugcugaauucuagcucucaucaccacacauaacacuuucucagacuccagauucccucccuaaagcucuaauccagccugcaggugguaacugccagcuuaauuuccuuaaauaccaccaggguucuucucugcuuugaccuaucacacaucacgucuuaaauccccuuaauggcuucaggcccuucaccuaccuaguaacaccaacuguaugcaagcugauacuccucuuugccucugggcucagccagcagcccacugaccuaggagcuccagugggcaucccuucacccccuuugacuaauccuucaaagucaaauucaagacacuucuccaugggcccaucaugucucccacugguucaauaucacacuaccagcccuagauuacauuuauguguuaggccguucuugcauugcuauaaagaaauaccugagacuggguguauuaguccauuuucgcacugcuauaaagaagcacuugagacuggguaacuuaugaaagaaagagguuuaauuaacucacaguugcacauggcuggggagaccucaggaaacuuaugaucauggccgaaggugaaggagaagcaggcaccuucuauacaaggugguaggaaagagagaggggggugaagagaacuaccaaacacuuuuaaauaaucagaucucaugagaacucacucacuaucacgagaacagcaugcggaaaaccgcccccaugauucaaucaccuccuaccaggucccucccaaaacacguggggauuacaauucgaggugagauuugcguagggacacagagccaaaccauaucacugggucauuuauaaagaaaagagguugcauuagcuuacaguucuacaggcaguacaagcacggcacagcaucugcuuggcuucuggggaggccucagagagcuuuuacugaugguggaaggcaaagggggagcaggcaggucacacagugggaacaggagcaagaaagaaagugucagagggaggugccacacacuuuuaaaugaccaggucuugcaagaacucauucacuaaugcaaagacaggaccaagccaugagggauccaaccccaugacccaaacaccucccaccagaccccaccuccaguguuggggaguacaauucaacaugagauuuguguaaggacaaacauccaaacucuaucaauuuuguuguucuaauuuaauguauguucauuuuguaucccccacaacagccugacuagugucaagaaggcaaagguauuaacauuuacugaacaccacuggguguuagacaucacauggagacacaaaauaucuugagugcaaguacuguuaaaacuuccauggaacugacuggcucccuauuccuucuggauaacuuuuaacuauauauggucuuacucuaugaaguagcccuaaugaugaaaauaagaaguuccaaaaaaugagucauuaaaaaaucaaaauacucaugaguccaagaaagaacaaacagcuucacucuucuuucccuaccaaacaagcauccacauuguugaaaauaggaaauuucacugauuuuccuggccccuaucuguccccuaucuaugagaggaaaugaaaaagucacaguaaccugcagaaccugaguaauaaaaaguugauugugacuccagacuagguaagccacagacacuaccuccaggcuugaaaacuagccacauccagcagaccuucagagcuagaaaaaagcuuggccauuuauccuaaucaucaaacacuugcaucaaacaugcauuuaacguauucacuacccaggaucugaggaauucuuucuucauccuucacucagugaagaacuaaaaguuccuacauaagaggaaacuaauucucaauguucucucauuaauuuuaaagaauuuuuaaaaauguuacccaugugaacugauacaccaaaaauaccagaaucaugugacagcaaauauguaaauauguauauggauugcauaugcuuuauucuccacccaaaugucuuaauuuaagaagaaguauaaaaucuacugguaaguauuauaaaaaauuauagcuauuuccaaguaauuguaucuuuauugacucucacccuuuuuccuccuacaacagaaaucgaacacaauguaacccaagaaaugcagcugaauugacccaacuagugucaaugacucuuccauggagacgagauuagacaaaaagagagccaaugacaggugcaugcaguaaaaccucaagauacacuagucagccuaagcaauuuuuacugaucauuuuugguugcguaugauuagaaaacuagcaacuuggcaugucuaauaagccaugaauuccacuuagagcagcaaaauguauuaaacacagggggaaauggugcauuuuguugucacucuguaaccccaacacguuagguggaaagcaauaaauuagccacuugcagaugaagguaaaaacauacaccagugaugugguuuggauuugcguccccgcccaaaucucaccuugaacuguaauccccaguguuggaggaggggccuggugggagguaauuggaucuuggcggcaaauuucucccuugcuguucucaugauagugagugaguucucacugguuguuuaaaaguguguagcaccuccuccuuuuccuccuggucuagccauguagaaugugucugcuucccccucaccuuccaccacgauuguaaguuuccugaggcccccuagccaugcuuccuguacagccugcagaacuaugagccaauuaaaccuuuuuuuuuuuuuaauccagucagcaaugcaagaacagacuaauacaacugguaaaaccaaaacagaggaaugccugucuuucacuuugugcugaaaaccacagcagccuuugcuaacaacaugacuuuggucaacucaccaguuacugcagcaaguaaaaaagcacgggagugcuugcuucagcggcacauauacuaaaauuggaauauacagagauuagcauggaccuuaaaacaaaaaaaagaaaaagcguggggaaaaguacguggaagacucggcacuacagacauuuaucacauaaaaucaccaccccuccccuggggagaaaaaaaauccuugccuccuuuucaacuuuucuaugacaccagaugggaagcauuucaaaacaugaaucaguucacagcaaaacuuuucaaaagcacauuuuuuugguaaagcaaggcacaucuucuugaauacauaccuguuuucaguaccucaauuuucauacuucaagaaaauguuguuucaauacauaaauauugcucaucuuuugagaacaauauuuaaaaggaagauuaagccuuccuagaaagcgguuagucguauguuuacucuuaaacacaacugacccaaauauuaauaugguauuuaaaugucaugucacuuauuuuucucccucuagcucacacacacacacacaaaacccucagcauuuuuaaguuggaaaaaaaaaacaaagauuuuuaacccaaaaacauaugaggagccucuaguuuuuucacccccauucacaaagaaaaucugugccauaaggggauugauccacugucaaccuggaggcugguuuccuuuauagcuguucucugggaaucugugucuguuucuaugacacugucaaaaccugcuuucccaaugcauguaauggaugaaaggcagucuaggaucaagcucuucuugguucguugaacaaagauuuuuaggaaauaaugauuuaucaagguccucauaauccucagcaaaaaaaaaaaaaaaaggcaagucagagucuuacaaaggcuaaaucauaauuaacuuaaugucuucaucacugaaauuaacagaagaacuguaagucuccuuuuugacauauaauuuacuaaucacaugucaaaucuaagcuugccuuucuuucuuuagagacagggucucacucugucacccagccuggagugcaguggagcuuacugcaaccucuaacuccuggauucaagugaugcucccaccucagccuacagaguagcuaggacuacaggcucacaccaccaugcuggcuaauuacuuuuauuuuguagagacgggggucucaccguguuguccaaccuggucucaaacuccugggcuuaaaugauccucccaccucggccucccaaagugcugggaucacaggaguaagguacugcgcgaggccuaagcuucauuuuugaaacacaucuccaucaagugaacaaggcuaaguaaauuaaauguaccucuuuaugcuugggcaggcaaacugaccaguucauuuuugacuauucuacuggaaauacaaaggaguuauuuucagcuacgaccuccaaaaauuugaaaagcuguacaugaagguugacaucaaaaaaggaggaagaagaaaaaaagagagaaagcugguuguuguuuucaaaguaagcucuguuccaugcaauaaaucaguuuucuaaucggcaaaugcaaauguaaacauuaagaagccuucuaagaaaaacugccccuugcuucauugcuuagaaccuaugucuaaggacauucugucaugauuucaccucccauaaggcacagcacuaucuaacuauaucaucucucaugaggcauggcauuauaugacuauauaauaauggcagcuaacacacauuuggcauuuaccauguuaucaugugcuaggcacuauucuaagcccuuacauguacuauuuaauucaacucucccaacaaucugugaugcagauaguguuauucucauuucacugaugacaaaacucaggcacagaguuaacuugccaacagugaguaaaugauggagccacaagauaaugauuuuuaaaaaucuauggcaccuuaacauuuuguaaguuuuuucaaccauuaucucccuuaagccucccaauacuugucauauuaaugggauaauauuagcaucaguuuaauuuuauaaauggauaaacuaugacugcaaaacauuaagugacuucuccaagcuaggaaaugaaggagcuggaagcagaauccagauauucggagucuauauucucuccuucuuccacuacauagacuuuuucuuucuuauuguagacacucaaugaaaaguauuuucaucaagcugauuauuucucaaagcauaacucuagauuuaaguuccggaugguuagaagcaaucuaauucaccucuucacgcccugcaucaagugcagggccuggugcacaggagggacugcuaguucaagcauuccccagaucccccgucuuccuccacaaaacucccuucucuauguucaugcuaccucuccaugcugcauggccuucagagacacaguccauccucacaaggccucacuuucaacuuucaggaggccaaaucucuucuccaaaucuaaaauccaaaaacucaucugaggacuaugcagucugucuuccagauggcuucaagggagcccuuguuuucauacccuuguuuaguccucucucacacgaguggugugaccaaaaaacuacagcagaaaugacaggauguuauaaaagacuguggcuuccaucuugagcucgcauucucucauauucucucgggucacuuuccauggagggaggucagcugccauauugcaaaguacucaggagucuauggagcagcccacauggugagggccuaugguuuucuguugaaggccagugaggaacugagggcugcccauauccaccaucuccagaugacugacgccucagccacaacuugagugcaaccucaugcgagaccuggaaccagaauccuccaacaaauggcuccuggaugccagauccacagaaauuguugaugauaaauacugguucuuuuaaagcugcuaaguuuuguccauaauuugccacauagcaauagauaaugcaggagcaaaauuuguuauaaacuaguauaaggcuacuuagagucucuacuuuugugaauauccaauuuaugugcuuguuuuaugaggugccuccccagaggugauuggggaugcuauauaauacauacauuacauuaccacccuagaaucugaaauauuuuagaucuugaaacagagccagccacgaggguuucagauaaggcacaguucaaccuguauucacuuuuucuaaaauaccuuuccugauuaacuucaccuuggcacauaagaaacaauuucuuacaagaauuucuguaccucuuaagaaucuccaccacaugauucaauacuugauuauaaauugucucauaucauacucuguuguuuuauaaauaaaugucuccccaccuaacaguuaaacuucuacaggcaagaguccucccuuuauuucacuaucccaccagaaauccuggaugcuacuagguacacaauaagcucugaauauauucuuguagaauugaguucacaaauccaaaccuacaauuauggucacauagcauugguccagaccccaauauacccucacacucaaaacauauuuaucuucaaauaacugcuggagaacaugauguaaaaacagugucugaaagaaaaagaagcaggcucccuaaggaauucuggaaaauuugcacauccuccaagcgcccuuguaaacagcagcagaagcacaaaauaaucauuaucaagggaaaagaucuauuagccuccuaaugauugguccaucugaaaccuuucaacgaaagagcaauuuuaccuuucugcuuucuucucugcauccuucuucaggcaauaagaagagucacugaucaguuuuuaauuuuauuuccuggagagauaugcagcauggagcuuuaaaaacucagggaaaaggcuuuacaaaauaaagaccaaggaaacacucagugacauaagcucuaauacuaaaaauuaaaaugcagugcaauaaguaucauucugaaaagaaauuccacgcaagccaucucuuauguaauuuuuuuaaagcuucccucgagcagaagacacucucucucacagaaccuaaccaggaagaguucuacaaauccaaaugcuaaggucauaggaacagaccagaggccugagauggcuuaauuuaagggcuggggguggggagaagggaagggcgcaguuaggaguaugggaggugaugggauuggcagugaaaucuacaugauguucggcaaauucugacuucugccucuacaaccaguucucaguucuucccucccaugcugcaaagacacagugagugagcaccaaaaaaagaaccaagagaaaaaccagagagaagagucuaggcccaugugcuaagucucuguucccuccccuguagaaagugugggcuggauuagaugacuccaaauguccaugucaggccuaacuuuccaucauaacugaaacccacucuguuguaauuaugucagcucuuccacacucuugcccuggcugucugcugcacuuuggguagcaucguggggcugaauuaacugaggauaugggacugcaugcagcuuuggugcagaggaucagacaguagaacuacugggcaaaagcaugaguggcugacaggaaaaagcaaugacaagcagaaacgaguucgugugaaagauuuugugaagcuaccacauuaucuagauucugaaugcuugagauucucuugacaaagggagcaguagcccacacauuuauugggauuuuucaagcguuugaauacuauugacuuuuaaaaugugccauccagaaaagacuguaaagcuuauauuaugccaguuuugauaccacuaagauuuccuacaauuucccucagucauagaggauuguaguucaauuccacaaagccacagcugcuccaaaugccuuaaccuacaauccugcuagaaauccccaaaguucaagguugaaaggaagucauggaggugggaaggguguguguguuuagaagcagucuuccagcugucuacauuauuuccugugaggaaagcagcacacauugcacucuaaaaccugcuaaauauguuucaagauaauagaugaaaauccauguauauuuaaaugacauuaacaucuucaccugucaaaccuaccaaaaaauuauucauaaaaccuaugcaaauacccuuuuuuccagucuuccaccaagugauuuacagaaaaauccuacaagaaccaaagccaaauccuuaacagaacauaaauaacaacacucagagcuuauagagaaaaguuuuggaagucuaaauauucaagcacaguuuuaaguuacaaaagcauuagcagcagcaggacuaaaacaauccuucaaucagucuuuugacaaauauuuacugagcaccaccacgugccuggcauucuuuuagguucuugaagauuuaacagugagcaaaauauacagugucgcugcuccaggaaguuuacaggaaauuuuucucaaaauauuaaauguuuuuaacuaggaauguuuucucuguugaauuacccacaucuaccuuaccaaggaacuaguaaaaauaaacaagaugcauaaagauagucauguagaucaaugggauagaauucagagcccagaguuaacuccucacauuuauuuuuaauugauuuuuuuuauaagggugccaagacaauucaauggaaaaaaacagucuuuuuaacaaaugguguugcgacaugugcaaaugaagaaugggucauagaccuaaauguaagaccuaaggcuauuaaaaaucuuaaaagcaaacauaagaguaaaucuucaggccuuagguuaggcaaugguuucucagauaugacaccaaaagcacaagcaacauaggaaaaaauauagauaaacuggacuucgucaaaaucaaaaauuuguggguauauaaggaacccuucagaaaguauaaagaugacccaaaugggagaaaauauuugcaaauuaaacaucugauaaggaacuugcauucagaauuuuuaaauucuuauacucaaaaagacaaaucaguuuuaaaaacuggcaaacaauguaaacagacacuucuccaaaaaagauauacaaaugaccaauacggccaggugcaguggcucaugcccauaaucccacuuugggagaaucaguugaggccaggacuucaaacgagccugggcaacauggugagacuccaucucaaaaaaaaaaaaaaaaaaaaaaaaaaaaaaaaaaaaaaaaaaagggccaguaagcacaagaaaagaugcucaacaucauuagucaccagagaaaaaugcaaaugaacacaauaagaugcuacuucacacccaauaggaugauaauaaaaaaagauuuauaacaagcgcuggugagaauguggagaaauuagaacccuuauacauaaugaugaagucaugguggaaaacaguuuggaagcuccucaaacuguuaaacuuuaugacccagcaauuccacucuuagguauauacacaagaguaauuaaagcauuauuaaauuaaaugagaacauacaucuauacaaaaacuuguacaugauuguucauaucaauacuauuuguaauagccaaacaguguaaagaacccaaaagaccaucgacugaugaaagaauaaauaaaauauaguacauccauacaauggaauauuauucagcaauaaaaugacaaaguacugauaugugcuacauugugaaugaaucuugaaaacacuauuccaagugaaggaaaacagucacaaaagauuacauaucauaugaauccuuuuauaugaaaugucccgaauacacaaaacuauagagacagaaagauuagugguuacacaguggugggggcaggggauggaaggcuggaaggaagugaagagugguuuucaguuucuuucugcagggacgaaaaucuuauaaaauugauuguggugauggcugcacaauuccguaaauauaugaacaaccacugaauuggacaauuuaaauggguaaguuguacaguauacaauuuauaucucaauaaagcaguuuucaaaaauuaaauaagaaauugaggagucaagcaguuauaccaagaacaccuagaaaacggaaaggagagagaugccuucucuuucucagauuaugucaacguaaagauacuuuuucuuauucagauuaauucaacauuuauucauugaugccuacuacucuuuaggaacuaggcuugacugggaaucccauaaaaaagaccuaguucucucccucaaggcuuuccaucccuacuaacagcugcuaccacucaccgggaaaggagcuaaggguuucauguauagcaucccaugaugagguggacagccuuacccuuauuacugaugagaaagccaacucaaagaggguaagugauuuggccauguucacagcacuaaccaacaggagggagacucgaagccagauuugucuaugacaaaagccuaugcccucuucaccucacuguauuccucccaggucaaggugagcaggaaaguacaaaaacuacugcaaugaaaugcagucuggauuagggucagaagagggccucuccagcuccgcaucaaggagaagucuucacaaaaaagugaaaccuaggcagaacucuccuucaugagagcugauacaucacucaaacaaaaggagguggguggggcuuucuacacacagaaaaaggugagagggaauguggaaaauucagagacuaggaagcagcuccaucuggcuagaguaucagacaaguaugaggagauggugggagaaagaauagaaaggagguugggacuugaaaaugacugccacucgcagcuaggaauuuaacccaagcacagaggcugacuagacauuaaaguauucuaggcaggaggcaagaaagagcacucuagaugcaggugguuaaugcuggaagcaggggccuugcagggauuaggaggcccugcaaauuguccagcugagaacugagaagggccugaagugcagcagcaaugaaaacaggggaaaagaaacaauuuggaagauguuuaggaggugggaauuccaagaccuggaaggauguggaaacuuaaggauccugacccaagagguagacuggacacugauggugacaacaguacccacaacucuccuccuuccuuccugagccccucccccauguagccacuggccucagggaaacugaccccacucccacccagcuucaggaaagacccuuuauucuucuacaggugaucccauugcccuuaucgcccaagaauggccaugagacucauucuagcuaaaagacucaagggaagucugcuggaggacuucaggagaaagccuuucuccuagaaaagacugucucuauuacuauccuacauauugccauauacaaauaucaccucuucaucucuagaauuuggccauugcuaccaccugaggauggcacuggcuccaagauagcagagcaaggaugaaaugagagaagcugggaccuugaugucacugacccgcccugaaccuccuuuccuugccccuggauucccugauaggugagcuaauaaacuuccucauguucaaguaguuugcaaugguaucuccauaacuggugaccaaagcaucuuuacugauagagugugagaucauucaucaaacuuggaagcacaggaagauaagcaggucuggaggaggguagugauggcuggcuuaggcaucuagugcagaaucuaguaagugaucagaauccagaaaauaaggaaguugggacuacagguacagauguggaguuucagcauucuaguggugguugaggcaaugugaguagaugcacaaauggaacaugauacuauuucuccuacagacagaucugacaaauauauaugaauaucaaaucaccacugcucucccacuucuaacaaccacucauaccccucggagaaccugugcaaccuuaggcagggguggcagagauucgauaucccaaacugaaauucagaaauaaauguauuugcaaauaauauaucauacauacuaauagcuaucauuuauugagcaccuuuuauccuauguaccuaaaauucuuuccucaaauucucacagucauccuaugaggcagauaucaugccccucagcuuacagauaaggaaacuggggcuggcaaaaaaaaaaaaaaucacuuguccaaucacaaagccaguaauuacaaggcagacaaggauuugauugaacacaggacagggagcagggaggggaaagacugauggugaccauacagcacucccauuaggaggcuggcccaggugaaagggccaaacuaagucaggagcagcgaggauggcagagaaaaaccaauuucgacaagucgcaauuaaggcagcagagguuccaagccugcuucucaaacacaggucugaugaaggucaagguggaaccugagugauuuaacaacucaaauagucucucugggcuagcucagcaaccugacccucacucacggcccccacuguucucuaaacaaagcacuuucuaaccaaccgcugaaacauagucccccucaagaugaggacuccacauuacuaaaugcgcuuucccgagggcucagaaggugucguuccuaaacaauacacugcagcacaugguucccucugcagucucgguccaccaauuccuccuuugccaucugaccuuuugguuauugucugugugagcuaucgcucagcacuucucuguuuucccugccuguccccaucucucuuguucuaacuuccucuuggcaugucaauauccugugcuggaaaacaaacuucucacacauuuuggaagggcugcaggcccuuuaugucuucagcgaucauuaagacagccuccgaaggaacuauuccagaccuugaugaaucucuuugcaagaguguguaguuauagagaaagggauucacaauacgcagcauuaagacauaaugacuauuucacuuaaaaaagaacacaggaaauacaugcauggcucagaggacacaggaaugcaaucacauuuuuuacaaugguauagacacucuaaauuguacuuacaagguuuuugagucacaaaguaaacugacugguuccugaauuuagcacacugagucuaugcccaggacaugugauaacaggugccuguuuaaucuuaacauaugaaacguggaaacaaaacuuauggugcagaaacaaacggugguuagucaucacaacccaaagcaggaugaccaggagcaauaugcaggagcuucagaugugauuaaaauugucagagauaaagcugaaccaaagcagucaaucucagagaggcaggagccguagaugcagccaguuugaucucugacuugucauguuuacaacaggccugcagacaaacacacuuugcaucagaaugaaaaauauaauuuuuucauaaaaacccaauauuuaauguauuuacaccaucuuuuccaguaagccuuagagcagugucagauuagguuuaaacagcuucaagaguaacacacaggugauucagcaagauuaaaaauuacagugcugguucacaauagcauaaacccccacugugaaaccaaccaacaugguucucaguuucaagaaugggagacaaggaagaaaagucacuaaaguaugaggaucuauuuuccauuugggaaauaugcucuucuucggaaagacucagguuggaaggggagcauuaaauuuagaagagaaagauuugguacuuacaaaauacaaaaacggugugauucauguuuucugaaauagcugcuagucagcuuuucaauguacugcaugcauucaguccacugcaccgucucauuuucuacccauuaucaauacaaaaauuagaguaucuugacaacagauuuuucacagugggauucacuuuauucuagggucuuuucuaguaaaaauaaaauagcaaaggaacuccauuaucuagaagauuuucaauacagccuauuccagcuguaacacuccacucauucuucuaucaaauuauaguuaauaagcaucuaccacaugaaguauacagcucugacuccuggggaucacagguagcagcucacaggcugcuggaggagacagauguguccagaaauaaugcaugcagugugacagaugcuguaacagggaugugugaggcacaaauaggcaccuaccuccgcuuggucaggcagaagugaaggcugccuagcagaugggacacuugauucaaggaugcuuccgauaaguauguguuuauggagaaacaaaaugguacaccaaucagcaggaaucucaugcauaaagucucaaaacaaucuggaauauuugggaaaccgugagcaguuucugcauaccuagagggcaagucacuuggacuggcagggcuagaucagguagggugcuaagucaaacaaugaagcuuggacuuuaucucuaggaaggaaugagccacuacaacaaggagaagaggaggaaagguggaauaaaguuaaaauuugcugggugcuuaucaugugcaagacagcaugaauguagaaggugaauacuguacaucauuucucuucauuuuacagauggggaaacugaaacucagaaacgacucggcuaguaaguaauuagcggugccaaaauuuaaacccagguaaucugacuuuagagccuaugcuuuuaaucacugcagguauuguuuuguguauaaagauaugaagcacguguaaagauacuugaauaugaagcaagauaaagauaacauauuguuuucacugaauaugaggguaaacaacucaccauuccaaaagagggggaaaaaagaaaaaauagaaggcaucuaaaaguuaccccgcauucaauauugaaacugugcaacaaagacauaagaacaaaggaagcugcuauccucuaugagagugguucucaacggagggugauuaugcccaucagggaagaucuggcaacaucuggggagauuuuugguugucauuauuggaaaagaggugccacacaucuggugagaggaggcagggaaugcugcuaaguauccuacaagggacaggauaaacucccacagggaguucaagauaguucaagcuuaccaauacagaauucaagaacacacacaguaacuggacugcaaaaaguguaguucacuaucaaccaagaauaccagaagcaccuagggagggacagccaaaagcuguuggagguaaccaacaaugcuuucccccuuaaacaguuauuaaaucacauucaagucauggaugauaaaagguauuuuuaauaauuuuuuucaagaaaaagacuucuuguaaaauugaggggcuauuuauacacaguucaucuuaugcggccacaaccuggauaucacuuuugaauuuuagaaaacuggauguaguuaugcaggagagacacuuucuagcccagucacaucuaauuuaauacccaaucaagaccacagugaaucuuacguuugugugugauuacuugcuucuaccuacguuuauaugguuccugacucuguaccuuaaguagcugauaccaaaagauaugaguauucacauauaaacuuaauauaauuugugaaacuauugcuuuucauuuuuucccaaucuucugggauauuuuauuuauuaguccaaauugaaugaaaauuguaauuuuugguaagugagaugcauaaaauuuaagcccucgccuuaugcuuguuuuccuagcuuauuaggaaauuucuaaccaaaagcaucaaaacugacucacaguauucccucaggaaucucaggaugauugggaaguaacauuauuuaguaguuaauggaugaacuauacacuuuaacugggcgaaauguaugguauaccuuaacaaagccauuuaaaagaagguaauggaauuuucaucuuacugccauauugguuucauuaguuuagucaauacucauagggaaaaaugagcaccuaaacauucaucaugcuacucagaggauuaaaaucuugccaaaaugaaaauacuaaucuauuucauauuuguagcagcaauuuugagaauuaaauuuauaaucaaaucuugugacuuuuguuuuccugaaaauguuuugcuaaccaaaugaaaaacuagaaaagcagucugagccacauucaaguuuugcuaagagaacaaaaagaaaguuaucuaccucccucagcacagagaacuagaaaggauacaacaaaaguuucccagaacauuacucaaacaacugagaccaaccauaccaaauauccuuacuugaauaaacaacagauagcagcaaaagacaaacagcuaaaagcuauuguagggcucaacacacaaccaauagcucucagcuuauguaaacuugaguuuuuaaaucucggauaagguucaaacugugaacugcaugaauaagacuuucugcuaucaaggugagguugccccuaaagcaaguaaaaaaggcaaauaccuccguaacauuaacagggaugcaaagauacuguguuuuauuuuucugguauuuuuuuuuuaacagaaaauuauuuuccauuuaaauggaaauuaaauggaaauaaaauuauuuuccauuuaacugauauucaucuuaccauauaagaugaguaacuguugucuucaggcugaaacacuuuucaugaugacacauuaauuuuuuuucuaacaucgaugaaaaacuuuaucuaaguugaagaaaaaucacuucaaaacuaacuuuucuauuuguaauuuggugcuuaaauaaauccaaagaauguuuuucaaaaugauacacagaaaaaauguuuaccaagauucucucauauuucuuccaccuuaacuugcuauaauuaaucuuuucuaauucacagugcauuacuguaacaauaauacaagcaaauucucaaguaaccauuuaggaaucaguaaaauuauuucuacuaagagaugaaaugugugcauaauuuuaauguaaaauuagccaucuucaucuaagauagaauaggaaaaaggauaaucacaaaauaaauguuaggaaaugcuuuugaaaaauagagauuuuucuaguuaauuucagagaacaguaggcuaauugauguugccugcuuaauuuugacuuuaauuagugguaaucaaaauuacuaaguauacuaucucaaggaaaaacaccauaaugguagcuacuggcuauuaacuuugaaguaacuguuuacuuuuucauuuacaaacuaaaguaggaguuaauuuuaaguaauuaaugcaacacacaucaauuguaccuaugcaccauaauacaggaagguuaggaaaaaguuuuuuaaaaugucaaguauguacagaacauaaacauguucauccaauguuugaauaccucuacaugcaaguuuuuuuauacacaccauuuauaaauaugcaaauauauuuaauuuaguacacgccaaggguggguagguguuuaacacauacacuuuuaagguagcauagaagauaaugugauuagcuuuagcagacaacaucuguguuacacacauggccaucaaaauaauuguggcaugcuuuugugacaaggacagaggccaagccuguuguuaaaugauuauuuccaacaacagccugcuuaaauuauuguuuaguuauauggcccauauccaaaguaacaguauuacauaguugcuguugccuuugaaucacucaccaauuuucagcccauuuguaaaacaagauaagcaccacuggauuauaaaaaauaauuauggaucaggauuuuugauucauguuucuuugacaaaauuauuccauuugaucccaaguccuggcugcucucuugacagaauaauguacacgcucuacagcugauaggcaugacuuugaugauuaaauaggaagcucacauuccagaugacuuuagacuccagauaauuuagacuuugcacuucaaaaagauuucuuuacugucuuaguaucugaucaucaguuaccuuuuucuaauuguuucuaucucgacacaagaaucuauauauuaucuacaauuuaggauguuuuugugauuuuugccuauuuuauucauacaguacaccaaagaauguuacaucaucuuguaaguuacaauauuuuccugauuucauugggcgggugagaggagaaauauuuuggaacauaaagaaaaguuaaaaauacaaaauguacacccuccccgaaaagagucuauuuuauuggucuugaaaggaaauaccgaaugagaaucgaacugaauuuugcucaguauaauuacuggggaaacaauauucaaaacaaccuccuaaaggaaaggguuaacaaucuuguagcuuuaacugauuauuuuugcuccuuucucccgcaaaagaauuacaccuaugaaacuggaauucuguacacuaagaauggcaacauuaacgcugaaacuuuuagccaggaauaguuauccuagugugcauaaaacuauguaaaaacugauucacaaaaggaaaugcccagggccuaccccauuaugauuaacuucugagaugaagcgacuaagagaggauacuuggcagccugaacucgauuucucagaaagccagcucuaucagagcgggggcgggggggcgguuucccuucaccagacucagcuguugccuuaucuaaaaugccuuagcgaucuaaaacugaaagagaaagauaaacaaaacaacaaaacgcuccggauuuagaucuccuuuagguaguuaacacuguugcaaaagcaaaacaagcacgcaggcgcgucggucagguugucacuacaaacauacguaccuucucauccaauguaaggaagaggaucucugcgagcucugcugccuuuuuguuugggcucucuagguuaauguagugauugcauuuuaaugacccacaaacaggagcaaaguuauuacugggucgcuuugagagauguuuacuuaaaugugaggauaaacccaggucgcuguagaaagggaaaauauuuuccguccaaacguagcauuacccaacuacgaacccacgcaaaacaaucacaaugacccauuaaugcguuucaacgagugaacuaguucacuucccuaauaacacugucaaggaaaacgccuucaacaaagucgagggaaaccaugccuuccacacuggugggacgcagcugguauaacccauucugccccucuuugagagcugcggggcacccagaggcuuuuggagaaaaccgguuuggggaagaguuuuggggugcugcugggagccggugugcugaguaaacuuagaaacgucaaacucaacuuugcuuuaugaaggaacucaaaguuaacucacccugguacguccacccucucccugcgcgcaggggacagcggccucuccuccccaccgcgcagagucgcggccgccgcccucgacccaccggugacagcccucaaagcgauggacccccgcacccgcccugccgccaacccccggaacgcgcuccgggccgcacccaccuugaugcccugcugcugggugguaaggguuaacuuggauucauccaggagcaaaacuucgcaguaaaauucuuccggaacagcgcagaaacagcccaugucgguuguggucgucuccagccaggagagaaagcuaccaccgaggcgcccagccgcccccuccacucaagcgcgaugcauuaauuuauuguccgcgccguggcgagggugagacgagcagcucccggcgggguccggggaccggccgccgaaccgcccggcggggcgggagcgagaaaggcggaaaagcccgggagagucagcgcccgggagccgccggggaagcgccggcggaacugggcgcggagggcgguggcgcguccccgcgcauccu

SEQ ID NO: 192747 - RNA, 45951 nt, Homo sapiens
gcgcggcggccgggcggggcgagcggaggcgaguggaggacgcguagacgcgccgcgguccccgccugccgcugcuccgccgcagucgccgcuccagucuauccggcacuaggaacagccccgagcggcgagacgguccccgccaugucugcggccaugagggagagguucgaccgguuccugcacgagaagaacugcaugacugaccuucuggccaagcucgaggccaaaaccggcgugaacaggagcuucaucgcucuugguggguggccgggggucgccgccgcugguagggccacgggagccgccgcugccccagcugcuggggaaggaagcagggagaggacucgggaaagguggagucggagacagacgggacaagcagcauauucagggaucaggcuggccucccggaaagcgugggcaucggaggaccccgcgggggcugcccaggcugagggucgcggggcuggagggcagcugcggcgccgggcgcuggcagcuggaagggccagcgcugacguaugucugccccgcggcccggcgcccuauuccugcuguccugcgcggugggcgcggacggcggggccccugcgggcgggcgcguugacggagguacccgguccuacccgacccuccguggagcuccgcccggagagggcgccucucgggugggcgggggcugcuacugcagcgugugcgggaguccgggccucucgggacgcuccccgcugagcgcagcuucccaggcuggagcgcugcccagcaggcccugcgagagggcggaagcgggugccugggaccgucccgggcgccggggguugcugcgcaaagcgccggggcccccugcgggagguaggagaggcacaaugguggggcugccugguauccccagacuucaaggcauagcccagcggacgcgcaggcccagcuuucgugugguuuguuuuucucgcuccuuuaaucgagucgagaggaaaacuccuacaacaggcccagccucgcggugugggcggcggcugucccgcgugaacggcucucaugcugcccgacccacuucucuccuugugguccccaggugucaucggacugguggccuuguaccugguguucgguuauggagccucucuccucugcaaccugauaggauuuggcuacccagccuacaucucguaagugacacacccugcagccguccccuucccuuccuccauuccuccccgcagggcugcugcaguagacugcacauccgcaauucccgggagaaaagugaaagcucggcggggagggaugagguuggacauaagggguggggauaguauucaccauuuuggaaccuuaacuuaaucccuaucucuugacgauuagcccagagguauuuucauuagauuauccuggugaccaguguccccucucuuuggcacacuaacaggaaagcgcuaccacucugucguccucccuuuacuggugggaggaucucagaagguacagggagcugagcacuucugucuaguaauuauuuuaaugaguauuucaccauauauuuaugcaccuagagaguaaaacccuaucaauuaggucuuccuuaauucauaauuacguuaauugagacaguagggagaauuuucucauuuucuuuuauuuugaaaaagccacauguuacagacaaacuugggaaaugcuuacccuaguguaaaaacaaaaaccuuuaaaaaugcuccaugauauagcuccuugguuauauaagugagucauuuauauaauugagcuacuuaaaaaaugaauuuuuacgauuaggaucugaauuuauuaccaaaguuguuuuuauucuacaauguguuuauuuuuuuuaauucuacgauuuuauuuuuccauucguucaaguaggaauuauuccucuccagaaaugaauuuuguuuugcucuacaguucuuccuaagaaagccagugguuuuuaccuucauucaguuggucucugcuacuuucuucaaccauagggauaaaaauaaaggaagaaaaaauuuucaccuaggaggcuaagacacagauaacacauuauuacagcuuguaucugucacuaguuaggcuagaauuuagucuaugacuauaagggaagaaacauguuuuagaaguuaguucugauuugagcaauuaaauugcaguuaccuaguaguuguuacuguguuaguccgguacagacacuuagucauacuccagaaagucuagcuacauauagcccugaggccuaccccgggcucugcuuuauggaggagacucaaggaaaaacgggauugugugcacagaauaaagcauacagacccccgugagcaaauauucaggcggucgguguuacauuagucuaaucaagucuguucauugcauaaccaauaugauuguauaauuguccaaaagaaagaaaaaguauuugaaaaugguggucuuuaguagcaucaaaauccauguugcuuaaagugugaccugugaacacugucuuagucugcuugggcugcuauaacaaaauaccuuagacuggauaauuuauaaacaauagaaauuuauugcucacaguucuggaggcugggaaauccaggaccaaggcaccagcagauuugguguccggugagggcuugcucccugcuucaaagauggcaucuucucacugcuuccucacaugguagaagggucaacuggcucccucaagccucuuuuauaaggacacgaaucccaugcaugagggcagagcucucaugccuguuucuuuucuuuugagacagagucucgcucuauauugcccaggcuggagugcagugucguaaucucaguucacugcaaccgccaucccuggccgcccccacccccgccaaauucaagcaauucuccugccucagccucccuaguagcugggauuacaggcgugugccaccacgccugaguaauuuuaguauuuuuaguagagaugcgguuuugccauguuagccaggcugaucuugaacuccugaccucaggugauccaccugucucagccucccaaaguacugggauuacaggcgugagcuaccacaccuggccaagcccucaugucuuaauugccuccuaaaggcaccacuauuuaauacuaauacauuggguauuaggucccaacauauggauguugggggaacacaacauucagaccauagcagucaccuucauuuuaacuauucuccauaccucuuguaacucuuaugcucccuagccagaguuauuuuuuaaaauacagguucaucuauuuagcaaaaaucaaaugccagucacauguguggcacugugguagcacuuuagauauggcaagaaauaagguagucauacucucuguccuuguugaaugagcagucuacccaggcaagaaauaggcaaaguagugaccgugugguaagcccucuaaaguaaauaaacaguucugguagagaagaccugaggaaugagaaggggccagccaagagcagagccagggagagggagaagagugugucaggcccugaggcagcacacagcuuagcucugugugagcaaagaguggugggggaggcaccagagaggugcaggugccagcagguagggucagugguagaagugugcauuucauuccagauggugguagggaguuugcauuuucugauugccuuggauggguuuuaaauagggggugacaugauacgauuuauauuuuaaggucacuuuggcugcugugaccucuguaaggaguucgcgaucuugccaaacuauugccaguaauuuacuuccuuccuuucucaccuuucagccuuucucuugcuguuuccucuccuugggccaucacaagaaggggaguagugucaguauugggucaagagacugcaggaugcaaagaugaaauugggaaaagcucacuuggcuuccuagcuuuucucccuuuggacucccuuuggaagucugugagugaagcucaggugcaccuggcuccuggucagggucugcugcacguuggagcauguagaugguugaagacuugcccagugcucacuggggagcaaccaguaccuuauuguauaccccucuuccuacugguuguucuuuccgugugcauaauuucccuuugagcucuuugagaacagggucuuucaucucugacuucuaguuucuagaauuuuuggccaucuuauauaggcaauucggaaucuaauuccagccuuccuuucaucaagaacuguugacauaauuaccuuaaucuccuuacuucccucuuuuacugauaacaggaggcagacuacuggaaauguuuauuauaaagauagaccuccccccauugcuaagauauaauuuagauacuuauaaauuguacacuuuuaaaguaugcaguucaguggcuaguauguucagaguuguguaaccaucaccacugucuaauuccaaaacauuuuuaucaccccaaagggaaaccaucaccaaucacucccuauuccuccuacccagccccuggaaaccacuaaucugcauucuguuucuaugaguuugccuauucugagcauuucauguagacggaaucauacaauauauggccuuuaaugucuggugcagcccugcuucuaaugggauugcacaaauaagaguccucuggaggguguaugcugugcugcacccucauaugugaguaaguccuccuggugcagucccuccagggugggcgcuagugagccagggcccuaguccuguacuugcuccuuuguacaaauggaauugugaggcaaacucagacuuuaucuucuauuuaaggaaaggggaagguuugcuuucuguccuacccaguaacuuuuuugcuuaaaauucuauaaaaaugucuauuacuuuuccucuuuuuauuucauauuuuccuuaagacuugggcugccaccuuccugggacuaucagaguugggccuuaaagaucaaacagguaguccaguuccuuuaguuuuaaaaugacaauucagggacagagaaagguggaguguguuucccaaggucacacagaggccaggcuuggucuggaacuacacaggaauguaaagcacauuuaggcauauuuuagugccaauguuagaaagauuaaauauguuuagggggcggggcaugauggcccacaucuguaaucucagcacuuuggggugcugaggcagagggauugcuugaggccaggaguucaagacgagaguccagcacuauauauuuaaucuuuaacaacacuuuugaaaucucauacccaguucaguaaugugucauuuuaguuucuguguguccucacaagcccauuuuaaacuuuugcugcugguguaaagaguuauauugcauuuagcucuuuguaugacuccugaaaucuguguagcauuuuauuuaacagauauguacauaucucugucuaagugcuuugcaaauauagcucauuuaauccucagaacaacccuauuauguaagugcuaugauuauucccauuuuuacagaugaggaaacacagaaagagaauuugaauaacuugaucaaggucucacaacuagcagaugaugaaacugguauuuaaauccaaagaaucuggcuccaaauuucaugcuuuuaaugauuacguuaugcuaccucccuuguggcucuuugaaugucccacaaacacaacaucaccuuauguagagaugaaaauuaaaaaauguaggccuuucaaaaaaacaguugacccugucaauacauuaccuuugugcaguguauuuuuccucucaaauaagguacugucaucccaaaucauauaucugcacacauaggcauugacuguguuuuguagacauuaguuagaauauguuacuaacaacuuuucuuaucuguuauguagcuuugacuuaugacagcagaggcuugcucuguuuuacuagcacaaggccaccugaaaauggcacacugaacuggauuuccuaaggggaugcagcguugccuuuaguucuguuucaagagacaaguaucucaagggaagauguuuggggaugaccccuaucgaggucagaucagaaagggauggcaagaagguuaauuugaagaaaaaaaacaaugaaaauaucuacaagaguuguaacacaguuaaccacaaguaaaagcaacagcauccucuuagcuaaaugaugcucagcacacaaagggaggacacauucuggggaacacaaguuaaaaagaguugcagucuacuugcuuaaggugugcauugacagacuccuaaagagguuuauuacccagaggagacuuugagaaagucaccguggugugaaugacaguugugaacagacacuuucuguuuugcagcuagucacuggaagcagagcuguuuccuuaacaguacuggaggauguguauuuguaguucucuucuuggacucauuaguaggggguguauuuguuuucuuguggguuuuuuuuuuuuuuuuuaaauuguaauuauguuuuguucuuuuuuacucaugagaacuucagagcagauguauuuucuacugagcugccuauguucccauuacacuagcuuuucucucuggaucuauaugugcuuuguuaaaguguugaagagcagagcaaugcaugccugcgcuuugccuucugggguaguaugaagcacaagccaauguggccuucuggccgaugugcacuuggauaaaaaauauaacaggcauucugcaaacugugacuuaagcaauuuacuuaaacauuuaaaucuuuaauuuacuuaauuuaaaucugaaaucuuaagcauuuaaacauuuaaccuuccucaacuuuuuuacuguccuuguuucacuuaacauuacugcuaagagugcuggacucuuuuaagaugaaaguguuguggagaaaugaaaaaguaauaaaaauauccuuauaacaacuugugacuauuuuguaaaauaaugacagccagcguuucaguuaagguucgcccgcuugccugugucauaaagaaaauaaaguuuuaaaaagcaaauaagaugaaugauuuaaauuauuuauucaugaucagaguuucugggcucuaaagcaguuguggaggaggaucucauuucuaauacucuauucuggaauguuccuuaugagcuuuuuuuuuucucuuuaugaaggcccuggagauuuagucuauuuguccuucuuucugucguagccucccucaucuccuucugaccuggacuucucuuuuucaggacugacuuugaaugaggacucaguuuucaacuuaauuuuuucacauggcauuuaaaacaaguauaaauacaaauauaacauguuaagguauuuaguggugauucauaacauuaacaauuaauuuuggggaaguaugaauuaauauggcagaaguuuuaaaacaauuucaaaauugugaaugaaauuacuuuuuguagcagcugaaauauaagugggggcuguagaaacguacccugacuucauucugucacuugcacacuuuccugauuccagggaguggagcuuaucagucacucugagucaugugucuacuauauauauccugcagccucugauagaccaagugaucuaguuaagggaucgcucacuugucuagacugcgguccgcaucuaagguggcccuccuuuaccuaggaaaaggcagcuuagguuguuccccuucuaaguugugagguuacuugagauuaaguuaaacuuuaugauaccaaucugacacagauacuuauagaaccacugguuuuauugacaaaggguugucccagugggauuugcaucugcucuuuuauugcuccuggcauuaaucuuuuuuaccaucaaucauucaaacaguuuuuuuggggggacaggcagggaggcugagauggguggauugcuugaguuugagaccagccuggacaacauggcaaaaccccaucucuacaaaaaauacaaaaaauuaguacacgccuguagucccagcuacuccagaagcugaagugggagaaucaccugagcuugagaaagucaaggcuguggugagcuguguugaugccacugcacucagccugagugacagagugagacccugucucaaaaaaacacacacacacuugggaggcugaggaaggagaauugcuugaacccaggaggcacagguugcaaugagccgagauugcgccacugcacuccagccugguuuuuuugaguguguuuuuuuugagacagggucucacucugucacccaggcugagugcaauggcaugaacacagcucacugcagccuugacuuucucaagcucaggugauucucccacuucagcuucuggaguagcugggacuacagguguguacuaauuuuuuguauuuuuuguagagaugggguuuugccauguugcccaggcuggucucaaacuccugggugcacacacacacacacacaaacacacacacauucaguuuugaguuauaaaauguuagcuaaaaggggucuuagagacuaagcugcuagggugauagccaccuguaacagauguggaaaucaaggccacaaacugaaguuaauugacauaggucacagguguguugggaccaauucagucuuaaguguagggaugucuguccacauuccgcauuguuauauuugacugugacugacucuuccauuuugcauuuaaaaacaaaaugguggauagugguaaaugagaucacuguaauuaaacaccaaaagauuugaccacugaaugacugcauuuuuuucuuuauacuucauuauagguauucuauagacucaucuuaauuuuuuuuuuuuuuuuuuuuuuuuuuuagccagggucauacucugucacccaggcugcagugcaguggugcaaucaugacucacugcagccuugaccucccaggcucuagcuauucucacuccacugccucuguaaucuuuuuucuuuucuuuucuuuuuuucuuucuuucucuuucuuucucuuucuuucuucuuucuuuccuuucuuucuuucuuuucuuucuuuuccuuucugucugucugucuuucuuucuuucugucuuucuuucuugauggaguuucccucuuguugcccaggcuggagugcaguggcgcaaucagcucacugcagccuccaccucccggguucaagcgauucuccugccucagccucccaaguagcugggauuacaggcaucugccaccaauuuuuuguguuuuuaauagagaugggguuucaccauguuggccaggcuggucuugaacucaugaccuuaggugauccaucugccuuggccucccaaaguguugggauuacagacaugagccacugugcccggucagucuuucauuagucuuucucguacuguuuguugguuuucucucuugcuuuaaaagcacauauacucugcagugaaaaagauauguaacuuucugaucacgcauaguuuccugccuucuuuuuuucuaugaaggagaaaaauauuuuccuuauuggcauggaaacgaacuaguguuuaugucuuaaaaugucugauucuuuuuuccuucuuauuugagguacugauaauaggaaaaccauuuugaauuacuaagaauuccuacaucauacucucugauaaauacagccaaaagcaaucccaugcauggugggcauggaggauggucaaguuaugugucugccauaacaaaaaggauuauaaacauuaugguccauguucuucauauucaauuuccaaagaaccuaucuuaaccucuggaauauuugcuauuaaacauaaguuaccacauuagaaauaaaauauaaagcagauggaccagaagaugauuccuuucuguucuuuaccaauaggacaucuuaaagcuuuuuauccauauauauggauaaaauuaaaauauauauggguauaaauggauauauagauauauuuuaaugaacugcuuuuuuuuccacacugucagucucugguaaauaguugauauugguacaacugguuugaauaauaaagccaaugcugugaagacauacuauuacuuaauuuuaugucauuuggcuaguuugaauuguagcaacugaguuacuuaugaaccaugcacagaacacauaguauguaccuaugugucuuaggugugaguagccaaaagcauguguauauggagcugauuauuaccucuugagcaaacagcuuaacuuuuauaaaauucaguuuucucauauguaaaagguggggauaggguuggggggaguugggauaauauaugucaaacguuuaggacaaaucaggcauucuguaagugcucaauuaaggggaguuaguuucauuaacauauaaagaggaaaauugacuuaaucauagucauaguucuuuaacuuugugucauuaagcuuuucauugauuuaaggaaaaaccuuccuaagaguauuuucuuucauuuauuuuuucacuuucauuuuuuguuccuugucuuauuauuuuuuuccuguacuuaaaucagcuuaagacaucauuauucaaagaauaaaacacaguaaaguuuuguucuuccaaguuaaaaauaugugauauggcuagugguuuucuucuguacugguacaaugguguauauguuccuaagcauugaguauaaguuggacuaacaauuuuuuaauauuaaaucuuaugcauaagaaaugugaacuugguccuaaaagcaagaacucaaaacagaaauauaaaaagguuguacaguucacauauaaaaaagcauuugaucuauuuugcaugguaagaacaaaauagaucugaauuaagaacuuguaaaaguggauguuuuuccagauggauuuauugugucugaaauaauuugaaaaauaguauggaagguugucccuuuccugucucccuccaaguaagcauuagcuguaaguauuuugaaauauugauugauagaugaaaccucagcaaaagaagaagagcacauuuugaccaauaccgagcuuaagcuuagcuuagaaagcuuuuggugaugaugcacaccuuuuaugucaguucagugagcugcagccauuuacaguggccuaaagaauaaugaccuugaauuaccucauguaagaagucuggagguugaaauuucaaggcgcuacagcagaaauccaugcucuuuuccagcgacuuuggaguauaaucuuccucgcccacgccuguuuccuuaauauauaacaagauuguugccauauagcgcuaaggcuuucaagagcaggaagcuggaagaccuuuuauuugugcgccucucauauuuuaucagcagaggaaaauuuugucccaaagccuucuaccguauuuccuuuucuguuucauuggucagaacugugucacauggauacccuuaacuccaagggggcuaagaaagucaguaucuagcaaaaagcaaugggauuaccaugguggauuuguacuaacuuugauuuauccccuaggccuggggcaggagccuagcuucccugagucaagacagauuugccagguacauguauauaaaaucagggcucugugggugaguaggaaggacuggcuaauugauaggcaaggaacagugucugcuauuuccuugagcaaugauagugaccgguugcuguaauaggauuuuugaagcagcaguguuaccaugacaaucugaucaugcuggugaccaucauucagcagugaauaguuaacugccaggcaguguacaauggagagauugagcugcagauauaaauuuggaaguuauuagcauauauaugguaucuagauuuauggggacagauacucucuccagaucaaaacaaccaaaauggcaugaugguaauaaaauaguuuuaaaaaucugguauuauagaaugccuaggugguaagugaaguuuuuuuuucucuuuuuuguuuuuaaauggauuuuauuuuuuagagcaauuuuagguucacagugaaauugagcagaagauacaaagauuucccauguacccacuacgccuacacauacacagccuccucuaccaucagcaucaccuacaagagggguauguuuuugucuuuguuuuuuuuugagauggaguccugcucugucgcccaggcuggagugcaguggcacgaucucagcucacugcagcuccaccucccggguucaaguaauucuccugcuucagccucccgaguagcugggacuacaggugcacaccacuaugccuggcuaauuuuuguauuuuuaguagagacgggguaucaccauguuggccagucuggccuugaacuccugaccucaagugauccacccuccuuggccucccaaaaugcugcgauuacaggcgugagccauugugccuggucagagugcuguuuuuuauaauuggugaacauacauugacacaucauugucaccuaaaguccuuagagaauguacagcuuacuugugucaugggucagggaauaucuuagguuuucugaaagaugacacuuaauuugggaaggagauuccagcccagaaucaucucugcucaaccuuguuuucuucacauguuaaugcuauucuuuggccauccuugguucuugccuuugcuuucagaaaauagcagccaaggugugaacaaguagaugggccagcaaggguggagugaacugguaccaguuacuggggcccaguguacuggaugagggauggccagugaguuguguucauauauguaccaguccaaugccaauguaaagaauuucugccauucuaccauugcagagugggccugaaaaauguuuucagcaauguucaaauuucuucccacuaccugcaaacaugaauuuggggauuucagcuaacuucuuacuaccuguagcauaugggauuuggaguaggguauaauuaaaauugauggguaacucuaaucuccuuuuagccuuauuagccauauaaacccucugacagcuacuuaaacaaagaaacuagagucuucuuaucucucucuuuucuucuuaaucuuuuaucucccuauaauaauaaguuauuacuguacuauaauuaauaccuguuaagggaguauuuacugagacuuucuuagugcuuuacauauauuaacuacuuuaaucuucacaacaacacaaugaggcuuauccauacuagauaggugaacaaacuaaggcucagagagauuggauaacuugcccagggucauauaucuaguaaguaguagagcuagaauacagagcuacaaacuaaggguggugaaaugcugcaaagccagaaaagcacugagaagaaaugaagggaaagcccuggccauuccauaguucaguguaaucaguaacuuaugauaguuuguauuauuuaaguagaaaguuaaaaugagucaauuucaugugaugggcuguguggcucucuuuucuccuugugugucucuuuguggguguguguguugaaggccuuuuaaugcucuaaaacaaaacagauuauaucugaccauuguuagagaaauuuguaaaaaaaaaaaaaaaaucauuagcugggcugggcaugguggcucacgccuguaaucccagcacuuugggaggccgaggugggcggaucacgaggucaggagaucgagacaauccuggcuaacaaggugaaaccccgucucuacuaaaaaauacaaaaaauuagcuggcguggucgugggcgcugucguggucgugggcgcugucgugggcaccuguagucccagcuacuugggagguugaggcaggagaauggcaugaacccgggaggcagagcuugcaguaagccgagaucgcgccacugcacuccagccugggcaacagaaugugacucugucuuaaaaaaaaaaauuauuagcuguuuucucaaagagaaauuaaaugaauauagcugauguucacuuuaguguuuauuuuuaacaaagccucauagagaaaacuagucucauaggagaaaaucauuauagaaagucugaugcucagccaggcacgggggcuuacgcuuguaaucuuagcacauugggaggccaagguggguagaucgccugaggucaggaguuugagaccaacuuggccaacauggugaaacccugucucuacuaaaaauacaaaaaaacuagcggggcgugguggcaggugccuguaaucccagcuacucaggaggcugaggcaggagaauugcuugaacuggggaggcagagguugcagugagccgagaucgugccacugcacuccagccugggccacaagagcaagacuccaucaaaaaaaaaaaaaaaaaacaaaaaacaaagaaagucucugaugcucauucuuuuccaaauggaaaucucccccgcccccuucuuuuuuuaaucaauuuuaguacauacucauuggaaagaccuuaaguaaaauucuguuauucaggauuaacuuuauacaauuugaaauguauugcauaucuuucuggauaucauucuuggucuguaaacauauaaaaacaucuuuuuuuaaacaaaaaauuagaauucacuuuuuacacucaacacuguaucuuggacaucuuucccugucaauacccuuuuuaaaggcuucagaauauuucauuguacggaugugccaaaauguaaacagucuacugcccuuuacauacacaugcucuguaaccuucuaguuuaauaaauuaaaauucauuuuaauauaacuccuuucucuuuaaauuucauuuugucuauauaaaauguagaauuugaacuaguucaucucugagaugucuuccaacuccacacauggugauuccuaauucugcucgauuaauuuuagagcugccagcugcugccacaguuuugccaacuauccucugccuuguagucgugccucugcugcucacccagcccuggcuucucuugauaucugcuuuggggaagcaaaaugcugccccagaacaugguagguggcucaggagagagaauaaggaagccacagcacugagccuaggcggccaggcuuuagaacaguggugagaauaugacaguaaggugugcagagagcaguaagacuguggugucuguccacagaagcuguauguggguguguuaguucugagcccaggaucagugugacugccagaggaugaggcgguacuagagacagaggagccuguaaaagaguggaccaggccuguggagagagugguaggaauuguugccuguugccauggggucauuccagaacuccucuagggguuagcugugcaggcugaaguuccagcuagacagauacagggcuuuuagaugcaguucuugaaaucuuagugaacaguuuuauuucaguguuguuaucuugaauccuuuuacaaauuucagaauauucaggugaggguucuagaucauauuagaguugacuuauucuaauuuuaguagagacauuauucaguuugacuucuacguccaacuuuucuucucuuuuggccucucacucauuacuggaaagggguagccugcccucuggcuacagcugauuauacccaaacuggccauuuggauuuccuuucuuagaacacguagggcaggugcugugaagacuggaacuuugaggugguuuccaaacacaguucugcauuaugaucaccugcacagccuuguaagagcagcugaaucacuaggucugaagaaggacccaggcguguauauuuuuaauaaguucuguagauggauguggaugaucaucuaaguuugaggaccaguggacuaggacaccaacucagaacacuauccuguucacuucugauaguuccccccugcaaauccaggugaguagaguggaggguagaauggaccuccagggaucuggacacugagacuaugacccugccuccuauuuuucugcucuguggccaguuuaaccuuucucugggguccccuccaaaaguaagauugugaccuccuauuguauguauaguaauucaauaaauauuaaaugccuacuuuguaccggacauuuugcugagugcuauccagcuugccacugaacuguuuucuuaauuaguaaaauagcauaggauagugaacaaagcacaggcuuuggaguuaauuuuaaguguaagaccaauccuugcuacuuguagcugggugcccugcacauguuauuucucuacacuaagccucgguuucuucugcucaaauacaggaacaauaccuauccuacauggcuauuaugaagguuaaauuaaauaauagguuucuaccccuccauucuauggcuuggccauuuuggcuagacugcaagggaccuaagagcauagagcauaucuuaugguuucaugaauccucuguguugccuaaauugcuaccucuuuauucugauacaccaaguuggaauaugauucauauuuguacaaggcaguagaguguuuuguuggagaaucacuuuuaucuacugaauugggacaaggaagucuaaucagaagguauauaaguauccugggcaugguggcucaugccuguaauccuaguauuuugggaggcugaggcaggaggaucacuugagccccaugaguuugagaccagccuggggaacaaggcaaaaccccgucuuuauaaaaaaguacagaaguuagccaagcaugaugaugugaaccuguagucccagcuacuggagaggcugaggugggaggaucacuugaguccaggagguugaggccgcagugaguugugaucaugccacugcacuccagccugggugacagagcaagacccugucucaaucaaucaaucaaucaaucuuuuuaaaaagaagauauauaaguaaauagcauucagaaaaccucaaguuuguuuuuuuuuuguuuuguuuuuuuuuugagaccgagucuugcucugucacccaggcuggagugcagugguggaaucucggcucacugcaacccccgccucccggguucaagugagucuccugccucagccucccaagcagcugggauuacaggcaugugccaccacgcccggcuaauuuuuguauuuuuaguagaggugggguuucaccauguuggccaggcuggucuugaacuucugaccucaggugaucugcccaccucggccucccaaagugcugggacuacaggugugagccauugugcccggccagaaaccucaguuuuaagcuuuuuucuucucucaccaugacuacauggggcacuucacuuuuuugaaccucacguuccugagugagcuagaccaucucuucccuuuuuucuuguuuuggguaguuugugauuguuaugacacauaaagacauuuuuuaaauugaacauugugcuauuuuaaauuaaaacaauuaaaugcuucaauaauaugagaagaucuauuaaaaaaucucuuuagcuuaauagacucauuggccuuuuccuggcuucuuucauaugccuugguuuucugcaaaguugugaucaguguauguauucaauuuggaguucuuuuauuucuacuuuucaauguuacuauauaguguucuaguauauuaacauggggacuuuagaauucauauuguagauaugaauuaaaaaagaauuuuuuuuuccuagaagagcugaacuguuaggcuuccuguuuuucaaucuguggaacuugacuaacauuuaaaaaauaaugaaauagaauggaauuuaaaauaucagaaugguuucaggaaauaucuauuuaaguuuauauuuuuaugugaagaugucuguuuacuggaucaugauguaaaauguaugcuuaccgaggguuguggccaaaagaauuuaaaagccacuggauuaacaaugacagucccaucacauuuugagguuuuuacgucauauucuagaaaagacuguuuaauucccagguguguccugagaguugcuucuuuuggaaguacauaguugugagcuauugcguucacaaaacuaagaccuugagugaaauguaauuacguaucuccucugcccagaaugaauguacaggaaacaaauuuuuauuauacuaauaauuaaauaaauccaauuaaauauggauaagccauacuauaccaaaugaaacacagcgggagaagaaaucuuacacauaaaggauauacuguguucuuugguuaacaugcuugucuacacuuuuccuuuggccuucuauuacauucgccagcuucuaucugaaggaagcuaaaaaaauacagacuuugugcauacauuacaagccauuuuuuaauaaucagcucucuuaaauucauuuuauaugauucuuguacuuugaaauauuuggggcugggugugggagccaccagacugcacuuugggaggccaaggcaggaggauugcuugaggccaggaguucgagaccagccugggcaacacagugagaccuugucucuacuaaaaauuuagcaaguagcuagguguggugguguguaccuguaguaccagcuacuugggaggcugaagugaagggaauuacauaagcccagaaguuugagguugcagugagcuauuauugugcaacugcacuccagccugugcagagacccugucucaaaaaaauaaaaauuuugccuagucuugaaguucaaagcaacauucaccuuauuacuuguuccucucucugucuuccucauuaguaaucaucucauugagcuacaauuuuuccccuuuugguuauuuucuaaaacucacacacauagcugcuucuaauuaacuguacaagggcuuucuuagugagugacugagcaugauuuagcagccugacugucucuuuggggagcugauguuauggaguagccaauguauuugcuuuuugaaaauuuuuuauuucaauagguuuuuggguaacagguggcguuugguuacauggauaaguuuuuaguggcaauuucugagauuucggugcacccaucaacugagcaggguacacuguacccaauguguagucuuuuaucccucacuacccccagcccuuuccccaaaguccccauaguccauuguaucuuaugccuuugcauccucauagcuuagcucccugucaauguauuuucaguaguuaaccuguuucauaggcuaaacaagauucagaguucuuuuauuuuacuguuucaguccagcucaguuacgauaaauaucuagaucuguuaggauaagaaauuguggagcuucagguuuagaauaaugagauuccuaggacugaaggaaauuucugugauuuagaaaauuauuuuaaauguauuuccauccauuugcagaaugaauuuuguuuaagcaauaguuaggguugggaaaguccuguuauuaacugaggagaggaggaaaguccauagccuguggaucaguuaaagacauucugaacuaaauagacaccaugagguuuguuuucacccguuuacuauaaaauaugcuguggauuuugggcaguaccuaaccuauguuccaaauguugcuuuaugggaaauucuuauucacccaugauauaucucaauuauuaaaaguacauaagaaccugguuaucacgagagaauucuuccugauauaucccucguggcaggacccagcuugggaguggaaauugcucuagcucccagucacuagugguauauucuaggacuuguggggaggcuuuggcaggguggagauccagggcaguaacagcuggugcugguuucucuggugaccaggagacuagaaacaagugguuauaauggcuugucccgauauccacauugcuuccagucuuuaagcuguacucuugcaucuagugacacagugccuacaugugccuaaguuucucagugguaucagaggacagguuaugaaaguguauuugaaaaucuuucauugauaucuuaccaaaugauauacuuucuuuuguacugccuuucagaauuaaagcuauagagagucccaacaaagaagaugauacccaguggcugaccuacuggguaguguaugguguguucagcauugcugaauucuucucugauaucuuccugucaugguuccccuucuacuacaugcugaagguauguuggucuugcuaccacuaaaacuccaucucaguaccuguauagaagaaguaggaauaaaugcuugaauguugugcaucuguggcucugucucagauuauaaacaagaagacaggccugggcaacagagcgagacucugucucaaaaaaaacaaaaacaaaaaaaugcucaagcaagccacuugccucagccucccgaguagcugggaccauaggcgcacaccacugcaccuggcuacucuuuuaaacaauuuuaucuaaagaaauuuagauauaggaaauuaaauauaggaagcuccaucacuccaaccaccaucauaaaugguaguaucuugaguuuuaguucugguuaauuauggauauauaauucuuuuugucuuuggucuuagccuuuuuuuuuuuuuuucuuuuuuugagauggagucuugcuccgucgcccaggcuagagugcaguggcaugaucuuggcucacugcaaccuccaccccccagguucaagcaauucuccugccucagccuccugaguagcagggauuacaggcgcccaccaccaugcuuggcuaauuuuuguauuuuuaguagagacaggguugguuuuuuuaaaaaucuauuuauuuguacuucuucugggagauuucucaaucugaccuccuuuuuuuuuuuucugagauggacucuuggucuguugcccaggcuagagugccaugguacaaucuccgcucacugcaaccuccgcauccuggguucaagugauuguccugccucagccucccgaguagcugggauuacaggcaugugccaccacgccuggucaauuuuuguauuuuuuuugguagagaaagaguuucaccauguuggccagggugcucucgaacuccugaccuuaagcaauccacccaccucggccucccaaagugcugggauuacaggcgugagccaccgugcccggacucaaucugaccaucuaauuuucaacuguacuccaugauuacauuauaaccauucuguuauuccugcuauauaccguguucuucauuucaacuauuauauuguucacaccuaauguuuuugcuuggcucucuucuucuuguccuuguuucauauugcuaauauuuucucauuucuuuuaguaugguuaccgcuccccaguuuaaaauucuuggucagcaguucuaauauuguugcuccugaccaaaacuuguaguugauuguguuguuuuucuuuugaaauguacucuuggccaggcgugguggcucaugccugcaauucuagcacuuugggaggccgaggcgggcagauggccugagcucaggaguucgagaccagccugggcaacacggugaaacccugucucuacuaaaauacaaacgaaauuagcuggguguggcagagugcaccuguagucccagcuacucaggaggugaggcaggagaacugcuugaaucugggaugcagagguugcagugaaccgagaucacacuacugcacuccagccuaggcaacagagccagacuccaucucuaaaaaaaaaaaaagaaauauauucuuaaaauaucuuuuuauuuuagccuacaaacugcuuuucauccaugaguaucagcuaucccaucaggcacuggaauggagggggccccaguccaugcuaguacuaguaaguucuggguaggggguggaugaguccuaggaguggggggccccaggcacacaggaaccauaguuaaccacucuucaccuacagaagagcuccucaggucaaagcuucacuguacaguccccuucuaccccagcaaagcagcaucaaaaggaagugauccuggguuauaguucacagcucuagggguuggagcaggagggguagggaaguaacugccuuuaguuaguguccaccuguuuuccugagugauuugcaaagacaggacuuuuaugccaaaaccucuguuuuagaaaaaaguagaggacaauauuuuuuaacuuugagguauagaagcaagacaaaauacaaaaguuucaaagaaaaagauuugauaaauucaacuaaaaauuucuaaaaauuaaauuucuauaugacagugggcagcauaaacaaaguuaaaauaaugacagacuaggaagauagauuuacaacauuuacaccaaauaaggaauauccagaauacauaacaauuuccauaaguaaaaagaaaaagaaaaugggaaaagguucuaaguuaaguauuucacggaagagaaaaaauaugaauggcuaguaaacagcucaccagugaugugggaagugugaguuaaaauagugaaaucccauauuuuguucauuaaacuggcagauauuuuaaagauugaaaauaucugguauuggugaauguauagggaaauggacauguaaugguacaggcugaacaucugaaauuggaaauccuaaaugcuuuaaaaccccaaacuuuuugagugcccacauaaugaucaaaggaaaugcucauuggagcauuuagauuuuagaguuucugauuugguaugcucaguugguauaauguacauauuccaaaaucugaauaaaugugaaacccgaaacacuuuuagucccaagcauuucacauaagggauacuuaacagccuagugguauaaacuugaauaaccuuuuuaagggaccuuuuaaccauuucuuguugaauugaaaaaugauacucuuaacaauucuaaggaaauagucacugugcauuaaagagcugcacaaagauauucauggcagcauuuuuuguugucaacuguauauaauaugaacugcauaauguaaacauuauaaacagaaauguccaucagcagguaaaugguucauucaauuaauaguauauccauacaguuaaauggaaugaaauagauccauauguacagacccagaaauuuuugcauaauuuaguaauuaugaaaaguuauacaggacaguugugcuagcuuuugccuguaaucccagcauacucggaggccaaggcagaaggacugcuugaggccaggaguuugacaccauccugggcaacauggugagacccugucuccacacacacaaauuuaaaaauuaaccaggcucccagaucacagcauguugaccaaaaaaaaaaaaaccgaaaaccaaaaaacaaaugccaggcaugguggugcaugccuguggucccaucugcucaggaggcugaggugggaggaugguuugagcccaggaguucaaggcuacaauaagcaaugaucacccaacugcacucuagccugggugacagagugagacccugucucgaaaaagaaaaaaaguaauagaacauuaaauacaguaucacaccauuuaugguuaaaaaagaaaaaagacaagacacuauaugaagugagugucuuuuaaaguuuaaaaaauuaaaugaaaacaugcucaguauagauucuuuuauauuuuugaaugacuucaccacagaaugccuuguaaggcaauuaagaauuuuccuuucaaaacugauggaagaaaauaaaaauuggucuguggaaagaguugauuucaaagauuggauuuuuuuguuuuuauuauucaaagucauuuaacauuuauaaaaauauucuuacaaucuuuaauuuggacaugacauaauuuaaacuucagauaauuuuaaagcccuuaauaagauccaucuaaucguagggaccucacaguagucuuuaguggaaagaaauuggcuuuugcuuugggcccacuugcuuguggcagugaacacuaucuugucagcagaacuacuugcaguaguucugaccucagacuuccaaaugugagcaagcuugacuucuagccuacuccuaaucaccucugcuaauggaguucacagagagguagagagaagauccaaaauaaaugguagucacugaaucauuuauauuugguuuugaaguucauuuaaaauauugcuuuguagcagacuuucuucccuaaugguaaaaugaaugugcauccauuaguagucuccagcugcauggcaucauaguguucaugaaagugaauuuauugcauacauuccaaauagauaacauacuugaaaggauuaaacauucaugaugcugucaaucaaaauacuuucuuccuacauuaguggcauacucugaaugaccuagugaacagacugagaagaggccucugaauugcagagucucgucuguaggagaagguucaggagaguauugaauuuuagggacuagaauccaucuuaccuaugcuguugcaaucgcaugcugacuggaagugugggaaagagacuuacaaguaaggacauggguuuguuuuguuuuuuguuuuuugggacagaguguugcucugucacccaggcuggagugcaguggugccaucuuggcucacugcaaccacugccucuccaguuccagcgauucuccugccacagccucccaaguagcugggauuacaggcacgcaccaccacacccagcuaauuuuuguauuuuuaguagagaugggguuucgccguguuugccaggcuggucucaaacuccugaccucaagugaucugcccgccucggccucucaaaaugcugggauuacaggugugagccacugcucccagcccgaggacauguuuaauauuuuauuuuuugcagaguuaauauuguuggcuuuauuuucauuuuucuaaagcagcugauaagauuggaggaaaauaaaaggagccaauggcuuggcaucaaagcuuaguugagaagauaauauaugauguauuuagguagaaauuggaucaugcauauucugagcuuugcucugacaucuggccuugagcaagaggguuuaaaaauaaauuuaaaagcuuuuuuucuugauuaugaaauuuacauaugcucauuccuuuauucagcagauuuauuuagaaccuccaugugccagauucuguucuacaucugggagauacuuuggcgaauaaaacaaaguccuuguuguccuacuguuuacauuugugugugugugugugugugugugugugugugugugugugugugaugggauguguuuuauguagggaggaaaauaacauuuguaauccuacaucuuagaguagucuuccuauuuuuuaaaaugugcaaauauauuggucuguguauauaaauaaaaacagaacucuguguguauguguauauauauauguauguauugcugucuuaacauauguguggcuuagaucacauaugauauauaauucugugucuugcuuuuuucaauuaacacaguauucugaguauuuucucauguuauucaguauuuuuugacauagcuaucuaauguuauugauaauuuaccuacuucccaauugaaagacauugaggacauuugucaugcgauuauacauaaugcugcaauuaauaucuuuguauccucuguuuaccuucauuuaaaucauuuucuagauuuacuuuacuuuuuuugagacggagucuugcucugucgcccaggcuggagugcaguggcgugaccucugcucacuguaaccucuuucccagguucaagugauucuccugucucagccucccgaguagcugggacuacaggugcacaaccacgcccggcuaauuuuuguauuuuuaguagagacgggguuucaccauguuggccaggcuggucucaacuccugaccuugugauccacccaccucagccucccgaagugcugcaauuacaggcgugagccaccaggccuggcuagauuuauuuuuagaacaagguugaguaaacucuggcaagauuagguccugaccugaauugucaccugugcuauuucacccauugacagagaauauaacauuuuucuuuucuuuuuucuuuuuuuugagauggaguuucgcuauuucacucaggcuggaguggagugaaguggcgugaucucugcucacugcaaccuguacuucccgcauucaagcaauucuccugccucagccucccaaguagcugggauuacaggugcccaccaccacgcuaggcaaauuuuguauuuuuaguagagaugggguuucaccauguuggccaggcuggucucaaacuccugaccucaggugauccucuuggacaccucagccucccagagugcuaggauuacaggcguaagccacugugccucgcaacauuuuucuucuuaauguucguaggaggcuaaaaagacagggaaaucuuuccuuuaacacguucuuuuaagcuuuuauuugugcaugcugagcaauguagccuguaacuauucuguggcuacacugcaaaagcuuucuucugacauuaacucucaguuccguaacugcauguuaagcauaccccuaccugggaaauaucucuucugggggaaaaucacauggugacagcauuagaagcacagacggaauagaauggccuguuguaauucguaauuuaaggagucauugugucagugcuaauagugccaagaguccaguuaaaauagcauggacucugucugaacugcaggcagcagugggcuugugagucuccuugggaguaucaucagcuggcacuuugagggcagcuugauugaaaagagccagaucugugugggugacuuuaauaaacucaggcuauuccugggcuguagaauaguuacacagauuaagaagagaggguuguaagagguggcagcugaauaucaccuugggaguugaacaguaauuaacuuuauuuuuaacauaagaaaaugauuucauuucagaacaggaaaaugcuaaggauguagcuagagagcaguaauuauuuuacugucucaagacaauagcuagaggguaccagaaaguagucaauuaacagucugcagucuagccuacaaaguaaucacauugaagagguacaaaacuguggacacuuaauucauccagaaaagauaauaagcuugucuggauugcugaaggguuggcaucuacauaggcagguaauauuucagagauuuuccacaauaagaacuuuaggauuugguaauacuacuauucuauuguacacuuucuucaaguacauuaauuugugacuuuccuaaaacucugcagaagagaaaacugucucuuagguugauuugccuaaagucauaaaacacaccccaccucuccugauuuuuuuuuuuuuuuuuuuuugagacagagucucgcucugucgccaggcuggagugcaguggcgcaaucucagcucacuguaaccuccgccuccuggguuccagugauucuccugccucagccuccugaguggcugggacuacgggugcccaccacaaugcccggcuauuuuuuuucuaauuuuaguagagacaggguuucaccauguuggccaggauggucucgaacuccugaccucgugauccaccugccucggccuccuaaagugcugggauuacaggcguaagccacugcgcccagccccaccucuccugauucuuaauccaaugagucauuuucacuucaccuuaaugcucugguuuuaauauggacaucugucucucucuugauaauccauuucugaaaaucagauauucuauguaggaauacauucuaugcagaagcuuauuuuccacuauuuuaagugggaaaaauuuuaauguauuacaugucaauguaaaacucaacgaauucacuaaguauuaauaaaauacagcaaaauaccuauauauaacaaauaucauguuaggauguuagaugcuaaaaacacuugcugcucuccaaauaguuaauauaguaaguaacaauugcucugugugcaggaauacauagcacauccccugugaugcucugcauauucuucaaaauguccaccaaggauucugauauucugucaaaaauguuacucaagacauuuccugcauaucauaauguuguauugcauuuuggggauguauagcuuuuccuauauaagcaacuacaguaaaacauuguaugaauuuuggauauuaaaaaccaaaaggcagcagggugcaguggcucacgccuauaauccuaagcacauuaggaggccaaggugggcagaucacgaggucagaucaagaccauccuggccaacauggugaaacccugucucuacuaaaauacaaaaaauuagcugggcacgguggcaugcgccuguaguaccagcuacucgagagguugaggcaggggaaucacuugaaucugggaggcggagguugcagugagcugaucacgccacugcacucccgccuggcaacagagcaagacuccgucucaaaaaaaaaaaaaaaacaaaaaaaaccaaaaaaacaaaaccaaccaaaaggcuuccacagggaaauaacuagagagguggucuugcagggucugcuguaauuaacuggcacuaugccaaggaaacaaagcuaaugccagugaaaaauacagucauuuaauucuccauuuugggucaaugcaaaugcguaucucaaaaaaaccaagguucugaaccucuggcaacaucuuauaauucaguaagaucugcugcuggcuaaacuuagggcaugcuagagcagaguugcugggaaaacuaagaguaacaucgaacuacuugcacauacugaggguaccucaaggcgcuggcuuccuuggagugcuuggaccuuuaacagaaggucuuagucuaccauugugugugugcagaaggcugauuugaguuuuugcaugauugcacauucaugcacguagcauuacuauccauguguagcgagacuacuagaugcuagucugagucuuuaccuuuccaucaucuacugucaugcuuucccaagucugaagauccuguuuuccaagaucugugcucaguaaacaagcuuuggagucuuuaaauguaaggaauaggaaaggugaagagaggccuggcuuaaaaucauaacauggagauuauggcagugaaucccauuggauugaauggucugauauggaaagcaggcuguguaguuccacuaguccaaaaauucuauuuuuugagacacagucucgcucugucacccaggcuggagugaaguggcaugaugucgacucacugcaaccuccgccuuccagauucaagcgauucuccugccucagcuucccaaguagcuuggauuacagacgccugccaccacaccuggcuaauuuuuguauuuuuaguagaaaugggguuuugccauguuggccaggcuggccucaaacuccugaccucaagugauccacccaccucagccuccuaaagugcugggauuacaggugugagccacuauaccuggccugguccauucuuuuuuuuuuuuuuuuuuuuuuuaagaacaaaacuaguuuauuuggauuggggacucugaacaguucugucucuauuacccgacuuccuccucccacgacuucggcaccuagaggaacuuuggcuccggcugcgguggcuccugcggcucuggcuccggcggcccuggucccagcugcggugccuauuucuuccucugcuuggugaauugugccucucccgacucuuugaugugcguuugugagauuucuucccccuaugacuacucuuuuuucucucggauuccccauuucuuuuguagguguggucuggacuaggguuucuccuuccccgcugccugcuguaguaguggucgugguggcccaucuucucccuccucucggaguucuugccaaaggaggagccagucugaucugaagacaaguagaugucucuauuagcuucccagaauucauuguugggauuucugaacacaugaagaaaguugcaguguuuuccucuuggacauuguuguauuucaaauaaaccacaaaucgccauuuuccaccgggucacugggcagaauucacauugcagcugucguccugcauaccaucguccguuaaacagagaaagggcugcuuggcauucuucuuccgacugguacugaacauauacauugccccucaggugagguuccaaauugcagcugaccuugaacugaaucacuuuccccacguucuugaacucgggcaacacauccucauagaaaucuaggaacuguugguagguuucuuccucgcuguacuccaggcuugcgucagggucauagucaucccuccugcacugcuccauuccaaacguuguaaacaugcucuuaauaagaaggguaggacuagauguugggaaauuauguuuacgugaacaucugucuccaaaucugcaagcuccuguuuuacuguagaagggacaauuagcucgauccuucuccauuacucugaaauccacgggugguucuggguuuugccaugugguacuauuuucuaaaucauuuucagccugauccagcaucuucugcacagcuuccucuuuuucuuucuucuccuguuguuucugcuccuccucuucucucucuuuccucugcuguucuuuccauuguuccuuuaacuuucucucuuguucuucuagccauuuuuuagccgccucuuccuuuuccuucuuuauucugaauucuucuugugccuucugcucccucagcaaccacuccucauguaaucuuucccucucucuuuccaauagcuucucuucuucuaguuguuguucuucaauaaaaguguccucuuccuccuccugugagaguccugagucucucagucgagcaaguuccugccgacguuucuuucguuucuccuucuucagggcggcccuguacuuuuuguggcuugguuucucuggaaaugucaucuucuugggaaacgucaucuucucaagugcagccaucuugccagcaccgccugaccccucagacauucuuaaccuaugggaauauauggaagauuuuguucauagcugccacugucagugauucuacuuaugaauauuuuauguuuucuaguauuguuuuguuugcauacuuauauauauuacaaauuacuuucauuuuguuucuccuuuauauugcaguuagacuuuuuuuguaauuaaguauaucauaaauuugaauuucauuucauguacuaaaaggagaguucuaaaauauuuacuuauggccaggugcgguggcucacuccuguaaucccagcacuuuaggaggccgaaaugggcggaucaccugaggccaggaguuugagaccagccuggccaacauggcaaaaacucaucucuacuaaaaauaaaaaaauuagccaggcuugguagcacgugccuguaaucccagcuacuugggaggcugaggcaggagaacugcuugaacccaggaggcagagguugcagugagccaagacugugccacuacacuccagccugggugacagagugagacucugucucaaaaauaaaaaauaaaaauaaauauuugcuuaaauauuuuugguucuaggauuugcuuuccccuacugaaagcuaacauguucuccuguuaguaauguuucauagauguuguuagaaaacacaguauucuugggucagagaaaguccuugcuaugcuuaguaauuuuauuuucuuacaaaauuauagggguaaauuuuaaaauuuucaauuaauaccuauuuuauagaggaaaaaccagacuuaagugauuaaguaacuuguauaagguuugcuuagcuaguaaauggcagaaccaggauuggaaguuaguuucuuugaguccauccuguuacucucuauauacuauauuaacucuuugaaucccucuuuguuggguugagagaucuguauauaucuuuagagugagauuuuaggccaggugcaguggcucacaccuguaaucccagcacuuuaggaggcugagauggguggaucacuugaggucaggaguucgagaccagcccggccaacauggcgaaaccccaucucuacaaaaaguacaaaaauuagccagacgugauggugcgugccugcaugccuguggucuucagcuaccuggggggcugaggcgggagaaucacuugagcccaggaaguugaggcuauaguguuuuguauuugugccacugcacuccugccugggugacaaagugaaacccuuuuuuauuuaaaaaaaaaaaaagacuuaaauuuuguguucuuuauucuguauucuuacuaauuucuagguuguuuuauauaucaacuuuuuuuugucuuuuugagacagggucuugcugucucaccaagccuggauugcagugaugguaucacagcucacugcagucucgaccucccaaggucaagccacccucccaccucaaccucccaggaggaccacaggcauacaucaccaagccuggcuaauuuuaaauuuauuuuuuguggccgggugcgguggcucacgccuguaaucccagcacuuugggaggccgauggggguggaucauuugaggucaggaguucaagaccagccuggccaacauggugaaaccccgucucuacuaaaaauacaaaaauuagcugggcauggugguguuugccugcagucccagcuacuugggaggcugagacaggagaaucgcuugaauccgggaggcggagguugcagugagcugauauugugccacagcacuccagccuggguaagagagcaagaaucagucucaaaaaaaaaaaaaaauuuuuuuuuuccuagagauguggucucccuauguuacacaggcuagucucaaaacucuugggcucaugugauccuccaaccucagccucccaaagugcugggauuacagguguaagccuggcuaguauaucaauuucugauggaaauguuaaaaucuaugauugcagauuuuguccauuugucuauauaauucugacuuacauuuaaauauuucaaagccauauuugaaagcuaucuauagcuauauauaaauauauaauuauaaaaauaauucuauugcaaacauaugcaaaguuagauauaauuuacguauuucaaagguauauacaaguucaggaauuuuaauauucuuggugaauugcuuuccuucuuuaucauccuauuuacuuauuuugccuuaaguaauuuguauguauuaauauugcuaaugagcuauuuugggaguugguguuugucugauauaucuuucccauaacuuuauuuucaguguuccuauuugguuuuguuguagguauguuucuuaagcauacagcuauaguuuugggguuuuauaaaaaauuuaguccuauagugucuggguuuuguuuuguuuuugagaugagcucuugcucuguugcccaggauggucucugcauuugucuguucucaugcugcuaauaaagacauagccgagacugggcaauuuauaaaggaaagagguuuaauugacucacaguuccacaugguuguggagaccucacaaucaugguggaagaugaaggaaaagcaaagggaugucuuacaugguggcggcaggcaagaaagaaugagagcccaagcgaaaggggaaacuccuuauaaaacuaucacaucucgugagacuuauucacuaccaugagaacaguauggcaggaaaccacccccaugauucaguuaucucucacccuguccuuuccacaacacaugagaauuaugggagcuacaguucaagaugagauuuggguggggacacagcuaaaccaugucagucuccaacuccugggcccaagcaauccuugcaccuuggccucccaagucacugggacuacaggugcaugccaccaugccuagcaagucucugucuuaaaaacucuugugcauguguaacaaauuuuaauucacaaagguuacauuucaagaguuacuuuuuacuguaguugagauaaggggagucuggacaacauugugacacuugucucuacaaaaaaaaguuauaaaaaauuagccaggccuggugguucaugccugcagucauucccagcuacuugggaggcugugggaagauuguuugaacccaggaguucaaggcugcaguaagccauguucaugccacugcacuccagccugggugacagagcaagacucucagaaagaauaaucuggagauauuguugagaacuuggguuuuguuuuuuauuuugaguguuauacaaguucaaagucuaguauaaauuucucagagccaacauggugcugauggagugagcuauuugugcauuuuaaacugaaacucuugucauuaguguuagcccuuuaucagcuuuguaucucuaaaacaccugaaagacugucuuagaaaaccaucauagcuuguugauuaugaguacaucccuugguuuggaaucauaaggacuaagacuuaaauuuaaagcaugagaaauuaagauguuuuuacacuaaggagaaguuguaaaaaauacugauuuggaaucucuguaagugacuucuguuuuuuuguagagucaccuaggcuguguggaauacaaugugguuagaaucuuuuaaacuaaaauaacucaguauauuguuuauuaaacuuucuagggaaaugggcagauuacucugaauauuccuuuuccuucugcuuuucuuuuuaucuuaaaaaggaguaaauugcauggaugacuugaagugacgaguugguauuuauuauuugaaucaacaguaaaaauuuuuuggacauagugugaaaauccuuauuuaaguaauuagggcagaauucuugucaauuaaaaaaaaaucucaauggcaaaguagagcuguaaagaaggaguuaggaauaauaacuacauucaagaugaaagaugaagaacaacuguaaagauuccuugaaggcuaagaucuacccaaaacugagguccaccaaaggaagaauucaggaauggacaagguauuuuuuccauaauaggaugaauaaaugugauaaacuuaccaagauaagccuaccaagcacaggccuccuagauauuaggcuuaucuguacagggcuuuauacaugcagauaaguacuauauuuucuuaaauugauuucuaagaguuaugauuaauaaaagccucuuacagcuauauacuaaaacgugguccaaguuaggaagauaguuaagcuccuggaccugguguguuuuaccuuuuguuuuuuagucucagcuuuuccuuaccagcucauuacucaucauguuuuuuccaucuaaagaaagcccaccuuuaaccugcagaaaacacugguaaugccuuuggggaaaauaacagaggcaucucccauccccagaguagugaaagacaguguguauucucagaaugugcccccuccacccuccuguuacccaugcuggcucuuuuucugugcaguguggcuuccuguuguggugcauggccccgagcccuucuaauggggcugaacugcucuacaagcgcaucauccguccuuucuuccugaagcacgagucccagauggacaguguggucaaggaccuuaaagacaaggccaaagagacugcagaugccaucacuaaagaagguaagacucaggaacaagauggccccacaugugagaggagaugugacacacugggcucaaauaacaggcuuccuggccuucuugucuuaucaccaccccucagccaaaugccaacauuacucugggauuucuuuacaaagucuuugccuauugagaacacuuacaguucucgacuuuucccaagacucuuccuccaugccacauuuaauguagccuucagucagaacauuaggaaaaaugacuuuccuugguaggcagcgauuuuagagaaucaucuauauugauaugcaaguccaucucuucuaauuguuuauuuaauuuuuuuguauuauacuuaauuacauagguaguuuuaaauaaauggagaaagcaccuuucaaaagcuauacuagcaggaaaaauuccaucaagcauuuacguaguaaauuucuauaauuuuacaaaaaauucuugaucuuuacuugaacuguacaugaggggaaaagagcccccucagguauguguucucuccacuugcagaagaaaacuaaaggaccuaaaacuagagacaagccugggaugccaaaaagcgggaggagaaaugauaaagagccauucaugaauuccaugucuacucuaagacacuugucuaaucacccucacauaauaaauauuuagggcaaacuaccacucuuuagaaaaaguacaaccucaaaaccuauaguucugaauuguaacauaucgaauaccuuggacugcuggaugccaaaagacaauacuugggguuaucuaugacguuuaaacagguaaauaggggaauucucuaggacuguacacucugugacguuuugaaugaagcgcaggcaggcuucucugcuauccuccaggcaguguaauagucaaggaaaagagcaacaguauuggaucacuccuuagacacuaaccagcuggugaaagaguucauuggccagucuccuccuuagaaugguuugcaccaaguggagaggccaugucgcugaaggggaaaggggagcccucauacccacagucacuguaaacauccaguagacaggaagauggcuucgggcaguggcuggauggaaguagauuggagauacccaggucuggaaugaagucaucuuccacaaagucuuccuucacugagaccacgaauucugggugaucauucucuaaaaggcugagaggugcuuccuugauuuucacuaccgcauuagcuuggcucucugucucagacuacgggcuuggcauauauguagucaaaauuaauuaguucauuaauagcuucaagcuuggcugauaauguccccacugacagagaaagggaggcugguuaggaauuggguccuucugaguagaccucugggagcugcuccaggcuggcagacccuggggaaggacauuugaagaacacuagugggucuaaguuguccagaaugcccaacaggauaucauacugggaagguaguugauguuuacuuccaaccccaccacaacuaacuucuacccucaucugccuaguuagggaugucaagcaucaaauagauggaauuaucuuggcuuucgccuccucuucaguaaccagagcauccauccccaagugcugucuucacucaugguucucaacuacgaguccaugcauuuucucuuguaaaaacugauuuucuagcaaaaguuuuugguucuguucuaaaucuaccacuugcuguuucaggucacucauuugagcuugcuuucugucucuggcaguuugagcugcuaauccuguuuuuccuccucagugccuucuccuuggggcuccccacccccacagcacucaccaucuccuggcuggcuccucucugggcuggcaccaugagcagcagggccuagcuggccaaggcuguagcagcaggcugaccagacagaagcaguacuuuggaggcccugacggccagccugauucaguucagauugaucgguucaguaugcuguucaguuuuuguuauggguacaaaagaauguccacucucagcucugauuaauucacucaauaaauauuuauuuauugagguguuuaauaugugccaagcauguucauaacacuggcagugaaccagcauaccgaagagaccauacuccuugaauucaugaagcuuacagucuaguugagagauaggcaguaaaauugaaaauuagauaguauauuuaccauauaauauagggaaaaaauaaagcaaguagaaagaugggggggggccaaggacuggagggaugguuaugauuuuaaauagagacguuuaggaaaucuauaccagaaggcucuacugaaucagacucaauaguaguaaaggaaucaggaacagugacucagccuguaaucccaacauuuugggaggcuaaggcaggagaucacuugaggccagaaguuugagaccagcuuguuugugacagggucuccuauggagacccgcucucuacaaaaauuuaaaaauuagccggacguugugaugcaagccuguggugccagcuacucaggaggcugaggcaggaggaucacuugggcccagguaaucaaggcugcaagugagcugugccacucuagccuggguuacaaagcaaaacccuaucccccuaaaaaaaaaaaaaaauagaaaaugguaaaagaaggaaccauggggaaucauacuuuagaaugagcugcauauacagaaguccggaggugggagcaacaaaagaagugaucuagaggggugcaggaggagaugagguggaagaaguugcgaauggaggcuggaagacguaucacauaaugccuuauaggccauuguaaagguuuggcuucuacucuaugugagauguggagguacuggggacuuuuaaccacagaagcaaaaugaucuguccuguguuuuaauaagaugccuguggccacuguauuaggaacagacugaagggguaaggcaggaaguugggagaacaguuaaaagguucuugcagugaucuggcuggaggugaugaugguggcuugguuccuuguguagcaguaggggguaagaaguaucagauucuugauauauuucaaagguagaaguaaugggauuugcuuauggauuggcuuauggauugggcaugggucagagggguuaaggacaaggacgagcuuuuuagccugaacagauggaaggauaaaauugccacugagcuggagaagacuggguagaacagguuuuguuggggugggagguuguggugggugggaggauauggaauuuaguccuggacauuuguuugaggugucuguuuguuagauaccuacaaggauuagucaaauagcuaguuggauacaggugucaagaguucaagaaacaggucuggacuggagauauaaauuugggggccacaagcuuauacauauuaagcaugagacuagaugagaucacgaagguaguguaguuaggaaacaggagguccaaagacugaacgcuggggagucuaagguuuagagacuggagagaugagaagcaacuagcaaagcagacugauaaggaguggccaauugagguagcaagaaaaccaugagcgugugguaucccuggggccaagaacagaaaguuuuucuuucagagaggagaagugaucugucauguuacaugcugucaacaggucaaguaagauaaggacugagaacugagcagauuuagcaaugaggaagguacuagugauuuugauaacacagauuuuguggagugauaucaaacuccugauugcaauggauuugagagaaugagagaaaagggaugagagaauauagaucuuucuuuugagaaauuuccugcaaaggagagcagaagaauggggcuauaacuggaagaaggaauuaugguccugaaauuuuaaaaguuuuuuucuuaagguaggagaaacaaagccuguuugaaaauuaaugggaauaauucaacagagcaaaaaaugaugauaggagugagagggugaauuguuggagcucuguccuugaccagugaaggauccaguauacaguagagggauuggucgaagagcuggaaguuuaugguaacagcagggaaaucagguuuuaugguaugcugugagcacaugugacuaugggagccuacagaagugacuuucuaauuguuucauauuucucaguaaaguaggaaggccaauugagagaggauggggaaggagacaauggaaagagaagguaugaaauaguugcgaaggagagggacugcucaucuuuuucuguaaagggccagauaacaaauguuuuaaauuucgugggcuaucaugucucuguugcagcuacucuucucugccauuguagugugaaaacagccauggacacuacauaagcgaguuuggcugcagugugcuggccccucuaggacaguuggagaguaaauggacugucaggcaguguuaaaggcaugcuugagauuugcguucaugaauuuauagugaaaccaguucuuguuuauguuuuucuccagccauacucagcuacauggguauagcuacagaguagguggagaguugugucaagguugugauuuccagcaagaacuaugaagugagggugggacuguggagugguuaaugcuugacaauggaauuuaaccugaguaaggugggaaguggugguggaagaacucugaaucaggauaauagcgggaauacuccaucaucaucuacaaugagcaaaaaagcaggguggggagugcacuacaaagauaaaaggugaugguggcugagugggaugcuugauacaagauuauggagggacugcaguauugguacuaacagggauccugggagucagugccauauguaggguggaauauaaggguuauuggaggggaggaacuaagaggucaggauauuagaagaucaucacauaugucuacauggauauuaaaaucaucaauaauuaaaauaggaguaguaggucaggugcagugcucacaccuguaaucacagcacuuccagaggucaagguggguggauugcuugagcucagguguuugagaccagccugaguaacauggugaaacccagucucuacaaaaaaaaaaaaacacaaaaauuagccagauguggugaugcguaccaguagucccagcuacucaggaggcugagaugggaggaucaccugagccuggagguugaggcugcagugagcugagauggcaucacugcauuccagccugggugacagagugagacccugucucuaaauaaauaaauaauaggaguaguguuagaaaggaacauuaaguuaggagcuaaaaucuucaagaacuaaggcaaaguagcccaagagucagggaugacagggaaagggaaggcuacucagugauagaaucugaugacaugagauucugaaaguggcaaugaagaacaaaaacaacaccuaccagauccauuuguacuagggucaugagaggaaagaaacagccaccacuugagaaagcaguguccucagggcacagccagcuuucucuaagagcaagaagguaaaggaaacauucggaggaauggaugaggauauagauuuugccagugaugggucuugaguuccagagggacucagauuuuagaaauuggagaaagguuuuuguguuuuagagcucugugguaguuagacaugggaguugugagguugccugaccauggggaaguaaaaucccaagacaguucuccagcagcacugaugccccagaagugguauguuccccauuucucccucacagaccucucuucucuggacuccuauuuuugggcauacaaauccagucuacuugaauauguuuuagguauuuuuuaacuuguagccuuaaccuccucccacuuuaggauugccagcuuuuuuuuuuuuuuuuuuuuuuugaaacagagucucacucuguugcccaggcuggagugcaguagcaugaucucagcucacugcagccuccaccuuccagguucaagggauucugcugccucagccucccaaguagcugugauuacaggugugggccaccacgcccagcugauacuuguauuuuuaguagagacaccguuaugccauguuggccaggcugguuucaaacuccuggccucaagugauccacccaccucggccucucaaaaugcugggauuacaggcaugagccaccaugcccagccaggauuaccagcuuauuuuuaagagcuuucuuuucuucucccuucccuuagccuaaucagcaaccuguggugaugucauuucugucuacuucacccacauuucuuagccucuugguucucuuagauaucaauacuuaaaauccaaucuuacuuuguuaugacacauuccuaaauaggggcaagagaauuaaaauaaguuaggaggaauuuacaugcugccacauuuuagacuuuucucaaagcuuuuggauuaacuaggaauuucuacaaaggguuaguuaagggaaggacuacauuuucuccuuugcugugaacuugguucaguaauuuuaacugagcaaagggagagcaacuaucaggcagcugguggacaagaagggacuccuuggcucucaucacuaaggcucuggcuccaucaagaacagcugcagauuguaaaaucucacagugggcccuggaggcuucuagacaaccccuuuccccuccaucuuacacacuguacugguucucauagcacauucccugccacuugguaauuagaaaguggaaggcuuggucuccugcagaaguaagaaaauauauuuuucuuuuuuuucuauagagaugggcucucacuguguuuuggccagggugaucucaaacuccuggcuucaaggaauacuccuaccucagccucucaaagcucugggauuauagacaugagccaccacaccuggacagaauguuuucuugaugaauguagugucuugucaccaacucaaagacuuagagcaaacucuucucaucauaggagagaaugguggcacaauaagaguauaaauacagauuuuaaaaacaauuuaguauaacaacaauuuauauagcauucauguugcauuagguacuuuaacuagagaugggcuuuuaaaauuuuuuuaaaauagagguggggggugggggucucaccauucauauuggccaggcuggucucaaauuccuggcuucaagcgaucuucccaccucagccucccaaagugcugcgauuacaggcaugagucauuaugccuggccgaauuuaaaguauauggaagaggccgggcaugguggcuuacgucuguaaucccagcacuuugggaggccaaggcgggcagaucacgaggucaggaaauugagaccauccuggcuaacacagugaaaccccaucucuacuaaaaauacaaaaaaaaauuagcugggcgugguggugagugcauguagucccagcuacucgggaggcugaggcaggagaauggcaugaacccgggaggcagagccuguagugagccgagaucgcgccacugcacuccaggcugggugacagagcgagacuccgucucaaaaaauaaauaaguaaauaaauaaaguauaugaaagcacauagguuauauggaaauacuauguaugccauucuauuuaagggcuugagcacucacagauuuugguaucuguaggguuccuggaacuaaucuccucucccccaccgcccccccagcccccccccccaaacacauauaucaagggaugacuguauuucuagugcugggaaugaggacuucucugauuugucgccaugggauaaauaugaugaccuaguugucaucagauugauaauauauugauaagugaaaucuuacaggcaagcacacagauacaaauagaauuugaacacuacucuuaaggaaucucugcuucuuucaaugcuuaaaggagaauagagggcagacaguuucggugacacugucacaacaaggggcuaggcuagaugaccuucaaguauuuugcucaaguauuuaggauuugugcucuaagagguaccuucuccauuuccuggaaacccucuuagcccagaccacaaaccccaacaugaucgcaccugaacaugagucauccaaguuuuguuaucuaguagcuacauuaggcacaaagcuugcaagcuugcauuccaaagaaagagcuuugauauauuuuucuuucccuccuaacaaacaaacagcgaagaaagcuaccgugaauuuacugggugaagaaaagaagagcaccuaaaccagacuggauggaaacuuccugcccucucuguaccuuccuacuggagcuugauguuauauuagggacugugguauaauuauuuuaauaauguugccuuggaaacauuuuugagauauuaaagauuggaauguguuguaaguuucuuugcuuacuuuuacugucuauauauauagggagcacuuuaaacuuaaugcagugggcaguguccacguuuuuggaaaauguauuuugccucuggguaggaaaagauguauguugcuauccugcaggaaauauaaacuuaaaauaaaauuauauaccccacaggcuguguacuuuacugggcucucccugcacgcauuuucucuguaguuacauuuaggauaaucuuuaugguucuacuuccuguaauguacaauuuuauauaauucugaaauguuuuuaauguauuugugcacauguacauauggaaauguuacugucugacuacaacaugcaucaugcucauggggagggagcaggggaagguuguaugugucauuuauaacuucuguacaguaagaccaccugccaaaagcuggaggaaccauugugcugguguggucuacuaaauaauacuuuaggaaauacgugauuaauaugcaagugaacaaagugagaaaugaaaucgaauggagauuggccugguuguuuccguaguauauggcauaugaauaccaggauagcuuuauaaagcaguuaguuaguuaguuacucacucuagugauaaaucgggaaauuuacacacacacacacacacacacacacacacacacacacacagaguaaccuguaacucucaauucccugaaaaacuaguaauacugucuuaucugcuauaaacuuuacauauuugucuauugucaagaugcuacaauggaaaccauuucugguuuuaucuucaaagcggagaaacauguugauuuagucuucuuucccaaucuucuuuuuuaaaccaguuuaaggaacuucugaagauuuguccaccucugauuacauguauguucuuguuuguaucauuagcaacaacaugcuaaugacgacaccuagcucuaagagcaauucugggagaaugaaaggaaguauaaaguaacccauaaucugcuuggcaauaguuaagucaaucuaucuucaguuuuucucuggccuuuaaggucaaacacaagaggcuucccuaguuuacaagucagagucacuuguaguccauuuaaaugcccucauccguauucuuuguguugauaagcugcacaugacuacauaguaaguacagaacaguaaaguuaaaacggaugucuccauugaucugccaaaucguuauagagagcaauuugucuggacuagaaaaucugaguuuuacaccauacuguuaagaguccuuuugaauuaaacucgacuaaaacaaguguauaacuaaacuaacaagauuaaauauccagccaguacaguauuuuuuaaggcaaauaaagaugauuagcucaccuugagauaacaaucagguaagaucauaacaaugucucaugauguaaaaaauauuaaagauaucaauacuaagugacaguaucacucuaauauaauauggaucagagcauuuauuuuggggaggaaaacaguggugauuaccggcauuuuauuaaacuuaaaacuuuguagaaagcaaacaaaauuguucuugggagaaaaucaacuuuuagauuaaaaaaauuuuaaguaucuaggaguauuuaaauccuuuucccauaaauaaaaguacaguuuucuugguggcagaaugaaaaucagcaacuucuagcauauagacuauauaaucagauugacagcauauagaauauauuaucagacaagaugaggagguacaaaaguuacuauugcucauaaugacuuacaggcuaaaauuaguuuuaaaauacuauauuaaauucugaaugcaauuuuuuuuuguucccuugagaccaaaauuuaaguuaacuguugcuggcagucuaaguguaaauguuaacagcaggagaaguuaagaauugagcaguucuguugcaugauuucccaaaugaaauacugccuuggcuagaguuugaaaaacuaauugagccugugccuggcuagaaaacaagcguuuauuugaaugugaauaguguuucaaagguauguaguuacagaauuccuaccaaacagcuuaaauucuucaagaaagaauuccugcagcaguuauucccuuaccugaaggcuucaaucauuuggaucaacaacugcuacucucgggaagacuccucuacucacagcugaagaaaaugagcacacccuucacacuguuaucaccuauccugaagaugugauacacugaauggaaauaaauagauguaaauaaaauugaguucucauuuaac

SEQ ID NO: 192748 - RNA, 95161 nt, Homo sapiens
acgcacgucacguccggcccggccuccgcccgccagccgcucuccucccgcucgccguuagggaggcucugcaccucagccgccgccucugucgccacucucucccccuguuccgcgucugcgucgccaccaccgccggggguauccggggggucgcuuaccgggcuggccccgcgccacagccguagcuuuaaccucccgucagcggccgccccaggaagaggcuucucggccgcggagccacuuggggccucaguucucgcccucuugccgucgccgcggguccuggagaagcggccgcggccagggaacggggcaucgcgguuccaacgguagguaaacgggcggguacccggaucugcgcaugcgcggguugcaggucgccgcggcccuuccccuccuguugccccccagcgccgccugccacccgcgccugcucucgggcguugcguuucgggauguggaggacucuagcagguggggcguuccguggagagggcccccuuuccgcuggagaaagaggaagaugaagccgugucccuggcugccgggggguguggcagccuuggauuugcagcggcugcagugcaguugagcgggcgugccccucaccuccagccccuccagaguagauggcgcgacaccccacguuucuuugcugaccucuccugcccgcuggcgcugcgccucuuccccgcccacuuccuucaugcugggcagugaaguugauguagaagaaaaaggaguguguuuuauucugggcucaacugcgccccuuuuuaaggucacgugagaugagugguugcggacuuccuuaaaucgcucagagaauauagccaaaauugggcuguuggugcacuggggccuugucuagaaugcgcucugcauaggccaggcuggagggggacacuuuguauagcauuaggguucgcguggcacgccugguuuccuagaugagguuguaggaaucgguuggcacauuugcgcagugggaaacuguuaagcccuuuuuguuuguaaucaguuaaaaucaaacugacuuuuagaaagacgguggauuauuucauuugguuccccguuucgccuucuaaucagugaaaaaaguugggcauuuacuuugaaggaucugauaaucuaaaaugguagccagaaucauuaccaguaguaaugcagacuauuaacauuaacuggggugcaccuguuuagagagacagacauuaaagggugguuuugaauuauuugucuuuuuagagcuggguuagugugaggcuauuuucaaccuuccuuuuuugguaaccuugaaaugcuuguuggccugguuuucucacagguacugugcauuuacuaagugcuuguugauggaauugaauggacugauaauuauuuguauauccauugggagcgccuucuuacuuuuuuuuuuuuuuccuugagacaguuucgcucugucguacaggcuggagugcaguggagcgaucucgguucacugcaaccuccuccucccggauucaagcgauucuccugccucagccuccugaguagcugggacuacaggcgcccgccaccacgccugacuaauuuuuguauuuuugguagagaucagauuucacuaaguuggccaggcuggucuugaacugaccucaagugauccgccugccucagccucccagaguucugggauuacaggcgugagucaccgugccuugcccccuucuuacuuuuuuaauccgugcugcuuuuaaaauuggaguaauaguuucuccaguuuaauuuuauuacuaauuuagacacgugugugacacagcuuaaguucuuggaaaauguagaagggcauauugcaguggcauaauucauugggugguguaaauguuaguuuuuuuuauuagaaugucauuguuuuaggagagaaaauggcugaaaugaaucuguugacuugucaguguuuccccaccaauaaaauaacugcuuuuauaaucaguuaugaauaaccucaauccaucgcugcauagcuccuccaucaucguauucaaauuuuaaauuuggggacuauaauaguguaaauuacuguuuuguuuuuuuuuuugagacagggcaucacugucgcccaggcuggagugcaguggugcaaucucggcugacugcaaccucugccucccagguucuaacgauucuucugacuuagccucccgaguagcuaggacuaccggugcuugccacugcgccugacuaauuuuuguauuuuuuguaagacgggguuuugccauguugcccaggcuggucucaaacuccugaccucagaugaucugccugcuucugccucccaaagugcugggauuacaggugugagccaccuugccaccuugcccagccuuacguucaauuuuuuuuuuugggggggggggacggaguuucauucuuguugcccaggcugaagugcaaauuuuaguguguaaauuauaccuuaauaaauguauuuuuuuaaaaacccacugguggacuuuggagagcuuauacucuguugguagaaacagacauuaaacaaacacaaaaugaauauguaauaaaacuugugguaagccaggcucacgccuguaaucccagcacuuugggaggcuaaggcuggaggaucaguugagcuuaggaguuugaggccagccugggcaacauagggagacucucuuuacagaaaaaaaaaaaaaaaaagccaggcaugguggcaugcuccuguugucccagcugcucagggagcugaggugggaggauugcuugagcccaggaguuugaggcugcagugagcugugaugaugccauugcauuccagccugggggacagagugagacccugucucaaaaaacaaaacaagaaaccugugaugaauauuuuggagccaaggaacgccacacccuagauaaauuaauaaaugagaccauuaguuugaguggguugaagaaagccucuccaaggaugggacuugaacugaugauaggaaggaggaagcgugggagaguguuccaggucagugaacuagcaaguauaaaagaccuaggcugaggaaaaugugguaagcugacaagauaauuugaugacauuuacuagauuucuacuagagaaggaaauauugcaagucuuuuauuucaaguuauuaccuagcuucuaguguauauuuucuuuuccuuguauauauaauguauaaagauucuuaucucuugcuuuaauuuuaagagcgaugucugucaaguuucuauuauugcccuuuucaggaacagaauagaaaaaguucaguuuuguuuaccuauucuugaaaauauuucucuacuuuuugcuuuugugugucaagcugcugcucuuuacaauugaaaaguaaaaguaaaaauaaaacugaaaacugcuuguugauugacauaguaggugcugaauaucauuuugcauuggggugagcagggagguggaggagguucucuaugguccuaauuuggagcaaacacuggucacguuggauuuaguguuuggaaagguguaaaggagcugaaauuuagaauuagguaagaugggaguuuuuuucaauagcaaaagcagacugcauuaugauugguuguagaaucacuuugaaacuauuacuguuguaaaauauucucuuuuucuauugagaggaaauauucuaguaguauuuccauaaugaucuuuggccagcaacugcaaaacauuuccagcaacuacaaaguauuuaagugcuuuaugaauuacucuugguguggcuucauguauuucagugacauuuuaaacaaaauuuucacugagaauuguaguuguugccuagaaggggcaucuacuuguaagauaguagacuuagaguucuaguugcuaauucaguaacuuugaaccaguuucuucagcucucugagcuugcuuccucuucugagaaaaggaaggguaauccauucuccuuauuucaccggaugguuggaggauucaguuggagagugaacuggaaaguacacuggaaaugguagcaucaguuucaguauugggguucugcuauuuaguguucaacuggggaaacaaaaaugaagucauuuuuuuuuucuuuuuuuugagacgaagucucguucuugucccccuggcuggagugcaauggcggcgaucucggcucacugcaaccuccgucuccuggcuucgagcgauucuccugccucauccucccaaguagcugggaccacaggcaugugccaccaugccuggcuaauuuuuguauuucuuguagcgaugggguuucaccauguuggccacgcuggucucaaacuccugaccucaggugauccgccugccuuggccucccaaagugcuggcauuuauaggcgugagccacugcaccuggccuaauuuuguauuuuuaguagaaaugggguuucaucauguuggccaggcuggucuugaauuccugaccucuggugaucugcccaccucagcaucccaaaguguugggauuauaggcaggagccacugcacuuggccauuuuuugcguauuuuauggucaaaguucacaaucuaguggggaagauauacaaaaaaaguuuaaccacugcuuuuuuguucauguaccagcuucccuuuuuuuuucaguuuuuauacaagucugugcaaaaagagaaauguuuuaaucucaggggaccuaucuggcuagaccaaguuguagaauuacgcauaauaccccuuaccugaaaaaaugaaguguauuguaguuucguauuaacgagcuaugaaaaaugauaaacuagucuucuuacucuuaucagucuaguaggccuugccugugcauguuuucaguggagaaaagguauauuaauauuucccacguuguugcaagaaauagcuucuacucuuuuuuuugguuuuauuuuuuaaagcagugaaauucccaaucuuuuaagcaauagagcccucuuuaauuuaaaaacuuucuaguccugaauucuguauuaguuauacuuuguaucugauaaauuacuuaauggccaagccaguaugaacuuaauaacagauuaagugauuugguguuuuccugauuguguuaguccauucucacacugcuauaaagaacugccagaauaaagaaaagagguuuaauuguuucacaguucuacauggcuggggaggcuccaggaaacuuacaaucauaguggaaggggacgcaggcaugucuuacauggcagcaggcaagagagccuuuguaggaagugaagggggaagagccccuuauaaaaccaucagcucucaugagaacucacugucacgagaacagcaugggagaaacugccuccaugauccaaucaccuccuucucuccacacgugaggauuacaauucuagaugagauuuagguggggacacagagccaaaccguaucacugaucaaaguagcgucuaugaacauuugauagguaaguuuaugcacuauugagacauucguucagcuuuucuguuaaguaugucagacaaauuaugcuuuggucaguuucucaggccaggagggaaccacuaaguuagcauauuugccacuuuuguuguaccauacuuguucaguuagaaugaaagaggugccuuuugcuucagugaauuauuuggagccccagcuaguaagaagcugaaugucuagagcaggcauaaguuuauuuucuuuuaguuuugguuuaaugauguaaagucaaauuagcaauagucuacaaacuuauaaaucucuaucaucuuuauugagacccagcuuccugcuggcuuuucugacuuuguauaccagugauaauagggauguauuuauguaguuuuuuggcuuuaacaaguagugagauagcucuuuuaaaccuuucuaugugaauuguauccuauuuugucaaagcauuugggcaaaugugaguuuuauuguuucuuccuauucuauuugaagguagaacuuuuuuacuucaauguggcacuuuuucuuggcacaucuuuuugagucauucuguugcccaggcccagugcaguggugcagucacagcucgcuacagccucaaacuccugggcucuagaaauucuuccaucucagccuccugaguagcugggacuacaggugugugccaccacacuucgcuaauuuauuuauuuauuuauuuauuuauuuauuuauuuauuuauuuauuugagauggagucuuucuuuguugcccaggcuggagugcaauggcgcgaucucggcucacuguaaccuccgccucccggguucaagcgauucuccugucucagccuccugaguagcugugauuaaaggcgugugccaccaugcucagcuaauuuuuuacuuuuaguagagauaggguuuuaccauguuggccaggcuggucuugaacuccugaucuugggugauccacccgucucgaccucccaaagugcugggauuacaggugugagccacagugccugaccaauuuuuuuuuuuuuuuuuuuuuuuuuuugagacacggucccucucuggugcccacgcuggaguucaguggcaugaucacagcucacuggaagccucuaccucccugggcuccagugauccuuccaccucagccucccgaguagcugggacugcaggcgcaugacaucaugcccagcuaauuuuuguacuuuuuuguagaaacgggguuuugccauguugcccaggcuggucucgaacucuggagcucgagugaucugcccaccucggccucccaaagagcugggauuacgggugugaaccaucaugccuggccucuuuuuucauuuucuucagcuuuguugaaguaugguuuauauacaacagcauguccagcucaauacguuuuaauaaauauauucauauguaacuaucacugccacaguuaugacauagaacauuuucaucaccucaaaaaguucuguguuucaguuuucucaucaguaaaauggauauaaugaaaguauuugccuccuuuaggguuguuguaaggauuaaaugaguugauauaguuaaagucuuugaaauagugccuggcauauuguaagagcucagcaaaugcugucugcuauuauuaucuauaguauugauauuggugcucuaccccuuuuuaaaagccccuuacuacuaauuuuaguagauaguuaaaguguaaagauucugugcuauuaagaaagguacguuucauuugucaaaaaucaguugauuguagaugcuguuuugguuaauauagcucuguaguauauuuguaaguuggcuagugugaugccuccagcucuguucauuuucuucaggauuguuuguguuaaucaggguuuuuaugcuuuuguacaaaauuuacgguugcuuuuucaguuucuuugaagaaugucauuguaauuuugauggggagugcauugaaucuguagaccacuuuggauuguauggauauuucaacaauauuaaauuuuucagcccauggggggaaaaaggggugugugugcugcuacuauguauguguauuuuuguauauguaaaugaaauugaauggaaugcaaaaguaccuugagucccuguagaacuuagguugauagcugguguaugaagaugcacuuucuugaaugucacccaacuuuauugauaauugguguuuaauugcauuguuucugagccgggaguagugacucaugccuguaaucccagugauuuaggaggcugaggugggagguuugcuugagcccaggaguuugaggcugcaugauugggccacuguacuccagccugggcaacagggugagaccucaacucaaaaaaaaaaaaaaaaaaaauacauauauauauauauauauauauggcuuuguuuguaaucacuguuaucucauggugagguauaugauguaaaauucaauguaauuuccuauuccuugucaauaacaccaugcuaggcaacugucacuuguauuuaaaauaauuuugcuguuuggggcugggagugguggcucaugccuguaaugccgaggugugcagaucaccugaggucaggaguucgauaccagccuggccaacguggugaaacuccaucucuaccaaaaaauacaaaaaaauuagccgugcaugguggcacgugccuaugaucucuacuacucaggaggcugaggcacgagaaucgcuugagcccaggagacagagguugcagugagcugagaucaugccacugcacucuagccugggugacagaguaagacucugucucaaaaaaaaaacaaacaaaaaaaacaaacucaaaaaacucucucucucucucuuucucucucucucucucucucucuguguguguguguguguguauaaauuuugcuguuuagauuuauaacaguaugcuuuuggaaauacuugguuauuuugaaaguccacacauuguauucucuugugucaauccuuuuauugaacugcuuucucgacauuuuauugauucuaucugcuaggacauuuuauuagaucuuuuugguauauuuuuguacggugccugcugcuguuuuccuuuuuuuucuuuuuuuuuuuuagaauguaauauuguaguuuagguguugcauucauuuucuaggacuuucaugacaaauugcuacaaacuagguggcucuaaaauaguaggaaguuuuuucucacaguugaggaggguagaagcccaaaaggaaguguccacagggcagauucuaggggagaaucuuucuuugccucuuccagcuucugguaguuccuggcauuucuuggcuucuggcagcauaacuccaguuucucccugucuucacaugcucuucuuucucucugugugucucuguguaucuuguccucuucuuauaagggcaugagucauuggauuuagggccugcccuaaaucuaggaugauuuccucuugagauccuuaacuaauuacaccugcaaagaccuuauuuccagauaaagucacauuaugagguucuugguggacaugagguuugggggggacacuauucaacccaccacagaugugaagggaauauuuaugugauuuaagcucugaaaagggguaggaaacaggacuaaauaaugucaacuacuuugcaguuugcagaaauguuaccuugggccacucuccagucugagaguucucagcaaugugcucuagauacaagucccaagugaaagauuggcuccugggguuuggaccauaggccugcccucuggaaguaccuguucgcaagcuagaaguaagugaugaccuaaaauguauauaagacuuugaggccgggcaugguggaucaugccuguaaucccaggaccuugggaggcugaaguggguggauugccugagcccaggaguucaagaccagccugggcaauguggugaaaccucauuuuuacaaaaauuagccgggugugguggcccacgccuguaguccuagcuacucaagaggcugagguaggaggaucacguaggucuggggagguugaggcugcagugagcugugaucgcauaugccacuguacuccagccugucucaaaaaaagaaaaagacuauggccaguuugagcgccagaaugugacauucuaucauacuauaaauugugauaauuuacaugaaaaaauaguauagugauuaagagcucaaggacuuugagaaucacauucucugguuucauauucugccucugacccuuauuaucuggguggacuguggguaaauuggugagccuugcaaugucuaauuaaggguuaaagaauaccuuaauacauguaaagugcauggaacugccuggcauaucauaacugcucauuuaauguuuguugcugcuauauccgucaacauccucaggagaaagagaaacuugucgucagaaagguugaugccuccgauuguuuuccuaguaucaaggguaaauuuuuacugaugaauucauagauuccuacccagccucaccuuagaaaaauaugcuuucagguugucuaguuagagguugcagguaguagaggucaugagaugagauaauaggcuccugacugggagcaguggcucacaccuguaaucccagcaaggugggagggauugcuugaggccaggagucugagaccaaccugggcaacaugagacuuccucucuacuaaaaauacagcuggguauggugguguguacauguaggcccagcaauuugggaggcugaggcaggggauugcuuggguccaggaguuugaggcugcagugagccauaauugcaccacugcacuccagccugggugacagagugagacccugucucgaaaaaaaaaaaaaagaaaauagcuucuugauuucauuaacaaggcauucuaaacacugaguagccauuuuagugauguauaaaacuugcucccugacagacuuuuguagugaguuuucauuuauaguacaucaagcaaaucccccuuuaugucaugaggauaucagcuugacuuuuaguguaagucuguuaaauaacuuaucucugaaguuaacuucgaaauuguuuucaaauggauagauagguagauuaacuacaugucuuagcaggcauuucaggauguuuugcaacuaauaaucaacuaaaagauuuguuaugggaaugugguuuuccuucccuucaguuuuuaauguuucuccuggagguguauguuacuaauaacacuucuuugaaaaccacacugauuaauauuacucuucugcuuaccugaagcuucuugggcagaguccugcaguguaguuuacugagcuuauuaaaagauuuguuaauagaugacuagaauucacagaggauaaugauaccauuagaauucacaaaggaugaugagaccaaauauuaaacacuuugccaaacaaguucuucucucucucucuagucuaauugcuggucuuuuagcauuaugcaaagaagagagaggagacugguucucuaucuacugcauaccuauguuaucucaguuaaacuaaacuuaacagcuguacagguauuauucuuuuuuuuuuuuuuuuuuuuuugagacaggaucucacuuuguugcccgggcuggagugcaguggugcaaacacaacccauugcagccuccaccuccuggcagaagugauccuccugccucagccuuccaaguagcugggacuacaggcacuacuauaccuggcuaauuucuaaauuuuuuuguagagauggggucucacuauauugcccaggcuggucucaaacuccugggcucaagugauccucccaccuuggccucucauagugcugggauuauagccaugagccaaugcaccuggccuguacagguaguuucuuguuuuauauaaagaaaccuaggcucagagacauggaaguuguucaccaucaugugucuacaaaaugacggaguuauuaauugaaucuaaaucuuucugggacuguucuuuuugcucuuuuccaacauaugcuaucgcuucucuaaauuagggagcucaggcaaccacuauguuguauacaaaaaaaagaagaaaguacuuaaguauaguagcaagcuuaaaucauaucuuugauucuuugaucuuuugaaaauacuuccauguuuaguucugaguaugugaggaaaugaggaaggaaugggaugggguaggguguccacacauaauugaggaaaauggauuauuugaaugguguaguccuugaagauguguccugucacauauccuccuuugcaauucguuuauuuauuuaucuucagcaggaagauucuucuccaauuuuccaucaucaucugaaaccguugcaagguuuugccuuuagguuacagauagauuuuucagacagaagaauaccuuucaauauagguaaccucuuaagaggacuguacugcugcuucuauuaauagucucuucugacaguuaaagaugugggaaauugaaauaauuguuuuugucuuguagauuaacugcugaaguacugaucgaguucugcauuucuucaaugaggaacuacaggcugaucuucugccauaaucucaaacagccauaaaugacaaaagaaugcuugcucagugaggguagcuggugcagaagccauuuuuuaaacuuagguauuuaaguacugaaagguaaguuuucaaaaugguaacuaucucgugcucuauaaauccauagagauuuuggaacuugccccuguagcugcuauuugauuuaacuugagguuuuauaguucuuagcuggcaccagauacauugaagaauggauguugcuugucugagacuauguaaauguauggcauuuugcuauccuuaaguuaauuuuuucuuuuaaguuggcugcauuguuuccuagucauguugugacauucuugauccaguggguauacacuugauccaguggaccuuauuuuuguaaacuuaggaauuuuaguagacuuauuuuugugauuugcuuuuuuucucuugcagugagaaagaaauuguuuuucuagggugauggaaaaaauaccagcuggugucauuuuguucauuaucaaccuuugaguuuuucuuucuuuuacaaauacucuuuuccuacguaaaguaauaaauguguaauguguuuauuuuagaaaauaaauuuuucuuaggauuacuuguucucugaugugucagauauuggaaauggccaucugagacauuguuuucucccacuucuuuacugaucacaauuccuacaaaauuaggacaaauaacuauuucuucugaacuagauggcucugaaaauuuuucuuuuggauaauuaugaaauaacaguguuaaggacaggcacaacggcuugugccuauaaucccagcgcuuuggaggcugaggcuggcugaucacaugaggucaggaguucaagaccagccuggccaacauggugaaaccccgucucuacuaaaaauacaaaauuagccgggcgugguggcgcacaccuguaaucccagcuacaugggaggcugaggcaggagaaccgccugaacccaggcggugaauguugcagugagccaagauugcaccauugcacuccagccugggcaaaaagagcgaaacucugucucaaaaaauaaaaagaaauaacaguguugauaaaaggacaucucuuauugaaaguugauguccagaaaugaaaaauuucuuuuuuauaaaaauguauuacaggccgggugcgguggcuaacgccuguaaucccagcacuuugggggccgagacgggcagaucacgaggucaggagauggagaccauccuggcuaacacggugaaaccccaucucuacuaaaaauacaaaaaaauuagccgggcgugguggcaggcaccuguagucccagcuacuugggaggcugaggcaggagaauggcaugaaccuaggaggcagagcuugcagugagccgagaucaugccacugcacugcagccugggcaacagagcgagacuccgucucaaaaaaaaaaaaaaauuuauuacagcugcuuuaucauguagaaauaagaacucauuaaucuuguucuuauuagcccaucauuuauaaaaagugguuauuagaucugcacuuucuaaaaaggauucucuccuguuugggcuuaugaauugagggguuagaugagcuuuauauggcacaguccagaacggguuuggauuuaccugugucauuaauaagcuuguucaguaaagguuuucuuggagccaaauuugcuccuuaauuugucuuugggacauuaaugccucuugcuaaaucuuugaugauuaacuuugcuauuguuugauaaguaugcaaacacuaaagggagcauucagcacuaacucuucguaauagggaauauguuuagguaauuguacugaacuucaucuguagaacacacuaugggccugcuaacuggaacauuuaaauagaugagaacacauucagguguaaagcauuuuucuuuaauguaucuagucauauugccaccuguuaaucauuauagucuuuuuuuuuugucuuucauuuggcagaaaagacagcuuugauuucuggcugcaaaaaagauaugaggaagagcuccuccccuuccuugaguaacugcaacuccguucuugcuaacaaaauauuuggaauuccacuugaugagcugcagcagggaggacauccagacaaugagguuccauucauaguccgccacguuguggacuauauugaggaacaugguauacauuuccuuacuuugagggcuagcuuuuguuuuaauaaacacaacuuacaccuuuuugaccuuggauuuuuaauuuuuuuuuuuaauauggaaaguccaaaacauaggaaaaacuagaaauucuuuuuaauguuuuagugugauuuuuacuuaaauucauauacuuagaaaugacaguugcccagccuagaacaaguuuuagugggggugauaggaauauuuuuaauggauauaaggggugggauaaaauagaauaucccuuagaacagagauaguauguuucuagauguauaauuugaagguuuuuagacaagucaggggagccaagaaaggcuuuccaaaaguaugaguauuuuaaguuaauuggagaaugaauauauauggucaagcaguugacauugcagcuuauugaaugauugccuugaacuaacguaggaggucuggagcaacaaggacuuuuucaagucaauggaaaugcugagacaguggaguggcuucggcagagauacgacagcggagaagagguggauuugguuaaggaagcagauguucccucagcuauuagccuucuuagauuuuuucuucaagaacuuccugaaccuguuaucccuggcaguuuacauauucacuugaugcagcuuucucaagguaacauaauuugauacuuaucaauuggucauuuguuguuaauuuccuagucuuuaccuuuuagaaaucuugacauguaaacaguaaguauaguauuuuagagauuaauuuguuauuuucucauuugcuuuuugggguuguaugaucuugucauaggaaaggcaacuuccgggaucccucuaguacuauuuacuuuuugugauugguuuuauuagccuaagaaacagggugaagaagaggaaagggaggagacaagaacaaggaguaggaggggucaucaaaaagaaagaagagaaauuuauguaagguaaugugugugguggcacaauguccaauaguagccaaagguguugcuuaguggugauauuaccacuauuaggguuacuuaucccugguuugauagaauuuccuagcaaaaggaagaagacaacuuugauucuaggcuuugaauauaccuaaaacuuguucuugaacacuuagcuaaaggaaaugaauaucaaauugaacauuagacucuaagcuaaagaaacaaaaaaagauguaucuuuguuagguuuuuuugguggugacuaaaaaguagugcuuagcuagaguggaacaggaacaggaaaaauaaugguagaggcagcagaaaggucaaagaaccaagaagugaggaaaugcuucuguuccuagagccaaaugguauucauguauauguaauggagggacaugcuucauuauauaggaaaauguguaaaguuggcauauagaguuauauauuucuugaauuuuaaaauuacccuuucaggcuuuuuugguauuauggaguucauuuauuuuuugaaucggggcuucuaaagaaauucaguuaugcuaagaaauuauaacuacuuccuuuaugccuaucucuaucacagcugggcauucuauaauauguguguauauauccuuaaguauuauguugucagagaagguauauuuucuuucgaaaguguuuauccgucuuuuucuuaaauuuuaaacugugagccuaaguuaguuggaugucuuugauuuauguauaaaggucaaugcaaagacguucugugacccucuuacacauguuuucuguacagcuaaaucauaaggcuuacuuugaacuugcuauauucaggaagggguaaccugauucaguucuguucuuuuacucuauaaucuggaucaaaaaacagguuuuaaaacgaaauguuauuaguaaggcuacccuuuuuucaaugcaucacuuuaauuuuucuccccccaaaauuacgcuuuuuuguuuugaauuuuugaauccauuuuauuauuacaggaauuuuuucaaauguuuauguugagacacauaauaagcauuuugcauuuauuaaauaugaaccgaaaccaauaugguaaagguuuuuugagccuuuuaaaauaacucuagagccauucucuuuauagugauagguuuccauguucccucuguuagcugaauugcagacacauauuuaaaguuccaagagucagauaaucuuucaguccugaaugaaaauuuauaaauuaauaauugcagugagauuuaauggaagcaaagucauugacucacugguagaaucuaucagaagcuauuuauuuuucacuaggauugucauuucaguugguuuucauuuauucguuguuguuguuuuuuugaaauguccuugcucugucgcccaggcuggagugcaguggugugauccuaguucacuacagucuugaucuccagggcucaagugauccucucgccucagccucuugaguagcugggacuacaggcgcgcaccaccaugccuggcuaauuuuuuaaaauuuuuuauguuuuguagagacaagaucuugcuauguugcccaagcaggucuugaacuccugagcucaagugauccuccugucucaguuucccaaacugucucaguuucccaaagcacugggauuauaggagugagccauuguaccuggccugguuuucauuuaaaauuaugacagcaucauguacuguugggacaacuaaguuccucuucaaagacacaacuuucuggucauaaauuguaaaccaauccuaccccuucuuuucuuucaaaaauugcgcauuuacccuauuugaaaaaguuucagucuuagccauggccugguuuucauuuaaaauuaugacagcaccauguacuguguugauauucauggaauuacaauacgcaucuuguuacuuauucuuaugcuaacauucacuugugaaggaauuuaagauaugcaaaaauuugcaaaagagaugugcaaaaaaaagcaaaaaugcuuauggucaauaagugcuuucauguuuaauaugagaaauucacuguuuucuucuauuuuccacuuauacauagauaaucauuagcauguguauguaugugugcacauauacacccguuucuuuaauagcugugcagcuagguaugguaguauuuggggugauauuugcauuuauguuguaauaucaucugaucauucauucauuuaguuauuuugggaaggugucuagaucucugaacaaaguuuccucucuucauuuacuguagauaauuuuguuuguuucuuuuauucuuugagacagagucuugcucugucacccaggcuggagugcagugggaccaucuuggcccacugcaaccucugccucccagguucaagugauucucaugcuucagccuccugaguagcagggacuacaggugugugcuaccauacccagcuacuuuuuguauuuuuaguagagaugggguuucaccauguuggccaggcugaucucgaacuccugaccucaagugaucugcccaccuuggccucccagagugcuggaauuacaggcaugagccauggcacccagcuguagauaaauaauaugauaauauuuuaauauucacaaauacaugacaguuaauugcuuuuaagaucauggaagaagcacuguugcaguugcauuucagcuuuuguuuuuaaaaagugguuucauuuuucugugguagcuggacagugcauccacuggugugguuaaaccuuuuauuuagacuaggguuucacagccuugguacuguugauuuugggcuugauaauuuuuugugauggggaguuguguaccuuaggauguuuagcagcaucccugaccucuaccaaaggcacugucuuccccaaagucaugacaaccguucauugucagauguugacaacuucuggguuagaccauaaugguuaguccaacugcuuauacauuguguuuugauagaaaacauagcuagcaguuuuguggauuaguuagaacauuuccaaaaaauguuacaguacuugaaggaauuguuaggggaaacuucucugauacauacauuauuuuccuuggauaugauuuaacuagaaauuagacuccaaaggaaagaaauuuaagcaaguauguauauauuuaauguauuuugaaaugcuucucugccuuauuugaagacuucagacacaggccaguauagguacaaauguguagaggaaauguagccaaacaaaacuuuggauaauguggauaguauuucaaauaaaaacaguauugcccacaagcuuaccaccucaagucaaaugguguaguauguucaacaucuuuuuucaguuauuguguauucauucagugaauucaacuaauguuuauugaacaucugcugugugcuaggcagugcucuagaucagcaauccccaaccuuuuugacaccagggacugguuuuguggaagacaguuuuuccacugauggagaggaggaaugguuuugggaugaaacuguuccaacucagaucauuaggcaucagauucucauaaagaauguacaucuagaucccuugcaugcauaguucacaguagcauucuugcuccuaugagaaucuaaugccgccacugaucugacuugcugcucaccuccugcuguauggcccaguuccuaacaggccacagacuggucugcagccccggcuggggacccuugcuccagauacugagaacucagcacugaaaaaaacuagaugaaaaucucugcccucauggcugggcguggggacucacgccuguaaucccagcacuuugggaggcugaggcgggaggaucacuugagccuaggaguucuagaccagucugggcaacauagggagacccuguuguuacagaaacuucaaaaaauagccagcugugguggcauuugcuugugguucuaguuaccuaggaaguugacgugggaggaucgcuugggccugggagguugaggcuguggugggccucagugaucaugccacugcacuccagccuggagcgacagccugucucaaagaaaaaaauaucucugcgcucacagaacuaaaaugcuauaggggauaagggaagaugguaaaguagaugauaaaaauaaacauauggauagguaugcuagacauuaagugccacagagcuggagagaauguuagguagaauuugucaaguguugguaucuucauuauauugauaauauuaagugcuugcauuuuugauaugugauuucuauaauaauuuucugcugaaugcuuagguuguuaaaauuucucaucaguuauagguccagugauuuaaacauuaauccagggacuauucugucugauuuuaaaauugaaguacugguacauuugaauggacagcugguaauauuacaaaguauagaagaguuguuauugguugcauuuuaaauuuuaaguaaaacucaugugacuguagccuuuccugauaaacuuaaaauuuuuuuuuuuuuuuuggagauggagucuugcucugucccccaggcuggagugcaguggugcaaucucggcucacugcaagcucugccuccuggguucacgccauucuccugccucagucuccugaguagcugggacuacaggcacccgccaacacacccagcuaauuuuuuguauuuuuaguagagaugggauuucacuguguuagccaggauggucucgaucuccugaccuuaugauccaccugucucggccucccaaagugcugggauuacaggcgugagccaccgcgcccagccuuuuuuuuuuucuuuuugagacagggucucacucugucacccaggcugaagugcaguggcacgaucucggcuuacugcaaccacugccucccaggcucaagccauccucucaccucagccuccugaguagcugggagcacaugugugugccaguacacucagcuaauuuuuguauuuuugguagaacgggguuucgugauguugcccaggcuggacucgaacuccugagcucaggugaugcgccugucucagccucucaaagugcugggauuacaggcaugagccaccauacaaggccaaauuuuuuuuuuuuugaaucaacauaguacuggaguccuauuuccugauaaacuuuuuagacuaguguuauuuugcagagauaguuaauaucaugaccguaaccuuuuaccaggaguuuuucaguaaaauaauuuuaagaaccugcggaaaaauacaaaaugaaacauaauuuaauugauuuuuacucauguagcacaauaaaucacuucauuucgagaggaccucugagcacuuauuucucccaaaugggauccucaccaauuaguggaaugaauacgggucuaguuucuguuaaugaaaacucauugacacgauaaauacaaggccuaacuugugugauaaaguuuacuugauaagcagaaaccaacaugaauuuagaggagaaaaacagacgagaaaugaaagaccuuuuaauuuaguuauacugauauugcugaaguuaauuguuuauuuuaggacgccaggagaagaaaaucacacuguuaccuuuuucuuuccuucuuuuuacuuucaucuaagcugaaagguaucacugauacuauuagccccucaaauugcaucucugcuuugcucacuagugguuuguauugucuggcauggccagugcauuuugacuucuuauaguuggcacuaguguggaaacacagguacagucaugcuggagacaguaggaugagaauuaaaaaaaaaaaaaaaaaaaaaagagaauuggggccaaugaguaauagaugaggaaaacauccuccagcaauuaagggauugaguuccuuuuuuccagcuccucuucuccaccucuucuccauuucauaagugaaauacaaagcccuaaggcauuuggccccaguagaggaagugaagagguuuugaauuguuguauuaaaaaggugauguggguggaguaaugugaaccuggcaaaauaucagagcuuugcuuuuuccuuuauugaaaaaaaccuguuauuauuguuuuauagauuauaauaaugaagaugaauuuggaagaaaguugagguuccucuugcaacagcuuccaccuguuaauuauaguuuguuaaaguuucuguguagauuuuuagccaauguagcaucacaucaugaagaaauuugguccgcaaauucuuuggcugcugucuuugguccagaugucuuccaguaaguuguuuaaaaaauuuuuguuuaauuuuuaaaaauuagauaugugaggccgggcacgguggcucaugccuguaaucccagcacuuugggaggcugaugcgggcggaucacaaggucaggagauugagaccauccuggcuaacacggugaaaccccgucucuacuaaaaauaaaaaaacuagcugggcaugguggcgggugccuguagucccagcugcucgggaggcugagacaggagaauggcgugaacccggggaggcggagcuugcagugagccgagaucgcgccaaugcacuccagccugggugacagagcgagacuccaucucauaaaaaaaaaaaagaaaaauuagauaugugaaauggaaucauuauauugucucccaaggaucgcagguugcuugaugaacaauuauuuuuuauaguagauaugauuaauucuuacagcauuuuugugaacaggguacaaauuagguagguuuuacagaugggagaauggaagcacagaaugguaacauaaauugcccauguucauaaaguaucucauugguugucuucuaccuuuaccugugauugauuuaagaacucucaauucaauuuggacuucuauucuuagcauuuacacagauguggaagacaugaaagagcaagaaauagugagcaggauaauggcuggacuucuggaaaacuacuaugaguuuuuugagaaugaagaggaagauuuuucaucuaaugauuugaguucaauuacugaacaggugagaauauucuauuuggagggauaauuuuuuuuuuuuuuuuuuuuuuuaagaauaauaugcucuuaaagacuugccacagacauaaguggaauuuaaaucugaccuggaaguaauuaucuugguuauuauauguaaucaguagguggcacauucaugauuuuuuuccugaacaacauccuguccuccauaauuugauuaauaaggaaaaggcauuaaaauuagaguauaugguagagauuuuuuguuucuuuuccuauuguuuauuuuguaaggauaaugcaguguuuugguuuuuugcagagaaacugcuagcauagaggaauauaggcaaggggugagaaauuuaaaguagagggaaagauucgguacacauuuuuaaaaauuugaaguuuuucuucaauaauagagcaaaucaacacaauaguauaauugucacuaaugggaagcaucuggauauuaauaguuuaaguggcagguaauuuuuaaauucuggugacucuagaauauuaaaaucucuuucugagguuacauuauaaucuuuuaaaaaauuguuuuauuauuuauagagacagggucuucuuaugucgcccagguuggucuugaacucuuggccucaagcaguccuccugccuuggccuuccaaaguguugguauuacagguguuagccaccacaccuggccccacaaaaugauuuuaaaaagugugauauaacauguuaaaauaggccaggcgugguggcucaugccuguaaucccagcacugugggaggcugagguggguggaucagcugaggucagggguuugagaccagcccggccaacauggugaaacacugucuguacuaaaaauauaaaaauuagccaggcauaggggcaugugccuguaaucccagcuacuggagaggcugaggcaggagaauugcuugaaccugggaggcggagguugcagugagccaagaucguagcacugcacuucagccugaccgacagagcaagacuccaucuuaaaaacaaacaaacaaaaauguugaaauaauaguaucucuguaccaaaaaggugugaacugaauaaguuuuuauucucaguuuuaaaagccuucuuuaaaaauuuuuuuugauauuuugcuguugugcccaggcuuuuauuaaucaaccacaauaauucccaccccugccccaacccuuuuuuuuuuuuuuuuuuugagacagucucgcucugucgcccaagcuggagugcaauggugugaucuuggcucacugcaaccccugucucccagguucaagcaauucuccugccccagccucucgaguagcugggaugacaggcgcucgccaccaugccuggcuaauuuuuguauuuuuaguagagacaggcuuucgccauguuggccagacucgucucgaacuccaggccucgggugauccacccaccucuaccucccaaagugcugggguuacaagcaugagccacugcaccugguccccuuuuauacuucugaaaacuuuuuuuuuuuuuggccaguguuuccuugcuuagauuaccagauggauauuaaguacauccucucaacuuucacuaguuaauaaaauacguagauggggaaagaggauaauuucccauuagaucuacuuuaaaaccugaucuaucauuugagauuuucaccuuuguguugaaaucuuaccucucaguuaaucacuuaggccagugauuuuucaguccuuuucauuagcauuauacaugaugugggauagacuaggaaagacauuuauaaacacaacgaauuauacagaaucugcugcauguacuuuacaugugaacuuaaugguucacuaacuguuuuguuuuuauuuuuguuuuuguuuuugagacaaagucuugcuguguuucccaggcuggagugcaguggugcgaucuuggcucacugcaaccucugccuccuggguucaggcaauucuguuucagccuuccaaguagcugggauuacgggcacaugccaccacauccggcuaauuuuuguauuuuuaguauagguuggauuuugccauguuggccaggcuggucucgaucuucugcccucaagugauccacccaccuuggccucccaaaguucugggauuaaaggcaugggccaccgcgccuggccuaacuauuguuaauaaugacuuuuuagugacccaucugacuagugagcuugauagaccugugguugagaccuccugcuuuagguaguuuggaugguggauacucucuucauuuauauaaaaagugauguuacauguagaagcuaggaucuaugcuauuaaagaaaugacaacaauuucaguuauaaugauaggcauuauugcuuauuauguauagacauugcugaagagguuacauauauuaauccuuucaaccagcucugugagguaguuaguauagcaucuccauuuuauacuuaagacuuggacaaguuaaguaaguugccagagaaaguuagggacaaguagggaugugugaauauagguauuucugccucugaggccuagcuuuuaacuacuguauuauacuuuauuuaauuucgaaaccaaaucuuacucugucacccaaguuggagugcagugucacaaucgcgucucucugcagccccgaccuccugggcccaagugauucuccuaccucagucucucaaguagcugggacuacaagcacaugccaccaugccuggcuaauuuuuguauuuuuuuguagagacaagguuucaccacguugcccaggcuggucuggaacuccuggguucaaggguuccaacccccucagccucucaaaagugcugggauuauaggugugagccaccgaccauacccaaccuguauuauacuuuaaaauaggcacucuguacuuguugauuaggagugugauagaauaucacaguguaaugacuuuucuuuugguugcaguuuuacuuucugauaguauucuaguaacuguauuuguccaucaggaaaaacaccacuguuacauguaguaguaaacacauuuauucuagauauuucuauugcauuuuucuagcauggagaaaaagcauacuugcauugcucagagucuuuaaugacuaguauuaguuuauauuaagcaauucuauagauaguuucuucuuugggauaacuuaaaaacucauuugaaaauauuuugcugguuuuccuucucuaauauuucaguaucuuuuuauuagagugauuaccuacguagccaguuucauaauggaggacauuuuagagcuccugcuagcaagauaauuauaaccuugacuugugcuuacuggucaaaauaugaguucuuccuuguuauaggauuccaucucuucaugaauaauucaaucugaaucacuuagaaguuagcugacauuuucuaaaauguagcuaacaucuuaaggcaacauuuuuuuugcgcuucuuuuuucacacuuacuauauuaaaaugacuuguuuaaggcaccuggaaaaucagaucaauuaaaagucuguuguaaguguuacauuuacgaaacuaguuagaaaauuaaguuuucuuaauguuaacuauaccuuacaggcuuacuuauauuccuagauauacuaauuuugcaauauacuaauauacuaauuugcaacuagugauacacuaauccugcuucaaaauguuacauuugucugguugcaauuuuauuuugauaugaaaaaguugacaguuacuuacuccauaagagagauugguccuaggaaaugaggaaauaaaaaugaguuguuuguguuuaaaauuuucauagaauaguaugucuuagauguguuaacgguuucauuacauuuuaauucugaauuucuuuuuauuuauauagguuaaugaacuuucugaggaagaagaggaagaugaaaagcuggaacauauugaagaacuuccagaagagggugcagaaaaaucaaaugacaugccagaggugguacaauuaaggaugacugaaaacauccuggaaucaaauaguguuacggcaacaagguaauagcucaguugaaugaacuuuagcuuuugaguauuucauucuaaguguaaacucacuccagcauucagaaacacaaacuguaacuauaugugaaaguuuggcauuugugugugaaaaagagcaagaaguaaaauuuaaagaugcagucuugcuaaggaauuuucaguuauuaguguuaauaccuuuuuucaaaaacauaacuucuuacaaauauuucuuguuaaaguugguuuuguauuagcuuauuaauugggcuggauaaaauuucagaaccucuggaaguagcaucguuagagaaggauacagugacugaauugacuuguauaucccguuuccaggcuacaauuaguuguaacuaggcuguaaggauggaacucugauccauuaagauagugcuuuccaauucuuuucauguacaaaaugauaauauuuacauggcaugcuggguaaauucgauaaaugugguaggcugaagacccuaucccagcacauagcugggaccacugggcacacuauuuaggaagcuuuagagaacucaagagaaagagugaaccuuucuguggcuuuugauaaauauuuccagacuacuuaaaggauguaacccaguuuacauugucauacuccccauauguaucuuuaggucugcuaaauucuaugcucguucuccguaaagcuccaugguuuacuaacccuuucuacuuaggaggauccagcuauauauuuaguccacuagauauuuuucauuuaauuuguguucaguggaagggugguuaaaaagaagaggaaauaggccgggcgcgguggcugacgccuguaaucucagcacuuugggaggccgagacgggcagaucaugaggucaggagaucgagaccauccuggcuaacacggugaaaccccgucucuacuaaaaauacaaaaauuagccgggcaugguggcgcgcgccuguagucccagcuacacgggaggcugaggcaggagaauggcaugaacccgggaggcggagcuugcagugagucgagaucgcgccacugcacuccagccugggcgacagagcaaaacuccgucucaaaaaaaaaaaaaagaagaggaaauaauaauuugagucagaaagcaaaaugucauuuaaaaguaacugguaauaucuaagggaagagcuaucuauugccauuuaggaaaauuaugaaguaauuuuaaaugcugcuaaacacaauuauuacauuucucuguaggccucuggaucuuuauauuaucuaugguuucuucaaacaggaucauaauucuguuauauuaacauguuuauucucucuguugcccgauuuaacauucuguuuuugcuuuuauguguguuuacaugaccuucuaauuuauuuuuugaugguuucuuaacuguauuuuaauuauauauuaaaauauuaucuauauguucagauauuuaacuguauucuaacauucuuuuuucuugauauuuugaguuguuucagcuagcuugucaguacuguacugcuacuaaaaaaaaaaaauaccuuuguuguuuggcccuuuuuuccuccuucuaaauuauuuggauacauuuacuggaauugaagagugaaccuuucucuggcuuuugauaaauauuuccagacugcuuaaaggacgugacccaguuuacacugucauuaacaguauuuucuugaggaccuuacagcaauagauuuaaauggguguuuuaaauuuuguuaauuaauuaauuuauuacuauuuuuugagaccagagucucacccugucacccaggcaggagugcaauggcacaaucucggcucacugcaaccucugucucccggguucaagugauucucaugccuuagcuucccaaguagcugagacuauaggcacgcaucaccaugcccagcuaacuuuuguauuuuaggagagauggaguuucaccauguugcccaggcuggucucaaacuccuggccucaagugauccgcuugccuuggccucccagagugcugggauugcaggagugagccacugcacccggccucuaauuuuguuaauuuagagcucugcucuccaauaagguggccauuagcuccuucuguguauuuauuauuauuuaaugacagggucucucgcucugucauccagucuggagugcaguggcacaaucacagcucauguauagccucuaccucuugggcucaagcaguccugccucagccuccuguguagcugggaccacaggugcucgcuaccaugcccagcuagguuuuguauguuuuguagagaugggguuucggcaugucacccaagguggccuugagcuccugggcuuacaggugugagccacugugcccggccacuuguguguauuuaaauguaaacuuaaacgaacugaaauuaaauaaaauuuuaaaauuccuuccauauuugugccaccuacauuucaagugcucaguagccacacguguggcaagugacuaucauguugggcagugcagauauagaacauuucuaucauuguagaauuucuuuuggacagugcugauuuagacaagugaauucauuaaguauuuuuauuuauguaauuaccagcaaggcuaaguaugguuucaaauacauauuacuaauagcuucucuucgaucaucugucugguuuuguagaggauccuccuuugcuccaacacagucauuggagauuuagugguugucaguuuuguuuuuuuuuuugagauggaguugcgcucuguugcccaggcuggagugcaguggugugaucucggcucacugcauccuccaccuccugaguucaagcgauucucuggccucagccucccgauuagcugggauuacaggcccgcaccaccguggcuggcuaauuuuuguauuuuuaguagagacgggauuucaccauguuggccaggcuggucucaaacuccugacuucaggugaucugcccaccucagccucccaaagugcugggauuacaggugugagcuaccacgccuggccaguuguuaggauucuuuaauugcagcuccuaggaacagauucugguuaaaguauagaaaaagcaguuuauuaauaagaaggauucugggcuacagucaaaucgaaaugcaaagauaagaacaugggcagcucugugaaauuuagaaacacagaggcauguaauaaucucuucagcauguggcuauugcugugagaguucugacugccuccgucugucuguuauucugcuuuggagcacauagcugugggguggucgggagagggucugcccuaaauuuaguuaggugucucuauucccauggccagcguggaacuggucauugugauuuaugugucucugaggacggugcgggauggagggaggagcuaguuucccaugggaaaacagggcuauuaccaaaauguugggguagggauauuaggcagcagaaacagauaugucuaccauuguggucuucuagauuuaguaauauuuauguguuucgguuaauaucuauacauuuccuuuuuauuuuaguuuuggcugauaaaguguauaaagauuaaaaaguacccaugacuacuuuuuuggugguaucuauugcuucauuauaguacuuuucagguaaauaaaacccuuuacaugucaugagaguagagguaccugcuguuuuuuuaguugacauuuauuuauuuaugaaaauguuaauaauuuaacucuucucuugaaaguaaaaauauccacgguguguaguaccuucuagacuguggucaauuuauauucuauuuguuauuaaagaugcucauauuaaaaaauuuuuauaaauuaccuaguuuuacauucauuuggcaacuuauuuuuacgguuguuauuacugcuugagauagaggcuaaagauugaaguuguuuauagguguguccucuaugaaauuaaaaguaaauaaaaaugcaugccauuucauaagugcuuaaugagagauaagcaaaugaaaaauugaaguggaaugaagcacacagcuaguuagagggaacaggcccggcgcgguggcucacaccuguaaucccagcacuuugggaggcugaggcaggcagaucacgaggucaggagaucgagaccauccuggcuaacauggugaaaccccgucucuacuaaaaauacaaaaaaaaaaaaaaauuagccgggugugguggcgggcaccuguauucccagcuacucgggaggcugaggcaggagaauggcgugaacccgggaggcagagcuugcagugagccgagaugucgccccugcacuccagccugggugacaaagugagauucugucucaaaaaaaaaaaaaaaaaaauagagggaacagauuuguuugaucagccuuucagaaagaaugauuaggguuuuuaaauauauuuuuagagauauuuauuuuugcaugucucucugcuaaacaaggauaucuguuuguuuuuuguuuguuuucacauggaguuucacucuguugcccaggcugggcuggagugcaguagcgugaucucggcucacugcaaccucugccuccuggguucucaauucuacugccucagucuccugaguagcugggauuacaggcgcccaccaccaugccuggcuaaguuuuguauuuuuaguagagacaagguuucaccacauuggccaggcuggucucuugaacuccugaucucuagugauccacccgucucggccuuucaaaguguugggauaacaggugugagccacugcacccaacuuccauugaaguauauuauuucuaauccccagcaauccacuuaagcuuuuuauucuuguuucuuaaaaauuauaaaaguacuuugcugagucuagcugauuucauuaguauaacaugucuguuguuuuaaaaacuaagaucauuuauuauauuauuuuucucugaacucuucagagagguaagagcguuucauuccuuugguuaaaucccuuuaaugucucucuauugaaggagccaaaauucuuaaauggccuguaagguucugcauacauagucugccccaucccaccucuaacugcuguacccguuuuuccuuuaucucuugccugcucucucuuuggucauucuccuuuggccauaacaaaauucuuuaauucaccagucauguucuacuugagccuuugcacuggacuguucuucuauauggauagaugugccacuagauagcugcaugguucucucaguauguucaauucuuugcucaaaugucacuguaucagugauaaccuccucauccuccauucuugaucucccuuacccuguucuguuuuguucauaacuguuauaaccaucuaacauacauguauuauuguuauugucugucuuccaucacuagaaaguaaaccaugagacagcaggauuauguuuacuuauguauuuauaacacuuaggauagugccugcuacagaauaggcacucaguaaaguauuacuuguugaauaaauggagcuuuagaaggaagauggaauuuucuugaauguucaauuuaauaugauuaaaauuacauauauagcaaaugugucaguguucugagacagaagaaauauaaaauauauuguuugauuaucuaccuuggaugaaaggaaagucagggagaaauuucccuagaaugcauagggccuaguauauagggagcucuuaaugaauuugaaacuggagauugaacuuuucguaauuaacaugucaucuuuuugaguauuccuaugaaguaauuugcaaacauuuauuggaaauauuagguagccugcuuuguauuucucuucagaaguagccuaggaaaguauguuggaauccuaagagaaauaaacacuugggggaugauuuaaguuagcauuucucaaacuuuuggucacaaacauuaguacccuuauaaaaaguuauugaggacuccaaugagcuuauguuaauguggacuauacuuauugguauuuaccauauuagaaauaaaaacugagaauauuuaacuacagggaguauuucuuugccaaguuguaguuuggaaagaugcuguuuuuuuuuuuuuuguuuuuuguuuuuugagacagugucuugcucugucgcccaggcuggagggcaguggcacaaucuuggcucacugcaaccucugcuuucagaguuaagggauuauugcgccucagccacccaaguagcuggguccacagaugugcgccaccacaccugacuaauuuuuguaaucuuaauagggaugggguuucaccauguuggccaggcuggucucgaacuccuggcuucaagugaucugccuacuucggccucccaaaguguugggauugauuauaggcauaagccaccucucccggccugggugcuucuguuuguagcuaaaauguaacuauuuaugaccucguggauuuuuauuaauaaagucuuucuccuuuauuaguuuuaaguuaaugcuucucagauauuuugguuauacaauccccuuacacacuuaaaaauuauugggcacccuaaagaacuuuuguuucaguuuguuauaucuauugguguuuauauuaggaauuaaaacugagaaaaaauuauuuaguuaauuuuuuauuuuuuugagacagggucuugcugugucacccaggcuggagugcaguggcaugaucaugacucacuacagccuugaccuuucaggcucaagcaauccucccaccucagcuugaugaauagcuaggacuacaggcaugcagcaccaugccugacuaauauuuuauauuuguuguaaauacaaggucucguuacguugcccaggccagucucaagcucccaggcgcaagugauucuccagccuuagucuccuuaaagugcugggauuacugggccuuauuuaguguuuuaaaguaacaauaaaccuaucacauauuaguguaauuuuuuuuaaaugaaaaguaauuguguuuucuaauucccuaaacuuuuuuaguagcaauguuuuacauuuuugcaaaccucuugaauuucuaucgugaaggauucuuacauuuucuucugcauuuaaucuguugcugcuaugaucuggaaguuuugguauuaggaaguggggccuuugggagguuauuaggccaugggggugggguccucaugaguuagacuggaacccuuauaaaaagccugagagaagacuccuuagcccuuucacucagugguaacacagugaaaagucuaucaaugggcccucaucagacacugaaucugcugcugccuugaucucagacuucucagccucuagaacugugagaaauacauuucuguuguuuccuaguguauggcauuuuguuauaguaaugugaauggacuaagaaaauuggugcugaggaguggguguugcuguaacaaauaccuaaaauauggaaguugcuuuggaacuggguaauggauagaggcuggaaggucuugcacucacccaggcuggagugcaguggugugaucucggcucacugcagccuccgccuccuggguucaagcgauucuucugccucagccuccugaguagcugggacuacaggugcgugccaccacaccuggcuaauuuuuguauuuuuaguagagaugggguuucaccauguuggccaggcuggucucaaacuccugaccucaugaucugcccacuucagccucccaaagugcugggguuacaggcaugagccacugcgccuggccagaaaauuuuuuaaaaugagcugggcauagugucaugugcuguggucccagugacucaagaggcugaggugggaggauugcuugagcaugggagguccaggcuacagugagccaugauugugccacugcacuccagccugggcaacuaagugggacccugucucaaaaaaaaaaagacaaaaaaaaaaaaagacccugaaggcaauucagaaaucaauuacaggccuugagugcaagggccugcgaggaggcccuaaaugcaaaggaggggccaccaaugaugggggaccuuggggaccuuggcaagauuccauuaugccugguaccauacucuucugccacuuuagguauggcucuggugugauaacaggcagcaccaucucuaccagagcacagagugugugagcccuagggguggcuaccuccaccguucaaaggauggggcugccccggugacccagggaagaggaccaugauggggaugggauaugguauauuggucauuuggaaaagauugcuucacugaguucuguaaucuuccagauaguuggcacauuuguuaaaguucacauucuuuaauaucacuguugauugcaucagaagcaucuuuaaguauucagguguuuuugagcuuauggaggaggauacagguuuuccagaauuuugauuuuugcuugaaaauucaaauuuuauauugucaguuuuucuuagagucuuagucguuucugagaaaaugucugccaguguucaaguccuaauaaccaugguuuagauguuagucuuucaaguaaaaaugguauuccguaauaaaagugauuaguuuagcucucaacaagguaaguuaugcugcagaagugcuuuaugaguacuucccuuuuacacugaauauuaaaaaagaaauguacucaaggaguaagaugaaauuaaucauuguuuucugcuucucugucacggacuggccccuuuuuaaaaaguuucaaguggcuggugaggaagaaugcaguggccacaguauuacuugucuggacuuaugcuaagaccccaagcagcuuuuucuaccauugauuuugcaucaucauuguugaaaacuuuaaacaacaauuuuaaguuuauuugagcauuaaaggauucaugaaucaggcagcagucaaaaccagaggagguucagagugcuccacuuuagcagccugagcauuggggcuuuuauaggcugaaagcagaaguaaagaaauaacuugauuggguaggcauuugccuuauuuggauaugauacaguggaaaguuccuaguuagagguuaguugguggguuuugauuagucaucuuacuguugacauuggguuucaguucacuuauguaggaagccaaggcacuggagccaucucagccugauggccucccaauuuaagaaauuugaaaacaugcaaaugucagcacagugaaaaaggcauacaguaugaagguacuucuaacucuuucauagacgguuuugaagacucucagguuuauagaccucuuuuugagaaccagugguuuaaauguuugcuugugaguuguauugauuggucuguucauguaucuguuauuucugcaguugucauuagcuauguuuuguuaagauuuaagcugucuucagaguggaaaaaaugguggaguuuggggugugagcagccuagggugcaugaaaaagcaguaguuuuguuugauugauccugagguucuuauccaugaaguccauggaaaucucaagauuguuucuaaauuguuguuuuauauccacauguuuaucauuuagcuuuauauauauuauauauauauauauuuuuugagauggaguuucgcucuuguuguccaggcuggagugcaauggcacgaucucagcucaccgcaaccuccgccucccggguucaagugauucuccugccucagccucccaaguagcugggauuacaggugccugccaccaggcccagcuaauuuuuuguaauuuuaguagagaugggguuucaccauguugggcaggcugcccuugaacuccuggccucgugauccaccugccucggccucccaaagugcugggauuacgggugugagccacggcaucuggccucauuuagcuuuauauuuaaauguacaaauuuuaggggaauuuuuaccuuuaaaaaaugugaagagagaaaggagaguucuaaaagagcuuuuaccuuuucuucccugugcuuuguaaucuuuuuccuguguuguauugggaaaguuuauuuuggcuugagguuuagguaauuuuuaauuuaugcucaugcuuaagaaaccacaagccaaaaaaaauuacuucguguuauaaaguucauuuaaaguugugcuucugaugccuuccuaaaacucaauuuagaaagaugaaaaauugggcugggcucaguggcucaugccaguaauccagcacuuugugaggccaaggaggguggaucacgaggucaucaggaguucgagaccagccuggccaacauagugaaaccccgucuguacuaaagauacaaaaaauuagcugagcauguuggugagcgccuguaaucccagcuacucgggagggugaggcaggagaaucgcuugaacgcggaagguggagguuucagugagcugagauugcacauugcacuccagucugggcgacagggugagacuccaucuccaaaaaaaaagaaagaugaaaaauugaaacucucuuuguggguugcugauguuagggcuucauucuugugaguucauugguuucugaugguucaauuuuagauaaggugcaggaaagaagguguaagugauuuaggaagagccauggguuuaggguuuuaagacugguuucuggccaggcgccguggcucacgccuguaaucccagcacuuugggaggcugagaugggcagaucacaaggucaggagaucgagaccauccuggcuaacguggugaaaccccgucucuacuaaaaauacaaaaaaaaaauuagccaggcgugguggccggcgccuguagucccagcuguucgggaggcugaggcaggagaauggcaugaacccgggaggcagagcuugcagugagccaagauugugccacugcacuccagccugggugagagugcaagacucugucucaaaaaaacaaaaaacaaaaaacugguuuccacuucauucuguggauccccuacugagaaaauaugccuucaguugacuagagggguaugcggacuguaguaguaucuuuuuucuuuucuuucaucgagucauacaguuugcaaaauauuucaguugacagauuuuaucaguucacauuuucaauauccagguuccacuugaguguaaaaaggaagucauacuuugguggaaguaccagaaauguugggcaguaacaaguagaauuuaugcucugggucaugaggaaauuuuauuagaguuaaaaaaaauguuuuaaguacuagcacaugauaaauauugacagguucucucccucuuuuccgucuccuguaaaugaugccuuugauauuuuaaagacuuguuauauauaacuuauugacuaacuuuguaacagugagaaaucuuuugauauacucuugucauagguauaaaauacuccuaaguugauggggaaaguuaggaaaggauuuuugcuuuugguuuuaaaggagcaugagguuauuauuuuuguuuuguuuuauauguucauuuuucaaaaccauaguuuuuuaaaugguaauuuugguauaguucuagcaugacucaucuggaagcuauccaauuuuuagacuugaaacguuaaccauaaaugcuuuucucaaauuggauaauugaacaauagcacuauuuugcauauuuuaguaauuucauauuuauaauuuaugucccugguuauaguaguuugauuaaugaaaacagauugguuucuccacuuauauuggauuaggcuuauauauuuuugagagaagucuagcuagauuaaaaaguuuguuccucuuuguccaccuccugaaaaguugcaaaguaaugaggaaaaaaauuguagacucuugauuggguaccuccuugucaguagugaccucauguugcagucuuuuuccguuuaaacugcagaguguagcacagcucuacuguguguaggacucagcacuaauaauugcucagcaguuuuuauaagccuaucaccuuccuuuacugugcuuucaaugaagucuuuaccugauguuuuuguuggaaggugccaggguauucagaaugguuuccaaggcuguguugcacugguaaagugaucuuuaccagagucaguugaggcugaacugcaauacuuuuauugaaauaucguuuguagcauuaaauauuuacaauugggaaauuaaaauaauaguaguuucuuauuuuauuuggauacaaaauauuagugacuggaguaagugguugcaagauugaucuuauguucucaagaugauuaugucaucguaggcagauuugaaaauagaguuaauagcagaagggauaaaaugucagggaaugacuauagucuucaauguugugcuugacugaugacuuuaaaauauauauguccccugugauuuauuguuugucuuucuagucaaggcuuccuugucuagggguugaaugaauacaauuagcauuuuuauguggucuuuauggcaucugccuauaguaccuauguaacuugaccugaaauuucucagcaguuauuuuucuugugucuuuauuuuagcucucacaucccugugauaucuauauauuuuagcugcagaugcauaacuauauugauauaucuuuuuuauuucuauuggugugugugagcccuggcugauauaucagggcuuuuuacccacaggauuugacuaaaguaugaaaauaaagaauaauuaaaaucugugaaaucugaaagcuaagucaguccuuuuuguccuucagaagcucagagaacaaaguuguacaauucauuuuguauguagccuugugggugacaaccugacucuuaaaguagaaaaucuauuuauuugauuuguuuacuauggcuggugggaggcuccuuauuaaaaggagcuguuuauuugauugucccagcauauucuucagggcuaaagaaucuuuacucuugcaguaauaaucgagcuugcugaucacuacuuuuauauauacuuguaguuuucaguagcaauuaaaaggguuaggaagcaaaaaagaucaacuaccuugugaucuauucaauuuaaggccacuggaacuuuugccucuuuuugucuccuuugaauaacuggaaauuuuauuaaacuuuauucuuuuuggaggcuggauauagaccuaggccaguguuucucaaacuuacuacuauggauaagaaucaucauuggcauuuguuaaaaauguagacucuugggcccuacuuuagagauuuggagugggaacuuggaaucuaccuuuuuaaaaagcuuuuuuccuuguuuuauuuuauucuauuuauuuauuuauuuugaggcggagucuugcucugucacccaggcuggagugcagucgugggaucucagcucacugcgaccuccgccuccuggguucaagcgauucuccugccucagccucccgaguaacuggaacuacaggcgcacaccaccaugccuagcuaauuuuuuuguauuuuuuuuuaguagauacgagguuucaucuuguaggcccggcugcucucgaacucuugaccucaagugaucugcccgccucagccucccaaagugcugguuauaggcaugagccaccaugcucagccucuuugcuuuauuaaaaacuuaauuuuuuaauuaaaaaaauagaugcgguuuugcuauguugcccaggcuggccucaaacuccuggccucaaguuauccucugcccuggccuccugaagugcugggauuacaggcaugagcugccguggcuggccucauuuuguauuggaaaguaaaucauacuacagaaaugggcauaaaguaaauguauagcaaaacaaguuagaagcaaauauccuuguaaccacacacaucugugaauaaacugacagcaccccaguggcucucaaaauccucauccccucccucccuacuaaggugauuacuauguggacauuauagcaaucacuuccuuguauguuuuagagcuuuaugaaaaugaaaucagcuuauauguaaauucuugaucugguuucuuucacugaacggugauuuuuuucacuguguaaguuugagauuuauccaugcugcugcaugucacuguggcucauaucguuguaaaguauccucuuguaugauuacaccacaauuauccauuuugcuguugguggacaauucaauuuuuuuacuuugugacuuauuaauaguaguauuauauacguucuuauacacaucuucuaguguacaugugcaugcagaugaagacauuaacaccugucuucaguuuuaguaaguauucccuaauuauucaacguacuuauuccaguuuacaucccuacuaacagugugugacaguuguuucacauccuugccaacacuuggcauuaacuaaucuugugagcauauaacaguauuucauugucacuuuaauaagagcccucccccuuuucauauguguuuuggcugauuccuacuuuugugaacuuuagugguucauuggagguuuuuuuuuauuuuuuauuuuuugaggcagaauuucgcucucguugcccaggcuagagugcaaugacaugaucucgacucaccacaaccucuuccucccggguucaagugauuccccugccucagccucccgaguagcugggauuacaggcaugcgucaccaugcgcggcuaauuuuuguauuuuuaguagagacgggguuucuccauguuggucaggcuggccucuaacucccgaccucaggugaucugcccgccuuagccucccaaagugcugagauuacaggcaugagccacugcaccuggccuuuuuuuuuuuucaauucuuugucaggagacuuuaaaaauuuauauuaaaaauagguuuuaaaaauuuuauuauuuuuuauuauauaaaaaaugguuccuggcugagcacgauggcucacaccuguaauccuagcacuuggggaagcugaggcgggaggaucacuugagcucuggaguuugagaccagccugggcaacaugaugaaacccugccucuacaaaaauuacaaaaguuagcugggcaugugccuguagucccacuuauuuggcggucugaggcaggagaaucccuugagacggacguggaggcuguagugagcuuuguuugugccacugcacucuagccugggugacaaagugagacccugucucaaaaaaaaguugcuaauuuuaaucaaauuuaucacucuuuuccuccugugguuaaugcuuuuugugucauguuuaagaaaucuuuuccuaaguaaacauuuccacauuaucuucuuacagcuuuauuauuuuaccuuucauguuuagaucuacaaucuacccagaauugauuuuaucucucaugugugagguuggggccaaguaaacuuuucccauauggauaccaaauuguaucucauucauuuuuuaaaacacugccauuucccugcuuucuguacacaaccuuuuguucuaaaugaagugcauaugaugguuguuuuucuuuucugucugccuauuuuuuugugugggugccauacuauuuuauuuacuuuggcuuuaugguauuugagguuugggauaaaguauagaucuccaacaaaauaacacugucacuucaggagauucugauacaagugguccauggaugacaucccugcucuagagaugcuguaagagagcucccaaauucuggcuuaguauauuugccuuuguuuauaguuauaaaaacacauuauuaaaugaagccauuuugguacauaguugcacacguuguuuaugcuuacacauauaaagacaauuucugauauuauuuucuaaucuuaaugagcaccaaugauuucacaacaguccauuguauuuauccugguccauuuuauauauucauuugcugauauuucuuucuuaaaaauaauucugcaaauauaguaaaauguuaauuauagacuuuaaauguuggggcuauagguguucuuauacaguuuauuuucacuuuucuguauuuuugagaaguuuuauaauauuggaaaaaugcuacagagaauacuuuaugguauaaaauccauccuccccuuuuguaucuaggauaaauugugguagauuugauaaacccuuuuugauagagucucagacuuucugagucaaagugugugcacauuuuuagagcucuuugaaaugcauuacuaaauagauuuccauaagaaauuuuuacucauuaaccuucccacuagcaacaugcaugccaguuucauagccuuugucaauauacuauauugacaucagcagaaauauauauaaauuuuauuuuaauccuuauuuguuuauuuuuuuugagaugggggucucgcuauguugcccaggguggccucaaacuccugggcucaagugauccuccugacucagccuccugaguagcugggacuugaggcaugagccacuggcaccuggcuccuuauuuuaaacuuguauaucuaguuagguugauuauuuuucuuuuugguuauuuaauucuuuaugaaauaucuuguauccauuuaccuacuaacauuuuauugauaaucuaaucugacaaaaaagggugagaaaauuccucugggaaaaugagcagaugacuaacaagggcaaaucugagaaagaacagagaggauauaagcccuaccaagaauuaaaacauuauauaaagcuuuaguaacagacugaugaaguaaguaguugagaauuagagagcuucuucaggauuugguauaagauaaagcaaaagcuuaccagagaucacaaauuaaauggcuaagaguguucaauuuauagauuuuuccccacaccauucaguaugccacauugucaguggauuauaauuagauauuaaaaauaaaaugaauauuucucgauaggcaaggaauuaucuaaguuuaguagagauugcaaauauuaucaaggaaaauaaaacagaucgcaccacauaaagauuuaacuuuuguaauuuaauagcagcugaucaccgaaauguaaauauguaagcaauaguguauuagagcaaaauaucagaaaaugauuuaauauccuaguucauguuaagacucuucagggaaagccucauuuaucuuuuuacuuuuuguuuuuuuucuacagaaaucaauaaauauuuaacuuuuagcucacaggaaaccgcuagaaauaaacugaugauggcuacacucuucuuuguaccauguuuugggguuuuuuccccccagcuuuuuuggauuucagaaaugaaguuccaaaaaacuuuaguuguuuuauuuuucuuucuuuuuuuugagacagggugucuuucugucacccaggcaggagugcaguggcacgaccacagcucacugcaaccucccugggcucaagcgaucuuccugccucagccuccuaaguagcuaggacuacaggcaugcaccaucaucaugccuggcugauuuuuauuuuuuuuguagagaugggaucucgcuauguugcccaggcuggucuugaauuccugguuucaagugaaccuccagcuucggucucccaaagugcugggauuacaggcaugaaccacuacaccuagucagaaaaaucuuuaagugugaauauugguaaacacuucccuggagacgaucagcaugaaggccuuuagaaccauaaauaauccauucauuggaaacuagcaugauacuggcaguuaacaaaaaauauuuuuauauguaggagggguuaugugugucagaccaagagggcuuacuguuguuugauaaagcauuuguucacuucgcuacugagagacaugaagauugcugagugaaugaaugguaaaugauacucauuugguuuccugcaguggauccugacaauacuaacuucauagcguuuguucugcauuuugguuagagauuguauugccacauuuuggaggaucuucauaaaacuaauuuacguuuaaaaaaugacaagguagcuacagaugugguguucaggucaagaaggcagggucacuccucccuauggcuaaguguuggcugugaugaugugcuuaggcacacagugccauuuaaacauaccuuaucuuuuaucugauaaaugauuuuuuaaaaauuaccuguauucaucaauggcuaauacuacuguucaccuaaauccaguacaacuaauuuucccuccagcuuuggaaauagaucaguuuuucuccaccugagcaccagagaaaguaguugucccacucucacccccacaaguauauauauuugggggucuuuuugugugaaaaauaguuucuuuagaaaauuagguucaucaucugugagaggugcucaugcugugguguguguuuuuguuuuuagucacuuuuuuuuguuguagaaggcaguagagcaucuuuguuaauagcaggggcuuugggguacccaacccauggccauaugcauuuggccaaguuaauuaacaucuuugagcuucacuuuuguggaaagggggaaauaauuguaacuccuuggguauugaaaguuauuaaaugagagauaaaugcauguaaugguccuagcucauaaugaauucuaacuuuaaaauuuuuggucuuguuagugauacguuuuuccaaauuuauuuucuuugguuaauauuugaaagcuuuaccaaccagauucagaaaauauuuccaacuugauauguaaacaagaauacaacacuuaguaugugcucuccugguugugucaagguagugcaaauauggcagauuucagcacauuuuguaguuauuaaguauugaacauuuuuauagcuaauuucuuucuuugauugcagcacccauauaucucccaucagcauccuaccagccucuacagaguaaguaguauauuuauagaagacaaauuuuuaagauuuuaaaauacuacuaagcuguagaaaugaaaauaauguacuugugcucacuuuagaggaaagacuguacacaggcaguaaacuaguuuuuuauguacugugauaggaacaaaugaagaagaaacccauugcauuacuauacaaaauaaagaugagcuuucuucagaugguuuuuuugaauccucugaaauaauugaaaaauguucauagaauauaaguuuuaaaaaaguagacuuuacauaagaagugugagcaguacucaugguuucuuucauuuugcuguuaguagguuauuuugcuuuauaaguauagcuuugaaaagccuuauuuagugguuuucuguguagugaggagugaauuauagggacaacugaucuuucccaucccaguaauaauagugacauuaugguugauuuguauaugauugucuguuuggguaaauuuuacuuuuaaaacuuaagccaguaucauguauuccuuuuauguauuucuuuuuacacuuugguuuacccauuuaaguaccauaauaguuuuacuggucauagguuuuagcauuuaugucugugucaccagauauccaguuagagugacugcuucuuacuaaaacguguuguuuuguaguauuuuagaaagaacaauuagagcagcuguggaacagcaccuuuuugaucuucagagcagcauagaucaugaucuuaagaauuuacaacagcaaagugugguguguaauaaugaagcagaaaguauucauugugauggggaaggaucuaauaaccaguaagaaacauuuuacuguuguuuauuaaauguuauaaaauuguuuuaucuuaaaacuguauugcuacuuaaauaacaggaucucaucuuucuuggagauuucugaaaguuguuugugaaaagugacuuuguauauauacuuguauauacauccauacuuaacacuggauaucucaucacuuuuuucauaauauauguuuuauuaaguccaauacagguuuguuuguuuuuuguuguuuuuuuuccccugaacaucgaaugaaguaacaagcuuaccuuuaggaauuauguuguaugaaaaauaacuuuaaaaaauuagacucugcaacagagugaucuagacagacaguuacaggggcagcagauugauaucacuauagugcauauaaucauugagugaaauggugggcagaaucauccuuugcuauuuaaauaguuaucccuucccaccagccucuccccugcuuauguuuuuguuagauuaacucuuaauacagguugagcaucccuaauccaaaaauccaaaaucugaagugcucccaaauccaaaacuuugagcacugacaugauacucagaagaaaugcucauuugagcauuuuagauuuuggauuuucagauuagggaugccagucuggcaccucuccuugggauguugugagggaccuuguuugucaugcucucugaaaauuuucauaagcaaaugaauggcuuuuaaaauaauuuaugagccaguugcuaacuggcaaauauuccaaaaucugaaaacaaacaaaacaaaucugaaacacuucugguccgaagcuuuuccgacaaggaauaaucaaccuguauuuaaauguguauuaguuaaaaguacuuauaaugcaugauguuacuccacucuucaucugaccuguuaccuuuaaaugaaggaaagccucucuuuguuuucuauuacuucaguccuguauuucaggauaccugugugccucccucagagaccguggugcagugauuucauguuuuucauauaucaauuuuuuuugggggggggaagaugagaaaaauguacccaaaucuagaagauucauaggaagguaaaggaaaaaaaaagauaauuggggagugguuuuuuuuuuaagacaguuuuuaaaagggcuaacuagaauagcuaucaaauauaaaaugaaaaauguaaauggaugugaaaaccagugcugggaauguuuauuuuuggaauaccauauaguacaauugcaagcgugccauggauggcacugccagccagugcagcucuauuugauggccuugguuuguguacuuugaaggcaugauuagaaugcauacaacugggaaaaggcgggagagggaaagaaaagagaaagaaaaacauuaaaaaaaaaagcauguauacaacuggaucuauugggaguauuugggcagaaugugaaggaaaaaaucaguaucuaaguguuagaaauagugggaaaauguuucaaaggauguaagcagauuucuuggaguuuguccuuagcuuagcuagggauccuguaaaccuauacccauugcucaggugauagucuuauuuucaccacuggggaacacauguucuauugaggguagugguaucaucuuugaaacaaaaacugcaguguuuuggauauucuaaacuguaagaugacaacucugcaguaggaagcuauuucuguuuuacuugauaagguguuggacacuguagugucuaguacuggacuuguauuugaucaggacagaugugucauuauuaugugagagugugcauuuacaagggaaaugauuauuucggcccauaaauuauuuuaaaagcuauuuauucgcuuaugaacauuuuuagaggggauaacauggucccucacaacaucccgaggagacaaaaacauagcagauuuaauaaucuaauuuagcaagauaaaaguguggauuuuugugaaagguacacauuuucuuuaacaaguaaaaguuucagaucauuauugauauuuacuuauuuuaaaguaaaggcauuacacacucaacauuuggccugaucugauuuuuaaacuucaucccuaggauugauauugcugaugauauuauuaaugccagugaaaguaacagagacuguucaaaaccuguggcuagcacuaauuuagacaaugaagcuaugcagcaagauuguguauuugagaaugaagaaaauacccagguaaggaaugucaaaaauauguguuagauguacaacuuugauugcuucauguguuucuuugaugccagaaguuauaguucaguauuuugcugauacacuuaauugucucaauuauaaauccccaagaauauacauuguuucagaguuuaggaaacaucacuggguagagaaguauaaaacaacuuauuggcugggugugguggcucacgccuguaaucccagcacuuugggaggccaaggcgggcagaucaugaggucaggagaucgagaccauccuggcuaacauggugaacccccaucucuacuaaaaauacaaaaaaauuagccgggcgugguggugggcgccuguaaucccagcuaccggggaggcugaggcaggagaaaggcaugaacccaggaggcagagcuugcagugagccaagauugcgccauugcacuccagccugggcgacagagugagacuccaucucaaaaaaaagaaaaaaaaaaacaacuuauuuuaaauuauuuuccuagaaaucaugaugucagcagagguagcuaggugguauuaugguugacuuuuguuauuuuuaagacagcuuccguauuucuuaggaguuuugcugaagaacaugguauaggggagaacauauaauauucucauacacuucuuaggaugggauagaucccuguaacagaauauugguuaacaagagaaaaacaaguuuuaagacauguauaccucauauauacaugggagauacucgggggaagugaguaaaucucucagagguggcuuaaauaccaucauguccugaaacaaaggaaaaaaggguguuggggagaccuaguuguaaugagaugaccaggaaaagcacuguaagcaaaguuaagguuagcucucaagauugguaguuuuuagugauuuagagucaucuuucucuugcucguacagagaggagacacccguagaaauggagauuucuacuacagaugaaaauuucuuuuauaaaaggguaacuucucuguauuauccuguguuugcuauuucugaaaauaauaagcugaaaauaauccuuaugccaaagaggaauaauuugguguggcauguucugaaccuccacuguuggcauccuuucuugauuagcagaaaccuaggaacauuguuguaauaaugacuaaauuauugucacugucacauuuguuaguaacuuuuuuuaauauaauugccauuaaauguaaaaagcagcaucuaagacauucaaaauguaauuuugauacuacuuuuaaaaauaagaugcuaaauuaauagauaagguggguuuccucaguauauuuucauucuaaaccauccacuaaaguagggcuaaagaggaauuuagaguaggaagacuuagguuuuguauucugccuuuguucaguaucagugugacuuuggccaaguuaccugacuucugaacugcauuuugcuuuucucuaaauaaguggggguaauaccuauauuagaggauuaugauaaaaagaugugaacauauuauaaaauuauuuuauaaacuagaagacauuucaaagaaguuaagcugccacuguuaguuucacagacuuggguguauuagaugaacagcuuuucaguuauugcuucuauaguuguccucuugcccuuuccuggauuaucaguuucugccugucuaccuagucauucccaucaguguaaaacauuuauacuguuauuucuuccaaguucagaaaaaacccucucucgacuccccccaucccauucuagcacauacacccugauuucucugcuucccuuuauaaauagaauugcuggaagaauugucugugucucuuuucuuuaacucuucuccucccauucucucuuaaauucacugcagugauccuuuccuccgaccauucauuccucugaaauagcuuuugcaagucaccagugaugucuguugaauguuuuacuugaccuaacagcaagguuugauucaauuaauuacucccacuaccuugauauacuuuuuucacuuggcauucaggauaucucacucgguuuuuuuuuuuuuuuuuuuuuuuuuuuuuuuuuuuuuuuaccuacacuggcuguucuuucucauuccccucugcugauugcucuuccucuucugaaucucuuaaauuuggaauggcccagggcccauuucucagauugcuuauuuuuauucacuuccuugguaaucuuguuuagucuaauggcucuaccuaccaucuaugugcuacugauucccaaauuuguaucucgaguccagaccuguuuuggaacuuuagauugcuauauccaacuaggcacccagcauuuccacugguauauuuuuaccaagcaucuguugaguaggaaagauuucuuuccuuacccaucauuagguucauagcugaggcaucuguaacagaagacauuaacaagagaaaagcaugcacauuuauuuaauguaaguuuuacaugacaugaacaccuucagaaaucaagacccacagaaacagacacaccuguguauuuuaaugcuuugguuugaugaaaaguggacaguggugcggaugaauaauuagacaaagaggaugauaaauaaagggcggcucauuaaccaaggccuguuuguucagauucuuuucuaugucccuguguauucagagauaagggcauuccuuucauccagguauaggguagauacuucuggaaugaagguuguuguuguuguuguuguuguuuuugagauggaguuucgcucuucuugcccaggcuggagcaguggcacaaucucagcucaccacaaccucugccucccgaguagcugagauuacaggugccugccaccaugcccggcuaauuuuuuguauuuuuaguugagacagaguuucacuauguuggccagacuggucucgagcuccugaccucaggugaucugccugccguggccucccaaagugcugggauuauaggccugagccaccacgcccagccaaagguuuuaugacuuacuucagaagauaagucugaccacuuuuuacuguuucuacugccauccucucaccuggauuaauauugccuccuaauuaaucuccucaucuuuguuucuugaugguauguucucaacacugagccagaaugauccuuuuaagaggaaaauuagauaaugccacuucucuuccuaaaaccuuccagugccuucuagcuaucaaaauauagcuauaggcacuacggaauauuggcugugauagucaggauugagacagcuaaaucauaaguccuaucuggauugcuuauuuguggauaucuccuuagcuuacauucuuaccuagucuugcagauacuuccucaguuuuaccaaaucuccucaucacugucuguuuauggcaggcccucccacuuacccacccacuccagucucugaacuuuuuguccuuuuucccugcuucgcauuccgccgcacuuuuuuuuuuuuuccugagauggagucugucucuguugcccaggcuggagugcaguggcacagucucggcacaguacagccucugccccccagguucaagccauucuccugccucagccucccagguagcugggauuacaggcaugugccaccacgcccggcuaauuuuuguauuuuuaguagagacgggguuucacaguguuggccaggcuggucucaaacuccugaccucaagugaucugugugccucagcuucccaaagugcugggauuacaggcgugagccacugcaccuggcccccuccccacuuuagauaguguuauaauuauuuuauauaucuuuuaauuuuuauuuuuagagacaaggucucacucuuucccaggcuggagugcagugguaugaucauacucacuguaaccucaaacuccuggccucaagcgauuuuccuaccucagucuccuaaaguguugggauuacaagcaucaggcaccaugcccagccauuucuuuuauauuacuagucuguuuauugucugucucccacuauuagauuaaaacuucauggggcuacucacaguggcucaugccuguaauccuagcacuuugggaggucauggugagagcgucauuugagccugggaguuugaaaccugccugugcaauguaaggaggagaacccaucuguacaaaaaugguaaaaaaaaaaaaaaaaaaaaaaaaaaaaauagccagguguaguggugcuccccuguggucccagcuacuugggaggcugaggugggaagaucaccugagcccaggagguaaggcugcagugcguggugaucacaccacugcaguucagccugggcgacacggugagacccugucuuugaagaaaaaaaaaaaacuuuaugagggcugaaauuuuugucuguuuuguucuuuauuacaucccuauuaucuagaacacuuaguagguauucauuaagcauuuguugauguaagaccagaauagcaucuggcacauaguaagcuaguaaacaacucgguaaauaauuuguugaaugaaauugguguauuaggcugggcgcaguggcuuacgccuguaauccuagcacuuugggaggcugaggcagguggaucgcuugagcccaggaguucaaggccagccugggcaacauggugaaaccccgucucuacaaaaauaaaaauuagccaggcuagguggcguacgccuguagucccagcuacuugggaggcuuaggugggaggauugcuugagccugggagguggagguugcagugagcugagaucgugccacugcacugcagccugggugacagagugagacccugucucaaaaaaaaaaaaaaaaaaaagaaauuaguguaucaauuacuuuauaaagagagcaggaacuaauucuuucuaaaauuguuuuuaggaaaccuuuaugaaugauggguucuuggccuugaaaaaccugucaccauuucuuccccccaaccccagcuaagaaguucagugauacucuuauuauuugaauaaguuaguucaguugggcaauacacaauaauaccuguuuacuuggacaguauaagcaaaaauaccugauuuaaguuuucuuucuuuuuuuuuuuuuucuugagacggaguuucauucuugucgccccggcuagagugcagucgugugaugugggcucagugcaaccuccgucuccuagguucaagugauucuccugccucagccucuuguguaccugggauuacaggcaugugccaccacgcccggcuaauuuuuuuuuuuuuuuuuuuuuuuuaguagagacaggauuucuccuuauugaucaggcuagucucaaacuccugaccucaggugauccucgcgccuuggccucccaaagugcugggauuauaggcgugagccaccgugccuggucgauuuaaguuuucaaugacuugauaaucuagguuguacaugcacauacuuucuaauacagaauaugacuagugcuauuagggcacuauagucuugcagaagagaggaaagaacuucuggccaggguaguuauggaaggucuuggaaugagggggauuuugaacuuggcuuuuuauagggcuggauuugguucaagauuugugaaagaaacuaaaaugaauaguauaaguaaagauuacaggguaauguugaauguuaaugaaacagagcuacuuguagaacucaggguauugugggaggauauauaguagaagauaauucuggaauauugguagauuugggucauacguagagccuggaauacuaucuuaagaauuguagauuuucucaguagaagaaaaauauagaaaacuuugaagcagagggaaugauguacccagaucuguauuuuaggaagaagguuuuuuguaguagucauaaaaaguuugugggaaagacuggggguaaggacaacaacaaucaguaggcuuuuugcacuguauuuggcgagcacuuaaaauaucugagcuggugggcaugguggcucaugccuguaauccuugcacuuugggaggccaaggugggcagaucaccugaggucaggaguucgagaccagccuggccaacauggugaaaacgcaucucuacuaaaaauacaaaaauuagcggggcaugauggcacaugcuuguaaucccagcuacucgggaggcugaggcuggagaaucucuugaacccaggaggaggagguugcagugagcugagauuaugccacugcacuccagccugggugaaagaguaagacccugucucaaaaaaaaaaaaaaaaagucugaacugugagcccuagggaaggaaggaaaaauagagaaaauuccaaaggugaaaaugauuaagauuuaggugcaaacugggguaagaaacacagacacuaagagauuggaaaagaggucaguguugcagaacuggaauaucaaggugguuuauaugaagcagauguucaggucuugagcuguggcuggugguggaggcucauuuugucugugagugaaugccauugccaaagcagugacuugaauagaauaaacggggauugaagaaacccuuggggaaccucuguauucuagcucuuuggaggaaaaaaagcagccaugaccauagcaguugggaaugucaaagaggaugggauuuuuuccugagucugaaaguuggucaaaauagagagguaaaaggaggaaaaaagguggugggaggcaaagguacaaaaauaagaagaguaaguuuaauuuuauuugcuugcuagggugguuaaaagucuaaugaaauggcuuuuuuuuuuucuuugccuuugcuguugaacaaaaaauuuaagaauacccaggaacaauauauuuaaugcuggugaggguagguuaagguaaguggucuuauacagacaucggaaguauaaauugcuguaaacuuccuggaaaacacauuaacaguaagaacaaaagaccuuaaaccuuugauccagaaauuucaaaaucuaggacucuuuccuaaggaaauacauacaaaucagagguguaugcaaagauuuuucuacuagaauucuuacuggggguuucuucaucggaaaaaaaaaugggaaacacaaaaaguccuaaauggaaaaugauuagauaaaucauaguauauccauaucauaggauauaguugagucauuuaaaauuauuuuaaaggcccaaguaauaguugugagguaaaguuauuuugaaaaaaaaacaaaaaacaaaaaacaaaacauacaaaaccaaguguagauuacuaaagcuaaugcagucccaauuucuuugugugcaugcacugcauguguguguggcacauagucaaaaggccaagucagaauauucacaguggccuucugucugauagauuguggaugauuuuacuuuucuucauauguccuuauauuuauguuuccaacaguuucucugauuuauaaucaaauaauuaaagaaaauuuauuggauuuagugauagaaauuauugguaaagaaagaggagcuuugguagguagaggauuucaugguugagaaugaauaucaggugaguagguagaagcugcaguguguggaaugccuuuugcacaaguuuugcauugaaauuaaaaggaaagagaaggccaggcauggugguucaugccuguaaucccagcuguaaucccagcacuuugagauaucagggaaccugcucccgauagucauguagguucuuuucuauuuucccuaagcauuggcuggguugagaaauaaagggacagaguacaaaagagagaaauuuuaaagcugggcauccgggggagacaucacauguucguagguucugugaugccccccaagcuguaaaaccagcaaguuuuuauuagggauuuucaaaaggagagggaguguaugaauagggugugggucacagagaucacaugcuucacaagguaauagaauaucacaaggcaaauggaggcagggcgagaucacaggaccacaggacuggggugaaauuaaaauugcugaugaaguuucaggcacacguugucauugauaacaucuuaucaggagacaggguuugagagcaaccggucugaccaaaauuuauuaggcgggaauuuccucguccuaauaagccugggagcgcuaugggagacuggggcuuauuucaucccuacagucuugaccauagaagauggccacacccaaggaggccauuucagagaccuacccucaggggugcauucucuuucucagggguauuccuugcugagaaaaagaauucagcgauauuucucccauuugcuuuugaaagaagagaaauauggcacuguuccaccuggcucaccggcagucagaguuuaagguuaucucucuuguucccugaacauugcuguuauccuguucuuuuuucaaggugcccagauuucauauuguucaaacacacuugcucuacaauuugugcaguuaauacaaucaucacaggguccugaggcgaaauacauccuccucaguuuacaaaaaugaugggauuaagagauuaaaguaaagacaggcauaggaaaucacaaggguauugauuggggaggugauaagcguccaugaaaucuucacaauuuauguucaaagauagcaguaaagacaggcauaagaaauuauaaaaguauuaauuuggggaacuaauaaauguccaugaaaucuucacaauccacguucuucugccauggcuucagcuggucccuccauucggggucccugacuuccugcaacaacaguggccuucuggcugauagguuauggaugauuuuacuuuucuucauauguucuuauauuuagguuuccaacaguuucucugauuuauaaucaaauaauuuaagcaaaaaauuccaauuaaagaaaauuuauugcauuuagugauagaaauuauugguaaagaaagaggagcuuugguagguagaggauuucaugguugagaaugaauaucaggugaguagguagaagcugcaguguguggaaugccuuuugcacaaguuuugcauugaaauuaaaaggaaagagaaggccaggcauggugguucacgccuguaaucccagcacuuugggaggccgagguggguggaucacgaagucaggagauggagaccauccuggcuaacauggugaaaccccaucucuacaaaaauacgaaaaauuagccaggcgugguggcaggcgccuguagucccagcuacuugggaggcugaggcagaauggcaugaacccgggaggcggagaucgcgccacugcacuccagccugggcaacagagcaagacugucucaaaaaaaaaaaaaaaggaagaguugagcagucugguuguggaagagauauuccccccuuccccacucccgucccccauuucugcuuucuugauacaggauggagauuugagcaugucaguaggaaucacucacuagauagggagagacuaaaaaaugucagaaagaaaaaaaaaaacccaggguaguuaggggaacacugcauagaggggguugggagugagagauggaagaaaggugauucagugugcaaguugagugacuauuccuaaauaggagaggcuacuuuuaaucuucaguaaaaggggauauauagaauauuuuuuuaagcgagagguguuuuggggacuuaauucagauggcuuugaccauuuuaaaaugaaaugcauuugcagagggugaggagacaggaauuggguuuggaucugaagaaauagguaguuuugcaggagucucuguggggagaaaucagacagaacugagucaccagauguuugagaaccaauggaggucuaacugaaguuugaugacaugaauuuguagugagccaacuaggaagguacguuaagugacacauuuuauuguagcaucugucugucuggaggacagaaagcuggucauaaacuagaccacauugguuagggcauugacuaaauagcuuugaaauaguuagccaggguacagagugcguguuggguggauuagaaauuuagaaugaaguuuucaagcggugacaguaaggugaagaaguugcagaagaggggaauauuaguuggacaggauguaugaguuucaaguguauuauggcauggcgugauucaaguggcuuucguagaaaguaacuugugucuaggaaaguguaaggcuagauagagcaggagucagcaaacuuuguguaaaggucuacacaguaaauauuuuaggcauuguggguauauagucucugccacaacuacuuaacucugcuauuguagcauggacgcagccagaaaaaaccguaagaaaugagcauggcuguguuccaauaaaauuuaauuuauggacacuaaaauugaauuuugugucauuuucacuucacagaauaucauuauucuuuugauucucccuucuacccacaaucauuaaaaacguagaaacccuucuuagccaagugaccaugcaaaaacuggcaacagguuggauuugucuaguaugcuguaguuugccaacaccugggcuagaauauuguaaggagaucaacauuuuagacauaaaagauaauguuggagauuuguuuucucugaaauugacuugcaguguaaggaaaacaaauugcuugcuuuuuuuuuuuuuuuggagaaaugcuguaugguugcacuucuuuuuuuuucuuuuuuuuauuuauuauuauuauacuuuaaguuuuaggguacaugugcacaaugugcagguuaguuacauauguauacaugugccaugcuggugcgcugcacccacuaacucgucaucuagcauuagguauaucucccaaugcuaucccuccccccuccccccaccccacaacagucuccagagugugauguuccccuuccuguguccauguguucucauuguucaauucccaccuaugagugagaauaugcgguguuugguuuuuuguucuugcgauaguuuacugagaaugaugauuuccaauuucauccaugucccugcaaaggacaugaacucaucauuuuuuauggcgcauaguauaguauuccaugguguauaugugccacauuuucuuaauccagucuaucauuguuggacauuuggguugguuccaagucuuugcuauugugaauaaugcugcaauaaacauacgugugcaugugucuuuauagcagcaugauuuauaguccuuuggguauaaacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugaaaugguaucucauugugguuuugauuugcauuucucugauggccagugauggugagcauuuuuucauguguuuuuuggcugcauaaaugucuucuuuugagaagugucuguucauguccuuugcccacuuuuugaugggguuguuuguuuuuuucuuguaaauuuguuugaguucauuguagauucuggauauuagcccuuugucagaugaguagguugugaaaauuuucucccauucuguagguugccuguucacucugaugguaguuucuuuugcugugcagaagcucuuuaaucagaucccauuugucaauuuuggcuuuuguugccguugcuuuuaguguuuuagacaugaaguccuugcccaugccuauguccugaaugguaaugccuagguuuucuucugggguuuuuaugguuuuaggucuaacguuuaagucuuuaauccaucuugaauugauuuuuguauaagguguaaggaagggauccaguuucagcuuucuacauauggcuagccuguuuucccagcaccauuuauuaaauagggaauccuuuccccauugcuuguuuuugucagguuugucaaagaucagauaguuguagauaugcagcauuauuucugagggcuauguucuguuccauugaucuauaucucuguuuugguaccaguaccaugcuguuuugauuacuguagccuuauaguauaguuugaagucagguagugugaugccuccagcuuuguucuuuuggcucaggauugacuuggcgaugugggcuguuuuuugguuccauauggacuuaaaaguaguuuuuuccaauucugugaagaaagucauugguagcuugauggggauggcauugaaucuauaaauuaccuugggcaguauggccauuuucaugauaucgauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucuguuugucuguuguugguguauaagaaagcuugugauuuuuguacauugauuuuguauccugagacuuugcugaaguugcuuaucagcuuaaggagauuuugggcugagacaaugggguuuucuagauauacaaucaugucgucugcaaaccgggacaauuugacuuccucuuuuccuaauugaauaccuuuuauuuccuucuccugccuaauugcccuggccagaacuuccaacacuauguugaauaggaguggugagagagggcaucccugucuugugccauuuuucaaagggaaugcuuccaguuuuugcccauucaguaugauauuggcuguggguuugucauagauagcucuuauuauuuugagauacgucccaucaauaccuaauuuauugagaguuuuuagcaugaagguuguugaauuuugucaaaggccuuuucugcaucuauugagauaaucgugguuuuugucuuugguucuguuuauaugcuggauuacauuuauugauuuguguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugccuggcuuugguaucaggaugaugcuggccucauaaaaugaguuagggaggauucccucuuuuucuguugauuggaauaguuucagaaggaaugguaccaguuccuccuuguaccucugguagaauucggcugugaauccaucugguccuggacucuuuuugguugguaagcuauugauuauugccacaauuucagcuccuguucuuggucuauucagagauucaacuucuuccugguuuagucuugggagaguguauguguugaagaauuuauccauuucuucuagauuuucuaguuuauuugcauacagguguuuguaguauucucugaugguaguuuguauuucugugggauugguggugauauccccuuuaucauuuuuuauugcgucuauuugauucuucucucuuuuuuucuuuauuagucuugcuagcggucuaucaauuuuguugauccuuucaaaaaaccagcuccuggauucguuaauuuuuugaaggguuuuuuguaucucuauuuccuucaguucuacucugauuuuaguuauuucuugccuucugcuagcuuuugaauguguuugcucuugcuuuucuaguucuuuuaauugugauguuagggugucaauuuuagaucuuuccugcuuucucuuguggacauuuagugcuauaaauuucccucuacacacugcuuugaaugugucccagagauucugguauguugugucuuuguucucguugguuucaaagaacaucuuuauuucugccuucauuuuguuauguacccaguagucauucaggagcagguuguucaguugccauguaguugagcaguuuugagugagauucuuaauccugaguucuaguuugauugcacuguggucugagagauaguuuguuauaauuucuguucuuuuacauuugcugaggagagcuuuacuuccaacuauguggucaauuuuggaauaggucugguguggugcugaaaaaaauguauauucuguugauuugggguggagaguucuguagaugucuauaagguccgcuuggugcagagcugaguucaauuccuggguauccuuguuaacuuucugucucguugaucugucuaauguugacagugggguguuaaagucucccauuauuaauguguggaagucuaagucucuuuguaggucacucaggacuugcuuuaugaaucugggugcuccuguauugggugcauauauauuuaggauaguuagcucuucuuguugaauugaucccuuuaccauuaaguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccugugugugucuuugcccgugagauggguuuccugaauacagcacacugaugggucuugacccuuuguccaauuugccagucugugcccuuuaauuggagcauuuagcccauuuacauuuaaaguuaauauuguuaugugugaauuugauccugucauuaugauguuagcucauuauuuugcuuguuaauugacacaguuucuuccuagucucgauggucuuuacauuuuggcaugauuuugcaguggcugguaccgguuguuccuuuccauguuuagcgcuuccuucaggagcucuuuuagggcaggccugguggugacagaaucucucagcauuugcuugucuguaaaguauuuuauuucuccuucacuuaugaagcuuaguuuggcuggauaugaaauucuggguugaaaauucuuuuguuuaagaauguugaauauuggcccccacucucuucugccuuguagaguuucugcugagagauccgcuguuagucugaugggcuucccuuugaggguaacccgaccuuucucucuggcugcccuuaacauuuuuuccuucguuucaacuuuggugaaucugacaauuaugugucuugguguugcucuucucgaggaguaucuuuguggcguucucuguauuuccugaaucugaacguuggccugccuugcuagauuggggaaguucuccuggauaauauccugcagaauguuuuccaacuugguuccauucuccccgucacuugcagguacaccaaucagacguagauuuggucuuuucacauagucccauauuucuuggaggcuuugcucauuucuuuuuauucuuuuuucucuaaacuucccuucucgcuucauuucauucauuugaucuuccaucacugauaccccuucuuccaguugauugcaucggcuccugaggcuucugcauucuucacguaguucucgagccuugguuuucagcuacaucagcuccuuuaagcacuucucuguauugguuauucuaguuauacauucuucuaaauuuuuuucaaaguuuucaacuucuuugccuuugguuugaauguccucccguagcuuggaguaguuugaucgucugaagccuucuucucucaggucgucaaagucauucuccguccagcuuuguuccguugcuggugaggaacugcguuccuuuggaggaggagaggugcucugcuuuuuagaguuuccaguuuuucugcucuguuuuuuccccaucuuugugguuuuaucuaccuuuggccuuugaugauggugauguacagauggguuuuugguguggauguccuuucuguuuguuaguuuuccuucuaacagacaggacccucagcugcaggucuguuggagcacccggccgugugaggugucagucugccccugcugggggugccucccaguuaggcugcuugggggucaagggucagggacccacuugaggaggcagucugcccguucucagaucuccagcugcgugcugggagaaccacugcucucuucaaugcugucagacagggacauuuaagucugcagagguuacugcugucuuuuuguuugucugugcccugccccccagagguggagccuacagaggcaggcaggccuccuugagcuguggugggcuccacccaguuagagcuucccggcugcuuuguuuaccuaagcaagccugggcaauggcgggcacccuucccccagccucgcugccgccuugcaguuugaucucagacugcugugguagcaaucagcgagacucuguggguguaggacccuccaagccaggugcgggauauaauguccuggugugccguuuuuuaagcccgucggaaaagcguaguauucaggugggagugacccaauuuucuaggugccgucugucaccacuuucuuugacuaggaaagggaacucccugaccccuugcgcuucccgagugaggcaaugccucgcccugcuuuggcucgcgcacgaugcacgcacccacugaccugcgcccacugucuggcacucccuagugagaugaacccgguaccucagauggaaaugcagaaaucacccgucuuuugcgucgcucacgcugggagcuguagaccagagccguuccuauucggccaucuuggcuccuccccccacaaauugcuuuuuaauguuucaaagcugaucacauaaacagcuuuaugugaucuacauaaacuguaguacuaggugcuacauaaaccacaguccuauaauguauugguuagccaggcugaaauuaaucuuaagaauuuuuuuuuuuuuuuuuuuugagacagagucucagucuugcccaggcuagagugcaguggcaugaucucgguuugcugcagccucuaccucccagauucaagugagucucaugccucagccucccaaguagccgggauuaaaagugugugccaccacaccuagcuaauuuuuguacuuuuuuuuuuuaguggaaacuuacauugugacuuucuuuuacauugacuuuuuuuuuuuuuuugagacagucuugcucugucgcccagauuggagugcaauggcgugaucucagcucacugcaaccucugccucccggguucaagcgauucuccugccucagccucccgaguagcugggauuauaggcacacgccacuacgccuggcuaauuuuuguauuuuuaguagagacgggguuucaccauguugaucagguuggucucgaacuccugacuucgugauccgcccuccucagccuccaaaagugcugggauuacaggugugagccaccgcgccuggccuacauugacauuuuuauagaaauguuaagucuuuuuauucuauuuuuugagacagggucuugcuuuagucacccaggcugcagugcaguggcaugaucacagcucacugcaaucucagccucccaggcucaagcaauccucccaccucaccuuaccaagcagcugugacuacaggggcaugccaucacaccuggcuaauuuuuaauuuuuuuacagagaaggagucucacuuuguugccugggcuggucuugaacuccuggcuucaagcaauucucccaccucagccucugaaaauacuggaauuacagaugugagccaccaugaugggucucgucuuuucuguuuccaguuguccacauccacauuuuucuguuggguugaugguauuuuuccuuuuugguuuguacauuuuuuuuuugagacagagucucgguuugucucccagguugaagugcaguggugcgaucucagcccacugcaaccuccgccuccuggguucaagcaguucucugccucagccucccgaguagcuaggauugcaggcaccugccaccacgcccagcuaacuuuuguauuuuuacuagagaccggguuucaccaucuuggccaggcuggucuugaacuccugaccuugugauccacccaccucggccucucaaagggcugggauuacaggcauaagccaccgugccuggccauauuuuuuauuuauuaaggaacuaccuacuuucuuaacgaucagucgcaaauauuuguuuccaguuuuuugucuuuugacuacuuaaagucauuuuugaugguguuaaacuuuaucgucuuuuuuuuuuucccuuuuuuaagauuuuagguuuuaauaguugggaaggccuucccuauucugagauuauaagcuaacuuucuucuuuuaaaaaaauacuucuaugguuucauuuucuacauuugaauauuugacccauuuggaauuuaucaugguguaagaugugaagagcagauucagcuguuuguccuacauguuuaccuagauaucccaacaccguaauuuuuuguauaauauauccuuuucccaccaauaugaaaugccaccuuuauuauaaacuaaaugccuggauacauuuguaauaaaagugguguuucaaaucaguugaguguguuucucauucauucaccagcaaugagugacagugccacauucuugccaguauuugguaguguuaguguuuuggauuuuggccauucugauagauguguaaugguaucuuguuuaaauuuugaguuuccuaaugacauacgaugauaaguuuuucauaugcuauguguauaucuucuuuaaugagguguuuauucaggucuuuugcccguuuuuaaauuggauuguuuucuuauuguugaguuuuaagaguuucucucucucuuucccucucucucucucucucucucucucucucucucucuauauauauauauauauauauauauauauaaaaucuauuucuuucuuuuuuuuuuuugagacggagucucugucacccaggcuggagugcaguggugcaaucucggcucacugcaaccuccgccuccuggguucaagugauucuccugccucagccucccauguagcugggauuacaggcguguaccaccacgcccagcuaauuuuuguauuuuuaguagagacgagguuucgccauauuggccaggcuggucuugaacgccugaccucaggugauccgcccaccucagccucccaaagugcugggauuacaggcaugagccaccacacccggccuauauuuuggauaagcuuaucuaguagguuuuugcaaaauagaauuuuuuuuuuaaugugcuacuagauucuguaguaaauauuuaggaguuuuaucugauacaaagagauuauucacuauagauuuugaauagguauaaguuguacaguaaucaauauuuugggaguugaaaguguaugaaggugaaaaaaaaaaguguaugaaguugaauagccugauuagaacucacaucaaaauaccuggauuuaucaucaguaaaauccauucauuucaggguaccuucauugauggugccccuucaaaacuuagaauuauucauaccuugcaaacacugagaaacuguuuuaucuccuuucagaaguggaggccagaaguauuuauaaacucuaguagauagucaagaggaagagaaggcuauaaauuugacguguacuagucuuaagaccucaucaguuuugaucauauuaauucaguagaagagagagaguaggcuagauagaaguauaucaauaugcaauuuauugaguguuuguucagcaaaugcaagguacagaauggaguggagauauguagccuauuuaauagaaguaacuagcaugcuugagccaaagguaaaugagagaaaugggaagaugcagaacuaagcaaggugggugcaccaauuauggaccccuaaggaagggauggagaccagaggaauuaccggaaaugccugucagguuuuaauuaacucuuggcaguaaucuccgauagcuccuaagauauugcuaauaugacugugcuguaucugcugcuccuccugcugcugccacugccaccgccacugccaaagcucucuaacuuaccugaauugagaccagagcaccuuagcuuuccuuugcagaccuuaauguuuguggaagggcacaugggaggaaguggggagaagguauggguuauuuugccugcugauauuuuauuuuauuuauauauuuuauauuuuuuugaaacagaggcucgcucugucacccaggcuggagugcaguggcacagucuccacucaccgcaaucugcuccuccccacuggguucaagugauucuugugccucagccuccugaguagcugggauuacaggcgcacacuacugcaccuggcugauuuuuguauuuuuaguagacgggauuucaccauguuggccaggcuggucuugaacuccugaccucaagugauccauccgccuuggccucccaaaguguugggauuacaagugugagccucugugccuggccaauauagaugguuuuucuuauaagcuauuucuuuugauucucugugguaacucugagguagucaaguaaauuauuguuauucucauauuugugaugagaaaggcagagcuagggcuugaauuugguucuuuugagugagauaccaagguucuguuuguuuguuugugacggagucuuguacugucacccagacuggagugcaguggugcaaucuuggcucacugcagccuuugcuuccuggguucaagcaauucuccugucucagucucccgaguagcugggacuacaggugugugcuaccacgcccggcuaauuuuuguauuuuuaguggagaugggguuucgccauguuggccaggcuggucucaaacuccugaucucaagugauuugcucgccucagccucccaaagugcugggauuacaggugugagccacugugccuggccccaagguucauuuuaaauauugggucugguugugcacaguggcucaugccuguaaucccaggacuuugggaggcugaagacagauggaucacuugaggucaggaguucaagaccagccuggccaacaugccgaaacccaucucuacuaaaauuacaaaaaaauuacccuauucaacaugcugaaaccccaucucugcuaaaaauacaaaacaauuagccagguguccuggcaccacaccuguagucccagcuacucgggaggcugaggcaggagaaucgcuugaacccaggagauggaguuugcagugaaccugcaugagccucacucuggccuggaugacagagugagacugucucaaaaaauuuuuuuaaguaaauaaauaaaaauuaaauauuuggucuggguaaugguuauuucaugugcccagaaaccuucagaauguaaagcuaucuucuagagcagagauccccaacauuuuuggaaccagggacugguuuuguggacaacaguuuuuccauggaugguggauaggggguugggguuuugggaugaaacuguucuaccucacaucaucaaagcauuaguuagauucucauaaggaacacaaccuagaucccuuguuugcacagcucacaauaggguccaugccucugagaaucuaaugccagcacucauaugacuggaggcgcggagcucaugccauagugcucacuccccacucccccagcugcucaccuccugcuguguggccugguucuuaacaggcuagcgaucgguaccgguccagggguuggggacaccuguuauugaucauaaaaguuaccgaagucugauuucuguaucagugguucucacacuuugggucucagggacucauucauacucuuaaaaauauugaagaucccaaagagcuuuuguuuacauagguauaucuguuaggauuuaccauauuaggaauuaaaacugguaaauuuaaaaaacauuaauuuaacaaacucauuuaugguaacauaaguaagguugcucuuuuccacaauagauaacuguuuucauaaaauuuuuuaaguuugaggaguggcauuguuuuacauagcuagaaauauuguugauaccuguuugacuuacagaagacagcuggauucuuguauaugcuucugcauuuaagucuguugcuguuacauuguuuuguugaagcauaugagacagccucacagauguguaguuugaaaagggacuaguauuuuaacagcuuuuuuugcagauucuuguggaccuucuuucacgcuaaacaaagcuggacaagugguacuuacuuucuaaagaagaaucagagagucuaggaaguauggaaccuuuuguugauuugaaaggugaucaucaaaaacaccacaacguucauguauuuuguaguaauucucuggguauuuguauuagacuugguagguuuuuaguuugggggggaauagggaugagauggugucacuaagcucguuggaaaaugggagaguuuucucauguggggacuuucuuuguggaaaauaguuauuacuucaaauauacaaaggaaucuagugaacuccucuaugacuccuaucuuaccuacaagaagucaccaaacuuguaucuuuguagcugaggagaaauaaagcaagcagcaguuggcaagcaggaucagaagaccaucauuuuggaggagauaauucuaaggaagaaggaugguaguggugauacauauuaccuaauagagagaaaugcagaguaccugcuauacuucauaugacccagguuuugagggaagauaaauuacucucuguaaaaagagaugcuaaguacuacagacuauuauaaaugauagcuaauuagggguguuugacuaaucuguauucuaauauccuaauuuagauuggcaacuucucuuaucugaguauugggagcuccauuaauacaugguaguguucuuuuugucagucuguagguauauuguuagagccaugcagugaccguggugauagugaagauggcugucuugagagguaagcauuuuuucuuguugcuaauuaaucauuuugagaauuggagcucuucacagauuuuugaggugauuuuuuuagaugaauguccauuauaaauauauaguuuagauaaucuuaaacagccuucuuguuauaaugguaggcauaaaggauauuaaauacccauaaauguuuggauuuguacagguucagacaguaguuauaacuuggaaaacauucagagggaaaaacagccuuuuuggagacauuuaaaucuuucaguugauuguggaacaauugggaauuuacugauauucugaguauaccugucagugaguuaauucaugaucuuguaacuguguauaacuaacugagagauacuguauuugauucaacaaauauguauaggauguuuuucuuccucuuugaauuuauccuuggugugucucaguacacucuuaggcagcuggugcuuuuuuaaccucuuuggcuggcuguaaugguagagaaauacuggaggcaaugaguauuucgacuaauguagagucucaauagauagccucuuugaauagaagcuuucuagaauguuuuaaaucacagaguaagauuuggguucuuguuacccuuugcaucagucuucaagaugcugccaaaaaguauaacuuucuuaggaaggugauuugagauucugaaaacacuucaguaaugaaguugcaggcuagauuguaaauauugagagaucccagacaguauacuaauuugcugacagccuguuggccaggacauauuuguauucuauuguuucuuuuaauuauaaguaggaagccuguucuuuaaggguaagcaaauucuuuggagccacgucucuggagccuccccauacucugaagguccacagauuuccuuauagcaguuccuuguccuuccuuucaggaggcaggaaucauccucuuccagcccaggaaguauuggagcuaugggcugaagauauaaaauuaacaacauuaacaggcacccccagaauagugacaucuggauuugguagaacaauaaggacccauuuagugaggacucuucuguuguuguuguuguuguuguuguuguuguuguuuuuggaaaaagcucucuccucuucaacuucaacuguguauaaguuagcaaacugguuuuuagauccagaguaccuugguuagguggauuacauuuuguauguuuaacauucaugcuucucaaauguaggugauuaggucuuuuaggcugcuaagguaguaauuacucauccuaccauuugcuccuacucuaagcaaaggaaugccuuuaagcuuaacagagcauuuaguucauuucuuauucucagcaagaauaagguaauuaucuguaugagaagaugacuugcaauauuuagaucaaggcaugucuccugagugcauacucuguuauggccgguuagaagugacaucucgaugugucauuguaaauugccacugugucuuuggggaaaagaacuuucccccaguaggcauauugauaaucuacuguauaauagcaggugcucucuugacugguaaaauagguacagaucacuuacgacagcuugcuauaacacuuguucuaaauaaggguuaguuuuucuggggaaguaaaagguggacugaaauuuuuuaaaauuuccuuuuaguauguuacuguuauauuuugaggagggaaagguuuggaaguaguaaccuucucugauuggaaguaguauccuugugauagaauacagucaaguuuaaaguaaaagacauagugauaccuuuuuaaaaaguuuucuuugaaagucucaagaauggagagaauagagcuguuuauuugguuaaaacauuuauuuuauaaaaucuuuauuauacauucauucuuuuggguuucuacuuacuguggauuuuaguuuucauuuuauaaagguuuuucuuuuuugcugugguuugugggguggaguagggauuguuacuugauuuuucuaaacccgaagugauucuguggaucuuuucaguauugugugauuuuucagauauagggcuccaaagaaugggcauguguccaguuggcauuuucuccucgcacauuguaaaugcuaacuguguuauggaguagaggaaucuagguaagaaauauauaaugauaguagccuuuuuauucuuaauauacuaacaacuuuacuuguauuuuuagggaagaauauuuguuauuugacagugauaaauugucacacuugauucugguaagaacuauuuuuuugucuuagucuuuaaaaacuugccuagguuuaaacuguuaugucuggucuuuaauguggguuagcuagguuuaaagauuuaaauauaaauacucuuaccaaauauuuuacaguuaaacagcaacuuaauuugccacuuuugguuacaagagacuugguugugaaaacacuuuccugaauuugggauccaaacuugucuuccaauaagacauauucuaaaacugcauguuuauauuugaaaauaguuugcacagugggagugggacaguuggcuguauaggcacaguaaacuaaugaagacuacacuuggauaugugcuggauguguuuaagcugggugugaaaagcuuccguaguugugaaauauauucuuuauuuuaaaauacaggauucuaguagcaagauaugugauuugaaugccaacacugaaucagaaguaccaggaggucagaguguugguguucaaggggaagcagcgugugucaguauuccacauuuagaucugaagaauguuucugauggugauaaaugggaagguaauuuuacccacacgcauuauuuuccugauaauguuacuuguaaccgaaauuacccuaagcaaugauaagacuacagcccuuuucuggauaaccuuauucaucuugaucuucuguucucccuuucauguaagaugaacaaguggguguuuuuagugaaacacacugagauuuuggggcagcaucucauaugaacuagaaguucuugucugauccaucaacagcuuugaaaauggauguuagaacugauuuuuuuaaaaagucacccagcauacguuuuuguuaauauuuaaaucaggugcuaucuccuagucuuuggaagcccaguauguuaaggcuuagggaucucaccaguuuaagcagagcguguauaauuaccuuguccuuaguaucaucaguaguacuuuuuugaaaaaugaccuucaaggguacuucuaaacaaauauuguaccauauuccuguauuucugucuuagguuaugaagguauggugcaggggacucuaaaaauuugcacaaaggagagaaguuaaaauuuaacaagcaaacaacauggguauaugcauuucucaaaacucagcaaauacauagauuuuuguguuucuuuguauauaaaguucucuuuuuacuucaagaggauaaaaaacuguaaacaaaugcugaacuucaguggaugauuugcaugcuggaguguuuauggggaaauuuacugauaccugcaguuuacucugaaauccaugaaaaaaauaagaugguuaaugggauggauaaauguuauaaagcaaguauaguagaauguuaaugguagauugugauugguauauggauauucaguguaaaguucuuucaauuuugcuauguauuuguaaacuuucaaauaaaauguugagugggggugggaaucaagcaauaaauuuggaucuaggaguuuuucuggaucauacacuuugguaaagagacaaugagauaacucaagaaucuuaaggauaguuacauauucauucacuuggaugaagaucccuggguugucucaccuuuggcaaguaucuguugacauacacuggcaauaacaggaauucuaaugccagugccacggacuccuuuuggcacuguuuaaguguacucaccugaucgcaaauggagugugugugggucuuguuuuuuuuuuuaaggucuaggcauuuuuuuuuaagagccccaaccaagucauugucugugccaauuuuuauugccaucuccuccccacccuccuuuuuauauaggucuagauguuuggcaugcccaguggcauauuaucuguuuuaacuuagacuaaauuagaaaguugucuuuaauuugcuuuguucuggguuauucaggacaucuggaauuuaugaagaugcuucccaguguugggggauauguuagcauacugguggcaguugaagauuaaauguucuuuuuuguuauuuauuguggcugaaauaaaaggaaugguggucgacagagcaucccuugcagcauugcuaggaaaugagucuucaaaggaagcagcuuggauucugauaaagcacuuuuguuucuuccuauuagaagaugcagauaaauaguucuuuaugaucuuuggccugggaguccugauuaaauuuuaaacauagaagaauaauuguuuuucauugucugaagaggauagaccuucucugucuagcgucagcguucuugagucucccugaaagagaaccugauacuggacugucuuuuuuuuccaugucagaauccagcaccuauaccuugguauagauaaaggagguaaccuguaggcugcugaugccugauuuucagugccugagcugcccugguucaacagccuaaacaagucuauguagguccccuacuuguucuuccagaaauagggguccgcaacuuucagaaagccgacaguuacagacaccugagcgaacuucccagccaugaacugugcaugugcuuuguagaguggcuguuuguagaccauguuguuucuucuaacuuugucacuaaugcaaacauugauuggaguuaggauauuccuccaauuuuuuuuuuuuuuuuuuuuuuugagacggaguuuugcucuuguugcccaggcuggagugcaguggggcgaucucagcucaccgcaacuuccgccucgcagguucaagcaauucuccugccucagccuccugaguagcugggauuacagacaugugccacuacacccggcuaauuuuguauuuuaguagagacggaguuucucuguguuggucaggcuggucucaaacucccggccucgggugauccgcccgccuuggccucccaaagugcugagauuacaggugugagccaccgugcccggccaggaguuaggauauucuaaaugaaaaagucuuauuuauuuaagagaccaacuuacuuuagacccuggauaccuuggaaucagacaugcuuuguuugaugugacucuuuguagagaagugggaugacuccaaauagagcccuaugucacuauuccuaaguacauaguuucuguuuuguuuuuuccucaaaggauaagaaaaauagcagaaugcaguaguaguuagcaagcagguagcacaugacugucaccaguaugaauuuguagcagcuguuugcaaaguuuugacuuuuaauggaaguggauaccaucuucagauucucuccugcuaacucuggaaugaaaugcaguaggauuuuuucaaagagcaaacuaagggagauauuuuccuuuaaaaucauuuacacugaaaagcuucaaacaguaccugcuuaagaauuuccauuucuucaguuuuauguuugaguuuuaauaaaauagcacgacuuugaguuuuccccccccuuuuuugcauugcuugcugaaauggaaauguuauguuuguguuuguuaaaaucuaguuaguagugauuucuuuuaauaacguuuuugaacagaaugccuaacugguuuuagggaaauguuuuugguaucuuuggcuuuguguuauguguaugguuuguucugacugugcuguguguucacuuuaguauuuuuugccauuuuuuccauuuuauuagcgucaugcccuaucacuuuuccccucauugauuucaaaacaaugcaucugcagagagauggggaggguaaguaugguucaccauaguuuaguuuuuuugccuuuuaugguucacuuuguuugucuuuuuauuaagcccuucuccugcuguccccauaucuuaggaaaacuguucuggguucaaagugaacccagaaaaaauugcuauuacuuuugucuuuucuuaaaauaggauauuucucauaaaauguuuacuaccaguuacuuauuugcuggggcacagguacaaggguugcuuugaaaaucacuuuauuguuggguuuauugugggauugcacgcuuuguacccaauuuuuaauucucagauugaucugggcuucaaaaacaaacuaaauuauguucuuauuauuuugaaaggaaagguaaugcuuuaaauugcuaaugcauaaaguuaaacuaaauuacuaaagcagcgaucuuagcuauugugugaggaaaaagaaaacaucacucuugaauuuugacacugucaagcccucuuugcauucauuuucgcuauugcuaauagccaauagcaucaaaauuuuuaaguguaguuacuuaaaaaaaagcugccgggcgugguggcucacgcuuguaauccuagcacuuugggaggccgaggcaggcggaucacuugaggucaggaguucguaaccagccuggccaacauggugaaaccccaucucaacuaaaaauacaaauauuagccaaacaugguagcaggcgccuguaacaccagcuccuugggaggcugaggcaggagaaucgcuugaacccaggaggcagagguugcagugagucaagaucgugccacugcacuccagccugggugacagagcaagacuccaucucuaaaaaaauaaauaaauaaauaaaaagcuaauguguagaugggaauuuuuucuuucccuccugugcuuaauguuguauuugggguauauuuguggauuguguguaugaucuguauguguucuauauguaaucaaacauuauauuugcaaagacaucaaauguauuaacauagcuuucauuugagggcauacaggauaacugcaguaaaguaaaugugcuuaagaaggccuagugcuauuaaguuuugucuuaguaacacuguuggguauuauuaaaauauauauuauacauaggaauccuguagcagaagauaaccaucacaguuuaauguuagaggccaggugcugucaggugaauuagcuccuccuuugggaauauuagaauucuucuaaagucagagaacuccauuuggugaguguuccauguaacauggggaacagcucccacuuuuucuuaauauagcuauuugacagugagggacaggucauacaccugacaucauuuggcuuuuaaauuaaauuucuaagaaagaacuguucaguucuugcuguuucugguuuuccccuacuugaaaacuaacauuuguaaauaaaacaucuuuugaaaaguucagaauuauauuaaauaacaucuuuagaauuaaauugaguuuuaaagagcuugacaauguccuuucuugcuuugccacuggguucagaaauuuaaauuuauauggaaauagaacucugggcugggcacaguggcucaugccuguaaucccugcacacugagaggcugagaugggaggaucacuugagccuagcaguucaagaccagccuggccaacauagugagaccucgucucuaccaacaacaaaaaaaagaaaauuagucaggcguaguggcaagcgccuguagucccagcuacucgggaggcuaaggugggaggauugcuugagccuagaaggucgaggcugcagugagccaccaucaugacacugaauuccagagccugggcagcagagcgagaccuuaucucaaaaaaaaaaaauugaacucuggacuaaaaagugaagcuugaauaauuuuaaacuauaguaggcuuuaugaagauuauauauauauauauauacacacacacauguauguguguguguguguguguauguguguauguauauaugaaccacuacauaaugauaugauuuaaggaacacauagcugauauuuugugacuuuuuucccacguggaaucaagagacccaugguacuauucuuuguguuuguuuuauagagccauuuccugcuuuuaagucuuggcaggaggacucugagucuggagaagcucagcugucuccacaagcuggaagaaugaaucaucaccccuuggaagaggacuguccuccaguauuaucacaccgcaguuuagauuuuggucaaagccagcguuuccuacaugauccagaaaaguuggauuccucaucuaaagcacugucuuuuacuagguauaugauuuuuauguacuuacaagaggcaauuccuauuauguacccaagucuuuugagagauuuagucuuccagccugggcuucaauagugaaacuccaucucaaaaaaaaaaaaaaaaaaagagagagauugagucuucuagacauagaauucagagcuuucucacugauuuuauagagcacauuuuuguaaguuuugguuuuuuuugacccugcugaguucagugagguguagcguuugaaguuugcucucaaauagacauuuucucgugguguauuauucauuuauuuauguauucaucgcugaaauacagagcucuguaaaggaagcagcaaauggugcugagcaguuccuaaucuuuuuuuaucaaagcuuuaaauggaucugaaugucaaaaacuuuguuaugcaguuugaacaguuacaagagcucugagcugcuagguaucuuuguuucuuugcugccuuuguccaaaccaguuuuaaaugauuccaaacuguuuucaucaccacuuguauuagcuaaauuuguggucuguaacauuacaguguuucuuuauacuaccuguccuuuaguguuagggacuuauuuuuaccuuuaagauuuacuuauugcuaauagugccaugucagggcaauaagagauacaguguugguacuugaaaauuuaacaguguuggccuuuuguuuuaauucagaauucgaagaucauccuuuaguucaaaagaugaaaagagagaggacagaacaccuuaucagcuggucaagaaacuucagaagaaaaucagacaauuugaggaacaguuugaaagggaaagaaauagcaagguagguuuguagcauuccccagagugagcuuaaucuaauauuagaacugagaggauaguuuuucaaaagcauuaguuuagaucugugugagaaagguaacaaaucugagauacccggaggaacagugaucauguagaucugagauuauauaacuccuuggucuccugacuuccaggccaguauucuugccauuugcaccguggcaucuuuauauuuccacuggcaaagcagcuuuuagaauuuuuaaagcaaauacuuuacauugacaaaucauguuacugcuauuucugcucuaucaaaaacuacaaguaccaaguggggaggagagggaguuugugagggauggaguggaggaggggaaagagaauuuuaauaguuagaacauaugaaguggaaagaguccuguacuuggagucagaagacccauauucaaaucuggcuucugccaguuacgagaccuuaccuugggagaacuugacuuaauauccugcccuaucuaauuaaaauaagaugaaaugagaauugagcagucuuugcugugggaauuguaaaauacuauuuggacauaaauuaauguaacuauugcuuaucacaagugucagugauucugcuccauaauuuuucagcccuccuacagugauauugcugccaauccaaagguauuaaaauggaugacagagcuuacaaaacugcggaagcaaauuaaagguauauuaugugccauuuuguaauauauuugcauuuuaaaaauuuuuuuauauuaaugucugagaaucacaaauacaacuuuugauaauuuuaaaucuugggcacuguuugacaaaaauaaaaguuaccuuuuuuuguuuuauuagggucaaaauugcauacuguaguacuguguuauaguacaguacuguaguucuguauuauauuuuaaaugucuuuuuuguguuuuuauuaguaauaucuuuuugaaagauaccugagauuguauauuaauaagugaacugauguuauaaaguuuaucuaaaauauauuucagauauuaagcagcuuugaguuuuguuggauauuucauuaagauuuuuugguagguauuuucaucuaagacuaagaaugucuaaucacagugacucguuuauaccacaaagacuaaauuguaacucuugaaugauaaacuaggcauugcauuucugggugucaaaccaguauaguaauuguugaaguauauuuaguuuguggauguuuagugaguauguguuuuaauaauuauuacuuuaaaaauuaugcaaaauagggguuuauuaucuggagcaucacuuugguuuaaauuuacucaauaaaguuuuuauuuuuauuuuuauuucuaauuuuuucgagacagagucucacucuguuguccaggcuggaauucagugacgccaucucagcucacugcaaccucugccuccuggguucaagugauucuugugccuuagccucccgaguagcugggauuacaggugcacgccaccaagcccagcuaauuuuuguaauuuuaguagggaugggguuuugccauguugcccaggcuggucucgaacucuugggcucaagcgaucccccugccucagccucccaaagugcugggauuauaggugugagccacugcaccuggccuauaaaaauaaaaaaauauauauuuuuuauuuuuuugagacagaaucuugcucugucaucgagguugaagugugguagcauggucauggcucacugcagccuugaacuggugagcucaagugauccuuccaccucagccucaagaguagcuaggacuacagacaugcacugccacacccagguaauuuuuuaaaauuuuguauagaguuggggucuugcuuugugccuggauuggucucaaacuucuggccuucagcaguucucccaccucggucuugcaaaguguggggauuacaaguaugagccaccgugcccagcccaguaaaguguuaaguauuucugagguacuaaauacuuuguagacaacuagggauauagcagugaacaagacagacagagucccugcugucauggaguuuauauucuugugguuaagauaauguuugccucucucucucuccuuuuuuuuuuuuuuuuuuuuuuuuguuugagacaggguuuuacucuguugcccuggagugcaguggcacgaucuuagcucauugcagcuuccaccucccgggcugaagcgauccucccaccucagcaucccgaguagcugggacuacaggcacaugccaccaugcccagcuaauuuuuuuguauucuuaguagagauggcauugcaccauguugcccaggcuggucucaaaacuccugggcucaagccaucugucugccuuggccucccacagugcugggauuacaggcgugagccaccucacccggccaagauaaugucucuuaacuccucuuuagaguaucacuuaauuuuccccuauacuucuguuaaagauuuccuuguuuaaugccaauuuccagucaucagugaaaauuauuaccuugauuuuauuaguaguugauaccauuaaauugucuagcauuggccuccuaauuuucccauuuucuuucacuuuuacugcucuguaguccgucugcugcaugguagucagaauuaucuuuaaaaaagucauguuagccugggucccagcuacucuggaggcugaggcaggaggaccacuuaggccuaggaggucaaggcugcagugagccauguuugugccacuguacuccagccagggugacagggcaagacccugucucaaaaagaaaaauaaauagucuuacuacuuucuuuuucaagcccuucagugggcuuccaccuagaauaaagucaaaacuccuuacugugguuuucaaggccuugcacagucugcccuuggccgauuuuaucacuuucaucucuuuucuguuccucaaacuugccaagcuuuaggaccuucacacuggcuauugccucacuggggacagaugcccuuccacuaaauccuuugugcuagacaagcuccuuauuccguauucuaccaggaugauacuauucagagaggucuucuuugucaaucccguccaauguaguuguuccuccacaaauuauacuccuuuuagcgcugugacucuacccuguuuuaccuauagaucauagcauucuuuaaaguuauuuuacuaaucugaguauuugguuauuguuuuccuucucugaauauaugcuccacaagaacaggaaccaugucuguuuuguuuucuucuguaucucccaugcccaucagagcauuuuauucaauaauaggcucucuauggauauaaaaauaauagcuuguucucucuuuuuuuguuguuguuuuuguguuuuuuugagacagggucugacucuguugcccaggcugcauugcaguggugcagucucaguuuacugcagccugagccucccaggcucaauguggucuucccaccccagccucccaaguagcugggacuuacaggcaugugccacagugcucagcuuuuuuuuuuuuuuuugagacagagucucacugucucacccaggcuggagugcauuggcugauguuggcucacugcaaccuccgccuucuggauucaagugauucuccugccucagccuccugaguagcugggauuacaggugugugccaccagguacaggcacaugacaccacaccuggcuaacuuuuguauuuuuaguagagacgggguuuugccauguggaccaggcuggucucgaacuccugaccucaagugauccacccaccuuggcaucccaaagugcugugauuauaggcgugagccaccacacccagccuuggcuaauuuaaaaaauuuuuuguagagauggggucucacucuguuguccaggcuagucucaaacuccugggcucaagcaguccuucugcuucagccucucaaaguucugggauuacaggugugagccaccacacccagccuagaauagcugucuugcuguuuuuugcuucuuaaauguuuuauuuggcuuugaaauaucuaagucugugugcuguuaauguauacuuucuuguuguguauuuugcuuauucuuugacccggucaaagcuaaaaccaauuauuacugaucuguccuuauuucugacauguagaugcaaaacacaaaaauucugauggagaauuuguaccucagacacguccacguaguaacacacuuccaaaaagcuuuggcucuucucuagaccaugaagaugaagagaaugaagaugaacccaaggucauucagaaggagaaaaaaccaucuaaagaagcaacccuugaacuuauucuuaaaagacugaaagaaaaacguauugagaggugucuuccagaagauaucaagguaaucuugagcuaugauuuuugcccagauuagccuuuagaauuccugaaacaaaauaauuacuauagcaggguagagaugucuagguagucugauuuuccugaaucugcuccccaucuuugcagauucagaaacaugauuuaaucagcauaacagaagugccaaauacuucaagaauugaaucauaauaaaacugaaaaaacuagaaugcugaugaguucauuuauguuggagucaguuggcaagaugaguguauaaagagcaugaaacagguagcucaugccucaauuccagcaauuucagaggucgaggcaggaggauugccugagcccaggaguucgagaccagccugagcaacaaagugagacccugucucuacaaauaaaauuuaaaaauuagcuggaugugguaguaugcaccuguaguuccaguuacuuggaaggcugaggugggaggaucaauggagcccgggagauuaggacugcagugagcugugccuccagccuggaugacagagugagaaaauaaguaaauaaauaaauaaauaaauaaagcaugaaacagaccuacagaccuuagcuugaauccuguccuugugucuuaauagcuguauguauugagcuccuagcuuaugccccacguuggcugguuauauuuuaugcauuaugccacucagccccuucaacaauccuauaauguauauugacgugauuauguccauuaauacuaacuugauaugguuguuaugaggauuaaaugauuuuuuuuuuuuuugaagagccauuauucuuccccaguaaagccugugccuagggcaguccugaucaaagcacuuggcaaccuaaucuuauauuggaugagauuugcuuggagaauggagagaguagauggucucaggugaacuuuuaucuagguaauaguccuaauguggaacucuuaucuugacaacagaguacaccucucucaugauccaaauauuggagucuuucuuucccuugaacagagcugaauuagucauucucaucucuuccccucuuaacuuuucuuuugcuuaaaaaaaaauuucuuuuggccaggcgcggugccucacgccuguaaucccagcacuuugggaggccgagguggguggaucaccugaggucaggaguucgagaccagccuggccaacaugaugaaaccccaucucuacuaaaaauacacaaagaaauuagcagguugugguggcacaugccuguaauccagcuacuccagaggcugaggcagaagaauugcuugaaccugggagacggagguugcggugagccaggauugcaccauugcacucaagccugggcaacagagcgagaccucgucucaaaaaaaaaaaagaaauuuuuuuuuguagaaaaauuguuuugguagaaaucgugucucacuauguugcccaggcugggcucaaacucauggccuuaauugcugagauuauaggugugaaccacagcaccaagcccuuucuuuuaguuuuaaguuuuauguuagaauaaauauuccccuaccugcuacaacuuuaugcaaauguauuaucuuugguuuaagacugauucaagcuugagguugaaaucacaguauuugacagacuacacucagcuauccucuacugaauguguguaaucuaaaguuauauuuguuauagcaagauguuauccagugaauuuuuuuuuaaucuucaauuuuacucucaugagagaccagggugguauuaaugaguccugggaauaaguagagagauuauuuggucuaguguuaaaggauauucuguggaacacacauucagguguuaauaguugauccuauagaacgaaggggacaaguuuguuuuaauuaguagaguaugcgagacuuaccauauuuauuugucuauggagcuuguuuguggacaaaugaauuugggaagcauugcuuacucugcuaauuagacuacuaaaagcugugagaagaguauugcaguauaaagaaugugccaacucagaugaagggaaauggagguaauagagaaguaugaggucacaaauggacauuguugagcuuuuuccaggaucuuuccacuauacugcuuccagauuuucuuaaugguuuagaauaaauauuguauuauaaaaccuauguguguaugcacaugcgcaugcaugcccacucaucuuaaugccaauaaaaugccaacaacauuaaaugaaauagcaagcaguuauguauguuuacucugugcuagguaggcaguguugcaaauacuuuacauagaacucauaaauaguccucuuuagagcccuuuaagguagaacgaaguauucccauuuuacagaugaggauguugaauacaaagagguuagguaauuuacccaagccauauucauaaucuauucagauaaaauguaaagccaucaaagggguugguaccuacuuauuauaagagcaaauuguacaggagacugaaaauuuugccugcaaaucugcaagcaaaggccugggcuagacuguugaucgucugcccuuucuaccuaauuauuuacauugugggagugaggagaauauuaauggugccaguggaguuuuuuuguuuuuguuuuuuuuuuuuuguauuuuguuauuuuuuuuguuuaauuccagaaaaugaccaaagaucauuugguagaagagaaagcuucucuucagaaaagucuucuuuacuaugaaagucaacauggaaggccgguaauaucucucuugcuaaaaagauuugauuuuaugucuuaaaaaagaacaugaaucaauuuuguggccuacauucuucagggcuguuuuuugagcauuauuuccuacaauugggggauugccuauguauuuaauauaaaauuugaaauugggcgaauaagucauuguuuaauguuuuggacauuuuagauuugugaugacuagacaauuucuuuuuuuucuugcuucaggugaccaaggaagaaaggcacauuguuaaaccucucuaugauagauacaggcuuguaaaacaaaugcugacaagagcuagcaucacuccuguccuuguaaguaaaauaagcaauaauucucugguucauuuuaucaagauguacucuucccaaaaaaaauuauuauugugguauauuggagaaauacacagccaagacagaaauaauugucacuguaaggugagauuacugauuuuaaaauaggaaacuaauaaugucugcuaguauaucccagacacuuguguaagcauuuuuauguaugcuuaugucauuaaauccugacaaguaaaaucacagcagguagaauaugauagcaucauuucacaggugaugaaacugaggcuuaggcagugagugaugugccuaaucuacuuuguaagugacagaagcagaaugggaaacucauucagacuccuugucuaguuucuuuccauuuaaauucaugucguugaaaaugcaucaguuuugugguggccaugaugauguccuuuuauuugcauaaugauauaagcugacuuuuaaaauaaguuaaucuuuuuaaugagaagaagucacuuaaaauaaugcuuauugguauuugugugcauuuuuaaagaaaaaugaaaacuuuaguguuuaaaugcauauuaagugcuguccccaaauuaaccuuuagauaguaugacuguagauagauuggucuuggguucaaauagaaaacagcauguagcccauuuuacauuauuuccuaugaauuaauucacugaaccuucugguuugcuguggcuuucaggcuauuuuuauguagacagcuacuugcauggcagcuuccuuuaggugaugacugccuggugacuuucuuuuuuuuuuccuaacuuuuauuuuagauucaagggguauaugugcaguuuaauuaccuggguguauugcuugaugcugagguuugggguacaaauaauccugucaccuagguacugagcauagugcacaacauuuuucauuccuugccccccucccucccuucccccucuaguaguccacauugucuguuguugccuuuuuuuuauguccaugaguacccgauguuuagcucccacuuauagaugagcacauucaguauuugguuugcuguucauuuauuaauuuguuuaggauaauggccuccaccuacauccguguuaucccaaaggacaugauuuuguuuuuuuuuuuuuuuguuuuugagauggagucucgcucugucauccaggcuggagugcaguggugugaucucagcucacugcaaccuccgccucccggguucaagcaauuuuucaccucagccucccaaguagcugggauuacaggcacccaccaccacacccagcuaauuuuuuaguagagacaggguuucaccaucuuggccaggcuggucuugaacuccugaccuugucauccaccugccucggccuuccaaagugcugggauuacaggcaugagccaccgugcccugccgauuuuguucuuuuuuauggcuguauaauauuucauggcguauauguaccacauuuucuuuauccaauccacuguugaugggcaccugauuucaugacuuugcuauugugaauagugcuguggauaaccaugugacugcauguguuguuuuugguagaaugauuuguuuucuuuuggauauauauaccuagugaugggauugcugagucgaaugucagcagaugaaugaguaaauaagaugugguaacccguacacucaaaauacucuucagccauaaaaaacaaugaaauaauaauagaugccacaacaugggugaaccuuggaaacaagcugaaugagagaagccugacacaaaggggcacauauuauaugaucccauuuguaugaaauauuuagaauaggcaagaccauagagacagaauuuagauuagugguuaccaagggcuaggcggagaaggcaaaugaguaacagcuaaugggcacagaguuucuucugagguaaugaaacguuccgaaauuaguggagauaguugcacaacuugguaaauauacuaaaaaccaccaaauuauacauuuuaaaagggugaauuuuaugauauauaauuauaucuuaauaaaguuauuuuuaaaaaagaguauagaaugguccucaaaccaaaaaaguugauaccuauuuuuaaaaagaaaagugcuucccauuaaacuauauguauguucuuaucauuuagaauuuuuuuuuugaggcagagucuuggucuguugcccaggcuggaguguggugguacaacuuggcucacugcaaccuccaccuccugggguucaagcaauuccccugccucagccuccugaguagcugggacuacaggugcgugccaccacgccuggcuaauuuuuuguauuuuuaguagaggcgggcuuucaccguguuagccaggauggucucgaucuccuuaccugugauccgccugccuuggccucccaaagugcugggauuacaggcguuagccaccgugccuggcccauuuagaauuuuuaaaauaucuguuguaugagcucuuucagacuuuucuagacauaaauuauuaucuuccuugugcauaaauaaaaauauaagcaaaaauaaauguaagcaauuccuaaaaagauuuaaagcaaauguuuaagauuuugaaaauaaaguugaagauucguaacauaaugaagggaagcuucacuggacacuuugaauacuuaaaauguaaaacuauuuauauuauugauuguuauagggaucuccauccaccaagcgaaggggucagauguuacagccaaucauagaaggagaaacugcacauuuuuuugaagaaaucaagguaauccuuuaaagaaauaauuaucugaucccuucccuaagggaagaguucaaagacaaggcauguuugauucucuguuuggauaucuuuuuaggaggaagaagaagaugguguuaaucuguccucugaguuaggugauauguugaaaacugcaguacagguacagucuucauuagaaaacucugaaucugauguugaagaaaaucaagaaaaacuggcucuggaucuccgauugucaaguucucgagcagcuucuauguauguaugcugauuugugauuuuagccuauuuuuauaauaaaauguauaugccaagaaauuugauguuaaaugaguauuaaggaauuaauaggagaugaaucaagaauuuaucaaaggacacaugcuuuucaagugugauuugcaaauauuuauugucauucccauuuuuaaauaaaacauuacuguauuucaaaaauuaaaaaaaaaucuagccaggcacaguggcucaugccuauaaucccagcaguuuuugaagcugaggcaggaggaucccuugaggccaggaguucaagaccagccugggcaauauagugggacccagacuguauaaaaauuuuguuuaaauuagccagggguggugguguucgcguguagucccagauacuugggaggcugaggcaagaggaucacuugauucucuguuuggaggauguugaggccacugucgcaccgcuguuccagccugggcgacagagugagacucugucucuaaaaaaggaaacaaacaaauaaaauccuacaguugauuuauaacaaaguacaggaacuaguugcgaguugaucuuuuuguucuauauccacuucuuuaccuuuggaugauaugguguaugucacugguucugagcccugacuucacugggaagauuuuaaaguacugaugcuugaguccuucagcuauucugauuucauugguuugcaguggagcuuaggcauugguagaccuaacaguuccccagccacuuuuaauuugcagccagaaauagaaccucucuuaagaauauaaugaaucaagugugcccuucaguauuuuaccauuucaauucuaggccugaauuauuggaacaacuuuggaaagccagagcugaaaaaaagaaacuacgcaaaacguugcgggaauuugaagaagcauuuuaucaacaaaauggaagguuuguugagcaucacaaaauugagucaucuuucuucucuaacucacaaacugaccauauguugaaauaauggaauacgugggauuagaaauugugcauauaggaugcuagcacugaaaaauuuuaaaacauuccuuuaugcucugaggcccugcuuuuaauggccaggaauagucacagccaguguaaacaacaucugauuaacuauuuucggauuguccuagggagccuugguuguauugcagugauuuuauauucuuuaauucuacauccuuacccuuuugggagugguugugaaaugagauaucucuuauuuuagaaaggaucccaugacaggagugguauccuuaacuaguuuggauuuuuuauuuuauacugagaccauuguguucauacuguguguugagguugcccguuuccaaggugucuaacagugugccaggcauguggcuccuauaauacaguauggcacaugccuuuaucuaacuagguaaugcacaguugacuuggaagggcucuuuuuaaaaacuaagaaaaauacauuccaguucugaugguggccagaaguuuggguucaguuaucucaggccugagaaacauuuuucuaaguagcuggguuaucuuaccaagcugauagcuaauauuacaaauucuaaaauaucuguacuuuaauucccuuugcuuugugagucuccuauauagguuggcacauaugguuaaaaaaaaaucugaagugggccaggcgcaguggcucacgucuguaauaccagcacuuugggaggcugaggcggguggaucacgaggucaggagaucaagaccauccuggcuaacacagugaaacccugucucuaccgaaaaauacaaaaaaaauuaggcaggcgugguggcgggcaccuguaguuccagcuacucuagaggcugaggcaggagaauggcgugaauccgggaggcggagcuugcagcgagcugagaugucgccacugcacuccagccugggcgacagagcaaggcucugucucaaaauaaauaaauaaauugaagugcagaaaugcauuuuuccaagugucuacuguuucauuguauuauugggagaaaauuuugcuuauaguuaggauaguuugaugcuuuagcuagcgauuaaacugaauugcauugggucauuacuauaaaguuagaaaauuacucuuguugcagauaagauaguuuacuuuuacaucucaauucacuggagccgcaguuaacuaaauguauuaaaugacucaguguagccuccaacacuuaauagacacucacagaccuggcagagucuagcacuggauguccuguuaaaauacuggguuuccuccaguuaucuauguugauuauuuauaaguauagcaucauuuaaucuaucaguagagaaguccaucaaaaauuuuagaaguguuccuuggggaugaggguauuaguucaauaaccuuuuuuuuuuuuuuuaacagaacaacuuuuuauuugaacuuauguuuaguaacaguaugucucauauuaagacaacuuuuggaucuuuuuuuccaaaugaucucuagaacauuacaaauuuuauuuucuccccuaggaaugcccagaaagaggaucguguuccagugcuugaggaguacagagaguacaagaaaauuaaagccaagcuuaggcuucuugaaguucuuauaagcaaacaagauucuucaaaauccauauaagauacguuccuugaaaauucauaucauaaagucaguuguauuccuugaagcuaucaucguguguacuuggcugguacuuaaauucguuuugucaggcacucagagaaucucauuuuguacuugguuguggugccacuaaacaaaacaaaugaugggagaguaaguaggcccucucaagggagcguaagugauguuccauauuaaccacagacuguccucuccaccuuuagcaaacauaugguuuacuucauuguuuuguacuacagauacauccuuuuagcaaaagacuggaauuuuauccuuucaacuucaagaacuuuggaaaugcaagcuuuuuguuauuaccaacuuuuuguuucucauuacugaagaaaauuggaggaaaaucuucauacugaauucuucuguugccuuuuucuuacagaaugacugaaaauuugaaagaaaagccuauaaaagugcacauacgcaacuguguucucuguuuuccuagaaaaccaaaaucaaacugagauuucaagucguacuauggaacaccuuucuguuuaauucccaaagugacaucuucucacagguaguauguuaguaaaauuuugcaauucgcuggucacacagcucccggaugaagauaacaguugguagaccaaaaggugaccucgcuuaguauauugaaaacacacaccacacaucacacacagaacugaaucauaccacaugcugccuaugggacuucaguuacuguuuccugaguuacuguuuauccgcuggcaauggugugauuugucuggaucagauccgcgcuauuccccaacccaccuccagauaaugugagaaaauagccaugucaguauguaggaacucugauggugcucagauuuguguguucaaucaaugggcuuaaaucagcaaaauauuaugccuaaaguaaaucuguucuuaacaagggcucuaccacugcauuuucacauguaccuucaggggguuaucuuuuuuuuuuuccccuccuauuuuaaucagcaaaauccauaccaaaacaacgacaacaacgcccucuuaagggaccacccuuuggucaaucauaacaugcuguuuaaagcagcuguuuacaggauguguagugguaugccccuugucauauacucuuagcauaucuuuuuuuccuuuggcuuugcauggcuuuucuucagguacugucucgguaucauucugcuaaucauuguuacagaauggugacuucauuugugcuaacaguacaacagcagauuugggucaggcuuaaucuaaguguuaacuuuuuuuucuggugcuuuuuuggauugaugacugucucacuuugacuauacccauguuuugcaugcaaugacucaugcaugguuuucuuaacuagcuaauauuaacaauuuauuccauauaaaaauggaauuuugcaacauccuuuaauaaggugagggaagcaugaaccucagacuucuggcacuauuacauaguaagcacaugaaguaguuugauaauaaauagcaguucuaguacuucacauuucacccgugugugcaaugccuuuuucugggggguggggggugagggaaaaccugguagugaauguguaguuggggaauaaagaaaagcacuaaauccugcccuuuuugugugguuuccuuuugauacaacuagguuauucauaauguauaccuagaaaagugaaauugaaaauaccaaaagauguaucauuuuuauuugaauccaucaugcaguguacauuucagauaauuuccuucagucuccagauaggaguguauccaaacaucuaauuuuaugugcacuguguaucuuauaugaauguuuuauuuuauauaccacaugcaaaaauguccauaugcacuauuuaaauguuuuaaauaauauauuccuucuuuauaaugcuaaaucuauaugaguaccauauuuuuauaagucaguggucugacugguuucauuuuagaauuaacagcugcuucaauauguuauucaauguuaauguuuggcugugaguagaauauguaaaaguggcauggcagcacuuaugcucugugacaguauugugugucauaguugagcaguagcugguagaauuaggcaguuggugauaguuuuacuuugguacaaauaaaaacuguauaucuauauacaaauaauauauagauauauauguccaccaguauaauggcauugcugugucuggcacuucauuguacagacuuuuauaauaaaagaacuugaaaguucuaagucauug

SEQ ID NO: 192749 - RNA, 21786 nt, Homo sapiens
uaguuuuuuuuuucaguuuauuguauacacacacauuucacuggugguuguuuuuuuuaaaaagucuguacaauugacaagacaauacaaacuagcuacgaucugcuagcuacacauuaggacauuaacauagcccaugguuucugcccuaaaacaggcaauugugcuacuccaacucucuaagagagauuuuccagcucaugucguguggcccagguaccuccucuucuguaacuuccaccucuggaacugggcccgcaagcccaagcucuaucuuguuuacuuuuauuuuagguucggcucaaagaggguaacucugaggcuucacuuuuucaucuucauaucugcuucaauggcacagcggcguccccugguuccuccauccuagaugacaggcagagaaagaaagggagcaugaguuggucaggagacaagagacggugcaacagaaaaguuggggauuugguuucuugggggagagggaagagaaucagcagaaaaauccagagggaugaggggcauauuucugucuucccacagaguggcuaaagaacaccugguaguuugugagaggaaauguaggauggaauaucuugcucaugcccacuacagagguccuuggaauucaccuagggucccacagaauaacuauuagucaucccacccaggcccaaaucaugugcaaaggagcaggagaguaaaagaaagguaggagagucagaaugggcaauggguagugagguucuugacuaacauaccuguccaacuguuggucccuauaagaaaggccuuuccugcagacugacccuggcacuaguucccuagcaccuccugacagugguuuuccaugagaucaggacaauuagaaggcuucuuuccaucugcugcucucucccugcagcccagcuccuuccucuugugcaauauuuugcugucuucaauagauaaaagauccuauuaaccagccuugcaauagccagccaaaugcuuugcuugggggauccagagucacuguuguaggccaauaagaaagaacggagauuauaauguucugucugugguacagccuguaggcaagaugaauuacugaaaccuuugcugggccaggccauuuuuacauuucuaauaugcaaggacucuaaaauuuuuagaguccaugaacauaaguugcccaugaggcaacagugaaaauaaaaaggugguaaccuugcauguguauaaugcuuuucuuuuuuuuccaagccaguuucauaucuauuaucucauuuuauccucacaacaucccugugagguaggcuggacaaguaccucauuauauuagcuuuaucacacaccaaggaaaacaaugccccaagagauuauccaaugaccuuaagaccauguaguuuucuagccugaugcccuuccauuacaucauaccucacugucccauaaugaacaacacagagucagagccaguuaauuuauggaggaaaguaauaaaagucuuuaggcuagcucuccuaagcuuaucuguaauuccagcagccacuauugaugcaguggucacuuuuuuuuuucuuuuuuuuguuugagacagaguuucacucuuguugcccaggcuggagugcaauggugcaaucucagcucacggcaaccuccgccuccuggguucaagcgauucuccugccuuagccucccgaguagcugggauuacaggcguaugccaccacacccggcuaauuuuuuuuuuuuuuuuuaguagagacgggguuuuuacauguuggucaggcuggucucgaacucccgaccucaggugaucugcccaccucagccucccaaagugcugggacuacaggugugagccaccacacccagccacaguggucauuauuacugagauuguuuuuuuuuuucuuuugagacaaggucucgcucugucacccaggcuggagugcaaugguaugaacagugcagccuugaccuccugggccccagugaugcuccuaccuugccuucugaguagcuuguaguuagggaccacaggugcgcaccacuccgcugcacagcuaguaggguuuuuuguuguuguugccguuuuuaaauuuuguagagacagggucucccuacguugcccaggcuggucucaaacuccugggcucaagcaauccuuccaccucagccucccaaaguguuggaauuauagacguaaaccaccacacccagccuauacugaguucuuuagcuuaaauuuuacuguuuguuacauuagucuugcaacuuaauuuuaggagacaagagaaaaacuauuugcugaguacugccauuaugagaaacacuguuaaaaagccagcuagcagcuccugcucugaccaauuuuaaauuuguuaagaaaagaauugguaaaaggugaagucaggaaaugacgagcagguacauccuagauccuucaccccuagaauacauuucagcccagugaucucaaaaacagucccuacccagcccacacacacacacacaugcagaaagacaggaaugcagaagaaaagaguuucuuauucaaugaccugaauaaacagaaguucaagacacugccacagucugcauguuggauuucccucugccacccacccccauuaagagcugagaaucuuuguggcaacaccaccccuugcagccauucaauacuuacaaagagagagagaaggaaggcaggagagcccauugggacacuguccuguuagaggacaaacaaacacugaucagguuccacagaaacucucagccacaagcaccccaaaccucaggacagagacacaagcaccacacacacaaggacaaaauuuuaaaacucaagaacaagaggaaagagauccaaaagcaaucuguccauuacgccucuagcacagaaacugaugguccccaacugcugcaggcuaagccauuucccccgccuugagagcacucucccagaggaauuaauaauuccccuacucaugauuucucccaugugacugggccuuucgguuacaauaggcuuauucaacguuuagaugggugcaaaccaccaucauucuaagaucuaugugucuguauaucauuggaaucuagaagcccaauaccaaguaguaacauaaggguccuuggaugcuucagacuucuacuacuggaacacuggcacacagguuccuuccugaucgccucaccuucucugaagcauccuguuugcggguagaaucucucccucgaagacuuuuagcacugaucccagacucggauguuugcauaaucaacugcguggccaagaauugcuguagggagaagaaacaggguaggccauggagaccugauuuaguagggacaaauuaaguacacuuuaagcacuguaaauagaacuuuguauaguacucuucuggcucaaauauauuuugacugauuggaaguuuagcauauuaaguuuuaauucuaguugcaauagggaugcuaaagaaucaagcagcccuaacuuuuuuuugcuauaacauaggaucaaaaucucuauccuccaggaaugagaaaaauaauaaaacuagaaugaaccaaagaucauucagcaauuuaaguaauuugacaaaucgugcaaagauuugcaauauucuuccaaguucaacaccccaaaaaguaccugguaacacaaucauaggauaaaagcagggaaaaggaaaggagaaacucuuauuugcugaucaccuacuauguaccagguacuuaauguaauuaaaaaauauacauucaccauuuuuaaaaaauuuuauuuaaaaacuuuaugaaacugcaaauaauugcccaagaaagguagaauauuguaucacaacucuuucaccacaccaaagaaaauaaaaguaagaacaaaauauuauguuuucaauugugucccugacagcuauccacguaaaagccacagcaacccuucuuggcaucaauaugaauccuccccuugaaguauuuuaauuucauccuugcugaaacacaaaggauccucaaaguaccuggaucuguuccaagacaucucgcugcaucuccacugccaugugauagacaucauggucugagcuauuguacauuacagcauucugaaacaucagcauaaugucacgcugaaauucagcugugcuucggaucaguccauuuucuauguuuuucuuaauaguugacaaauccauaggccuaaaaaaaaagaacagggguaaguagcaguggggauggaaagaggacgcaccuagaucuaugaauacauuaucauauagacuuucucauauauaccuuaacucccagcugccaggacuuaaaugcuaaccccuuaucccaaaacaugcacuuaacccaagaaacaaucuauauaauaagcauugagaaagguaauaaagggaguuuauuuagguuuuuuuuggagacagggccuggaucugucacucaggcuguagugcaguggcacaaucaugguucacugcagccucgaacuuccaggcucaagcaauccuugguucacugcagccucgaacuuccaggcucaagcaauccuucccaccucagccucccagguaguugggacuacaaaugcgcgacaccacaccuggcuaagucuuguauuuucuguagagaggggguuucgccauguugcccaggcuagucuugaauuccugggcucaagugauucacccaccucagcacccccaaagauuacaggcgugagccaccgcuccugguggagauuuauucuuuuagacuaucaguggugaucuagccacuggaauuaucaguuuagcacucagugccccuuauagcaaaaccauaaacuuacuugcuuuaaacuuucuaucgaaagcaaaacuucacuaagacuggacaauuuauaauucaggcaaguuaccaugcuggguggaccauggcucaccucugcacaaugcugugguagccaggugcuaugucaucuguaacaggcugcaggaagacauuggcauaccuguccaaaaggaauaaggugcaauuacugacauucuccagaagugcagggagggaacuuacucuaaguaacuaaagguaguaagaacuaauaccagcaguuccacagaagccuacucagacuuuuuuccagucaccaacaaugaagaguaggagaaaaugaaccuacugacugguaaagcccacucaccuaugauuagcugcagcucuccauacaagcaugauggcuuucuuccaaauuuucugugccugaauagcuuccugauccucacuacagacagagcugaaacagagauacagcaauuccacuaggcacaaguuaaaaaauaaaaauuauaauucucuuuucuuuuugagacagggucucacucugucccccaggcuggagugcaguggcaugaucauguucauugcacccucaaccucccagacucaauccucucaccucagccucccaaguagcugggacuauaggugcauaccaccaugcccagcuaauuuuuuaauuuuuuuguagagauagggucucacuguguugcccaggcuggucucgaacuccuggguuccagcgauccuccugccuuagccucccaaagugcugggauuacaggugugagccacuaugcccagcccuaauuauuucuugucagcuguuuauuccaggucaaaaaagggaaacacuaaagaaaagaucaggccaggcaugguggcucaugccucuaauucuacugcuuugggaggucaaggcaagaagacugcuugaggucaggaguucaagaccagacuggaccacauagauccugucccuuaaaaaaauuuuuuuaaaauaaaaauuuaaaaauaaagaaaaaggccaggcauggugucucacgccuguaaucucagcacuuugggaggccgaggcagguggaacgcuugagcucaggaguuugagaccagccugggcaauguagcaaaacuugguuucuacuaaaaaaauuuuuuuuaauuagcagggugugguggcacaggcugguagucccagcuacuaaggaggcugagguggaaggauugcuugggccugagaaguggagguugcagugagcugagaucgcaccacugcccuccagcaugggugagugagaacaagaaaaaagagaaggaaaggaaaggaaaggaaagggaaaagaaaagaaaagagaaaagacaggaaggaaggaaggaaggaaaagauccucuccucaccuucacugccuuggccucaaagaaagaaucucagauacucacaacugugaagaagcagggcugcuggggauggagucugccagugugugugacugcaguguagcauuguguaugcugaagccaucaucacucucgcucacaggagguucauuauccauuucugacaaguagccuucuccuugauccucuuccuuaggcuccucuaggcuggccgcuucacugacaccaucuuccuccucauccucaccuggggcauccuuagauacaguaugcuccaguuaacaaaugcaagcaaagcuauccagcaaagcaucauuaaacaugaucugucuuuuggguuagaauuaguucuagaaaugaccucacgcuguuuccugacucagcugucuaucacuuauacuaccaucuacuuacagacacugcguuaaguaauuuagaaccuggacaaagaauaauacccaggaucuuuuaaaaagaaagaaaaaaaaaagcuacuuacuuaagacuaagcuaagaggcguuccuucuuuccccuugcucgagaguaacucugacccuggguacaaaguuaucaaaaauaauuuuuauuuugugucucauuugauggagcaagcucacaucacauucuuuaagccucuguuacugcugcuuuaauaauucuaaaaagaaaacucuggaugauucucuuuggauagucuaauuaauaaacuugauuccuguauguucuccuuggcucagguauccuuauucacuacaaaucacucuaaguguaucaagccuucuuaaggacugugugauauucacaugcuguuucauaugggaggcaccuguugcuauaguacucccauuaugccugucuacugcagcuuuuccccaugcaacuccauaccagucucuuaucagagaauaaagaugugacuuuacugaaauucauuaaaaaguagugcuauagggaaaucuaaucacauggcaagaggaauaaagaaaagucugaaauaccuuuaucuggcuuccaaaaauagucccugauucuucuuucaaugagucugcagaggagagaaagacuaccugaagauuuuuccaccuuagccuuccccuuccuauggaccauaauccccugcagcucuccuuuacaugcugaccuguucuaccuccucuacuugcccacaacccacaaccccucagaagccaaagcaaaugauuucaagucagugaaagaggacuuuauuuaccugacauuucaaacuugugcugagucucugccucuaaaggaucuucaaugggauuugagccaugugauggagacaacaugcuuucaggggaugccugaaaaccagaaaagaaaaaacacccuaaguacugauaaaucgcuauagcucacacaacuuuauucuucagugauaaugagaccauagaagaaauucuaaguccuacucauguaaugugacuccaauggucaccuuaacaggaauaaguauauauaacacuaaucacagccuaugggcuuuggacacaucaaacaugucagaacucaggaaugcaacuggaaaaccaaaaagccuaagcugucacuucuuaucuaagguauaaaccuccaucuccccagccccgaucuuucuuaaguaccucugucuucacauuuguaaguggagucucaucgccuuucccaauggcaacaucugcuucaacaaucucuccagcugcaguacuucccaguuccucaucuaaguccugacuccugaguucugguggcuccauacuuguggcuggaacaacuccagcuacuauuucggcuccugaaaugacuggcucugguucugcagguuccaccuugaucucugcacugggcucccugauguccaccaguucauguauucccuuguuuuccguuuccucaaaguccagucucucuugcuugaccgucauuucuggugcagggagagguacuggcuugucccgcuccugcuggauaggaugcucccaggggccaggcagggacugaggaucaucauuuucuucacaaaaugacagugcugcuuccacugcugccacauccagcacuucaggaugaucaucuaccugucccacaaaacacaagacuauugaggucacagaaagaagcccaaguccuucaauuuuuguuagcaccaaaugugauggcuugaaucugcagcuuuucgcuccauuuuuuccauguaguggaggcaaacaaugaagaggcaccuguccugugcaaaccaguaacauggguagaccugaggagaugacuaguauguuagcaccaaagggcuacaaagauggagaugggcagaaguaggagaguuguuuaaguaauucuuacuguaagaagcaaagcagccgaguaugguggcucaugccuguaaucucagcacuuugggaggccgagguggguggaucacuugaggccaggaguuugagaccagccuggccaacaugguaaaacucaucucuacuaaaaauacaaaaaauuagugaggcgugguggcaugugccuguagucccagcuacucaggaggcugaggcacaagaauuacuugaggcugggaggcagagguaacaguaagccaagaucgugccacugcacuucagccuggaugaaagagcaagacucugucuccaaaaaaaaaaaaaaaaaagcagcagcagcaccaaagugaggcugaaaagagaagccuauguaggacccaugagauucucuggggcuucgcugaauaguuaccuuguccucaaugauggcaaugaugucuccaacagucucaaaauccagcucuucaccuguguaagacacagcaauauccaucuucucagccagaucuaauucuuccuucccaucuaugcugggagccuuugauccaacaggagccucugcuaccccugaucgaaaacacucuucuuugauagaauugaugaucauggauauuucacugcuguccauggaaacagucacaguauguggaucccccacagccuccaugggaacacaguugucggguugacucacugaguaacagaaagagaaaagcaucucagaagcuuauuggguacaaagcgaccaccuugagaucacauaagcgcuacagacagaugucaaauauccaaacacuuaaggucagaaagagucaucaacaugugccuauguuuucuucuccccaguuuuaucuagaaaggugagaacauauuuucaagccugcucauaucuguauacuuagccucuuccugcaauacauaaaugcccacccaccucuucucacaucuauuucuaaggauauuuauuucuaaggauaaagauggcacaugucuauguagaacagagaagaagcaucugaaucggagcugaugcucuuggucauuuuucucuaacuaaagcucaaaaugaaauuuuagaucuaguggcugcucagggacgcaccuggagcuacacuuucaguaguggagacagccggagcagaggauggugcuggcagcgcaggcaucaugacaaugguagcuugggacacagacucuacaggggguggcacaaguuuaacuggaggcucacuggcaacaguagugaaggaagcaagagguguggugaacuguguaggaccagcuucuaaaagccgggaaagagugggagcaccuaacauauaaagagguacacaaaaugaaguaagaagaaagcacauaaauaagaagcaauagcuacuugaagacucaacuaagaaaauucuuauggucucaaaggaugagagcaacuccugcauugaauaaguucaucaucuauauccuuacucuaaccuuacuuaagaucuuccuccaaguuaggaaugaaccaaagcacuagaacacacaacauauauaaaaaaugggugguaaggcuaggugcaguggcucacgccuguaaugcuagcacuuugggaggccgaggcaggugggucacuugaggucaagaguuugagaccagccugggcaacauagcgaaacccugccucuacuaaaaauacaaaaaaaaaaaaaaaaaaaaaaaaaaaauuagcuaggcgugguggugggugcuguaaucccagcuauucaggaggcugaggcaggagaacugcuugaacgcaggagguggagauugcagugagccaagauugugccaccacacuccagcuugggcgacagagcaaggcucugucucaaaaaaaacaacaacaacaacaacaaagggugguaauuuuuccucagaggaaaauuaaucaccaagaaacgaaaaacugguaugaauaaaucugucgcuucugcugaaguucagcauauuguaaaccacccaaguucaacaccauucaaauaccaauaagguuuguaugguauucuauggagcuuuuuuuauuucccugcuuuauacuuucuaccucauuaaauucucaucacauccuugugaaguauauauguuacaauaaaaaaggaaacugaggcucaaaagcuaaguuaccuauccaaggucacaaaaccaauguguggcaggccugagauucaagcccaauucucugguuccaaaucuuauuccacuauucuauaaucuuagguaucucuagcaccuugauuuugcaagcccuaagaaagcaguucaauauuacucucaauauccaugcuguggucaaucagggcuaucacuaucuugaagauagauggcuuuauaauauggagacuacauuguuuaccagguaaaguagcuccaaaaaaaaguuagaaaaaguugggcuuuaaaucuagcacugacaacugcuuaguaacagugaaacugaggucagucaaugucaaguucaacaccuuugagguugauaaaggaaaagugguaacuuaccugaugcagcaggggaggcugcaacaguauuggguguuugcuguaucuccccaccauguaucaugggaaggaccccgccuaccuccaggaggacaccuguacuguucagguggccagaagccacagccauuucacucucauugaccuaccagggaagaauagaggugaaggcuacacucaagcuuuccuucacuaccauuucccaacaaagcuccagcaguugaucaaacuucaugaaaacuaauagcuaauauccacagagaauaauuuaagacccaagggaaacucuaaacuauaauguucaaaacuuauuugacaagaguucucuggagaagagaaccaaaauaauugugauucagauaccucaggacccauggguacuaucaacuuacuguauuuuuaaaaaauuaacauuuaauuaggagaucuuuuccucuuuugaacuuuuauuccccaugucacauuuuaggucccaggcacucccuuccaaguacuaaaucaccacagcucucaaacacccacagaagucuccauaccagucuggggcuaguaggcaggaggcugcccuucuucaagagcucugacagcagaggggagggggguggaguugcuuucuguccaagcaucuuuuucuggggugaaucaucuguuacuggggucaugggggcuucuaagggugcagagccuggaggaagggugucaggaaucccaggaaacgaggugacugggguacucggcaaagucccggggguuaccuaagagacaacagagaaccuuuaucugacuucucaaacuauggaagguucccuacuaaucuguauggguuagugugucuaacuauuauuuuauuaguccugaguggaauugcccagaaacccucuaucccuccugcucuuagccauacuuuucuuccccacaaucuucucuuucauccacucaaacccacagugacucaaccaucccacccaaccugccuuuuaugaacuccuuacccacuaccaauauuacauuuacaaggauuuugucccuuauuucagcaggaauuucauaagacuaguaugaaacaauuucuuaaaauaguuuuuuaccuaucucucaaaaaggucaaaagccucaaugcuuuuagguccguucuuaucucagagcacagaacaugguaaauuaagucuuuagcauucagaucaagagaggaaguugccucuaggccaaaagugguuuccucaucgcucagcucugccggcuuauugccccuucacugaucaauucccacagauggaaauauacucaccccagagguagccucuuccauagugguuggagucaaguccccaaguggauaaucaccuccuggggaggcagaaucuauaggagagcgaaccaucacaguggguaaccuccggggggguguuuuuacugcuugacgagcuagaacauaaaagagaacaauguccaaaucuucaagauuaaauaaaugaaacuugacacuagucugcuauuauacaauaaaggacaaauagguauguugcauuacuaaagcagcauaauaaguuuggauuagaaagcuuuaacacuucuagagauggauaacuuuuuagccuaauuuuuccuaagggcaauucucacacuaagaaacuccuuuaacaaucucaaacuacuuaauuaucccaaagguccuuggagugggaaaguaguuuaaacauccuuuaauauucucuuuagcaacuuacuaauauucugcuuuuaagaacaggaaggccaggugcaguggcucacggcuguaaucccagcacuuugggaggccaaggcagguggaucaccugaggucaggaguuugagaccagccugcgaaaccccaucucuacuaaaaauacaaaaauuagcuaggugugguggcagccgccuguaaugccagcuacucgggaggcugaggcaggagaaucacuugaacccgcgaggcggagguugcagugacccaagaucgcgccacugcacuccagccugugcagcaagagcaaaacuccgccugggggaaaaacaaaaaacaaaaacagggaaagaccucacuggcgcacagcauguauuccuagaguuguaaaugcuuaaauuucuccucaucuaaugacugagcuauucucaaucuuuucacaggcccuugacuucuaaaacauuauguucaauaucucaucaagccuuuguguccugaaguuaauuuaaggucuagugagaucugagcacaacgcauguucuaggaguuucuucuuaagacauuaagggauguuuuuauucugguagaagagaaaacugcaaguaaauuuaaaucaauguauucuauguuacaaaacaguccaacugucauuagcaugcaguacugugcaaucaauugcuaaagaggcauacuagguucagcuuacccugguaugcagcaucuguagccuuccucuuuacuucagccuccucuucuuccaauuucuuuuuccuaaacagggaauuaaggguuagaugcuagacagcucuggcuccuccccagaguucacagaacccuuacaaaguaauuuuuuuugccaggccagcacuuucuggaagaaaggccuaaacaggaauucuaaccagcaaaacagugaauugggguauacugccuaacucccaguucuucacccaggcaaacuauagccacucuuaaguuagaacuaaguuauguuuucauacugaaaugucccauuauauuaccuucuaggacucacuccccccucccagccaccaaaccacuuugcagcuuuccccuuccagaaucugucucaagucuaaagggacggcaauuggaggaaauaagccagauuacuugaggggaaaagaggguaaaaagaaagaagcacagaagaacaauauaauauaacccacguugcaaugucauugcaaagcucauccagucugcuguccauguguccagcuugaauuaguucugcaucucucuuuagccgucuauaggaagaaagagagguagguagacuggguuuuuuaaucugcuauuuuaaaaguucugaccaguaccagaagacagucccuuaugucuuucucaauuuuuuggcauucucucugauaaguaccuauaucucuccuggguuuccuuuaucacuuucuuuaguucuucaacucgcucagcagucaauuuccgaacaauaacaucuucaacaguuuccaccacuucucccuuuucaccucguuuccgucuguggaaaauugaaaaaaaaaaauucauauucaaauaacauaacauuuauccccucuccuacuugcuuuuaccacuuaaucauagauaacuucugcuauuuuuuaaucauccaguaucauaacuaaguauaaaccagaauuccucaguaaauacucuccacuaaagaaauauggcugaaguaccuggcuuuguacucacuuuggugucucaguggucucuaaaagcuccgaguacugggaagcacaaugcuauuaaaaaaaaaaaaaaaagugaaaaugugaugagcaaggcuggaaagaaaugaccuuucaaaguuucaagagauuagaguaagauuuagagaagagaacuauauguaagacgggagugguuuacuaggagggcaaguaacuuuauaaucaaaucaguucaaaauaaucaaaacaagacacagaaaaagacagucuuauggacuggaguuugugcauuugcggaaaggcaaccuaacugccaauauuuauagcuaauaucuaccaaguaguuacuacaugcaaggcacuguguuaaauguuuuacauguauuacuucaauuagcuucacaacaauccugaagcaacucuuuuaucucuauuuuacaaaugaaaaaacagaggaucauggcccaaaguuuuuagauggaguaauaaugaacccagaucuaauucccaagcuugggcucuuaacuguuaugcaacaccaauaagaaaggucuaauaugaucauacauggauggauuagcaaacaguaggaaaaagaaaaagguauucucaacuauuuucccacaucaugguauaaaagcuuuguaacuaaaagucagggccugguagagaaccuacuuuacaacccaaagacugcucuaaaagagcccuugcuugggaacuuacuuuuugagagaaccagucuggagggcggccagguucugcaaagggcuugauugcucugcuaacugauacccuacaaaaugaggaaagcuuuauuacacaccaagcagaaaacaauaggagagguaugcugagagugcaaggcuuggaguucaaacuuuggaauaaaaaagaugcgaauggccaggcgcgguggcucacgccuguaaucccagcacuuugggaggccaagacggguggaucacaaggucaggagaucaauaccaaccuggccaacauggugaaaccccgucucuacuaaaaauacaaaaauuaguugggcaugguggcaugcaccuguagucccagcuacucgggaggcugaggcaggagaaucucuugaacacaggaggcggaggucacagugggccgagaucucaccaccgcacuccagccuggggacagagugagacuccaucucaaaaaaaaaaaaaaaaaaaaaaaaagccaaugaaugcgaggugugcaauggaccgugccuguaaucccagcacucugggaggcagaggugggaggacagcucaagcccaggaguucaagccacccgaggagaucccaucccuacaaaaaaaaaaaaaaaaaaaaaaaaaaaaaaucgacaagguaugguggugcguaccugcggccuguggucccagcuacuugggcagcugagguaggaggaucccuugagcccaggaagucaagaggcugcagugagcccaaaucgcgccacugcacuccagccugggugacagaguaagaccacccccuccgccauucaaaaaaaaaagaacagcauauauaguauauaaucauuuguguuagaaaaugagggggaugaaggggaaaaagaaaauauuugcucacauaaaauuuugcuggagagacacaagaaacugcuaacacuaguagacgggggauaguaacgggaggaagacacugcauauaauuuugaaucuuaugacuuaguaucugcugauaaaauaauaaaauuuaaaacuuuuacucaaguauucuuauacuauuuuucuauggcugggcguggugacucacgccuguaaucccaacacuucgggaggucgaggagggcagacugcuugagaugaggaguuugagaccagccuggccaauguggugaaaccccaccucuacuaaaaauacaaaaauuagccaggcaugguggcgugcaccuuuaaucccagcuacucgggaggcugagccaggacaaucacuuaaauccaggagguggagguugcagugagccgagaucgugccacugcauuccaaccugggugacacagugagacuccaucucaaaaaaaaaaaaagauucuuaacacuauuuaucuaauaaaaaugugaggaaauauacagauuagauucuauuucaaaccaguuuaccuguuuuguuuaaaaaugagcucaauuuauauacauauacaaauauaugugauguguauacacacacacacacacacauacaaaacacacauuguuuuuguuuagacaguaucucacuuugucacccagacuucagugcaguggcacaaucauggcuugcuguugcuuccaccucugaggcuuaggcaaccucccacugcagccccacccaaguagcugaaaucacagaugcaccaucaugccuggcuaauuuucuuuuuuguagggaacaguuucucuuauguugccucccuggcucaagccauccucacaccucagccucccgaguagcuggaacuauaggcacacaccaccagaccuggcuaguauuuuuguguuuuuuuauaguuuugucauauugcccagacuggucuccaauucaugaucucaagcaaccuccugccuuggccucccaaaguucugggauuauagaugugagccauugcacccagccccauucuauucucuaguucugugaggucuauaauuuuuccuagauuccacauauaacugagaucauaugguauuucuuuaugugucuggcuuauuucacuuuacauacuauccuccaggcucaaccauggaaucacaaauggaggauuuaauucuuuuuuauggcucaacaguauuccauuguguguguguguguguguguguguauacauauauauuuuuucuuuacccauucaucuguuaauggauacuauaauaauuaccuuaauuguggauaguuucacaaauguauauauauuucaaaaauaccaugucuuaugcucuaaaugugugcacuggccgggugucguagcucaugccuguaaucccggcacuuugggaggccgaggcagguggaucaucugaggucaggaguucaagaccagccuggccaacaugguaaaacccuaucucuaccaaaaaauacaaaaauuagccaggcaugguggcaaaggccuguagucccagcuacacgggaggcugaggugggagaaucacuugaaccugggaagcagagguuccagugagccaagauugcaccacugcacuccagccugcgcaacagagacuccaucucaaaaaaaaaaaaaaggugcaguuuacugcacaucaauuauaucacaaaaaaguuguuaaaagggaagagaugugacuuuucuuaccaacccccuuccuucuuguugcauggaacaaggaugugauagcugaaggucaagcagccaccgugaaccauaagauaaccagaagauaaacuaugcacugaggaagguggaacagaaagagaauauccugagccucuaaugucacugugaaguugcuaugagagcuguggacugccuagacuuccuguaugugugacaaaaaauaaacucaaguuuuuuuuuuuuuuuuuugagauggcgucuugcucuguugcccaggcuggagugcaguggcacgaucucaaaucacugcaagccccgccuccuggguucacaccauucuccugccucagccuccugaguagcugggacuacaggcgcacgccgccacaccugauuuuuguauuuuuaguagagacgggguuucaccguguuagccaggauggucucaaucuccugaccuugugauccgcccaccucggccucccaaagugcugggauuacaggcgugagccacugcgcccggccuuaaacuuaaguuuuuaacccauuucuuuguugcuauugcuuucuauauaguguuuuuguuuuuaugguggccacauauuacuucaaaaauuagauuuaaaaaacaaacaaaaaaaaugcuaggaagcaugacaaucagcaaaguacugaauuguuuauaaauguggcaagagaguuaaauucauaauggaugauucaaaagaaagggggugaggggcugauaccgagaaagguaaaaugaugauaguucuaggcugggagugauggcucacgccuauaauccuagcacuuuaggaggcuaaggugggaggaucacuugagcccaggaguucaagaccagccugggcaacaagugacaaaaaacacaaaaaauuagucaagcaugguggcaagggucuguauucccaacuacucaggaugcuaaacugggaggaucacuugaggccaagaguuggagaccagccuggggaacauagugggaccucgucucuacaaaaacauaaauauuuaaauuaaaaaaaaaaaaaaaguucagccugggcaacauggcaaaaccccaucccuaccaaaaaauacaaaaauuagccaggggugauggcaugugccuguagucccggcuacucaggaggcugaggccggaggaucacuugagcccaggaggcagagguugcagugaaccacgaucgcacuacugcacuccagccugggugacagugagacccugucugcaaaaaaaaaaaaaaaaaaaaaaaaaagucaaacauaauaaaguuacuacauaacccagcaauuucacuccuugaauaaaaaacucaagagaauuaaaaacauuguccacaaccuuguacacgaaugugcacaucaucagcauuauucauaauggccaaaaaguggaaacaacccaauugucuaucaagugauggauaaauaaaacuugguauauucauacaacagauuauuauucagcuaaaaaaggaauuaaguauugauacaugcuacauaagaaugaaccuuaaaaaguguuaugucaagugauuaaaaaaaacaaaaaaaaguccagaagagcacguaucauuccauuuguaugaaauauccagaauaggcaaaucuacagagacaagagaguuggcuggguaugguggcucacacuuguaaucccagcacuuuuggaggccaggacuggugcauuacuucaagaccagccuggacaaaaccucaucucuacuaaaaauacaaaaauuagccaggccacucguggcgcauggcuguaaucccagcuacuugggaggcuaaggcacgauaaucgcuugaaccugggaggcggagguugcagugagccaagaucuaacuacuacacuccagccugugugacagugagacucugucucaaauuaauuaauuaauuaauagaaaguagaugagugcuugcuuggggguggugaggaggggacaacauggacugacaguuaaggaguaagggguuuuucuuagaauaaaauguucuaaaauuagauuguggugaugguugcacaacugugaauauacuaaaaaccauuauauuguacauuuuaaguagguuaauuuuauaguaugugaauuauaucucaauaaagcuguuuaaaaaaagaaauacagcuggccugguggcucacaccuguaaucccaguagguugggcggaucgcucgaacgcaggaguucgagaccagccuaggaaacaugaugaaacccccaucucuacaaaaaaauaaaaaaaauuagcugggcaugguggugugcaccuguagucccagcuacucaagaggcugagguggaggaucauuugagccugagauauggagguugcagugagccaagaucacaccacugcccuccagccugggccacagagugcaaucuugucucaaaaaaaaaaaaaaaaaaauaggccuggcaguggcucacgccuguaaucccagcacuuugggaggccgaggcggacagaucaugaggucaggagauugagaccaucguggccaacauggugaaaccccgucucuacuaaaaauacaaaauuagccaggcauggccaggcgcaguggcucacaccuguaaucccagcacucuggcaggccgagguggggggaucaccugaggucaggaguucgagaccagccuggccaacauggcgaaacucugucucuacuaaaaaauacaaaaauuagcugggcguguccgcaccacugcacuccagccugggcaacagaaggagacucagucucaaaaaaagaagaaaaagaaaagaaagucuacuuacagcuuaauaugauuaacuauagaaaucuaccgaugugaaagaguaucuaacaauuucuaagacccagaaaagcugacauccuagauaccuuaccaauuuugaucgccacuucucaugacagaagaugcuaaacauagcuucucucggauggaccauggcucuguggggccagugcuuagcagcuuguguucugggaaagggagaaaaaaaaaaaagccuuggaaacaaccacugagacuguagugcuaagcuccaaaauccccaaaaagaggacuaaaagccuaauacaaaacaucccaacuuguuaggacaaagugagcuacuauaaccaaaucuugauuuucaccucuccaagugaaauaucaccagugaccgggguaccuauucguugcaugugaauuauuaacauuuuauuucuuaaaacgccauggcuugaagcuccgcuuuauuaagaaacagggaaugucagauuaggcaguucucccuaaaagcccaguuuuaagaauacuggacuuuauuccaguuugaacuuauucagggcuuauuucccaggaacccgagcggccagccccuccuacuaccccgccucccucuuagcauaaacuuguuuacuucucucagauccucuacuccaaaugucggggguaaaagagcuuuucaguccaaaaaaagaaaaauggcugaaauccccgagaugcaauuuccugaguggcaagaaaagcucaugguuaaaagaccccacuuccacugccucacaaacgucagacaaaaaaaugaauggcucuuugaggugccgguuacuccgucuggcucauaacaucuuuucgucugcacgcccaaguuucuagagugcuuuuacgguuaacccgcagaguuccuaacacacuaggauucacuaagcugcuucucucacaccuccgcucucucccugagaaacaagaccccagauuucugggcccccaaacguuggucuucacgaugcuguagagcgcaggucucugaaaacccugggcucucaagcaacccacuucucccacucccuaagcguguaacaaaaauauggugccuagccucggaucuacaaaggccuuucacgcaaaaccugcucagauacucacugcccguucccgucgccaucuuggccccgaagucuccaacccugaggagagacggucuggaagggccgaaaccc

SEQ ID NO: 192750 - RNA, 46558 nt, Homo sapiens
ggucaacgccugcggcuguugauauucuugcucagaggccguaacuuuggccuucugcucagggaagacucugaguccgacguuggccuacccagucggaaggcagagcugcaaucuaguuaacuaccuccuuuccccuagauuuccuuucauucugcucaagucuucgccuguguccgaucccuaucuacuuucucuccucuuguaggcaagccucagacuccaggcuugagguaaguccgcagccgucuccgccacggaaucacggagaccccauugucccccuuaggguccagucgggcccccacagacagagguugggagggccgaauggggacuaucgcgaguuacgagacccggguucuuucuagucaggagucucgagcuguguggcguggaacaagucaaaauccucucuucauuccaucuuuaagguccuaagguugccucucgucggugaauucagguucuaaccuuaagccaggcugugaaucacccuucgggguugccccucuuccaguguugauucgccuggcuggaaaggguggaggaguuuaggaaagcugagggaacugugauguaccgauuuagaugacguuuuccuccuagcuagguuuuguuuuucuccuggugagaauucgaagaccaugucuacggaacucuucucauccacaagagaggaaggaagcucuggcucaggacccaguuuuaggucuaaucaaaggaaaauguuaaaccugcuccuggagagagacacuuccuuuaccgucuguccagaugucccuagaacuccagugggcaaauuucuuggugauucugcaaaccuaagcauuuugucuggguaaauauacuuuuauuuuuacacuguauugccuuugcuauuuccaaacaguuggguuuguuuguugguuuguuuucaauuaucccggcucaaaggucaggcuuuaagucucaacucugcccuugacuguguaacccuuuugagucucaccuucuuuucugugacaagaaauaaucucagccaggcgagguggcucaugccuguaaucuccgcacuuugggaggccaaggagggcggaucgccugagucuaggaguucaagaccagccugggcaacauggcaagacgccgucucuacaaaaaauauuaaaaguuagcugagugugguggugugcaccuauagucccagcaacucgggaggcugaggugggaggauugcuugagcccgggagguggaggcugcaguuagccaagaucgccucacugcacuucagccugggaaacagagugagacucuaucucaaaaagaaaagaaaagacaaagaaauaauaaucgcuuccuaucuuacuaggaucuugugagaaucaaaugaugugauaacugggaaaagucuuugaaaaccgcugcauuacgagucggucacuuuauuaguauuaauauuaguguuauugcaguuguacuuugaauucugaucauaccaugucucaacuagcaaagagaaguaguaccugagaaaaacuagggaccccagggagaaaucaagccuguguucauagugcucaggaccgggaauguggagucaagaucccccucggccaauaaacucugggccucauuuaaaaaaaaaaaaauuaucuguuucaguauguugguaaggagaaaauaaaguacagauuaugguagugggagauuuuucucagcccagucugauauauuucccaaaagcaauuagauuuauuuggacacuguucagaugaucugauagucauuaagggguguuucaaaugaacaggcuuggccaggcguuguggcucacaccuguaaucccagcacuuuggaaggccgagguggguggaucaccugagguuaggaguuuaagaccagccuggcugacauggugaagccccaucucuacuacaaauacaaaaauuagcugggcgugguggcaggcgccugugaucccagcuauuugggaggcugaggcaggagaaucgcuugaacccgggaggcggagguugcagugagccaagaucgugccacugcacuugagcuggggggacagagcaagacuccacugcaaaaaaaaaaaaaaaaaaaaaagaagaggaugacaugaucuuugacuuuuaaggauauaauaaucuaaugggaauuucgauguacuauuaugucucaacagaggaaccccaaaacguugccucgaucuuucgaaucuuagcaguggggagauaacugccacucagcuuaccacuucugcagaccuugaugaaacugguagggagaagggagauaaaggccucaaagggaagaauaacuuuuaagggagaaaacagggaaggaggauagagacggaagguggugaaaguauaaaaagaaucugccuagagagauggaauuuuguggguaacuagaggauuuuugagaaugauuaagccaaugggaagagaaagauaauaacacuaauaggagcuacuuugcauaugaaaauguuagacaaguaggaauauauuuuguugacugauuaauggugggaaugaaaguauagucauuaggauaugagaaguuuugugccucagucuaaucucagcagaggcaaagaaaccagcauaaagaaauauguuguuggccaggugcaguggcucaugccuguaaucccagcacuuugggagggcaaggcgggcgggucacgaggucaagagaucgagaccauccuggccaacauggugaaaccccaucucuacuaaaaauacaaaaguuaguuuggcaugguggcacgugccuguaggcccagcuacuggggaggcugaggcaggagaaucucuugaacccgggagguggagguugcagugagccaagauagcaccaaugcacucccgccuggcgacagagcgagacugcaucucaaaaaaaaagaaauauguugucaacuaauuuuuauauguuuuauaugaaauauuccaaaaggaauguuucauaaguuaaccuuccagaauucuaauuucagauuuucugagugauaaccuuucuuuucuacccauaagaaaaaaaaaaacuccauagguagcauaguguaguguuucccaacacuugauuucuuuuagugacacauauaaauucuuacguuucugugaaauuguaccuuguaccaugaaauggguaccaaucgagaggcuuuguauucaaaagcucaguccuugaaauuaauacggcuuacugguaaugaagaaaaucugaaggaaaaacaggaugcauggacaagaauaacuccuuuuacugauucuuuauauuugauugcaggucaccuggauucuucaggacuucaggaagugcauuuagcugggauguaaguucuguuguuaaaugaaccccacacaaaagccuuuuagcacuggucauagagauuuuauccugugcagacucugcagaguacaaaaccuuucauacuggguauaagugggcuuugaggccuaguuccuuaccuugaacaguuucuaaguuuuccacaucuaaauaguguugugaaaaugaaggcuauucauuuuaaccaucauaaucagaaguaucuauaaggaaaugaaggaaaaugguauacuacacuuauguauaggcuuuuauuuguaugugaaaggugcuguaucuuaguaauugaaaguacagaguggccggacacgguggcuuacaucuguaaucccagcacuuugggaggccaaggcaggcggaucaguugaggucagcaguucaagaccagccugcccaacauggugaaaccccgucucuacuaaaaauacaaaaauuagcuggaugugguggcacaugccuguaaucgcagcuacuucggagguugagguaggagaauuacuugagcccaggaggcggagguugcagugagccaagacugcgccacugcccuccagccugggcgacagagcgagacuccgucucagaaaaaaaaaaaaaaagaaaguacagaguauaagcucuggaaucaguguguggauuccuggcuuacuacuucauucaccaguugugacucugacaaguuuuuuuuaacuucauuggaccuuaauuuuuuuuauuuguaacguggagacaauaauagcauuucucauaaaguagcuauuguaaggaguaaauaaacuguguaucuagcacauaccaagcauuuuacuuauguauuuauuuuuauuuuugagauggagucuggcucuguugccaaggauggagugcaguggugccaucuugacuuacugcaaccucugccucccuggguucaagcgauucuccugccucagccucccgaguagcugggauuacaggcguccaccaccacgcccggcuaauuuuuguauuuuaguaauacaaaaauggaggcuucaccauguuggccaggcuggucuugaacuccugaccucaagugaucagcgccccacccccacccaccccuuggccucccaaaguccugggauuacagaugugagucacugggcccagcuugaauugcuuuaaaugcucuaacccagauagauaaugaaauccauggagggaggauagaaauuaauuuuuuuuuuuuuuugagauggagucucgcucuguugccaggauggagugcaguggugcgauuuuggcucacuacaaccuccgccucccggguucaagugauucuccugccucggacuccugagaggcugggacuacaggcacaugccacgacgcccagcuaauuuuuguauuuuuaguagagacaggguuucaccauguuggccaggacggucucuaucucuugaccucgugauccgcccgccuuggccucccaaagugcuggaauuacaagcgugagcccccgcgcccagccuuuuuuuuuuuuuuuuuuuuuugagacggaguuuugcucuuguugccuaggcuuaagugcaauggcgcgaucucggcucaccacaaccucucccucccggguucaagcgauucuccugccucaggcucccaaguagcugggauuacaggcaugcgccaccaugccuggcuaauuuuguauuuuuaguagagacggguuucucuguguuggucaggcugguugcgaacucccaaccucaggugauccgccugccucgaacucccaaagugcugggauuacaggcgugggccacagcgccccgccagaaauuaaauuuuuuuaaaaaguuagccccggccgggugcgguggcucacaucuguaaucccagaaguuugggaggcugaggcgggcggaucacgaggucaggagaucaagaccguccuggcuaacacggugaaaccccaucucuacuaaaaauacaaaaaauuagcugaaugugguugcaggcgccuguagucccagcuacucaggaggcugaggcaggagaauggcgugaaaccgggaggcagagcuugcugugagccgaggucgugccacuccagccugagugacagagccagauuccgucucaaaaaaaaaaaauuagccccaauacacugugcuggaaaauuaguaaauuguaaauuguauaaaacucguucaucuuuggaacauguuauaugguuaugcaggcaaaaugagggucuuauccccaggaugucacuugagucuugauauuuaccacagagaauacccuauguauuguuguuggaagagacauaucaacuaggaauagggcuccuagaaugaaauagaaaaauguugggaugcaccaauccacugaagaauaaucaaacaguauuugggacuaaccugacaggcaguuuguuuuaaucugcaggaaucaugaccagcaccuaaugaaauguagcccagugaguagccucucuuuuuuuggguuuuguuuugcuuuucaggugggaggcagaggguuuccauugcaccuguggcuugaggaugcuggacguucucagcaaacucucuuuuuuaggcacagcuucuuuguagcacuccgaaugguuuggaccguggccauagaaagagagaugcaauguguaguucaucugcaaauaaagaaaaugugaguguuuaauggaaaccuagauauauuggcaguuuuauuuuuugagugaagaaacuugguaucauaaugagacauagaacuguuuauaccucguaugcuagacaaggaaacuguauuacuauaggggagaaaauuucuuuguuuuuguuuuuucuuauuaaaguuuggcccuaggacagacacccagcuccaaaucuuccacaguaggucaucauuauuucucauguucaguugaucauuuugaggacaaaaauuacccuuacuguaguguaagggauuuaggaguuuuuuguuuguuuguuuguuuguuuuaacagguagggauaacuugcauaacuuguucauggauuuuuuuuuaccacuuuacaugcaaguguagauuaauuucuuauuucccccuuagucuagcuuuuaagcccuuauuccgaggaggccaugguacuuuuuaucuaaaccuuaggccauccgucguuccaaguuaaaucuagccucuccggagccaccucaucacuaagauaguucuguaucuaaucccucaucuaagccccuuuucuagacaucguuuuuucuucccugccucccaucccuuuccccaaaucauuaccauaaaagauagcugcucuucuuuucuuacauugacuuaagauaaacucauguuuucggcuguucuuaucaguuuuuucuugauuuaauacuguccuucuaaucuccauuuauaaucacuuuuuauucauuuauuuuugaaacugagucucgcuccaucgcccaggcuggagugcaguggugcaaucucagcucacuacaaccucugccucccggguucaagugauucuuguuccucagccugccaaauagcugagacuguaggcacgugccaccacggcccagcuaauuuuuguguuuuuaguagagacgggguuuugucuuauuggccaagcuggucucaaacuccugaccucaagugauccaccugccucggccucucaaagggcugagauuacaggugugagccacugccuggccuauaaucacuuuuuuuucuuuuuuuuuggugagacagaguuuugcucuuguuccccaggguggagugcaguggugcaaucucggcucacugcaaccucuaccuccuggguucaagcgauuuuccugccucagccucccacguagcugggauuacaggugcgugccaccacacccagcuaauuuuuguauuuuuaguagagacaggguuucaccauguugaccaggauggucuugaucuccugaccucguagucugcccuccucugccccccaaagugcugggauuacagccgugagccaccaugcccgacagcaucaauauuuuuaaaguuuuuuuuuuuccucucccuagaaauaagggucucacuauguugccuaggcaaaucuugaacuccugggcucaagccuuaagguuuugauacuuucuccgauucauuucuaaaaaaguuacaagaauuuacauuuucauuagcaauccaaaucucauagaauuuacuuauuuauuuauuuauuuauuuugagacagagucucacucugucacccaggcuggagugcaguggcgcagucucagcucacugcaaccgcugccucccugguucaagcaauucuccugucucagccuccugaguagcuggaacuacaggcgcaugcugccacgcccagcuaauuuuuuguauuuuaguagagaugggguuucaccaucuugcccaggcuggucuugaacuucugagcucaggcaauccacuugccucagccucccaaaaugcuaggauuacaggugugagccacccugcccagucuucucauggaauuuguuuuuuuuuuuuuuuugagauggaaucuugcucuguuguccaggcuggagugcagugggacaaucucagcucacugcaaccucugccucccggguucaagagauucucuugccucagccuccugagcagcugggacuacaggcguguggcaccacgcccagcuaauuuuuguauuuuuaguagagacgggguuucaccauauuggccaggcugauuugaacuccugaccuugugauccacccaccucggccucccaaagugcugggauuacaggcaugagccaccauaccuggacuucucauggaauuuuuuaaaaaauuacuuucugcugagcagucuaguuugagggaaaaugcuaauuaggccagauguuguggcucaucccuguaaucccagcacucugggaggcugaggugagaggauugcuugaguccaggacuuugaguucccuagcuggggaacacagcaagaccacaucucuaccccaccccccaaccaaaaaaaagaaauggcugggacuugguggugcaugccuguagucucagguacucuggaggccaaggcaagaggaucgccucggcccaagagccugaggcuccagugaguuauaauugggaggauugcuugagcacaggagucuggggcugcagucagcugagauggagacucagucucaaauaaauaauacacacacacauacauacaugguaaaauaguuuauuuuauguuaaaaauaauuagcaggccaggcaugguggcucaugccuguaaucccaccgcuuugggaggcugaggcagguggaucaccugaggccaggauuugagaccagcuuggccaacauggcaaaacccugucucuacuaaaaauacaaaaauuagccaggcgugguggcaccuggcugagaaacaagaauggcuugaaccugggaggcagagguugcaaugagcugagauuacaccacugcacuccagugcagugaauggacaggugacaaagugagacugucucaaaaaaaaaaggaaaaaaaaauaaaaauaaaaauaauuaguaguggcugggugcaguggcucacaccuguaaucccagcacuuugggaggcugaggcaggcugaucacuugaggucaggaguuccagacuagccugggcaacauggugaaaccccaucucuacugaaaaaaaaauaugaaaauuagccagggccgggcgcgguggcucacgccuguaauuccagcacuuugggaggccgaggugggcggaucacgaggucaggagaucgagaccauucuggcuaacauggugaaaccccgucucuacuaaaaauagaaaaaauuagccgggcaugguggcgggugccuguagucccagcuacucuggaggcugaggcaggagaauggcgugaacccgggaggcggagcuugcagugagccgagaucgugccacuguacuccagucugggcgacagagcgagacuccaucucaaaaaaaaaaaaaaaaaaaaaaaaaaauuagccgggcgugguggcaggcaucuguaaucccagcuacccaagacgcugaggcaggagaaucaguugaacccaggaggcagagguuucaguaagccgagacugcaccacugcacuccagccugggcgacagagcgagacucugucucaaauaauaauaauuauaggccgggugcuguggcucacgccuguaaucccaucacuuugggaggccgaggcaggcggaucacaaggucaggagaucgagaccauccuggcuaacauggugaaacccugucucuacuaaaaguacaaaaaauuagccagucgugguggcgggcgccuguagucccagcuacuccggaggcugaaguaggagaauggcgugaacccgggaggcggagcuugcagugagccaagaucgcgccacugcacuccagccugggcgacaaagcaugucucuguaucaaaaaauaaaauaaaauaauaauaauaauuaguagugauuucaugugauuauuauccaugcguaauuucucuagugucuuuugugcccuuauaauacuggggucuuaacuuacccaggcauugacuugccuuucauagaccauggacuccagagauuuggauuauuauuucuaaucucaacccugagggaaagcuauuuuaacauauucuauccuaugaagauaaaguugaucaugguuuuuuuuuuuuuuuuuuuuuuuuuuuuuuuugagacagagucuugcucugucaccaggcuggagugcaguggugcgaucucagcucacugcaaccucugccuccuggguucaagcaauuccacugccucagccuccccaguagcugggacuauaggcgugcaccaccacacccagcuaauuuuuuguauuuuaguagagacgggguuucaccauguuggccaggaugcucucgaucuccugaccucgugauccaccugccucggccucccaaagugcugggauuacaggcaugagccaccgcgccuggccacuaaguugaucauguuuuauuuagguuuuugguuucuaggauggagggaagaccuggaguauguucaauuauuggauagucuuauaugugauuuuuuuuaauugcaguaaaauguacauaauauuuacaauuuuaacuauuugugagugugcagucuagugacaguaaguauauuaauaaugugagacuaucaccagaacucauuuccagaauuuuuucauuauucaaaacagaagcuguauacccuuaagugauaacuccccaucccuguuucugcccagccaaugauaaccucuauuuucugugucagugaauuugacuauucuagauaccucauaugaguagaauaauauuauauuuuguccuuucaugugugugugugaggucucacucugucaccucugcuggaguacaguggcacaaucauaacucacugcagccucaaacucccgggcucugauuauucucccaccucagccuaccaaguaggugggacugcaagugugugccacuaugccuggcuacuuuuuuuuuuuuuuuuuuuuuuuuuuuuuugagacagagucucacucugucacccaggcuggagugcaguggugcaaucuugacucacugcaaccuuuaucucccagguucaggugauucuuaugccuuaaccucccuaguagcugggauuacagacgugugcuaccaugccuggugaauuuuuuuguauuuuuaguagagacggaguuucaccauguuggccaggcuggucuuaaacuccuggccucaugugaucugcccaccucaaccuaauuuuuuuguauauuuuguagaaucaggguuuugccauguugcccaggcuggucucaaacuccuggguucaagagauccaucugcuucagccucccauagugcugggguuacaggugugagccacugcguccagccuauauuuucauuuagcguaaugucuucaaaguucaucuaugucauagcauguauuagaauuucauuucuuuuguauguauauaucauauuuuguuuauccauucaucuguugauggacauuuugaguuguuuccaaccuuuuggccauugugaguaaugccguuaugaacauagguguacaaaaucugcuugaguccuugcuuuuauuuuauuuuguguauuuuuuuuuuccaagauggagucuuugcccugucacccaggcuggagugcaguggaacgaucacagcucacugcaacuuccaccucccugguucaagcaguucuccugccucagccucccaaguagcugggauuacaggcacaugcuaccaugcccggcuaauuuuuguauuuuuaguagagaugggguuucaacauguuggccaggcugcucucgaacuccugaccucgugaucugcuggccucggccucccgaaguacugggauuacaggcgugagcuacugcgcccggccccugcuuuuaauucuuuuggguauauauucagaaguagaauugcuugauuacaugauaauucuacauuuaauuuuuugaggaacugccaugcuauuauccauagaaugccucugcacccuuuuacauucccaccagcaaugcacaaacacuuguuauuucuuauaauggcuauccuaauggguauaaagaaguaucucuugcaauuuucauaugcauuuccauaaugauuacuuuguugagcaucuuuugaugugcuuaugggccauuuguauaucuucuuuggagaaaugucuauucaugucccuuuugauuguuauuguuguuguuacugaguuguaggaguuccuuauauauucugauauuaaucucucaucaaauauaagacuugcaaauguuuucucccauuuuguggguugccuuuucauucccuuaaugguguucuuugaugcacaaaaguuuuccauuuugaugaagaccaauuuaucuguuuuuuucuuucguuaccugugcuuuugguggcauuauccaaauccagugucaugaauuuuuucccuuaucuuuucuucuaagaguuuuauaguuuuagcucuuacauuuagaacuuugauauauuuugaauaguuuuuaauguugucaauauacuugacaggacaauggaaacuugguggacagugaaaugaaauauuugggcagucccauuacuacuguuccaaaauuggauaaaaauccaaaccuaggagaagaccaggcagaagagauuucagaugaauuaauggaguuuucccugaaagaucaagaagcaaagguaaaguguucugugguaguaucuuuguauucuucauauuccuucauucuguuaaaagaagaacuagacaaauuaaacuuaggagaguuuauuugagcaaaaaaauaacuagugaauccagcaacccucauagccagaacauguucaguaaaacuccaguuugccauguggucaggcaguauuauggacagaaaauggaaaugaaguacagaaaauagaagugagguacagagacagcccaguugguugcagccuugaguuugccuuauuugaacaugguuuaaacaguugauugcuugugguugacugaagcucagcugcugugcuuuccugagacucagcuuuuugauacaaaaguauacuucuaaauuaggcuuucaguuaguuuaaguacuaaguuagguugcaacuugguauauaaagacucaaguacagaggcauccccaggccaaauuuaguuuaauuaagaauucauucuucuuuuuuuuguuguuuguuuuuuuuaagacagauucucgcucugucgccuaggcuggagugcaguggcgccaucuuggcucacugcgaccuccucuucccagguucaagcgauucuccugccucagccucucgaguagcugggauuacaggugugcaccaccacacccggguaauuuuuaguauuuuuaguagagacaggguuucaccauguuggccaggcuggucuuaaacuccuggccucaggugaucuacccaccucaggcuuccaaagugcugggauugcaagcgugagccaccaugcccagccaacaauucauucuugaauaaacauuuuaugccugauauguaugagucacucuacuaaaugcuagagcuacagagaucaacaagaugugauaaccuaucuuuauuuauuuauuuauuuuugagauggagucuugcugugucaccuaggcuggagugcaguggugguaucucagcucacugcaaccuccgucuccuggguuuaagugauucucuugccucagccucccaaagcacgccaucaugccuggcuaauuuuuuguaauuuuaguagagacgggguuuugccauguuggccagacuggucucgaacuccugaccucaagugaucugcccgccuuggccucccaaagagcugggauuacaggcaugagccaccacgccuggcguaaccuaucuuuagacuguaggguuaccugacugauagguuaucaggucacuacagaaaucuucuuacugcuggugaacagguuccagucaauaguuugaguggaucaccaucaaaguaaucuaggauaaguaaugucuccaggauaaugguaauguauaaauguauagaauauaccuaacauuacuuuucagguauuuuauaauacagucuuuuguuuccuuuuuucuuucccauaucacugauagauauaccugaagcauguggguuauagccuauaugcugauaugccaaagauaguuucugaggcauuuagcuuuuuuugguuuuugguuuuugguuuuuuuuuuuuuuuuuuuuuuuuuagauagacagggucuuucucuguagcccaggcugggguacguggcacaauuaaaguucacugcagccucaaucuccccaggcucuggcaguccucccaccucagccuccaaguagcugggacuauaggcacaugccaucauaccuggcuaauuuuuuguauuuuuuguagcgaugugguuucacaauauugcccaggcuagucucaaacuccuggacucaagugauucacacaccuuggccucccaaagugcugggauuacaggcaugagcuaccaugccuggccuacauuuagcauuucuaaaucagcuuuguugcuuugaaacaaguagggcuauggguuugucuuuaaaauuuauucauuucacaaggccaguaugguauaguggaguuagaacaguugcauucuaguccucaugcuuuuauuuuuuuuaauuauuuaauuaauuagauagggucuugcucugcucugucacccagacuggagugcaguguugaacuccugggcucaaguaauccucccaccucagccuccugaguagcuaggacuauaggugcauaccaccaugcccagcuaauuuuuaaaauuuuuuguagagauggggucuugauguguugcccaagcugguuuggaacuccugcgcuccagcaauccucuugccuuuguugcgggaucuuuaggguguugcuuuucuggccagaaaccuuucugcccaguggugccuuugccugaguuguuguccugcgucgagguaagcagacaaguagaggguuagcaagacgaagagaagcuuuauugaguguuagaacagcucagaggagacccacagggggcagcuccucucuguaggcaguuugucuuaucccguauucagcucucagcagagaggaggcccuggaguggguggcuccucucugcaggcagguccucccuguugauuucccagcuuucagcagacagcauagcuccucucuccucuuugguugucugaucuuuucuccauccucuacccugcucuggcugagccugggccuuuuauggaccucagaggggagaaagugcuuccugauugguucauggacugugagaaaaggcagcacaaauccccauccagugggugggacuagcagcccgguccccagccuuuaagcccuccccguccugaagguggggacuuacaggaaccucccuucuacccaggagccugucugucucucucagcaguccauggcaccaggcugcucacaccaaggugcaccuaaaggccagcacugaccacccucagucccuacuuggcuuccccucuuuugcuucuccgugcccaaauucuagagggggucaagguggcagggugcugcccugagggugcacacacagauccgcccccggacuguaacagcaccuggacuugccccaaccccacucugagauuggagugggugccaagagcagagagaaguggggauaugggggugguggggaggccuuccugggcccccaagggugcaggcugcagagacuauuagguccugcaccugggagggcagcugcagcugcacccgggaaggcagggauccugccugcucccggcccccacaagaccacagggaggcucggaucugcagccacaacuugggcggcugcaagcccacccaggagggcagggcuucugccugcuccguggaacaggaggcccagguuaacagcugcaguuuguguagcuccagcagcaccaggggagcuccugccccaacucagaaggggaagggcucccgcuagcuccauggaucaugcagcccuauccauaccucucugcugcagccaguuugaugacagcagcaagcccucuggaguugcagcugccaacaccuuggccucucaaagugcuggaauuacaagugugagccaccguauccagccucauucuuuuauuuacuuggugguaugacuguucacaagacaaccacuugaccucaguuuuuaauuuauaaaauggagagcaugauaaaacaacuaccuccuuaauaggcuuguuguaaauaaaauauuaaaagcaguuuauguccucaucacauacacacaaaugguaacugugugaugaaggauguguuaaugaauuucauugugguaauccucauguaauauauacguaaaucauuauauuguacuccuuaaguauauacaaauuuuaucauuuauaccuccauaaaauagaaaaaaaaauuuaaagagcaguuuguaauacaguaguccucuguuauccacagagaauacauucugagaccccccaguggaugccuaaaauugcagacaguacugaacccuauauauaccaugcuuuucccuaugcauauguaccugugauggaguuuuuuacuuaggcauaguaagagauuaacaauaauaacuaauaauaaaauagaacaauuacaacaacauacuauaauaaaaauuauaggaggcugggcguggugguuuaugccuguaaucccagcacacugggaggccgaagcggguggucaggaguuugagagcugccuggccaacauggugaaacuccaucucuacuaaaaauacaaaaauuagcugggcgugguggugagcaucuguaaccccagcuacugggcuggcugaggcaguagaaucgcuugaacuuaaacccagguggcagaggcugcagugagccgagaucgcaccgcuguacuccagccugggcaacagagugagacucuaacucaaaaaaaaaaaaaaaaaaaagugcuggcugggcauggugagucaggccuguaaucccagcacuuuaggagguugagaugggcagaucaccugaagccaggaguuugagaccagcuuggccaacauggugaaacccugucucuauuaaaaauaccaaaaaaaaaaaaaaaauuagccaggugugguggcgggcaccuguaaucccagcuacccaggaggcugaggcaggagaaucgcuugaaccuaggaggcagagguugcagugagccaagaucgcuccauugcacuccagccugggcaacaagagugaaacucugucucaaaaaaaaaaaaaaaaaaaaaagugcuauaggcugggagcggugacucacaccuguaaucccagaacuuugggaggucaagguggguggaucaccugaggucaggauuucuagaccagccuggccaacaguaugaaaccuuggcucuacuaaaaauacaaaaauuagcugggugugguggcaggugccuguaaugccagcuacuugggaggcuuaggcaggagaaucacuugaacccaggagguggagguugcauugagccaagaucacaccguugcacucuagccugggcaacagaaugagacuccaucucaaaaaaaaaaaaaggugcuaugaaugacaggacgauuugaauaaaggacagcacuuugagaggccaaggcagguggaucaccugaggucaggaguuugagaccagccugaccaacauguugaagccucgucucuauuaaaaauacaaaaauuuagcugggcaugguguugggcaccuguaaucccagcuacucaggaggcugacacaggagaauugccugaacccaggaggcagagguugcaguaagcugagauugugccgcugcacuccagccugggugcgacagagcaagacuccaucucaaaaaaaaaaaaaaaagaaagaaagaaagaaagaaagaaagaaagaaaaagggacauagguguuugggaggauauuauuuuugacuuuacccugaguaacuggagaaauggugacaacaguauaaugaauuugaaaagaaggguggauucagcgggaauagauguguucuguuuuggacauugaguuauagaugcuaaggaggaaauuuagauggaaauacuaaaugaggaguugaagcuaucaggaugagaaauguacauuucuggggcagcuguauagaggagaaaauggaagcuaaugacucuaaguuuaaagugaagagaaaggcugggaagaaagagcaguagccacugugggacugauaaugaaguagacacauauaggaauaauauuagccaggaaucagaaaggagagaucuaggacacaaauacagguggcacauuuauauauuaauucuuuuuauacauuuuuuguuaugguaaaacaaaauuuacaauuuuaaucauuuuuaagcauacaguuuagugguauuaagugccuucauuuuauugugaguguacuuacccaucucuaggauuuuuuuauuaccccaagcagaaauucucucuuuuuuuuuuuuuuuuuuuuuuugugagauauagucuugcucugucgcccaagcuggagugcaguggcgcaauuuugucucacugcaccuccaccuccuggguucaagugauucuccugccucagccucccgcguagcugggauuccaggcaugccccaccguggccggcuaauuuuuuuuguauuuuuaguagagacaagguuucaccauguuggccaggcuggucuugaauaucugaccucaggugaucugcccuccucagccucccaaagugcugagauuacaggugagccacugcaccuggcccccaagcagaaaugcuguaccccauaaacaauaacuccccaucuucucccccuuccccagccccuaguaaccacuauucuauuuucugcccucuaugaguuugcucuagguaccucauauaaauggaauuuuaucauccuuuuaucucuggcauauaucucauaguguaauguuuucauugguaaucaguguuguagcauguaucagaauuucauucucuuuaaaaaaaaucaguuuuauguuaaauuguaaaaugcacauaaccuuuaucaucauaaccauuuucaaguguauaguuuaguaguauuacauacauucccauuguuguguaaccaaucuccagaacucuuuuaaucuuggaaaacuggcacucugugcccauaaaacaacuucccauuuuccccuucucccagccucuggcaaccaccauucuacuuucuauaaauuugauuauucuagauaucucugauaaguggaaugauacaggguuuuuuuguuuuguaacuggcuuauuucaacuagcauaauguccucaagcuuuaucuauguuguagcauguaucauaauuucauuccuuuuuauggcagaauaauauuccauuguauguauauaucacauuuugugacauuuggguuuccaucuuuuggcaauugugaauauuguugcuauaaaaauugguuuacaaauaucuguuuguguccuugcuuucaguucuuuuacuuuuuuggagacaggucucacucaguugcccaggcugcagugcagugaugugaucauggcucacugcagccuugaacucuuuggcuccagcaguccucccuucucagccucccaagugacugggauuacaggugugagccaccacaccuggcccugcuuucaguucuuuaggguauauacccagaaguaaaauugcugggucauaugguuauucuguguuuaauuuuuuaaggaacucucauacuguuuucauagcaacuguucauuuuacauucccaccagcaaugcacaagggucucaguuucuccauaucauagccaacacuuguuauuuccugauuuugauacuauccaucugaugacuacgaaaugguaucucaucguaauuuuaauuugcauuucccuaaugauuagggauguugagcaccuuuucauaugcuuccuggccauuuguauaucuucuuuggagaagugucuauucaaguccuuugcccauuuuuuaauugaguuguuucuuuuguuguuguugaguuguaguucuuuauauauucuggauaucaaucccuuaucagauaaauaauuugcaaaucuuuuuuccuauuccguugguugccuauucacuauguugauugugcccuuuguugcaaaaaaguuuuuaauuuugaugaagucuaauuuauccacuuuuuuuguugcuugugcuuuuggugucauaucugagaaaucauugccagauucaaugucaugugccucccccaacccccuccccuuuuuaaaagaaaauaguagggacagggucucacccaggcuggaguauagugaugcgaucacauagcucacuguaacuucaaacuccugcccucaagggauccucccaccucaguguccauaguagcuaguacuacaggcaugcaccaccacaccuggcuaauuuauuuuuuguagagauagagaugaggucuugcuguguuacucuucuggucucaaaauucuggccucaagcgauccucuugcuucagccucccaaggugcugcgauuacaggugugagccauugggcucagcucccuauguuuucuuuaaagaguuuuauaguuauagcucuuaaguuuaggucuuugauucauuucgaguuaauguguguauaugguauaagagaaggcuuuaacuuugcucuuugggacaaagaacaaagcaguguuggcuacaauauggagaaauugggacccuugugcauugcuggugggaauguaaaauccaguugucccaccacuaauuguugaaaaaacucuccuuucuucauugaauggucuuggcacccuuuucaaaaaucauuuaacuauauaugcaagagguuauuucuuggcuguguuccauuccauuggucuauaugucugucuuuaugccagugccacacuguuuacugcagcuuuguaguaagucauuuuauaaaucuuuaauuucacaaaucauccuugaauauauucuccuuuauggaaaaguuaaaacauaacagcuaaggauaacuaacccuaucugaccaccauucgaagucccuauugaaggaaagggcucagugggaaaaguuaagagcaugugagucaguggagcgcaguggucugagaaguagccucuggggccagacugccuggauucauagcuugacucugccacuuuuagauauaugacuguaggugagucauaugaucuccuuguguucaauuucuuggguuguugucaggaucgaaugaguuaauuacacauaaaacauguagagcaauacuuaucaauuaauaguacuuaacuauuauuguguaguguaagugcuuaauuauuguaguauacgacuaaacuauguggaguuaugaagaaggcugauaggugaggggaugcucaauggccuugauguccuccgcaaaguaaacauugaaguaaucugaugauucagaggagagugcgaggcgagagucuuaaaagugugugaagaagguuauaauugacuuuuggagacuguggaauuacuaaaagccuaguaagaugauauuuguaagguccuaugagggcauuaucagguagacaugcauggcacuuguucgaagugucuuccuacaagaauguucuggccuggaagcgagauuggagacuuuggaacuccagggaugauaguaaggguugaagauugccaaugguggaugaacaagggguugaggaagaauagguauggugaaggcagcagaaaagucgacgaugauucaaagccuggcuaaaaagccagauaucauuagguggacucaguaaaguaagagcaguaaugugauugaaaguugcugagaagguagaaaguggcugguuuagaaaguuuugagagcuaggcugggagcaguggcucaugccuguaauccuaacacuuugggaggccgagacagguggaucacuggagaucaggaguucgagaccagccuggccaacauggugaaaccucaucucuacuaaaaauacaaaaauuagccggguuugguggcaggugccuguaaucccagcuacuugggaggcugaggcaggggaaucgcuugaaccugagagguggagguugcagaucacaccacugcacuccagccugggugacagagcgagacuccaucucaaaaaaaaaaaaaaaaaauuuugagagccaggggagguuuuaguuaguuugagggcaugccauguuugagcucuugauaguauaauaauagaugaugauugcaguuguuuuuauuuuuauuuuuuuauuuuguuuucuuaaauuccccucaccuccccccaucgcccuuuuauuuugagacggaguuuugcucuuguugcccaggcuggagugugauggugugaucucggcucacugcaacuuccgccuccaggguucaagagauucuccugccucaaccucccagguggguaggauuacaggugcccaccaccacccccagcuaauuuuuuguauuuuuaguagagauaggguuucaccauguuggccaggcuggucuugaacuccugaucucaggugauccaccugcuuuggccucccaaagugcugggauuacaggcgugagccacugugcccagucaaauuuccuguuuuaagaaugaaguauuuuuauguuuuuuuuuuuuuuuuaauaccaguuuguugagagccugauguggaguucuagagaagcuuaguggaaguauugugaagucaugcucuccaaaguguugucaguggacauuguaagaauguggaaaauacaauggguuuuaguauugaagacaguacagagacuagaauggaaaggaaaaaugagggccacgcaauaacaagagcucccauuuauugacuacuuagaguauaguaggcaccaugugcuaagcaguauacauccauaaucacauuucauucucauauccacccugaaauaugacuguugucucccuuugaggggagcccauugggucaugagguaaggugugauacccaugguuacauaguuagaagcagcagagccaggguuuaaacuaagaucuaccugaccccagagccuguuuuuagcaauuuucccagguaauucugauauacacuaaauuuugagcguuauguucuauaacauaguauuaaguccuauuuuauuuuuaauuucauugguuugugggaaaacaaaaccaagauacaaucugaagaaggcaggauggguguugggagaauugacagugaccuuccuaaaacauaaaacaguuuugaggacuugcugauaaugggcaguagaucuauagaaaaacagugaguugggaauagucggcauggggaaaagguuucuagggcuuccgaaaaaaagagcaauguaaaaugaagauuuaggaucacuuuuacaaauauguuagucuucacauuugcagaauguuguaauuaauauaguuaagucucagcugguauuaacuuagcaaauugaauuuaauguuaauuuaaaaaauccuuuuauuuucuauuucauuguugaaaacuugucuaaguuauguugaucugcuuuuaugaaauuaaguacaguacagugaacauaauugaaucuuucucuggugauugaagaucuuucauagucucagaaauaucauucugaauugcauaauauagacaguauagaagcauggacuuaaaauagauugaccccaggaaauauucuggaacagguuuucccaacccgugggccauggaucaacacagguccauggccuguuaggaaccgggccgcacaguaggaaguaagaggugggccaggccagcgagcauuaacaccuaagcucugccuccugucagaucaguggcagcauuagauucucauaggaggcaaacucuuuugugaacugcgcaugcgagggaucuagguugccgguuccuugugagaaucugagaaucuaacuaaugccugaugaucugaggugaaacaguuucauccugaaaccauauccccacccagauccauggaaaaaaaugucuuccacaaaacugguccccaguaucaaaaaggcuggggaccacugcucugaaaguuuuguuuagguggaagaguggcauagggcuaugaguauuuauuugauuuuuguuuuaagagacagggucuucuauauuguccaggcugaucucaaacucuugagcucaaguguucccccugucuuggccucccaaagugcauuuugauggucuuugaaaaauauuuggacaauagagccuugacagaaaauuuaaauaauuaaauaaaaaauguuuuaaaauuguccuuuuaugggcucauuuucuuagauuguaacucuuaugcagucauuuucucuuucuuuuuuuccuucuuucucuuuuucuuuuuuuuuuuuuuuuuuuuuguggcagucucagucugucuuccaggcuggaguguaguggcgugaucagggcucacugcaggucacaaccuccugggcucaggcgauucuuccaucucagccucccgaguagcugggacuacaggcacaugcaaccaugccaagcuaauuuuuguagagacaauuucaccauguugcccaggcuggucuuaacuccugggcucaagugaucugccugccucacccucccaaagugcuaggguuacaggugugagcuaccaugcauggccauaaagucauuuuugauugauggcccauccuauaagaauaugcauagcaguagguuuuagguuacaaaagggauagggggcugggcacgguggcucaugccuguaaucccagcacuuugggaggccgaggcaggcagaucccuugaggucaggaguucgagaccagccuggccaacauggcaaaaccccgucucuacuaaaaauacaaaaauuagccaggcaugguggcaugcaccuguaaucccagcuacuaaagagcccgaggaaggaaaaucacuugaaccugggaggcagagauugcagugagcugagaucgugccgcugcacuccagcaugggcaacagagcgagacucugucucaaaaaggaaaaaaaaaagaaaaggaauagggauuuuuuuuuguuacuguuuuaccucuuugauguuaaauggaaaaaaaaaaaauaggccaggcacauuggcucacgccuguaaucccagcacuuugggaggcugaggugggcagaucaccugaggucaggaauuugagaccagccuggccaacaugaugaaaccccgucuuuacuaaaaauacacaaauuagcugggcauggugguaugcaccuguaaucucagcuacuugggaggcugaggcaggagaauugcuugaacccgggagguggagguugcagggagccgagauugcgccacugcacuccugccugggugacagagugagacccugucucaaaauauaauaauaauaauaauaauaaacggaaauaaauagauacuuguauaaagcagugaccuccuuggagauugucguaaccuuagugauuuuucauucauuucuuuacuuaaaaaauauuuauugaguacuugcuacauguugggaagugugcuaggcacuggugauacgauggugaacaaaacagacuagaauuuauauucuugucagggaugcaucaaaacaacaaaaauuuuuuucaaguuaauagauauucuaguuagaguucuugguugcaaauaauagaaacugauucuaguuuccucaagcagaaaagggauuuuucuggaggguacugaggaacucagaauuacaaggaaggcuggaaaacaaaguaaggcccagccaaaauacuauuccaggaacauugagcucaggaugccaccacuugcuggcuagacacucaaugccaccguuacuggcacccugccauggaacaugaucaggcuugcugcuagauagacugugcugcucauggauauuugcuaccaccuaguauauucucuacugugaugcagccaccauaaaaagucuggaccaacccuuugcuuuuugagcuucuuuaagguugaaaaucccaggcaggaauaucuaguuggucacaagggcauggaaaagggaauaucugucucccauuggccaccucaugaggaggcaggacugccucucuaacuuuagauuuuacugaaacaguauguuaggcagccaaauuguaaaugucugccauaacagacaaaauaauuuagauuuugggcugggugugguggcucacacuuguaaucccaacauuuugggagucugaggcagaaggauaguuugagucgacaaguuugagaccagccuaggcaacacaguaagcccccaucgcuacaaaaaaauaaaaauuagccaggcaugguggugugccccuguaguccuagcuacuccagaggcugaggugggaggacuguuugagucuagcaguucaaggcuacagugagccaugaucaugccugggcaauccagccugggugacagagcaagaccccauuucuaauaauaauaauaauaauuuaguaauugcaaauaguccaaguguaaugauggaaacaaaaugaggucugaaauagaggcuaacaaaaggaaaucuuuaaauggagaauaauaagggaagaucuccacaagugggagauauuugguuaagaaucgggugaugaacucucuguuugccugggacuagaauguucuaggauauggggcuuccauugcuaaagcugggaaagucccggacaagcugguauuaaguuagggccacucuaauugugaaggaaucauauaugacaagaguagaggcaggagcauuucaugaagaaggaauguugcagguacagaggccccagguggaaaaggucuucacauguuggagggacugagaagucagugaaugagaggaguguuaugugagcugggaaagaauaaguagucaggagguagaucacgcagggucuuuaggcuauggugaguguuuggauucuauucuaaguacaaugaguugcuacugaagggagggcuuuaggcaggggaauaauauggucugauuuguuuugugaagaccacucuuguugauggauggggaacagauuagaaaggauuaagaguuggaagucaacgggugguuuggcuuucaccuguaauccugucaauuugagaggcugaggcaggagaguugcuugagcucaguaguuugagaccagucuaggcaacauagcaaaaccucaucacuacuaaaaauaaaaaaauguuaguugcaugugguagugcaugccuguagucccagccacuugggaggcagagacaguaggauugcuugagcccaggaggucaaggcugcagugagccaugaucgugccacugcauuccagccugggcaacaaagggagacccugccucaaaaaggagaaaaaaaaaaaaagaguuggaagcagguaagaguaggagccauuguguuaguccuagcuacaguuggugguagccugaacuaagguguugacuauggagacagagaaauggaugcauucaaaauauauuuugucugccugccucagcaacaugucucuacaaaaaaaaaaaaaaaaaaaaaaagccaggcaugguguguaugccuguagucccagcuacucaggaggcugaggugggaggauggcuugagcccagggguuugaggcugcagugaaccacgaucacaccacugcucuccagccugggcaacagagcaagacccugucucaaaaaaauuaaaaaaguaaaaagauacauagauauauauauuuuggauagagaaucaacaggacuugaaggguugggugcaggcugugaaggaaggaugagaucaaggaugacuuuagucauaugcaguuugaaguguuuuguugugaagagaaaacagaugcuaucagaagaaaacugccuucuuuucucaccagauacagcaaucaaucuccuuuuauacccauauaaucugcagucgcucuugccacagagcacgaagugucccugcuccuaucuaaagcccuuccuucacacuguguccuauucauucauucauucauuuauucacuaaugccagagauacaguaguaucugagcuuacauucuaguuaugaggaaacagacagacaaauacauuuguaauauggcagaugguaaaaauacuauggugaaaaagcaaagggagauuauagggagucccuggauuggaguagggcagggugagaguuguuauuuuugauagguugcauaggucagaggagacuuauuugagagugacguuugagcagacaucugaaagagcgaggaagccaacaagcagaugucaggaggaaugagucauucccagcagaaggcaaagcaagugcaaugccccugaggugaguaugcuuggcguguuuaugggacagcaagaaggccaguguggcugaagcggagggagcaaguggagaaggguagaaaaugagggcagagaggaguuagcagaaggacagaucguguagggccuuguaggcauuuguaaagacugcaaaaaccgagucagauggaagcaucuccucauguguacuacugcaguauuuccccacuccuauauuaccaauuuucccuucuacuagaauaagaguucucaaauuuuuuggucuuagaacuccuuuguaaucuuaaaaauuacuuacaaccccuugccuuacaccugagcuuagagaaaagcauucagcuuuuuauacauugaguaugauguuagcuauacauuucuugagaagcccaucaucagguugaggaaguucccuucuauuuccuaguuugccaggagauuuuagcaggaacagguuuuuuguuuuuguuuuuguuuuuaaagagacauggucucacucucuugcccaggcuggagugcguggcacaaucacagcucacugcauccucaaacuccugggcucaagagauccucuugccuaugccuccccaaguagcugggacuacaggcaaacacagucaccccuggcuaguucuuuuuuuuuuuuuuccccuauagagauggggaucucaccauuuuguccaggcuggucuugaacuccugggcucaggcaaccccucugccucagccucccaaagugcugggauuacaggcauaaguuacccuacccagcccuuuucucuguaucuauugagauaaucaagugaguuuuuuuuuuaaucuguuaauaugaugaauuacuuuuuuuuuuugagauggaguuucgcucuuguugcucaggcuggagugcaauggugcaaucucagcucaccacaaccuccgccuccuggguucaagcgauucuccugccucagccucccgaguagcugggauuacaggcaugugccaccacgccuugcuaauuuuguauuuuuaguagagacgggguuucucuauguugguuagucuggucucaaacucccgaccuuaggugauccaccugccuuggccucccaaagugcugggauuacagguaugagccacugugccuggccuacguuuuugaauguuaaacaaccuugcaauccugugauaaccucacuugguugugacauaugauccuucuuauauguuguuggauuucauugcuaacauuuuguugauaauuuuuacaucggccgagcacgguggcucaugccuguaaucccagcacuuugggaggcugaggcagguggaucacucgaggucaggagaucgagaccagccuggccaacaugguggaacccccgucucuacaaaaaaauacaaaaacuagccgggcaugguggcacacaccuguaguaccagcuacucgagaggcugaggcaggagaaucgcuugaaucagggaggcagagguugcagugagcugagaucgugccacugcaguccauccugggagacagagcgagacucugucucaauaaaaaggccgggcacagugacucacaccuguaauucccagcacuuugggaggccaaggcagguggaucaccugaggucaggagcucgaggccagcuuggccuacauggugagaccccaucuguacuaaaaauacaaaaauuagccaggugcaguggcacacaccuguaauuccagcuacuugggauacugaggcaggagaaacgcuugaacccaggaggcagagguugcagugagcugagauagcaccacugcacuccagccugggugacagagcgagacuccaucugaaaaaaaaaaaaaaaauuuuuuuuuuuuuuuguguaccucuauguucaugagagauauugaucuucaguguuuuagcuuuucauguuaauguuuugguauugguaucaguguaaugcuagcaucaugaaaugauuugcaaauaauucccucuuuuuuuuucaauuuucuggaagaguuuauauagaauugguuuuauuucucuuuuagauguuuggcacgauucaccggugaagccaccugggccuagaguuuucuuugugggaauguuuuuaacaaauucaacuuacuuuacagauaggaacuacucaguuuaacuguuucuuuuugagugaguuugguaguuugugucuuugaaggaauuuguccauuuuaauuagguugucaaauauaguggcauaaaguuguuaaaaauacuuccuuauuagcguuuuagugucuguagaauccauagugaugucucucauuccugauauugguuauauguguccucugucuuauuccugauaagucuggguagagauuuaucaauauugaucuuuuuaaaaaaucaucuuuugguuuuauugacuuucuccauuguuuuucuguuuucuauuccauugauuuugcacucuaaucuuuggauacuuugaguucaauuugaucuucauguuuaguuaagguugaagcuaaggucauugauuugagaccuuuuuaaauaaggguauuuaguacuuuagcugcaucucacaaauuuugauauguugcauuuucaguuuuauucaguucaaaauacuuuccaauuuccuuuuuugguuucuuuuuugauguagggguuacuuagaagcuuguuauuuaauuauuugcaaauauuugaggacuuuuugaggaccucauauuugaggaccuuucuguuauugaauucuaauuuaauucgauugucaagaauauauuuuauaugacuuaaauccuuuuaggugcauuaagauugguuuuuaugguccagaguaugacucagaacaucuugguaaauguuuagugcaacuuagaaaauguauagucucuauucuugaguagaauauucuauguaugucaaguagguccaguuuauuuauauuguugaacacaucuauaugcuuauuaguuuucugucuauuaaucuaucaauuuuuuuuuuuugagacagagucucacucuguugcccagaauggacugcaguagcacaaucacggcucacugcagccucaaccuccugaacacaaacaauccuccugccucagccucccaaguagcugggacuacaggcaugcaccacuguacccagcuaauuuuuguauuuuuguagagacagcguuuuaccauguugcccaggcuggucuuagacuccugagcucaagcaacccacccgucuuagccucacaacgugcagagaugaguaaucauaugguuuuugucauuuauuuuauugaucuggugggauacgguggcugauuuucagauguuauaucaaccuugcauuucugggauacauccuaccuggucaugguuucagucuuuuguuuuguuuuguuaauuggaguuggggcggugccucacuaugucgccuugaacuccugugugcuccagcaauccuuccaccuccgccuccugagaagcuaagacuaccggugcacaccacuacaccuggcuaguuucaguaguuuuugucuuguuaggaauuaguccauuucaucuaaguggucucauuuguuggcacacaguuauucacuaauauuucuucaugauccuuuuuauuucuguaagguugguaguaaugucccacuuuccauuccugauuuugauaacuugagacuuuuuuuuaauuguucaggcuaaaaguuugucgauuuuugcugaucuuuucaaagaaccaacuuuugguucuguuguuuuucuauucucuuaaguucugcucuaaucuuuuuuauuuccuuccuucugcuugcuuuggauuuaguuuccucuuaggugggaguuuagguaauugauuugagaucuucuuuuuuauuuuaggcauuuauagcuuuaaauuuuuuucuaagcauuacuuuagcuguaucccauaagcuuugguauguuguaucuuaguuuucauucaucucaaaguauuuucugauuuuccuaugauuucuucauugacccauugguuauuaacaaguguguuauuuaauuuucuuuuucuuuucuuucuuuuuuuuuuuuuuuuugagacggagucuugcucugucccccaggcuggagggcaguggugugaucuuggcucacugcaaccucugcccccuggguucaagcaauucuccugccucagccucccaaguaguugagauuacaggcguacccuaccacgccuggcuaauuuuuguauuuuuaguagagauggggcuucacucuguuggccaggcuggucucgaacuccugaccuuaagugguccucccgccucagccucccagagugcuggaauuacaggcaugagccacugugccuggccuuuuuuuuuuuuuuuuuuuuccagacagagucucccucuguaaccuaggcuggagugcaguggugcgaucuuggcucacugcaaccugugccucccagguucaggcaauucuccugccucagccucccgaguagcugggacuacaggcacccgccaccacacccagcuaauuuuuguauuuuuaguagagaugggguuucaccaugauggccaggcuggucuggaacuccuaaccccaggugauccgcccgccucagccucccaaagugcugggauuacaggugugagccaccacaccuggccuauuuaauuuucauaaauuugcuaauuuuccagauuuuuucuguuaacugauuucuaauuuuauuccauuguggucagagaacauauuuugugugauuucaauccuuuuaaauuuauugaggcuuauuuuauuuuauuuuauuuuuauuuuauuuuauuuuugagauggagucucacucugucaccaggcuggagugcaguggcacgaccuaagcucacugcaacuuccgccucccagguucaagcgauucuccugccucagccuccugaauagcugggacuacaggcaugugccaccacccccagcuaauuuuuguauuuuuaguagagacaggauuucaccauguuggccaggauggucucgaucucuugaccuugugaucugcccgccucagccucccaaagugcuaggauuacagguuugagccacugcgccuggcgaggcuuauuuuauguucaggcauauugucuauugugagaaugugccauguguacuggagaagaauguguauucuacgguuguuggguagaguguucucuaggugucuguuaggucugguugguuuauaguauuguuuaaauuaguuuuugagguuucuaaaaaugguaucacugggugugguggcucacaucuguaaucccagcacuuugggaggcuaaggcaagaggacauuugagccccaggaguucacaaccagccugggcaacaaagagagaccuugucucuacgaaaaaaaaaaaaaaaaaugcaaggugugguggcucaagccuguaguuccagcuacuugggaggcugagguggaaggaucacuugagccugggaugucgagauugcagugagcugugaucaugccacugcacuccagccuggaugagagagugagacccugucucaagaaaaaaaaaaaaagguaccauacuaaauguggcugucucacuggcugccuuguuauucucacccagggccauugcauuuguuguuccuucauccuagaacuuucuuccccaaggcaaugcaugauuuucuuccucauuucagucucugugcauaugucuuauaaggaccuuuccugacagacuucccaaccccuguguuuuucuuuucauccuucuuuguuuugauuuaugccauuuaucacuaugugaaaaaguacagaguauauuuauuagucuacuucuuuguuucuuuuacucuuuuguucauugcuaugucaccuaguagguacucaaaacguaucaagcuuccaaaugugaauuuggaaguucugaagucagagcagaggacuugacuaaagauagaaauuuggaaaucauuagcuuagagugaaaauuuaaauucacagguagaagaaauuaccuauggcuagagggaggagauaaaagagaaaagggccagggccuggcccugaugaauccagcaucuauuagagguuugauagguaaggaggccuaacaaagaaaauugagaaggagcagaggagagggcacagagguagaagcaucauaguucuucuaguguaggggcugccuguacuagaaauaaagaacuaggccgggcacaguggcucaugccuauaauccuagcacuuugggaggccgaggugggccgaucacuugaggucaggaguucgagaccaguguggccaacacaguugaacccugucucuacuaaaaauacaaaauuaaaaaauaauaauaauggccaggcgcgguggcucacgccuguaaucccagcacuuuggcaggccgaggcaggcgaaucacgaggucgggagaucaagaccauccuggcuaacauggugaaaccccgucucuacuaaaaauacaaaaaaauuagccuggcgugguggcggaugccuguagucccagcuacuugggaggcugaggcagaagaauggcgugaacccgcgaggcagagcuugcagugagccgagaucgugccacugcacuccacccugugugacagagcgagacugugucuaaaaaaaaaaaaaaaaaaaaaaaguggccgggcgugguggcucacgccuguaaucccagcacuuugggaggccgaggcgggcagaucacgaggucaggaguuugagaccauccuggcuaacacggugaaaccccgucucuacuaaaaauacaaaaaauuagcugugugcgguggcgggcgccuguagucccagcuacucugggggccgaggcaggagaauggcgugaaccugggaggcggagcuugcagggagccgagaucgcgccacugcauuccggccugggugaaagagcgagacucugucucaaaaaaaaaaaaaaauaauuaauaauaauaaaauaaaaauacaaaauuagccaggcaugauggcgcauguuugugaucccagcuacucaggaggcugagacaggagaaucauuugaaccuagcaggcagagguugcagugagcugagaucacgccauuucgcucuaaacugggcaacacagcuagacucugucucaaaaaaauaaaauacaaauacaaaaauuagccaggggugguggugcacgccuguaaucccaacuacuugagaggcugaggcaggggaaucgcuugaacucaggagguagagguugcagugagcugagaucgugccacugcacuccagccuggguuccagagggagacuccaucucaaaaauaaauaaauaaauaaauaaaaauaacuaaaagaguaggaggugccauuaaagccaucaaaaauggaguagcuaacuuaacggaagccgacaugagguucagaaagauaauguggcuagagaagugacugucagaugcugcaacaugaaggcuguugauagccuugacaagagcagaagaguggugcagacagaagccgggcuggcuuauguguacucaagaguguguaggccaguuuauaaaauaauaauuauucaauucaguuuauaaaauaauaauuauuuaauuaagccuuuuaauagaaucugcagguugaaucuaguaaguuuuccucccuucuuuuuggcuuucucaguguuuaaaaacucccauauuuggaaacucucuggugauuccuuaaagauugaaaauggguagauguugaaugcuaucuaagccagaugauccugggaucuucccacaccagcuucugggaacugggaaacuucuaacuagcuagacagaacuaaaguaccaucuucauuaucucuccauggccuagcacuuauauccuuugcaaucaguugacauuuauuuucauguaaguguauaggaaagaaguagcuugcucuuuccuuuuuuuuuuuuuucuuaagagaagacaggaucuugcacuaucacccaggcuggaaugcaguggcaugaucacagcucacugcagccucaacauccugggcucaaucgauccuuccacuucagccucccaaguagcugggacuacaggugcacgcuaccauaucuggcuaauuauuguauuuuuuguagagacaagguuucaccauguugcccaagcugguuuugaacuacuggacucaagcgauuuggacucaccuuggccucucaaaguguugggauuacaggugugagcuaccaugccuggccgcugaaguagcuguuucuguuugcgaaaguaguuuucugcuaucauuuauuuuugacaucuuguccuuggacuauaugcagauguuaaucaccuuaauuaucacuauauuagcuaccagaaaccuaaaacauugaaacaagggaauagagauuugagaaauagaccuaugcauauauguaacugguaauucagccaagauacaaaauaaucaaauggagaaaguacagucuuuuuaacaaauugugcuggagcaauuggaaauccauacguuaaaagauaaaaguacuuuaacccauaccguacaucauauauuaaaauuaacacaaaauggaucauagcuccaaaucuaaaaccuuaaaccauaaagcaucugaagaaaggccuggcacaguggcucaugccuguaaucccagcacuuugggaggccgaggcugguggaucaccugaggucaggaguucgagaucagccugaccaacauggugaaaccccaucucuacuaaaaauaggaaaauuagcugagcggggccaggcgcgguggcucaugccuguaaucccagcacuuuggagggccgaggcgggcagaucaugaggucagaagaucgagaccauccuggcuaagauggugaaaccccaucucuacuaaaaauacaaaaaauuagcugggcaugguggcgggcgccuguagucccagcuacucaggaggcugagggaggagaauggcaugaacccgggaggcagagcuugcagugcgcugaggucgcgccacugcacuccagccugggugacagagcaagacucugucucaaaaaaaaaaaaaaaaaaaaaaauuagcugagugguugggcacgguggcucacacuuguaaucccagaacuuugggaggcugagguggauggaucacgaggucaggaguucgacaccagccugaccaacacggugaaaccccgucucuacuaaaaauacaaaaguuagcugggcaugguggcaggcaccuguaaucccagcuacucgggaggccgaggcaggagaauugcugaaaccugggagguagagguugcaaugagccgagaucgugccacugcacucuagccugggugacagagcuagacuccaucucaaaaaaaaaaaaaaaauuagccaagcaugguagucagcaccuguaaugccagcuacuccagaggcugaggcaaggagaaucacuugaaccugggaggcggagguugcaaugagccgagaucaugccauugcaccccagccugggcgacagagugagacucugucucaaaaaaaaaaaaaaaaaaauccaaagaaaacggagacaauuuuugugaccuugaguuggcaaaaauuuauuagauacaaugcuuaaaaauggauacagacugggcgugguggcucaugccuguaaacccagcacuuugguaggccaaggcggauggaucacuuaagcccgggaguucgagaccagccuggacaacaugguaaaacccucucucuauaaaaaauacagaaauuggcugggcauggugaugcgcaucuguagucccaguuacucaggaggcugaguugggaggaucgcuugagccugagaggcagagguugcagugagcuaagauugugccacugcacuccaaccagagugacagcgagacccuaucucaaaaaaaaaaaaaaaaagauaaguuucaauuagcuaauuaauuccaaacucuuaguaauauggcucuuagcauaauuauuaugguguguucuagagaagccccuuuugaaauccucaucuagcuuuccccugccuucucaggggaaaauugaaguuauaugaaguccugucugucauggagaccaggcacccuacuccucagugccucaccauaucuccuuuccuacccuaccuuugguugauccauucaugcaucacuggcuucguggccuugacuguaucucuuggcuucuuccuuuugggcuuuggcuucugcuacugccuaauuauuucuccaucuuccaaguuaggcaaccaagagagggaaccugauuggccuagauuauuuuugcuuauucuagaccacuaaauagauguguucaaccagcaauaugguccagucaucagugucugggggguaggguggauggggacauagggcgauguuuggaaggagucuaaggguacguauaauguggacgguaccaucagcugguaucacgaacaagagguaggaccaugugugugauaaacaacauaauauccauagcugucauaaagcaaaauguuguuauucuuauuucguucuuccagaaaccauugaucaucaagcugccuuccaguuauggcucucuuauuguauagccccccuccuaaaucaguccauaacagguagugcgauaaguguuuagagaaggagcuuuugccuguucucuaggugagagguagagaucucaaaguauguggcaacagaggauagaauuguggauuaguuggaagguguuaucagaggucauuugauagacccucaacucugaauauagcacccaaaccaugccuuucaaauaaacaacagucuauccucuuauacuuuaaucuguuccuguguaagcaauucucaaggcuaguucuucaugacguuugagccacuuuuuuuucccugauggguuucauaguauccauccuauaauggucagcaugcuauuugauuuuaguguguccuuuuuucuugcaugaugcuucuuuugcuauuuuucuucuuggcuuuucaucuuuagguuuguugagguccuuaaauccugauugucaauguccuaggaucccagagacaaaauggacuuauguuuuuuuuuuuuuuuuuuuuuuuggucacauaacuggagggacugagcuuguguuugcuuucuguuagaagaacuggugcaucuaagacagucagcugcagaauuugguuuggcuaguuaagacguccauggagauggaauaucaugcaguccagguagaaagauauuaacgggccuaugaagacagguugccuacccaaggcuucucaaacuugagaaaucaccugggcaucuuguuaaaaugcagauuuuaauucaguagguuugggguguggccuaacaucuggaaaccugcauuucaaagaagcucccaggagauguuguugcugcaggucugcagacacacuuggaggaguaagaacuaggggguuuaauauucccaaacaggugagcagaaguggccuauaucgcuccccgucgaugccagagaacuugaacaggccaagacugaagcagguggaaaaauucaaggacaacacaauaccagauaaaguuaaaaaaaaguauuuuucuggccaaggaaagcucaggaagguaagaacuuuuuaagaugaaaaucuuguucaucuucuaucucaugucuuugcuuuucugguaugaggauuguuuuauuaugccuuuuuugucuucuuccucuuuacuuuuacuuuuuccucuuuguucuuuccaucuuucugucuuuucuacaucuguauccacgugaaauauauauauauauauaaaauauuuauauaacauagauacauaaaguauaucuauauuguacuuuuagaaauguugucauaggccgggugcaguggcucacgccuauaauccuagcacuuugggaggccgaggcgggcggauugccugagcucaggaguucaagaccagacugggcaacacggugaaaccccgucucuacuaaaauacaagaaaucagcugggcguggcagcaugugccuguagucccggcuacucaggaggcugaggcaggagaaucgcuugaacccgggagguggagguugcagugagccaagauugugccacugcacuccagccugggcaacagagcaagacuccgucucaaaaaaaaaaaaaaaaagagaaauguugucaucauaccgucuucccaacccuuuuucuuaagaucugaaagaauacaagggaacuuugguauggauauuuuacugcuguuuuacaugcagucugacagaaacaacaucauauagcagguugguuuuguggaaagcaacuucugaaaaacuuagccuuuguccuuuacccuccccaacuuuaaaaaaauuaaauagaugggaggaucacuuaaggucagaaguucaagaccagccuggucaauauagcaugaccccaucucuaauaaaaaaaaauaaaauaaaaaauuaaaauucuaaaaucuuuggauauuuuauaaaaucaacuuauuuauuuauuuauuuauuuuccccugagauggggucucacucugucacccaggcuggauugcaguggcauggucuugacucacugcagccucaauauuuauuuauuauuaaaaauaauaaauaaacaaauggagucucacucugucucccagacuggagugcaguggugcaaucguagcucacuauagccuuggccuccugggcucaagugaucucccuaccucagccucccauguagcuaggauuacagaugugcgccaccauggcccacuccauccacugguuuuuaaaccuuuaacaugaggauuggguguggggugggaaucuugucaucuucagggcuuauguuuaaagaagacagucucucugugugacauuacuaucacucagaugcuggaggaagauucuaaccaggggcaccugauuggugauuuuuccaaggugaguuuggcuacacccauccuguauuucagugagucauuuuggaucugaaucuucucuguuugccgagaaugccugguguaaauaugcauccucaccaaguacucuuugguaaccugacagugcucuagugguagauccaggcccuaagccuuuccagagagaaaguauuucuuauucuucugggaagauccagaacaggggaaaguaugagacuuuuuaccuuuuuucuguuuaaaaacauauuuuaaaauuauguaaauaauacuugguuguuacagaaaaaguagaaaaugaagaaauuuaucccaaacuuuauuaaccaggguaauauugcuuaguauauacucuuuuuuuccccccuacugucuguguaauugcagaagguacauauucuuacagauuuuuuucuguguuuucacaaacacauauacaaauacaguuuuugcuuuucuacaaaaacaguuuauauuguuuuguuaucuguuguuuuuccucucauuuaauaauuauaucaggggcaucuuuuuucauauuaauaagcaguuaugcuucauucuuucuuuuuuuaagauucaaggucuugaucuguugcccaggcuggaguacauuggcaugaucauagcucacuucagccucgagcuccuggccucaagaaauccucucucuccuuggcuucccaaagcacugagguuacaggcaugagccaccaugcccagcccauuucauuuuaauagcuccauauuauuucuuuuuuuuuuuuuuuuggcugcucauaauuucuucauaaaucccuucuuguaagauauuugguuuuacaauuuuuucuuaugaaugauaccaagaugaauauauuuguagagaaaucuaaaacuucguacacauccuugauuuguucuuuaggaucaguucuuagaaauggacuugauguauaugcacuuuauagagacacugauuuuuuugaaggccucugggguuuuaagggucacuuggaaagaaggacaaaauaagggucuuugaucucaaacuuggguguggaauacuugcuguuauuucagcucuuguguauuucuagguaugugcgcugccaaccgugucagggaaacaccaagaucugaaguaugucaacccagaaacaguaagcagauuucuggagaugguaacugguuacauaagcuaccaucuggucucuucugucccuaaaaugcccauuuccauuuguauuucuuucacuguguucacucacacaggcuccuuauucaacugaaguuauauugaaggacucauuuuuuuccccauucuucucucuccuucguuuuuaguuaaacaaaugauacauaguuuuuguaaaagggaaaaagggaggggucaggcaugguggcucacgccugaaauccuagcauuuugggaggcugaggcaggcagaucucaggcacuugaggcagggaauucgagaccacccuggccaacauggcgaaaccccaucucuaauaaaaauacaaaaaaauuaaccaggcgugguaaugugugccuauaaucccagcuacuugggaggcugaagcacaagaauugcuugaaccccaguuggggagguugcagugagcagagaucgugccacuguacuccagccugggcgacacagcgagacugucucaaaaaauaauaauuacuuaagaaaaaagggagaaagaaaggaaaauaaaaaaucacacacaagaaauggucucaauuaaggucucaauuagggugaccaugcacccucguuuacauuuuacaaucccauuuucaucuauuagugaggguaauuauuaauaguguuugcuuucauucucaaaagucucccaguuuguacaaaaauuauuuggucaccauacccacaaucucaucaccagagauaaccacuagucauauuuuccuauggccuuccagauuuuauuuuauuuuuagacauggaguuucgcucuuguugcccaggcuggagugcaauggcacaaucucggcuugcugcaaccucugccucccggaggucauucuccugccucagccucccaaguagcugggauuacaggugccagccaucacaccgacuaauuuuuguauuuuuaguagagacgggguuuuacuauguuggucaggcugguuucaaacuccuguccucuggugauccacccuccucagccucccaaagugcugggauuacaggugugagccacugcgcccagccccagauuuuauucuagcauauguuuuauagaaaugggaucaugggccuagcacagcucacaccuguaaucccagcacuuugagaggccaaggcaggcgaaucaccugagguugggaguucgagacgagucugaccaacauggagaaaccccgucucuacuaaaaauauaaaauuagcugggugugguagcgcaugccuguaaucccagcuacucgggaggcugaggcaggagaauugcuugaacccgggaggcagagguugcggugagccaagauggcaccauuguacuccagccugggcaacaagggcgaaauuccaucucaaaaaacaaaaaaaaaggaucaugaugaacguauaguauugcaauuugcuuagugagacauuauagacaucuuucuauaucaauaagguaucuauauuaucauuuuaauggcuauauaaugccgcucuauucuacugacauguacaauuuauuuuaccaaaccccuauuauugaauauugaaguuauuucuaauauauugauaauauaaaacaaugcugagaugaauauaauugugccuacaucuuuguguacuuuuccuguuuacuuaagauguuagaaauugcugagucaaagugugauuacauuuauuuguauauguauuuacaaaguucccuucagaaaggcugaaccaauuugcacuccuacaaguagcuucaguuucuuccuuccuuuagguaucaaccuuucccuuccauauccuuuccugaaagacuuacuuucuuccuuuuugaugguggguagggaaccauuuugcauuucuuccugcaauuucaagcucucuagcugcugccucugccacugcagaaguccuugggcaucuccugaguccagccaugccuauccccagauggguagccugaauaugguuuuccuugguaucuugucagugccagcuauuuugguucucuaaaagggccacuuccuguuucauucucuuuuguggaguggggcugaaucauugccacauaucaaauauggggugacuuuggaggcuggacauacaguggacagaacaggaguaugcuuguaaggaacugugucauugacccuucucucccucagaguggcagugagcagaauauucagucauuguuucuguccagguggcugccuuacugucggggaaguuccagggucugauugagaaguuuuaugucauugauugucgcuauccauaugaguaucugggaggacacauccaggugagacgacauuguggccauuaguaggggagggcuggagauaacucuuuauugagaagagucuguggacaaaggggucuaugaacucuagagucaggacaaagauuacauauuugaagcaccucaaggcugagguccucauuguuuuaauucuguauaccuuaagcagguuacuuucccuuucccuccuagaucuaucucccucuuuucuguaggagccaagggguccuaccuagaaauaaaaacauuaauccaaggacugaagcacuuugcaaacacuuacuauucaugaacauuccucgcagugaucucuauacuuccagugguucaggucuauaaacauuuauugaccaucuacaagcucuaugccaggcguucaggguauauacagagauauacuuagaccccugcccuaaaggugcuuauaguccagcuuuucugguccacauuaucccagguuggcgucucagucauuucuaaguauuggcacugucuauaagccccugaggaaauacuuacuaaaauucuucuucuacagggagccuuaaacuuauauagucaggaagaacuguuuaacuucuuucugaagaagcccaucgucccuuuggacacccagaagagaauaaucaucguguuccacugugaauucuccucagagaggggcccccgaaugugagugucuaaauggggucuggcgggugauggaaauggauuuugaguuggacuucccacaccaguucagacagagacugacuggauucuacaguuugaagaauguuagggagguugaaggaagacguuucuaaaauugaaaaguuugaaacaauaaaggaaaagggauugagaaugaggcugcaguggaggaaaggaggaagggugguacuacuuggaccuuuuuuugcaaacacagggagauuggaaaguccuuuuugagguuggcaauagucuacuccucuccccccuccccagugaauggccccugggauccugaccuuguuucuuuccaccccacccaucucuggguucucucuaaaggugccgcugucugcgugaagaggacaggucucugaaccaguauccugcauuguacuacccagagcuauauauccuuaaaggcggcuacagagacuucuuuccagaauauaugguaaaggguggggcaugcggggagccaaacuuuaacaacucaacucccagggccugcaaagccuucagagaagaaacugcugcuccuccuuagccacugccagcagcagcaucucuauuauccuucauagguagaguucaggagucuagagaaucccuuacucuguuccuuaccuuucaggaacugugugaaccacagagcuacugcccuaugcaucaucaggaccacaagacugaguugcugaggugucgaagccagagcaaagugcaggaaggggagcggcagcugcgggagcagauugcccuucuggugaaggacaugagcccaugauaacauuccagccacuggcugcuaacaagucaccaaaagacacugcagaaacccugagcagaaagaggccuucuggauggccaaacccaagauuauuaaaagaugucucugcaaaccaacaggcuaccaacuuguauccaggccugggaauggauuagguuucagcagagcugaaagcugguggcagaguccuggagcuggcucuauaaggcagccuugaguugcauagagauuuguauugguucagggaacucuggcauuccuuuucccaacuccucaugucuucucacaagccagccaacucuuucucucugggcuucgggcuaugcaagagcguugucuaccuucuuucuuuguauuuuccuucuuuguuucccccucuuucuuuuuuaaaaauggaaaaauaaacacuacagaaugag

SEQ ID NO: 192751 - RNA, 181617 nt, Homo sapiens
ccauuuccuccuccuagccggacuggagggagacaaagcagcgcccgucugcuucgggccucuggaauuuagcgcucgcccagcuagccgcagguaacuucguaccucccuccucgcgggcgcggucucucgggccaggccgagaggguccuugggccgggccgucccaagcugggccccgcgagccgcgggcgggcgagcgggcggggcgcgguuucuuuggcgacgucgccgggaauugggccccgggcgggcgugggacccgcgucgggccggcggucccuucccccgcagggcccgaguauggggcccgggcgggcacggccggcgcuucccagcgcucgggaagucggggggccgccugggcuggggaggagaaacuauaggcccagcgccgccgccgcguuuccucuuggaaaaguuuucucgcgguuuccaaacuuuguuaccgcggccucggcgcgcgcggcagccccgcgccgggccccucggccgccuuccuucccuggggcggcuugucugggagccgcuuucccgggaagugauugucguccggcuccgaggcguuccugcccccucccccuucccggccgcugagacuucccgauggggcggcggggacgcgggcucggcgaaccgggaggcuggagcccgggcuucucccauacagcuucgccguaggugggccacacccguguggacuuuuggcgugaccguccacuuggacucggggauuacucagcuuuccuggguuucuugucgguuggacgcacuuagcuuucagcccuaguuuucaggaguggcauuagagagguuuuuuuuuuuuuuuaauuguuguugacuuuuaaaggagcgugugugugcgugcgagugugaagcacuuguuggaaaaaauguugccugaaugaaugccugaccuuugcuuggcagcaguggcuucccaguaaugcaggcggcgguuggcccaguuccaagguugacucccucuuacguccucuugcaucuuggugacauuuuuuuggugcguguguuuuguacagaauuuacaauuauuuggaaaagagcgagauaugucaagucuacgacuaaauucggggcauuuuauauuuaugaugaaggaaaugcuuacaucauuguugggacaggauaggcauuuuguggagcgaauauuuguguuuagucagcagugauuuuuaaauacuggacagguggguguuacuuuaaggaacggaauuuauaaaucgaauuaauuaggauguguuauuuuguuuuacaggaagaaugaagaaugaguguaggaguuaccuauaguuucugccuaauuauuuaccaaucuggacuuuugaacaaacauuuuuuuuaaagacggggucuccgucgcccgggcuggagcgcagugacacgaucaugacucacugcggcuucugucuccugggcucaagugauccccccaccucggcuuccgaaguaguugggacuacaggcacgcgccaccacauccgucuaauuuuuguauuuuugguagagauggugucucgcugucuugcccaagcuggucucgaacuccugggcucaagugguccuccugccucagccucccaaaguguugugauuacaggccugagccagggugccugaccccaucuggauauuuauucagcgaaagaauaauuuuuuaauccaccuaagagcucacaguguaauaggggagacacacaccccagguguaguacagagcggacugcaguaagugccuuaacaguacuaaugaaacuauugucugagucaaaucuuaccuaauaguaacaacaaaagaaacuuguagaggcacggagagggggcuaauaaguuuuacuuggguaaguccagaaaggcuuucaggaggugguggcauuugaucuggaugaaacaugagucgaguuuuuuuuaagugaagggagaaagucaugagaagcauaaaagggcauaggaguuuggggaauugugauaucacucuccugguuuucuuuuccuuuugacucaucucaguuucuuucuuuuccucgcccucacucuuuccucucguacccaggguucuuuccaaaguaucuuuguccuccacaccacugauguggcaucaccuucacucccaucagugauaucucauuucauauagugacuuagagaugagagguacccuccuccaagaugagaaucacugcucugugcagucucuucugucaucagccuuaugugcuaaaaguccaagccuuugagugcaggugugucuccugacccacauggucaccugugcauugggaagcuuuuugggugucccaggcuucucaaacucaagguguccaaagugggacuccugucucuucuggagacaugaaccagauguggagauccaggguaacugcccugcccggguuuugggauuuccuucuuuuuuuuuuuuuuuuuuuuuuuuuuuuuuuuuuugauggagucucccuguguugcccaggcugggguucagugaggugaucucaguucacugcaaacuccaccuccuggggauucaagcgauucuccugucucagccuccggaguagcugggauuacuaagugcaagcuaccacgcccggcuuauuuauuuauuuauuuauuuauuuauuuugagauagucuugcugugucucccaggcuggagugcaguggcauaauugcggcucacugcaacccgugccuccuggguucaagcaacucuccugccucaaccucaaggagcugggauuacaggugugugccaacaugccugccuaauuuuuuuguauuuuugauagagaggguuucaccauguuggccaggcuggucucaaacuccugaccucgugauccaccucggccucccaaagugcugggauugcaggcuucagccaccgugcccagccugauuuuuuaauuuuuagcagagaugggguuucaucauauuggugagucuggucuuuaacuccugaccucaggugauccacucgccucagccuccuaaagugcugggauuacaggugugagccaccgcacuuucggauuucuuugagaacguaacucacuguggggcauaacagacagcccugauuguuggggguaguguugugugcuggugagaauauggagagaaggaacagggcccucugcauuuguagagguccugagacaggaaagacuccguguguuuagagacuugagagaagacuuguauagcuuggguacuuuuucaguggggagaagaccucacaugagauugccagagaaggcagaggccauguugggguuuuauucuagagguguaagaagccauuguagggaguuucaugauuugauuuccuuuuuaagacuccugcuagugcuuggagaaggcuuguguuugugugcauguggaagcagagaguugagcuaggaagaugguggaguacgaggugguagggaugaagggagcuguauuuuggagaaaugagacaggacuuaaauauggauuggggcuggacagggaggcucaugccuauaauccuguuuuuuugggaggcugaguugggaggaucacuugaagcuaggaguucaagaccagccugagcaacuuuaugagaccccgccucuaaaaaaaaaaaaaucaaccaggcauggugacacgcucuguagucccagcuacucaggaggcugaggugguaggauucauugcuugagcuugggagguggagguugcagugagcucugaucaugucacacugcagccugggugacagagugagacccugucucaaacaaaagaaaaaaagggaggaagggagggaggaaggaaggagaaagaaagaaaacagaauggugguuguuaggggccaggugaaggggaauagggagcuauuguuauggguacagaguucgguuugggaagaugaaaaaaguucuggaaauggaucgugaauauauguaaugccgcugaggcauacaguauuuaaaaacaguucaaggcugcugugaacuaugaucaugccccugcacuccagccugggcaacacagugagacccugacucagaaaaaaagaaaauggacuggauguugggggccuaggguaaaguugcuuccucagugauucccuucuacucucccaacauaaccuuucaugaugagcuuuuagucauaucuuaagacucagcacuuucguuucugguagcaaauuuuuuagcacuggguggugcauuacauuaugcuguacguuauuauugauguaccuguuugccuuuacugcuaggaagggagccuuguaagcuccuugaaggcaggaacugagagucuuaguucuugucuuggugcuuaguaccuggcauggagggcaaauuagaugcuuguugagugaaggaggaaaaagucuuuucugccuggagucuagcuuguggauggaaugauaacagaugaggcaacagucagauuauggagggccuccaauaacaaauuugggcaaacugagaaccaucuacagcccauucuucuuccuugccacccagaucuaaucacugaugaaauccucuccaugcaguccucagcuuauguguaauauauucuuuuuuucuccuauuucuuuuuuuuuugagauggaguuuugcucuuguugcccaggcuggagugcaauggcgugaugucggcucacugcaaccucugucuccuggguucaagugauucuucugccucagccucccaaguagcugggauuacaggcaugugccaccacaccuggcuaaucugguauuuuaauuuuauuuauuuuauuuauuuuuauuuuuuuuugagauggagucuugcucugucacccaggcuggagugcaguggugcgaucuuggcucccugcaaccuccgccucccggguucaugccguucuccugccucagccucccuaguagcugggacugcaggcgccugccaccacacccggcuaacuuuuuuuguuuguuuguuguuguuguugagacggagucucgcucugucaccaggcuggagugcaguggcacgaucuuggcucacugcaaccucugccucccguguucaagugauucuccugccucagccucgcaaauagcuggacuacaggcacaugccaccacgcccagcuaauuuuuguauuuuuaguagagauggcauuucaccauguuggccaggauagucuugaucucuugaccucgugaucugcccaccucggccucccaaggugcugggauuacaggugugagccaccacacccggcugauauuuuuauuuuuaaaauacauuauuuucuugauuuuucccauaccuuccuuuaguuuuuugaacaucuguaagacaguuguuuuaaugucuuugucuaguaggucuuccaucuggucuuucucugggacaguuuuuguuuuuuuuuugagauggaguuuugcucucguugcccggacuggagugcaauggcgugaucuuggcucacugcacugccuccuggcuuuaagcgauucuccugccucagccucuugaguagcugggauuacaggcaugcgccaccacaccuggcuaauuuuguauuuuaaguagagacagggauucuccauguuggucaggcuggucuugaacuccugaccucaggugaucagccagccuuggcuucccaaaguacugggauuacaggcaugagccaccgugcccagcaacugggacaguuuuuauugguuaauuuuuuuuuucuuuuaaugggucauacuuuccuguaucuuuguaugaccugggacuuuuuaauuuuuuuuugaaaacuggacauuugaaucuaaugaugugcuaacucugaaaauuggacucuucucauucccaggguuugcuggauuuuuuuguuuauuuguuacaguuuguuuuuaugcugaggaucagccugagauacaaacuuaaggacuucucaggucuuuuuugagccugcaccuuucccugggcgcaugcaccaugguaacuuuuuuccuuaucucccccgcacccucaugauugcuuuugaauauccuagucuuuaaagucuagcuccuaaagaggaaaaagagaaaaaugaaggaaguagggaggugggggcccuuggcccauuaaauuuccuggaagucuacuucagcuggagggggaggacuugcagucauggagggggugcaauaauggcuauccuucucagugucugccuaucccugauuauaagcagcaaucagcaauuagaauacggaucccuaauauuuggaggacaggguccuuauuacccauccugguucccaaaagcugcuugcaagcuguuucaggaaugcauuguagguugucugcccguggcugggggcuagggaaugggguagcugcugcucagcuaagggcugaaauugacugaaauuaacccaauuuacugucccagucuuuccuuggaaguugcaagcuuucuucaacaguccccagaauuacaucugacuaauuaugccaguguaauugucuagguggggagacugaucuuggugcuuccuacucugcuguuuuagaaucuggaauccucucccagaauuucuuuccuuuuuuuuuuuuuuuuuuuuuuuuuuuuuaugagauggaguuucacucuugucgcccaggcuggagugcaauggcgcgaucuuggcucaccacaaccuccgccucccggguucaagcgauucuccugccucagccuccugaguagcugggauacaggcaugcgccaccaugccuggcuaauuuuguuauuuuuaguagagacgggguuucuccauguuggucaggcuggucuugaacuccugaccucaggugauccacccgccucggccuaccaaagugcugggauugcaggagugagccaccgugcucagccggauuucuuuccuuuuaaaggcugaauaauguuccauuuauuguauguauaugccauauuuuguuuauccauucauacuuuuuuuuuuggaggggacagagucucuguuguccaggcuggagugcaguggugcgaucuuggcucaccacaaccucugccucccaagcucaaaacgauucuccugccucagccuccugaguagcugggauuacaggugugcgccacuaccacccggcuaauuucuuuauuuuuaguagaaacgggguuucaccauauuggccaggcuggucucuaacuccugaccucaaaugauucaccugccucagccucgaaaacugcugggauuacaggcgugagccaccacgucugaccuauccauucauauguugauggacguuuggauuauuuccaagguaugcuacuuuuuuauagcucuuaaaauuuuuccaaauuccucuccagaaauguacuuuaucaucaccugugguacaucaggguauuuuccacuuuagacauucuugaucuauugucugaguacuugaaguggugugacuguaggcugacuguugaaugaagcugaaagggggguuuuaauagcaggucacaaacuuggauagaagaggagaugucucucgggcugguuggauauauaauaaguucuggaaggccacaugcuggugaugaugucauccagaaaggguuugguacugaauuucuguucaggaacguuccuugucagggauguuagggaucugccuugucaacuguaguccuucgucagccucuucagaaguugaugcccacuuagcucuugaagcagguguucuaaguaaauaauauuuuguacucuuauauucuguggauuaguuguagguacaugcuguugugaaaauaaauucauuugacuucucuguaucuugauuguggaggugaucacacaacuguuauuuauuuuuuuugagacagagucucacccugucgcccagucuggagugcaguggcaugaucucggcucacugcaaccuccacuuccugaguucaaaugauucuccugccucagcuuccugaguagcugggauuugcaagcaugugucaccacgaccuguuuaauuuuuguacuuuuaguagagacgggguuucaccauuuuggccaggcugguuuugaacuccugaccucaaaugauccguccgccuccuaaagugcugggauugcgggcuuuagccacucaccuggcccacacagcuguuuuuagauugguauacgagagagugaauuuuauugugcauaaaagguggaaaaaugaacagguaaaaaaauuuacucaaaaaaauuuugggggugaguuuggccuucuauauggagauaauaaauaaguagugaaaaacaugaacccaauuauucuuucuaccuucucugcccaaaucauuuuuuucucaagugaccaaaaccacacacuuugaggucuuuuuguuguuguugauacagggucucacucagucauccaggcuggagugcaguggugcaaucacaccucacugcagccuugaccucccggguugaaagugauccccucaccgcagccuccuauggagcugggacuacaggcgccugccacaaugccuggcuaauuuuuguguuuucuguagagacagaguuucaccguguuucccaggcuggucucaaacuccugagcucaagugauccaccugccuuggccucccaaagagcugagauuacaggcgugacccacugcgccuggcccacuuugaaguccuaaagaaauuuagguuauuauucuaugcauguuggaggauuuaagucuuauuagcagcuucuguuuucuguaaggaaaaaguuaaaacacaucuggaagagucucauagagcagcacuuucugaaacuugccuggguaccaguaugccugcuuccagaccuugaagauauuacauguacugcuuggugaucugcccugucccccacauguugugggccuggauugaauggacugaacaguguggggaauuaguccagcgugacuugccuugucucaugcuguuugcucacuugugagagcacuauacugaauuauccauuauugaaaguuccaagugugcaaagaaccacacuucaaaaauaaaaugucaacauugcccuuucucuguuagagccuuaaauguucauuauuuucuuuaguuuuuuuuuauaacuaucaaacuuauuuuucuccauguggaaguaugccacaacuccauuucuaauggagcuugaaauuagcauguauuuccacuuacuuguugaugggcugucaucgaucaaccccucuuuuugauugggauuuaauuugugguuuuuuuuuuuuaccagcuguaaguuuggaguaaugcauguaauguaaauacaguucacagggcaacuucggauguucuaaauacuuguaacauuugcucauuuugaacaauauuguaugaguagugugaagugauuuuuaaaaugucugucauuuuuuucauguucccauuuuauuaaaaggagggauggaacuauauuguggaagcuaauguaauuuuugucucuaagagguuuuuuuuucuuuuuagacuaaaagggcuuaacagaagaaaaauuuaucuuucuuaauugcuaauuuaaaggcuaauuuuuucccuagauugcuuaguuuugacuauuugauuccaucauaucaagcugugaauuuccuucauuuucuuguuuugagguuucauuauuaaauauugucaaaaauaaguggcucaucaacucucuugaaagugucuuauugcuauguuuuuuuuugucaguauuugacauucugaauugaagaugugaguuggaaaccugguuaauuaccaaguuacauaauccuguauuuauuaacuagguuagacuacauacagacuguucuugaaaaugaaagugcuguuauaacucagaaaacacauucacuauggcccauuucaaguuaauugaaggauugagccuuugauagugcauuugcccugugcggcucuguuacaugcauucuuucuaggcaaagaugcauuguuaccauucucucaugguauguugaauauuucauuagauucaauauuucaauauuaauccaagcuuuuuuuuugagacagggucaagccauccucccaccucagccuucugaauagcugggaccauagguguguacuacgacacccagcuaauuuuuuacauuuuuaguagagacaggucucaccauauugcuuaggcugaucuuugaacuccugaacucaagcgaucugcccaccuuggccuccaaagugcuaggauuacaggcaugugccacugugccuggccugaguuuacaauccaaauucuaaaucaugguuugugaaauaugauggugcagugaauaagcuagaggcuaaaagggagaagcauguuacuauuacugaugaaacaguguuuguggguuuuauauuccuggggaucucuaaauuggcaaaagguuucaugagggauucauuuguugucauucucuugcgucuguggaccuggguuaucauauuuuuagaaaagcuuuggacugacuuuuaagugugucuuuagaaaccugccauuuaggcugggugcgguggcucacgccuuuaaucccagcacuuugggaggcgggcagaucaccugaggucaggaguucaagacuagccugacuaacauggagaaacaccgucucuacuaaaaauacaaaaaauugcagggcgcggugucucacacuuguaaucccagcuacuccugagucugaggcaggagaauugcuugaacccgggagguggagguugcagugagcugagauugugccauugcacuccagcgugggugacagagcgagaaucugucucaaaaaaacaaaaaacaaaaaacaaaaaaauaauuagccgggcaugguggcacaugccuguaaucccaguuacucgggaggcugaggcagaagaaucccuugaaccuggaaggcggagguugcagugagcugagaucgugccauugcacuccagccugggcaacaagagugaaacucugucucaacaaaaaaaagaaaccuuccauuuugcagagagguaacuaagugaaaugugaguuugaucccuugggagggaaaaaaaaguggaaauggaagauggcaacuuuuuucuuuuuuuuuaauuugagacggaguuuugcuuuuguugcccaggcuggagugcaguggcaugaucucaguugaccgcaaccucugccuccuggguugaagcgauucuccugccuuagccucccgaguagcugggauuacaggcaugcaccaccacgccuggcugauuuuguauuuuuauuagagacgggguuucuccauguuggucaggcuggucucgaacuccugaccucaggugauccgcccaccucagccucccaaagugcugggauuauaggugugugccacuguaccuggccagaugacauuuauuucgggucuuuaagaccagugaaagaugugauguuuucuaguugcuuugaguuagucuaaagcaguaauuugcuguaucucucucuuuuuuuuuuuuuuuuuuuuuugagaucucgcccugucgcccaugcuggagugggagugcagugaugcgaucucucuucacugcagccucuggcuccaggauucuagcgauucuucugccucagccuuccgaguaucugggauuacaggugccugccaccaugcccagcuuguuuucuuuuuguuuuuuugagacggagucuugcucugucccccagauuggagugcaauggcaugaucucggcucacugcaaccuccgccucccagguucaagugauucuccugccucagccucccaaauagcugggauuacaggcacccaccaccacgcccagcuaauuuucauauuuuuaguagagaugggguuucaccagguuggccaggcuggucucaaacuccugaccucaggugauccgcccgccucggccucccagagugcuaggauuacaggcgugagccaccgcgcccggccccagcuaauuuucuuauuuuuaguagagacgagguuucaccauguuggccaggcuggucuugaacuccugaccucaagugauccaccagccucuuccucccaaugugcugggauuauaggugagagccacugugccuggccauuuugcuguaucucaauugcaucaggaaaggcucacuuaaauacaguucauuuauuaagucugccuugcaaagcagugugcugugugcuggagggauguuaauguguaagccaccauugcuaaccccaggaaauuuaugaacucaggagaucagguuugguaaaauagcugauagguaagaauuggcgcugggcgagguggcucaugccuguaaucccagcacuuugggaggccgaggcagguggaucacgaggucaagagaucgagaccauacuggccaacauggugaaaccccaucucuacuaaaaauauaaaaauuagcugggcaugguggugcaugccuguagucccagcuacuugggaggcugaggcaggagaaucauuugaaccugggaggcagagguugcagugagccaagaucgcgccacugcacuccagccuggcgauagagugagacucugucucaaaaaaaaaaaaaaaaaaaaaaaaggcaguuuauacccacuuuuugcuaaucugucaugagagauguuucuuauuucuuugugcauagagcaguugagcuaauucaguuaaacauguauagaguguuagauuagaugaaaguuaccaugaucaaaaaacucgaaagagcucucaguuucaugggagacacacauacacacacacagauaauagugcuaugugacaagugcugggggaacaugguauguugugucucuuugugaggcagagaugacagaugucugagucuugaaggaaaauuguagcuuuccaguuugagaagacuugaagggugcucugggcagaggaacagucuuguguauagaucuggaggcaugcaggugcauuggggaauauuuucuuggaguggagacaggugauaaggcugacaggcuagaguaggcgaggcuuguaggaguuuuuggcuucauccuguaugugguggggaagcaauaccauguuuuguuuuuuuuuuuuuuucagagggagugacccaaugauaaugauaacuggggcucccuggagaaugauuggaaauuagaagacaccuugauauucucaaccagagauaacagagcccugagagcaggaaggggguuaguagggugagugagguguuuacugagguacggaggagaaagaaaaugaggcuagagucucauucuagggaccuggauugguggaacuuuggucagcggagaaggggaaggccacagggggaaugcaguggaguauagaggggaugcuugguuuggggcucauggaguuugaggaacucagcuuugcaguuaagugcagggagaagcccuauacuugugaaaaugcagcucuggugaaggcaugucucgucacuucccaccuucacugugguaacgggaagaggugggguuugcuccuuuaccuuuguuuuuuagggggcagagggaagggguuguuucaguguugcucaaguaguuguuaugaacaguaagaauacaguggguccaaauauuuuuaagauaggaagaauaaagcugaacccuccaaugucuucugaauuucauaacuuuucuuucuuucuuuuuuuugagacaagagucucgcucugucguccaggcuggagugcaguggcgugaucuuggcucacugcaagcuccuccucccggguucacgccauucuccugcucagccucccgaguagcuaggacuacaggcgcccgccaucacgccuggcuaauuuuuuguauuuuuuaguagagacaggguuucacuguguuagccaggauggucucgaucuccugaccuugugaucugcccaccuuggacucccaaagugcugggauuacaggcaugagccaccgcgccaggcugaauuucuuagcuuuucuuucagcuuauuaucugccacuucacugugcauccucuauuuuucacucacugugguugccggaaggugcugguguucuuuggcgccauuguccuucacaaccugaaacagccucccugcccucaaacaguacgucagauacucagugaguccuuccugacuauuuggggaccgucuuuugggugccccuggagcacuuagaacauuauaccuucuaucguauuauaacucuuuuccuguauagacuguuguaagcauuuucccccuacuuuuuuuggggaagaucuucaaaccuacagaaaaguugaaguacagugagugcuugauuuaccagcugaccauuguuaacauuuuucaaauuuucucaauuacucgauagaaacuauuucagagucauuugaaaguaaacugcagaccucaugggacuucacucuuuagcauguuauucugaagaauaacauaacaggcccugcauaacccugacacuacugucacacucaagaccuuuuacauugauacaguaacauguaauaccuuuuaaagagcagucugaggguuagcauuggcucucccugggagcucuugagaaaugcagaaucuuaggccuuacccuagauauauugaaucagaaucuguguuuuaacaagauccgcagaaguacugauuuuuuugugcaguccauauucagauucagauucucacaguuguucuagugauacccuuuaugguuuuucuuucucuuuuuaaaaaucaggaaucaauaaaagaucacauauugcauucgauugucguaugucuuuagccuucacuuccagcuuucccacuugggacaguggcauuuuuguauaguuuaggccaguuuuguagauguucuccauuuuggauuugucaaauaggugugaugauguuuuuuuguuggguuuuugagaucgagucucgcucugucacccaggcuagagugcaguggugcgaucucggcucaccucgaccucugccucccagguucaagugauucucaugccucagcuucccaaguacugggacuacaggugcacaccaccacacccagcuaagcuuuuuuuuuuuaaaguagagauaggguuucaccauguuggccaggguggccucaaauuccuaaccucaagcaauccacccaccuuguccucccaaagugcugggauuacaggcaugagacaacggugucuguuuuuuuuuuuuuuuuuuuuuuuugagauggagucuugcuguguugcuuaggcuggagugcaguggcuguuugcaggcacaaucacggcaugcuaaacuccugaacuccuggguacaggugguccuucugccugagccuucccaguagcugggacuauugguguaagucacugugccuggcuugaugauguuucuuucuuagggcauucagugggucagguuguuccacuggugaugaugcuaaguuuaaacacuugguuaaguagcaucuuccagauuucuguguuacaaagacagaauggucuuuuggucuuaauaauuaauugcuacagugaucugcuagcaauuuccaauucaucuagcaucuagcaggaucugacaucuagcaggaucccagaacugauaauucgucagucauugaugaaugaaugacugaauaggucauccaggauauauaccacaaguuuuagaggccauucuuucuuguuuucuuucuuuuuuuuguuuugauuuuuguagagaugaggucuuccuauguugcccaggcuggucuggaacucuugggcucaagugauccucccgccuuggccuccaaaguucugggauuacaggugugagccacugagccuggcuccuucuuguuuuccugcucagucuggguaacuucucagacucuagucaaguccaggcaucuuuuugccuggcuuuccaacaaaaauaccucacucuucucccugugggcuucuuagcugugugaaagguuucuccucccuuagucccacuguguuuuuaaauuuuuauuuuuauuuauuauuuuuggguuauuauuauuauuauuauuauuuuuugagauggagucucacugugucgccuaggcuagagugcaguggcaugaucucggcucacugcaaccuccgccuccuggauucaagugauucuccugccucagccucccgauauuuuuauuuuauuauuuuauuuuauuuuuuuugagacggaguuucgcucuuguugcccaggccggagugcaauggugcgaucuuggcucaccgcagccuccgccuucuggguucaagcgauucuccugccucagccucccgaguugcugcgauuacaggcccugcgccaccacgcccagcuaauuuuguauuuuuaguggagacaggguuucucccuguugaucaggcuggucucgaacucccgaccucaggugauccgcccgccucggccucccaaagugcugggauuacaggugugagcuacugcacccagccgcuuauuuuauuuauuauuuauuuauuuauugagacggaguuucggucuugucguccaggcuggagugcaauggcgugaucucggcucauugcaaccucugcuucuuggguucaagcgauucuccugccucagccucccaaguagcugggauuacaggcgccuggcugauuuuucuaauuuuuaguagagaggggguuucaccauguuggccaggcuagucacgaacucugaucucaagugauccgccugccuuggcuucccaaagugcugggauuacaggugugagccaucgugcccggugauacuuuuauuuuuuaaaaaaugauuuuugguucaaggaagucaguucgguccaauuguucuaaaacaaaaaugucuucuguauuuucuuuuuucucuugugccuccaguccaggugcuuguuucacauucuuugcuuuuuagacuagucauucagucucauggaaacagggacuuccucuguauccauuaucaguuguuaggagggcuugaugcagcuuucuauuaaacacucuuccauuguuaauguucucaacuauaauacgauggaagcugaggaaaugaacauagauauccaguccauacagcaaacugucacuucaccccaggagcuuguuuuguuuuccuucacuugaccuccuacugcuucuugcccuguuccagcuacacuggccuucucuuucugucaguccuugaagauacugccucaucuguguucccucugccuggaaugcucucuuccuccagauacucacuugauuaguucuuuccugacuauuagauuuucgcucagauguugucaagacagaaagaccucgccgggcgcgguggcucaugccuuuaaucccagcacuuugggaggccgaggcaggcagaucacgaggucaggagagugagacccuccuggcuaacauggugaaaccccgucucuacuaaaaauacaaaaaauuagccgggcuugguggugggcgccuguagucccagcuacuugggaagcugaggcaggagaauggcgugaacccgggaggcagggcuugcagugagccgagauugcgccacugcacccagcuugggcgacagagcgagacuccgucucaaaaaaaaaaaaaaacacaaaaacaaacgaacaaaaaacagaaagaccucuaaggacccuacuuaauuccauugccauuacacugcuuaauuuucuuccuagcucucauacugucuucuuuguuuaguuauuuaugccauuauugcaaugaaggcuucaugaaggcaggguucuuuuuuucuuguugacugcuuucugggauagugacuauacaaaggaggcacucauauuugugagugaaggcuaaaugguuggcugaauuuuuuuuuuuuguuuacuuuuuguccuuugaugagugccuuuuguuguagugucuccugaugcuuguagcacagcaguuccaacugcucccauugccuuuggugcccucaagaaaaauaagaaaaggagcaaaauaaaaaugauucaaguguuuuauuauuauuauuuauuuauuuuuuguauauuuuugaaacagaaucucccccaucacucagccugcaguguaguggcaugaucauggcucgcugcagccuugaccucuuggguucaagugauucucccaucucagccuccugagaccacaggugugcaccuccaugcccagcuaauuuuuuuuuucuuuuuaaaaguuguuuuuguagagacgaggccucuauguugcccagacuggucuugaacuccugagcucaagugauccucccaccuuggccucccagagugcugggauaacaagucagagugugucuuaauuauaaguuaccuugauuuuuuuggcaguuaccaggagauuugagaguugagguuccaaaggcuguguuaacucugcuugaugcagaugcaagcuggcauaccugugacagcacugaguauuccacaaucuucugucuugugcagugugacaguuaacguugcuucggguacuuuuaauuucuaaauuuccugauuugcauuuaaacgaaccauccuaacauuucauuaaguuaacuuugcuguuaaaaaaaaaauuggcauugaguagcaugguuaagguagucuaaaucugccacaauauaauaaugaaaauucaggagcagacacauuuuaagcaugauuuggccauucuuuuauaagugaaugcugaacaucuuuggagaagguacguaguucuuugcacaaaugaggcaguuugccaguuaucagcccccuugguucugauagaacuaugcuuuuauuuucuccucauugcuucucaauuucucuuucuguuguagauugcuagcuaaaugauugcaucucugccccuuucugaauuuauagcaaacuuuugcuuuauagccaggauuaccauuuauaagguaaugaagaccagauaaguacaguuuaacuguuuauuuaguuccauuaagcaugaucccuccuggaaaaaccuaagguugcuguaauucauuaagguuggcuagcucuaguagguuuugugauagaucuugcgaaggagugcucuguaaguuaauuggaaaaguagaaacugucaagaguuuaaaaguuauuuguuuaguuacucugaacaauaccauuaauuguagagaaccagaagauacgacuaagauuaaggcaggagcuuugucuugggaggcuuguaaauauuugcaaauuauguugcauaaauucagcucaacuaauacuaucugcccugcauaaagcucccagccagcaacuuacgggauauaaagaaacauaggcaugguuaucauccuuacacuuaaaauauagcucugaagaccauaugcuaaaccugagaaaauuaaguuuaauaaaacaauucaauggcuguugagugacaacauaaaugaaaagagcaccagaauuucaggacuagagggauuuggaguauagaauucaacuucuuucauuuuauagauagaugaaaagagcaccagaauuucaggacuagaaggauuuggaguauagaauucaacuucuuucauuuuauagauagaugaaaagagcaccagaauuucaggacuagaaggauuuggaguauagaauucaacuucuuucauuuuauagaugauaaaaccaaggauccagaaaggugaagugacuuaaucaaaagucagaggauaagugacagugcugguuccagaagcugauguuucaaguagaacauguucucuuuagauuuuaagauacuuuuauuuuuugaaauccuuuuaggauugggaucacuaaaaacaugccuuggcucuguagcaucauuucaugauguucagcgucauucuuggcaggacccugcgcucaugaaacuuacacuguaauaauggcauaaauaaguaaacaaagaagacgauacgagcuaaaauaaaauuaagcaggguaauaaguaauggaauuaguaggaucuuuagagugccuuucugucaugacggcauuugagcugaaaucugaaaguuaggaaagaacuggucuucugagggaagagagcauuccaggcagagggaacacagaugaggcagugucuucagggacuuacagaaagagaaggccagugugacuagaacagggcaagaaguaagugaucaagugaaggaaaaaacaaaaacaagcuccuuggcacuuuugauuaaaggugcuauacagggcagucugcuugcauuaugguuauugaaagucuugaaaauacacugaguucucaauuuucaaguguuaguguauuuuaaguuucuuaauguaagugagugauuagaguccuuugccuuaacucguuuagaagcaggauuagggaggcugagucuggugaauuaauuuuuuuuuuuuuuuuagacagagucucacucuguugcccaggcuggaguacaguggcaagaucauggcucauugcagccuccaccuucuuuggcugaagcgauccuccugccucagccuccugaauagcuggacuauggaugcacaccacuacaccuggcugauuguuuuguuuuuguuuuguuucugagacaaagucucacucugucgcccuggcuggagugcaguggcgugaucucaucucacugcaaucucugccucuuggguucaagcgauucucaugccucagccucccgaguagcuaggaucacaggcaugugccaccaugcccggcuaauuuuguauuuuuaguagagacaggguuucaccauguuggccaggcuggucuugagaucccgaccucaggugaucugcccaccucagccuaccaaagugcugggauuucaggcaugagcuacugcgccuggccuguuuuuuauuuuuaaauuauuuguagagaugaggucucgcuauguugcccaggcuggucuugaacuccagggcucaagugauuuucccaucguggccucccaaagugcugggauuacaggugggagccaccacaccuggcuuuuuuucuaauauuaaauaauuuauuuuugcacaguaagacuucuuggaaguugucacuaacguuaaaguugggagauuccauguaaaaaucugcaucccuggccucucuugaaaagucagauggucuggaaacccuggauuuaugugguaaagauugccuggaguugaugaacaagugggcacaagcuuucugauuuugaaguccuggcuccuccuaguggucccuguccccagccuggagaggccaggugucauuugcaauucauuauugugcuguugugcauauugugcuguugugccaccuuuuuuuuuuugaggcggagucucgcucugucgcccaggcuggagugcaguggcgcgaucucggcucacugcaagcucugccucccggguucacgccauucuccugccucagccuccugaguagcugggacuacaggcgcccaccaccgcacccagcuaauuuuuuguauuuuuaguagagacgggguuucaccguggucuugaucuccugaccucgugauccgcccaccucggccucccaaagugcugggauuacaggcaugagccaccgcgcccguccugugccaccuuuuuuaaguuaagaaguaagugaaauuauuuguacuccaaaguaucaaaauuaggaaaacaaaagaccaagaauguuuuuuguucaagaaaaaaaugaaagucuuuuuuugagaaagugaaauaguuauguguuguaccuguuuaauaauuaaacacaaaugugaccacauauaccuaaaugucugcuugcagcuagcuucacuuaacuuuccucuuggcucucucccuuugcaacccuggaagguucuguguuuuguuuguguuaaugcaguaucucuggaaugcuaggauauguaggauccauagggcaaauaguucuucugaaaugucuuaucugugacauuugaugacauuugguugagcuguugucaaaccuuuagcaaucuagagcauuccauuuccuaagguucacugacuuggguugaucaguugaguggacaaauaaccuuuaaaaaccaaaguguaggccugacgucacaugaauguagacagcaaauucaucuaccuucaaugaaacagaugacugggacacaggcauucuguguuaccagauuaggcaaaugcagguuccuuuuggcaccccuaucucuagugauucuagauuugaugacaguauaaugacaguauaaugaugaaaauucagaaauuuaacauugauacaaugcuacuguuuaauucaguacccauagucaaauuuugucaauugucucaauguuuuucccuuucucaacacaauuucaguccagaaucacuguguuuaagucucuuuagccuccuuuaaucuggaaauauuucuuuuuuuuuuuuuuuuuuuuuuuuugagucggagucuugcucuguccgcccaggcuggagugcaguggcgcgaucucgguucacugcaaccuccgccucccagguucaugccauucucuuguuuuagccuucuaaguagcugggacuacaggcaccugccaccacaccuggcuaauuuuuuuuuuguauuuuuaguagagacgggguuucaccguguuaggcaggauggucucgaucuccugaccucaugauccaccugccuuggccuuccaaagugcugggauuacaggugugagccaccaugcccggccucuggaaauguuucuuuuuuuuuuuuuuuuuuuuuuuuauugaucauucuuggguguuucucacagagggggauuuggcagggucacaggacaacaguggagggagggucagcagauaaacaagugaacaaaggucucugguuuuccuaugcagaggacccugcggccuuccgcaguguuugugucccuggguacuugagauuagggaguggugaugacucuuaacgagcaugcugccuucaagcaucuguucaacaaagcacaucuugcaccaccucaauccauucaacccugaguggacacaccacauguuucagagagcacaggguuggggguaaggucaccgaucaacaggaucacaaggcagaauaauuuuucuuaguacagaacaaaaugaaaagucucccgugucugccucuuucuacacagacacggcaaccauccgauuuaucaauccuuugcccgccuuuccccccuuuucuauuccacaaaaccgccaucgucaucauggcccguucucaaugagcugcugggcacaccucccagacggggugguggccgagcagagggguuccucacuucccaguaggagcggccgggcagaggcgccccucaccucccggacggggcggcuggccgggcggggggcugacccccccaccucccucccggacggggcggcuggccgggcagaggggcuccucacuucccaguaggggcggccgggcagaagcgccccucaccucccggacggggcggcuggccaggcggggggcugacccccccaccucccucccggacggggcggcuggccgggcgggggggcugacucccccaccucccucccgggcggggcggcuggccgggcagggggcugacccccccaccucccucccggacggggcggcuggccgggcggggggcugacucccccaccucccucccggacggggcggcuggccuggcgggggcugaccccccaccucccucccggaugggguggcugccgggcagagacgcuccucacuucccagacgggguggcugccgggcggaggggcuccucacuucucauauggggcgguugccaggcggagggucuccucacuucucagacggggcggcugggcagagacgcuccucaccucccagacggggucgcggccggguagaggcgcuccucacaucccagacggggcggcggggcagaggcgcuccccacaucucagacgaugggcggccgggcagagacgcuccucacuuccuagaugggauggcggccgggaagaggcgcuccucacuuccuagaugggauggcggccgggcagagacgcuccucacuuuccagacugggcagccaggcagaggggcuccucacgucccagacgaugggcggccaggcagagacgcuccucacuucccagacgggguggcggccgggcagaggcugcaaucucggcacuuugggaggccaaggcaggcggcugggagguggagguuguagcgagccgagaucacgccacugcacuccagccugggcaccauugagcacugagugaaccagacuccgucugcaaucccggcaccucuggaggccgaggcuggcggaucacucgcgguuaggagcuggagaccagcccggcuaacacagugaaaccccgucuccaccaaaaaaauacaaaaaccagucaggcauggcggugcgcgccugcaaucacaggcacucggcaggcugaggcaggagaaucaggcagggaggcugcagcgagcugagauggcagcaguacaguccagcuucagcucggcaucagugggagaccguggaaagagagggagagggagaccguggggagagggagagggagaggagggagagggagaggagggagagggggaggagggagagggggaggagggagagggggaggagggagagggggaggggaaauguuucuuaaucugucuuuuuuuuuuuuuuuuuuuuuuuaaacagagucuugcucuguggcccaggcaggagugcaguggcaccaucuccacucacugcaaguucugcucccccagguucaugccauucuccugccucagccucccgaguagcugggacuacaggcgaccgccaccacgcccggcuaauuuuuugguauuuuuaguagagacgggguuucacaguguugaccaggaugguuucgaucuccugaacucgugauccacccgccuuggccucccaaagugcugggauuacagacgugagccuccgcgcccggcugcuuugacauuuuucaagacuacagccaguuauuuuguagaucgucucacgcuuugaauuugauguugccucaugacuaguugagguuauguaauuuucaggcgaaauaacacagaggugauguuguauccuucucagugcaucguguuaggagauacgugauguggguuuguguccuuauuagggacaguaauuuugauuacuugguuaagguggcaucucagguuucuggacugugaaguuacuauuucccccaucugucauaaauaaauaaucuguugggaguuacuaugacacuagaucacgcuacugagaaacugaaugcuaaucuacuugguuagcauucuuugauucuugccugaggcaauuaauauuaugguuccugaaugcugauuuuucuaaauacauuguucuuucuacauuuauuaguuuguuuccuauuguuuggaagaacuuuuccuucuuuauucauauuagcauggacucaugcauuagucaauggaucauacuuuguucuaucuaaucuccacuaaagcucucugaagaaggcagugguugguagucuuuuaugagggaucuaguucaaaguuacguuuuuuuuuugagauggaaucuugcucuguugccuaggcuggagugcaguggcaugaucucggcucauugcaaccucugccucccagguuccagcgauucuccuggcucagccucaugaguagcugcgaucacaagcaaccgccacuacgccuggcuaauuuuuguauuuuuaguagagagaggguuucaccacauuggccaggcuggucucgaacuccugaccucaggugauccacccacuuuggccucccuaagugcuggaauuacaagcaugaaccaccaugccuggccaguuuucacccaguaguuuugacauucauugcuaauccuuggcuggaucaguuuuuaccaguggggguugcaagauggucauuuucuaauucuauucuagauucaugguaaagaaauucccuccccauacccuuucuuuugaggaucccuauggucuuaaggauauuuauuuaauuauuuaguuacagacaguuacagucauuauucucuuugauaguuguccuaaauuuggcugaugggagcccuugcuuccugugucuuuugauaugaucuuguuagucuuguccccuuuccgcacaauacagugcuucagaccuggaacuuugguuucuauuaaugggaaaugguccguuuuuuaaaaaaaaaauaaguagaaaugggaucucucuguguggcccaggcuggucucaaacuccugggcuuaagugauccuccugccuuggccuuccaaagugcugguaucacaggcaugaaccaccaugcaaaugguauuuaauagaaauaaauacuugggcacugauaacacugguuuuuuuuuguuuuuguuuuuuuuuugagacaagagcuugcucuguugcccaggcuggagugcaguggugcgaucuuggcucacugcaaccuccaccucccagguucaagugguuuuccugccucagccuccugagcagcugggauuacgggcguguaccaccacacuggacuaauuuuuguaguuuuaauagagacgggguuucacuauguuggccaggcugguuguuuuguuuuuuaauuugccaacauuguuuuuaagaguaacauuguagcccguugugucauuguuacauaauuuauugagugaucuguuguuugaaauuuagguaauuuauaacuuuuaauguuuauauaaagcaguguugugaacaucauuguaucccaguuuuuacauguuccuuaacuuuagaauaagauuuuagcaguagauuuucugggucauacaaauguacuuuuuaaagauuuuauuuuauuuauuuauuuuauuuuuuauuuuuuugagacggagucuugcucuuucgcccaggccggacugcaguggcgcuaucucugcuacugcaagcuccgucucugggguucacgccauuuuccugccucagccucccgaguagcugggacuacaggugcccgccacugcgccuggcuaauuuuuuuuuuguauuuuuaguagagacuggguuucaccguguuaggcaggauggucucaaucuccugaccucaugaucugcccgccucagccucccaaagugcugggauuacaggcgugagccacugcgccuggccaagauuuuauuuuuuuaauuuuuauuauuauuauuauuuuuuaagauggaguuuuuuucuuguugcccaggcuggagugcaauggcacaaucucggcucacugcagccucugccucccggguucaagcgauucuucugccucagccucccgaguagcugggauuacaggcgugcaccaccagccuggcuaauuuuguauuuuuaguagagacaggguuuauccuuguuggucaggcuggugucgaacucccgaccucaggugaucugcccgccuuggcuucccaaagugcugggauuacaggagugagccaccacgcccagccuuuaagcuuuuaaaugucuaccagcaguuuguugucuagaaaguuuauauuaguguuuaccucagcuucaugccuuuucuuuucuuuuuuucuuuaauaauugaaggcacuacuuuuagaagaaaagacuaacuguuauuuucguugauguuuucucccuauucuuaaagccgcugucugacagaaguuucucuugacacugauacagugauauuugacuaagugugauuugaaauuucuucuggcuaugagugauaauagcugugggugcagagggcagcugauuuaaacauuauguuuuaauagaauaagacaaguccuucucuaggaauccaucaaaaaaugaagugaagcauaccuuuuagauacuacuguaccaugaauguuguggaguaggaaaaaucaggaucuucuguauucguuuuugaagcagugucuuugaaaguagcuuuuggccgggugcgguggcucacgccuauaaucccagcacuuugggaggccgaggcagguggaucaugaggucaggagaucgagaccaucauauccuggcuaacacggugaaaccccgucucuacuaaaaaugcaaaaaaauuagccgggcgugguggcgggccccuguagucacagccacuugggaggcugaggccagagaauggcgugaacccaggaggcggagcuugcagugagcugagauccaccacugcccuccagccugggcgaaagagcaagacucugucucaaaaaaaaaaaaaaaaagaaaguagcuuucauucacuuuagcuuuucaucuuguuucuaaagguggggcagauaaagugaguaggaacugagguaggaagucuuggugcuagagaagcccaaagggaaacauucuguguguuugggaaugcccucuuguaguaccccuccuauuuguaagccugaaaucauuaaauauuaagagguuguaagguuuacugggucuucauguguaggcuaguuagaauuuuuucaucuauagugaauauagcuuuccugaugcaaaagucccaaaguaggagaagauuuguuacauauuucauguuuguguuugauguuugccugacugacuuuuuguuucuuauuuagaaaugacugcuguccaugcaggcaacauaaacuucaagugggauccuaaaagucuagagaucaggacucuggcaguugagagacuguuggagccucuuguuacacagguaagaaucugaaaacacaaauacauuguaacaugguucuauagcacaggccuggguaacaaccauaagagcaagguuauuuaguucaaagccuuaauuccaguacuugaguuuaggugacaguucuuagaugauuugaauauugaugcauggguuuaguuaacccuugagaacgcugcugcugucguuuucuucagucuuauugcuaguaacggguccaugguauguagugcaacuuugcaaauguuugugcuuugcagauacuucaccuuucuucagaggggaaacccaagaaagguggagucuggauccuugauuguuaaggucucucacucugcuuaacacaccuuucauugugugggauuaauuagcagguaauucaacuugaggguuuagguuugguaugcuacaaaugucacaauguuaggguaguucauaaacuguuagcaacuagcuguguacuuuuaguguuuuacaauaguaugucuauuguuuguaugugagagauucagagagagagagagaaaaugagucuuguuuggcaaauuuacacuauaacauauauucaucaucuuuaaccuagagauaaucugguauuauguguauuaaugaugguaauguucuaagacauaaagcgucaucacuguaggcuucuuugggcaaucauucguuuauugggaccuuuacuaauugcugagauuugugugaauaaacugucaaaagacuucagaagcaaauuaucuuaaaauguuuugcaaaguuugaaaacaguggcagugugaucuccagauaaagcuaaguucauuguuaaccucuuucuggaacaucuuggugacauauaguagagacaucuaacuugucucuaaucauuuuuuaauuuguaaaaucaaacuaaaaaccuaaugaucauauuugagaaauuaaaauauguguuaaauaauucucuguacacauuaagaaagcugaauuauuuuggaaauuaaauauagcaucauugcuguauaucuuaaauauggggaauuguauguuaauguucaguggaaucucaugugauuuuuuaaaagaauaacuuaaucuugcugucuuuaaagauauuaguuugucauuuuaauugacuccaguuuaauguuaaaaaugaaacuuuuagguuacaacccuuguaaacaccaauaguaaagggcccucuaauaagaagagaggucguucuaagaaggcccauguuuuggcugcaucuguugaacaagcaacugagaauuucuuggagaagggggauaaaauugcgaaggagagccaguuucucaaggaggagcuuguggcugcuguagaagauguucgaaaacaagguaggucauuacugcuuuuuagguaaagagaggcaggccuuucuagaaaaucaguguuugaagauuuuuuuuguggucaguauucucauucuuaugcuugccaauugcucaguaacuuacuuaguuauuggagauguauuaaguuggacuggcucauauuuuaauucucauucuuaugcuugccaguugcucaguaacuuaguuauuggagauguauuaaguuggacuggcucauuuuaaucaugagagaugcuugcagagggacaucuggagaaucugaauccacuucucuuggguauuucaaguaauaguuaagucuuagaaauguuguaacacaaauugauaggaaagaaaugggaccgaaguuuacuuuucauccuguguaauacuucuuuuuaguucaugcugaagagaugggugugauaaaauggaaaaauaucuaccuacucugaaaauacucuagaaauuguccuauugugucagaauaguauguuaaaucagccaugcauauuugaacugguuggagcuugacauaaaucuggguauaaaggaaucauguuuugggaaauucagaauugauaaaaaguaaaaugguaauccacaguuuacuaauaauuaaugcuagaaaaauuguccuuauuauguuacaaauguggaaggaagacuuuaaauacggaagauaaacuucuugaaaccugcaguuuuuauuuuuaguagagaugggguuucacuaguugcccaggcuggucucaaacucccaagcucaaacaauccgccugccucggccugccagagugcugggauugcaggcaugagccacagugcccggccuugaaaccuguaguuguguguuagguuucuuuuccagucggagaauuucaacaaugauguagguuuuuuagguuauuggauaucagcuaagguaaaucgagcccugcuauuuacaggugcuuuacuaacccuugggagaacuucauagaucuuucgugccugaugguagauugcauaguccagagucuuaugucaaauucaucccuguggcaguacccauaaaugggcagugccuuagauggagauaacaucuccaauuguuuucugaauuugugaacaaauaaccuucaaugguaaauauuuuuucaguuuucaggcugaagauaaauauuucuaauacugaaaaugaugaaauuauuagaauuccacaguacuaauuaggcagguauauuaguuuccuagggcuucuauaacauaaauuauuacaagcuugguggcuuagaauaauagaaauuuauucucucaucauucugaaggccagaaaucugaaaucaagguguuggcaggcuugauuccuuguugggacuuaggaagaaucuguggaugccucuuuccuagcuucuggugguugccagcaauucuuagcauuccuuggcuugcagacauguuacuccagucucugccuuuguuaucauauacuuuucuuuuuuugugucucuguguccaaguuucccucuucuuauaaggacaucaaccauugaauuagggcccaccuuaauccaguauaaccucaucguaacuugauaucaucugcaaagacccuguuuccaaauaaaguugcauucacagguuccagguggacaugaauuuuugggcaaugcuauucaacccaguacagugaguuuugaauuaauuaauuaauuuuuuuuuuuuuuugagacggagucucgcucugucgcccaggcuggagugcaguggcgggaucucggcucacuucaagcuccgccucccggguucacgccauucuccugccucagccucccaaguagcugggacuacaggcgcccgccacuacgcccggcuaauuuuuuguauuuuuaguagagacgggguuucacuguuuuagccgggauggucucgaucuccugaccucgugauccgcccgccucggccucccaaagugcugggauuacaggcgugagccaucgcgcccggccuaauuuauuuuaaaguaguuuaaugguccaguucaggacaguuuuugagcuugcuguugaggaaaucaggcuauuacuuaauuguauucugugguacauucuccuccccagcccuucuugucuucuauaacgaaacucacaaucauauuaacagaugaguuugggcaguguuugcuggcucuagugacugacguuucuuuucuuuucuuucuuuuuuugaguuggagucuugcucugucucccaggcugggaugcaguggugcgaucuuggcucaccgcaaccuccaccuccuggguucaagcgauucuucugccucagcuucccaaguagcugggauuacaggcauaugccaccacacccagcuaauuuuuguauuuuuaguauaguauaguguaguguaguguaguguaguauaguauaguauaguauugccuuguuggcaggcucgucucgaacuccugaccucaagugaucugcucgccuuggccucccgaagugcugggauuacaggcaugagccagugcgccuggccacauuuauuuuuaaaaugcauuuaauuguuguagguaauuuuaauuugacuuuauauguuucuuauuucagaaguuucuccagugcaaauauguagcaaucaugguauaauauacauucccugcuccccaaaccccccacaauuuugaaugcauaucugaauugcuuuuguuauuuuuguuuguauaugauaaucuuuuaugugguucugaaucauaaggacuuuucuguccuaguccacuuuugcaauuauuuauuaucaugaccuguccaccauaauuugccuucucuuuggaaaaaaagagccaaaaccaaaauauaacuuccucccaucaucauuauugcaucagauaugaaaagcugaaaugccuuacuuuuuucucuuggcuuacuuuuuucuuuggagaaucuuaacaaauggugauaagaucucuuuucuaucauaaauagaacaaaauacauauuacaaaaauaugaagcacagauugcuuaaucaacugagacuuguuggcuaugucguugaagccauuuacucaucguuugaaacccuguagugguguuaauaggucugcagauucuuuggacaccccucccuuaaaaaaaaauagagccuaacccuugaacauggguugaacuuagugauuccuacaaugacuagaaugugguagaaguggugcuauuuacuuugggagcaaaguuauaaaaauggggccguauccacuccacuuuuucucauggauuauucugucugggggaagcuggcugcuaugucuugagugcacucaggagguccuguggagaagaacugaagucuccaaccaucagucagcacacauuugucaagcaugugagugaaccaccuaggaagcagauccuccaccuccagucaaguuucagacaacaucaguccugaccaaccccaaaucccugacccauagaaaacucugggaguuaauaauuguuuuaagcugccaccucuuggaauuucuuaggcagcaaaagaaaauuuauacaaacacuuuucccugcccuggcuucagugguccugagcauuuacguaaaacccugaccuaacuuuucugaauuuuucugauaaauaaaaauaugccauccacugaaacacuuaauuuuuaaaggauuuuuaagaugucuuuguucugaaucacuguugacguuguuuaggauggggguugguaaauuucuucuagaaggccagguaauaaguauuuuuggcuuuucugaucauaagggcucugggcugggugcgauggcucacgccuguaaucccagcacuuugggaggcccaguugggcggaucacgaggucaggagaugaaaacuauccuggcuaacacggugaaaccccgucucuacuaaaaauacaaaaaauuagccgggcguguuggugggcaccuguauacccagcugaggcaggagaauggcgugaaccugggaggcggagcuggcagugagccgagaccgugccacugcacuccagccugggugacagagcgagacuccgucuccaaaaaaaaaaaaggucucuguugaaacuauuaauauucagcucugcuguugauuugggaagcagcuauagacaagauauaaagaaauggucaugggggauggcuguguucuaauaacauuuagaaaaauuacaggcuauaguuugcuaacccugauauaggguuuucccaggcuguuaaagauaugagcuuacugucuucaaaaagguaguuauuuauguguuuauuuauuauacuuuugagccaaaaauuagaccuucuguaucuuuggguuuguacauguccauugcuucccgugcaaucauaauaaccaaaaguuggaauguacacaguuuuugauguguaacuuucuuuuuguguuagacccugauuacauaaauaaugaauaugcacauuugugaguauacuaaaauuucaccauaaugcuguaagugauguuaaaaaaauucacguacauaaaaacaggaucauuugacuucaaggcuaaugaaauggucaggugagccacaugugguggauaggagccagucaccaauugcauggcuuccaaaucucugugaucuaagaguuuaauuguacuacuaaucugcuucguuuuugaguagcuaccuuauauaggcagagguguacauaugccucuuagaugugcucuuuucuuauuuuaggauccuguuuaccucccguauccccccauccuuaucagaucaaucuuaccuuuguucuuuuuugucuuagcgcuuaucacagugguaauuuaaguugguugccuuuuccucucuacgcuccagcagugcagguucugugcuggucuggugaccauucuguuuguaucuaugauaguaccugguccgugauaggcacuuaaauguuugaguaagauaauugauuauucuccgagaaguacaguaagagaaaaugcuuuuuucucgaaauuuaaaguguguuuuccuuuccagugccaaauguaaaugcauggguagggguggagaaucuuauguuuuuuuuaaaaaauugagauauaauuucacauaccauaaaaaucacccauuuaaaguauacaaugcaguguuuuuuaggguauucagaguuguacagcuaucaccaugaucuaauuccaggacauuuuuaucaucccccaaaagaaaccucauacucauuagcagacauuccccauacauguacauuuuaacaguagauaaagaguagcagcugccuugugguacauaaauguauuuuaugaauccuugaauagggcucugaccagaaaaagaagccucuuaagccggauaggggacuuucaggggacagagaugagaagaccuaaaugaagcuuuuuugaaaaaggagagauauuaugaacagaggcccauuaauguuaaauuugaaguggagugaugaggaacagcuucuuacuagaacaguguuuuauaauccauuagccacaauuuauacuuggaucucaaaggccaggaucaguauuauugcuacuucuguagcuucuucccuauagcucaugggcauuucugggucagugaagggggagaagacccaaagaaacugaaauccaccuuuuuguauuccugcacugcuucuaaucauauuugcucaguaaaggggccaaauagauuauucgugcacugagcaacaguagauuuccuaggaagaagcuugugucagggaaauaugagugaggaaugggcugguugauaguguguggucccugagggggagaugguauucuagcacauaggaggcuguuuuuccuguuuuuccccccccccagagcuuauaaugauacaugaauacgaaaaauaauuaauagcaugaguggcagaggaaugggaggauaagcaugggauugggaaaguuaacuaaagguauuugagcuugcacuggaucuugaaagguagaaaaagggagcaggaggaaacucauccagguaagaaaaauagacugugcaagaugggcaugagaaacagugaggucccuggcuggaggugggugcuagucauguugagcacugcuggcaggagagguuuuuguuuuguuuuguuuuuugaguuggagucuugcucugucguccaggccggaaugcaguggugguaucuuggcucgcugcaaccuucgccuccuggguucaagcaauucuccugccucagccuccugaguagcugggacuacaggcaugugccaccacaccuggcuaauuuuuguauuuuuaguagaggugggguuuuaccauauuggccaggcuggucucaaacuccugaccucgugauucacccaccucggccuccuaaaguguuaggauuacaggcgugagccaccgcacccggcugcaggagagguuuaauauaguuuggagcauauuuagaggguggcuuggaaugccauguggcauuacaugguucaggucccauaugcuugaauguaucaagugacacaggacucacucacuaccucaagggggagcucuuuccaguauugguuuguguuuauuuuaaaagcuuuuuuuuccccuuagaaacugaaauuugucucuugaauuuucuuccuguuuuaagaaguuccaccaucugggcaauacagaauaugaggaaaaguggaguuuuugcagggagauuaguguuagcugugugcaggaaggguuaaagugacugguagacagcccagagguaggaccuagagucuggagaugaccauaguaguggggagugaaauggagcugugcaggaagggacugcuauaacagaauugauggaaagagagaauuggccaguugucaugcauguuaacugccagcagggccugugcaaguagcugaucuuuucaguagguaaaacuaagggaccugguaugugaaaaguuguaguaauuuauuuuccugugacuugaggcauuuagggugguguugaggcagcaugugcugcuaagaaccuguguucuuacagguguaaaaugcugccuuuuaaaauguuugcauuauuugcuuguaauggaugucaaaccuuauuuuguguucauuaaucacacguauuaauguuuauuaauacaucugaaacauguuauuugugugaguuccuauggcaaugauaaguauugguaaacauuagugcuccuuucucuguugauuuguugaagcccuguuauuuuucuuuuuaauuggaauuccaccaaguuuucaaaaauugagacauggcucauugggcuggagaugcugaucuuuuagauuucucuuuacuaaucuaauggcauagcagagguuaaauuaccuuggaguagaaaaucaagaaaugauugugugugucugcaauuuugguuuuaaugguaggacaagauuaugguagucugggaaaaggugauugagugcugcugaacagagcaaggauugauuguagcuaagucuagugacuuacugccugccauuugguuugaccuucauuuugugacuaucguaccacuaaccacagccagucaccucucauguauguguuguuauucucauggcaaacacugugaaaaccucuggguaauucacugcagccucuucuucagugcugaaaaaacauuuuauagugacaacuauacauccuuugucccccagauggccagaaggugaagauagaguaaguucuuuuacuaaauauuccuguccauaaauaaaaagcagacaucuuaauguuuggcuuacaguuuuuuccccuuucauaucuauuuauguuuagacagauuugucuuaagauuucuuugaaacguuucuuuuuagguuuuggcuuucaggucauuccauuucaggcaaacuuugauacugcgaaugcauuuuccuugaguagaagaucucaacuuacugaaagcagucaguguuguuaaguacuaaaucucaaucauuacauaaaucaucuuuuauguaaaaaaugucggccgggugcgguggcucaugucuguaaucccagcacuuugggaggccgaggcgggcagaucacgaggucaggagaugaagacccuccuggccaacauggugaaaccccgucucuacuaaaauacaaaaaauuagccaggcgugguggcacgugccuguagucccagcuacuugggaggcugaggcaggggaauugcuugagcccggaaggcagagguugcagugagcugagauugcaccgcugugcuccagucuggagacagagcaagacuccgucucaaaaaaaaaaaaaaaaaaaaaaaaaaagggucuuguuaguuuuagaacaagaaaggaguauuuauugucugcuaacacaauaguuaacaucugugaguuugcaagcaucuggguaaucuuaguaccuauaguugauuugugagcauacucuaaugguacuuguuuucucagcuuuuuuuuuuuuuuuuuuuuagagaggcaauuacuguucauuguagcuguucuuguuuuuuuaaauuuuuauuuuuuauuauacuuuaaguucuaggguacaugugcacagcaugcagguuuguuacauauguauacguguacuauguuggugugcugcacucauucucagcuuuuuuuaaaucuuuaaagcaugaaauuacccagucauauaaaacugagggucucuuagggcauuguuauaaagaaaggauggaaaaugagaguucuuaauugauguuaauggagagacauucuuuuauuuaucucaguaauuguguauaacuguguagugaagcuaaggacauagaugccaucuuccuugguacagcuugaauaauuuguauauagggagaaaaaauguguacacacauguauguguauguguauauauacauaguucacugugaaucuuggcaaggcaauuuucagaaaaauaauguauuucaucccugacaaaagguuauugagcacaagcugucaggcucuugaggcaugauuuucucccuggcaacugacuagagucaagauugaaggaggcgaaaauuggucuccuguccagugcagauguugacagcuucagacugauguacccacaucuacuauaggcagccuggaagauagauguuaaaagacagcugugauuaggacaaagcacguaucagugacuguuuuaaguagaguuugagacguagacaggaggcagaauggaaucuggguuugcuggguucaugaugugaagacuuaaaacauagcuuugaagagcauugugugggugugugugagagagauugcauuuuaauuugucugaucugguuagugugguuuuaaucggguugagaucaugagcuugaucucacauaugggcucuuuaauuuuucacaagagaaaaaugacaaguguuccuacuuuggaauguugaguauggauuucaaaaaguguuaaugaugcucuggaagagcaguagcugggaaacauucaacauuuugaaaaagauuaaaguuaaguuaauuagcuuuucagauuaguacaauaacuuuauuaaaacuagcaagaaaucagcugauuuuuuucucauagucuuccuuugaguucuggcuucucauuuguuaucuuaccuuuuccccuuguugucuuagaauuuucauccuguuuucuccucuuauuuuuguggaugucucuuuucaugugaucccauuguggcuuggucuuuuguuagaagugcucccacuccaauucauaccuuucagauguuccugaagacuguaauuaauuuaaaaauuguuauugaccccauuccuucagucucaccauuuaauccauuuuuucuuguucuucauuuaacuugagcaggaaaagcaaaauauaaauucugaaaaaucauuagcugguugucaucugggaauuuuaugucuuaaaguugucugccugacuuaaacuauaagucuuuagggcagaggcuauauuuucuuugacuugggauguuucaaggaugcugucugcuucuggaucacuacccuugugugagcauaugcugcuuugcagagacuuguguucugcuguagccagcuuggaauugaggaaagaagagugaaguuauuacauucuaaugucauuuugaagugguucauuuuuuccccuuuuauuaaaaagucuguccuguuaagcucacaaaaauaaauaacacuaaccaggauaauaauauuuaugaguuacaguggguaauauuacugccuuaauauauuuguacagucaguguagcugaggaaguuauuuuagguauuaaaauuuuaguuuuggcaugacuucaaccaugauguugcaguaacaugauuucuacuaguuaauuucuuaagaaagugauuccaaguugaaaugcauguuaugcauuuauuugaauguguaaucaggaaguaagugccucucuuuggaguguuucugaauagcagcagggcacacuugaauuaguaaggaaaaugagaacaugaauauguguguuacuuuauuuuaacuuuuuuuuaaauccauucugucugucaacuggaaaaagaaauuucaaagcuucuuuccuuacccucaggggauggggaagggggggaaguuaagagguuuucuaggcuugcucugauucagaugggcuuauaguauuuaaauaacuucauauuaaauguuuauuuccuggguugauuuuuuuuuuuuuuuuuuuuuuuaagacggagucuugcucugucgcccaggcugaagugcaguggugcaaucucggcucacugcaaccuccgccucccggguucaagugauucuccugccucagccucccaaguagcugggauugccagcacccgccaccaugccuggcuaauuuuguauuuuuaguagagacaggguuuuggcauguuggccaggcuggucuugaacuccugaccucaggugaucggccugccuuggccucccaaagugcugggauuacaggcaugagccacugggccuggccucuuuucuuucaaaagauaaacaguuguguggauuuaaaaaaaaaacaaaaaaacaacugcaucccagaaaguucucuuaaggcaucugucagggauucuuugaguuauucucaguuuaucuguacuuacagggauaucaucuaggggucuguuuuuaccaaauaucccuccuugauaaauggaaggcuugauugagaagauuaaaguguguuauucaggaucauccucaugucauagggcacguggguuaugccaaauauauacuaccauuugguuccuucuuauaagggcuguguuaugaagucuauuauucuuugcaucuguauugccaauuugcaucuauauugacaaguguggaaaacauuuuauuaccagaucauagaaaaugaauuaaaauuuggcugggugggaguggugggacauggagaugggaugggguaggaaacauauauuaacuuuggauuaucuugaaguuaggagauaauuuugugaagucuugguccuguuauuuuauuauguuguaaaaugaaaguugguggaauaacagaugaaaauaguuaucaggcccacgccuguaauuccagcacuuugggaggcugaggcagguagaucaccugaggucaggaguucgagaccagccugaccaacauggugaaacucugucucuacugaaaauacaaaaauuagccagaugugguagcacucaccuguagccccaucuacucaaguggcugaggugggagaaucacuugaacucgggaggugaagcuugcaauaagccaagguugcgccacugcacaccaccaccacccuaggugaaggagugagacucucaaaaaaaaaaaaaaaaaaaaaaagagcuggccagucaugguggcucaugccuguaaucccagcacuuugggaggccgagguggguggaucacgaggucagggguuugagaccagccugaccaacauggugagaccccgucuacuaaaaauauaaaaauuagcugggcguguuggcgcacaucuguaaucccagcuacucuggaggcugaggcaggagaauugcuugaacucaggaggcggagauugcagugagccgagauugugccacggcacuccagccugggcgacagcgagacucugucucagaaaaaaaaaagaaaaaagaaaaaagcuaucacuuguuggugagaucccuuaaucaaaucagauguauuuaagagaauuugguauaaaguagguuuaucaguagguuuuggagcuaaagcaccaaaaaguaacuuucaagaguuaggaaucucaugguagggaaguuuugggcauucauuaaauccagggcuggauguuuuuuacucuguaaaacacuguguaaaaagaugccaagcuguuaaguacagggcaguuuuauuauaggcuugccugugauguugguuacuuucucucuuuuuuuuuucuuccucuaguucuacucccuggguagaauuaaaaacgguuuuaaaaugagcguuaauuuucugcagugaacauguguuuugauaguaagagcaaaaagaaaaaaaaugaaaacuuacaauuuuguauccuagagaugaaacuaaugguuaacauuuuuguccuaaaugcuuuccaguuugucuucugugaauaugcucacguggguagagauauguuggguuugauuaugucauuugcuuuuuuucauuuaauggauccugaacaucuuucuguaauauuaaguauucuucuacaacauaauuuuuaauggcugaacacuauccucuagagaguaauaugauuuaagaacauuauuuuauaccagcaaacuaaagacuucucuuuaauacuguuaugucaagaguuuuauucacuuuucacauuuucaaaggaguauaguauuaauaaauaguuacaauccuaguuuuuuacuuuaaagacugaaggcuccuauuguuaagaaguauguaucggcugggugcgguggcucaugccuguaaucccagcacuuugggaggccaaggcaggcggauaaugaggucaggagaucgagaccacggugaaaccccaucucuacuaaaaauacaaaaaauuagccaggcgcgguggcgggcaccuguagucccagcuacuggggaggcuaaggcaggagaauggcgugaacccgggagguggagcuugcagugagccuagaucgcgccacugcacuccagccugagcgacugagcgagacuccgucucaaaaaaaaaaaaaaaaguaguagguaucugagaagaaauaaaagguuuuagauaguuaaaaucauuuugagauaaagagaacaaaguuacuugagcaagguuaucugggaaaucagugggagaagggagaguuggaauuccaaguaugcucaugaaacugauccugaaaugaguaauuugaacauguuuaagauaguugauggugucuaacucuucuccuggaagcuuuugucauuuuagcgcagggcuguuuuugcugguuugcagaagcauauucagguggaugucuuuaaaaucucuuuucucuuuuggauuuggcaguugauaacaaacaauaugcuccuguaaaauguucuguuuaagaaaugccuaccuaaggucuguguaaccauugaaucuucuucccugcagcaacucuacagaaaauuuuaaaaaugagauuggggcuacagauacccauuuauuuuaccacuuggcuuacucuuauuuuggauaaaaccccucuaguuagcugacuuuauaagcuuuuacagaaagauuuuguaauaugugcaaguuuuacuuuuucauuuuugcaugaacuagcagccaugggauuuuuauacuucagaaaaaagaaaauuugaagccugaguuuuauuaucauacacacaaacuaaagauauuggcauuuuuaucauuuaaaaacuuuuuuuauauaaaaguauauucacuauagaaaguaaaaauaaacaauaaacaaucacccaucaggcuguaccaccuuaugauuaagcucugucgauauuuugguauguguugguuguaguguuuaccaucccaucccuuucccaggacauaaacacauugugaucuccauucucacugugcaguacagauuguuauauaucugcuauuuaaaguggaaaugaaaaucauuuccauuaaugaagauaccugggugggggcagauuguauaauuuaucgaagauaagcuguguuucucuacugggcuggcaaaaauauuuuuucuggaccuuaaagguagaaagguucuggugaagaagcuauuuaaaaguauccuuaguauuauuuuggggaaggagauauaacuuugcccuauuuauugagguuuuuggaggacuuuuacaggcaguagagauguuuccauagcuggauuucugagccauuacguugugguugggaaccuuucuuuuguaguauacuguagaauuuugggaugugacacuguaaaugggauagaugaggaagaugaccaguuccugagaacuggaaggaaucccagcuugacuugagaacuucuuuaaaacaaaaugaaacaaaacaaaacaaaaaaacugcuaaaaaaaaaauuuaaaaaaagcaguuggaaaaacguaaggcacagcaagcuuugguuguagcuauuagcacaaaaggaacaauuauuacuacuuucugcacuauagacaguggagugaaggaagcuccccucauccuuuacagcuucagcauuuaaaauuaaaagcuaacauuuccucuguccuuuaggaaacuugguaucaugacuuuauuucuaaaaagguaagaaacagcugguguguggauaaugacauguucuaaauagguuuaaaaacuggaaaaaguagauggaaaaauagaagggggcacagaaguauuuguugagcuuugcauauauuauuucauuuaauuuucaaaacaacugaguaagguaugggagauguguacucauuuuacagaaaagaaaacagcuagagauaaaacaacccaaaguaacacagcugccaaauaucgaagcuggauuuagacccaguuccaauaccuuauuucaucuacaccaaguaguguucugggagagaaguaguuauauucauuaacauuacuucauagcauucuuuguuuuaaaggagcaauguaacagguucagguuaaaacaaacaagccuuuuguuuuuuuuauccaucacccaaauauuuuccaagccuauccuuuccccguaacuuuauaaaguuugguugcuuucaggggaauuuacucaugauauuugaugcuucaaaaacuucuugauuuugucuucuccuaauaaagaauuguggguuuuuuuguuuguuuguuuacuuuauaauugcccauugucuuuguuuuaaacuccagaggaacuuauuuuauucccagcucaggagagaacaucaggggaugacagauuuuauuucauggcagaugguacaguaguauugagcucucuuaaguuucaucuccuuuguuaguagauguaguguaguugacuggaaacagcugggacaaagucagguuuuacaaccgugcgaucuuggauauaguuccugucuaccucaguuuccccaguuugcccuuuugugugcagagagcacuuuugauaucuuauaaauuuaaacuaacagguaucuuuuuaaauuuuuaauuuuuuuuauuaaaaaaaauuuuuuuugagauggagucuuacucugucacccaggccacugugccuggcuaauuuuuguauuauuauuuuuuaguaguucuggucuugaaccucugaucucaaguaauccccuacccucagccucccaaagugcugagccaucgugcccagccuucugccacauuuuguuuuuuuagacagaguuucgcucuuguugcccaggcuggagugcaauggcgugaccucgguucacugcaaccucugccuuccggguucaggcaauucuccugccucugccuccugaguaggugggauuacaggcaugugccaccacgccuggcuaauuuuguacuuuuaguagagaugggguuuugccauguuggucagacuggucucgaacuccugacuucaggugauccacccaccucggccuuccaaagugcugggauuacaggcgugaccaccauaccuggccaucuuuuuuuauuuuuagaguucuuuuaagagacaugagagauggaggaaaaaaaaguuguugauuccuuuuuacaauuuuuuuaagcaagguuuugagcauggguucuuuuuacauuuaauuuugaaaugaaacuuauuaaacaucucaaguuagucuuagugucauuuuuuuuuuuuuuguaaggaugaccauucagaaguuugaggaccucauuuuuagcugggggcuuauuuauauacuuguuuauaguuuugcugauggagaaagugugaauauuuuaacccauuauacaguguguuucugauguauuuuuucauuacuaauacuuuauguuagccaugaaauuaaggauuugucauuagggcugugagcuaaaauaaauuagaguagauguagauguauguauguauguauguauguauguauguauguguguguguauguguguauuuagagacagagucuugcucugucgcccagucuggagugcaguggugccaucucggcucacugcaaccucugccuccuggguucaaucgauucucgugucucagccucuccaguagcugggauuacaagugcucgccaccacacccagcuaaauuuaguauuuuuaguagagacgggguuuugccauguuggccaggcugguuuugaacuccugauaaaugaauucagcagaccacuguaaaaaaagaaaauccaugaagcuguagcugcuacagcagcaagcaugaaaaccccugcacuuuuuaugaaaauaauuuuaucuugucaacacaagauaaaaugcagcuucugugugggugcagggcugcuauaagaaaggcauaccuauagacuaguaagauucgagaaaaagcaaagucauuauaugacaauuuaaagcaaaagggaggugaaagaucuagaguugaagaauuuaaugccagcaagggaugguuugauacuuuaagagagauguggcuuuaaaaaugucaagauaacaggggaagcagcuucugcugaccaagagaaggguucccaaaugccauuaaaaagugcagcagaaggccaggugcaguggcucacaccuguaaucccagcacuuugggaggccaaggcaggcagaucaccugaggucaggaguucgagaccagccugaccaacauggagaaacccugucucuauugaaaaaaaaagaauagaaaaauuagccaggcaugguggcgcaugccuguaauccgagcuauucgggaggcugaggcaggagaaucacuugaaccugggagacggagguugcagugagcugagaucgcgccacugcauuccagccugggcaacaagagcaaaacuccgucuaaaaaaaaaaagugcaacagaagggugggcacgguggcucaugccugcaaccacagcugcagacuucaauucacaguauguaucaggcaguucggcuuuuucuuacaaugucaugacuuuucuuuaccucuugguaguacuuccagcaucacuaguggcacuuuguauuagcuucaugguguuucucaauguuuugaguguuguacuaaacaugaugaaugagaacuacgaaugaucacuuuucacugucaugcaauuuacuggcugugaacugcucagguggagaugauuagcaucgcaugcagaugcaucauauggcauuuuaaguggauauucacaauacuugaccauacugcaauagcaauaggagauggcuacaaaauuauuacaguaguacaguguguacuacaauuaauuuuauguuugauuauauuucccuugacugcgaauggcaccauguacggccuguguuugugugcauaaguuuugauugguuaacuuucugugauagguuuguguauauuuaugguaguacaugauaaaauaggcuaguaucuacagauauuuuaugcauucaugauauaccuaacuuucucuuaauuuuuugguacuucuggauuacaugaugaguuuuuuucaaauuguugcaaaucucugaaacaauuuucaauaugcuuauugaacaaaauccacguauaaauaaacccaugcaauucaaacccaaacuguguuguucaaggguggcuguacaaacuucgcugcuagcuuuuaaguguacaaauagcugcauaaauaaccgaugugcaucaugaccagucaugucacuucuuucaaagucuguuggugauaguucccugcaaaucuguucaguuuaugcaaaguguguaguuguguugcuuccuuuucuccuagugauaaacccacaugaacuacuugacagaauugaauaauugaaagauuauucaacacaacaaagaugaaugugcaacaaagaaaugaaaagugauagaccuggaauugaaauuugauuagaauauaaagggaagaaauagcugauuguggaaauguugacccugcugcuauuuaaaacucuagcuaugcagcuagaacuacuuagugaaggcaaacuucucgacuuaaaugaggaaugugguugugauguccaagagaaugugugaugucauuaaaaacgacacauuaaaggaacucuugaagauauucaugacaaauaagcguagauauuggauaaaauguuggaaauggguccaaacuuagaaagaaauaugaugauucgccaagggauuaaaaagaugcucauucugcacccuaauguaaaugacaagaagaaggcagggaagcauuguucaaacuacuuuugaaaauuuuuuuucacaaggaaauaaaauauuuugucucaguguuuauaauguuuuaauuuaguacauuaagcaaauauuaguugacuauaucauaucccuauacauuuauaauagacaauaaaggaauuuuuaaugcauagacaaaaguauuuauuuuuaauuuuuauuuuguagagauggggucucacuuuguuggccagggugaucucaggaaacuccugggcucaaucgauucuccuaccuugaccucccaaagugcagggauuacaguugugagcucacaugccuggcugacaaaauuuuggggggucuuauuuuuuaaaaauuuauuuuuuucuuuucuccaaauaugauguuggaaacugccaaaaauuuuuaaagguuacgggagaaucauaauucucugugauuaaucucugauuaagaucagguugcacuguuucagcuuguauggucauuuuuacaguccugugcuacugugcaaagugaagaugaucaguauuguuaucucuguuuuacaacuguggaaccugagacuauuaaguggugaagcugugguuuuuguuuuuugacuucugaguuuaugaucuuauucucuauuauacugguuaccccuacacaagauuuuuauauucugagacagggucuugcgcuggaguggucuggagugcaguggugcagucccagcucacuguagccuugaccucgugugcuuaagugauccucccacuucagccuccugaguagcugggauuacaggcaugcaccgccacacuuagcuaauuaauuuuuuuuuuuuaaauagagacagguucucacuauguugcccaaacuggucucaaacucccugggcucaagugauccuccugccucagcuucccagagugcugggauuauaggugcuacauaaaauugaaaauaaaguagaaaauaauuccuuuaguagcccuugcuuuuccuccugguaaugggccaaauuuuuuuuuuuuuuugggagauggggucugucacccaugcgcuggagugcaguggcaugaucguggcucacugcaaccuuggcuuccugggcucaagcgaucaucccaucuuagccucccaaguagcuaagacuauaggugaaugccaccaugccuggcuaauuuuucuuuauuauuuguagagaugaggucucacaauguuacguaggcuggucuugaacuccuugucucaagugguccuccugccuggacuuuucaaagugcugagaucacagaugugagccaccgugucuggucucaggccaaauucuugaaagagcagucuuauuuauaacuuacuuuauuacccuugaaaucuggugugugcaacucccagaaagccacuugucuucuucguugucuugugcuagccacauuggcuuccuuggccuuccauaaucuuuuuagaucuuugacuugguguucccucuaccuggaaugcucuuccuccagauagccacauuauuccugugauuccuuugucaagacugucuucaaaucaaaugguauuuuuucaaggaggccuaccuugaucccccuauuuuaaauuguaucuuacaucccuuuucucucuguccuccuuucugucacugcccccgacccuacuccaguacuauuguuuauugucuuucucucccacuagaauguaaguucccuggagcccgggauuuuuuccuggccugguugguuaauuuccuggagcauuuagaauagugccuggcugauagaaggugaucaguaagcauguuuugaaagaggcaugaaugcucuugaagauugcuguugaauaggugaauacugaugaaacacaaugaagaccuuuucucugucuucugaucuuguuuuaccuagaauuaaucauuucuaccaacccuauuuugucuccuagugcuugcugcaaggcacugaacuaggcauuuuacaagguaucuuaauugacacucacagcagguauucuacacaucgugcagaggaggaaacagaaucauaaagucuaguugcauagcuggcaaguggcaaagccaaaacuuaggccuauauccagcuccagagccugugcucuuucauguuacugcauucaauacugguuuuuuuuccuuuguguuuuuugagcuauaacucaacauacauaaaauucaucauuuuaaagugcacaauucagugguuuuuaguauauuauuagguugugcagccaucaccacuguguaguuucagauguuuucaucauccuagaaagaaaccuaguuuuaccuguuggaaguuaguccucauucuuaccugcuucccacugcccagcaagcauuaccuucugucucuauggauuugccuguuguggcaaauggcgauuucauauaaagggaacaauacaguauucuuucacuuaacauauguuuugaaaguucauccauguugcacauguaucagcacuucauuuuuucuuacggcuaaauacuggauaaugccacauuuuguaugucuguuuuucaguugguagauguuuggguucuuucugcuuuuucagcuguuaugaauagugacacuaaguauucauguacagguuuuuaguuguguagcuauguauuagguuggugcaaaaguaguuaugguuuuggccauuuaaaaaaaaggugaugaaaacugcaauuacuuuugcaccagcuuauauuaguccguucucacauagcuauaaagaaauaccugaaacuggguaauuuauaaagaaaagagguuuaauuggcucaagguucuggaggcuguacagaaagcauagugucuucuccuucugggguggccucaggaagcuuccaaucaugguggaagggaaauggggagcuaggcaucuaacaugguggggaggagcaagagagggggugggagaggugucacacaccuuuaaacagccagaucucaugagaacucauucaccaucacaagaacagcaccaagagguugguacuaacccauucaugagaaaccacucuuaugauccacucaucucccaccaggccccaccuccaacauugagaauuacaguuugacaugggaugugggcaaggacacagauccaaaccauauccaccuagcaguggaauuacugagucauaugauaacauuuaacccuuugaggaacugccagacugucuuccaaaguagcugcaccuuuuuacauucccagcauugggguaugagaguucuaauuuccucauauucuugccauuugcuauuaucugccuuuuuuauuauagccauccuaacuaaguacaaagugauaucuuugugugguuuugauuuguauuaccugauggcuagugagguugagcaucuuuucaugugcuuguuggccauuucuaaaucuucagacaggcaccuguuuaaauccuuugccuauuuuaaguuggauuauuggucuauuuuuguuuguuuguuuguuuuuaaagaagccaggucuugcuauguugcccaggcuagaugcuaacuucugggcucaagcaguccuccugccucagccucucaaguagcuaggacugcagacacaugccacugcagccaacuuaaaaaaaaaaauuauuuaguauaagaguucuuuauauauucuggauacuagauccuuauaauuugcagaaauuuccuuucauuuguggauugucuuuuuacuuucuugguaguguucuuugaagcacaaaauuuuaaauuuuuuugaugaugucaaacuuaccuguuuuuuguucuguuguuuguacuuuuggugucauagcuaagaaaccauugugaaucagaggucaugaagacuuacaccaguguuaucuucuaaguguuuuauaauuuuagcucuaacauuuagguuuugauaaauuuuguaaguauauggugugagauagggguccaacuuaauucuuuugcauauugcacuuguccuagcaccauuuguggacaagaccauucuucauugaauauucucggcacucuuguuaaaaucagaauauauuucuggauucucaaaguugauugaucucuauguuuacauuuguuuugguugaccaguuuucucuuacaagucuggccuucuuguuuuugacagucuugguucucuucauuguuucuuuuauugcagaaucuuccucuccuuacucugcuguccacagucucgaggguccuaacuuuuuuuuuuuucuaaaucuuucccaacucauguguuuucauacaucucuggcuuucuucucccgcucagaaaggcccuagcuugcaaccuuuaaauaauguacugugcuuaaucaaaggugaucagaucuuuugaccccugccuuuguaauuuacuacuacucucuucugggcucucacuguagcuuucugauccaucucucugguuagguuuauuguauguacuuuagauagguuaauccucuuuacuuugacuucacucugguugagggaauugaauucuguuugucucuggccuuucuacucccaucuucugcuucuucuaagcauaucccuuacuccucaguuagacuagauaauucagacuagauauuaugccucuaagccuaauuaauauaugaauuauauauuaauauauaauauacaagccuuauuguauaccucagcaugauaagugguucuacaaagagcauaaauacuggcauuacaaauccugacucugccauuuacuaguuagguggcagggauuuaguuaguuaaucuguauaagcuuuaguugcauuauuuguaagccaaggcuaauaccacuuacucucuaggugggugacagaauuuuaaaaauauguguagugccauagaguagauguuggacuuuuuuuuuuuuuuuuuuuugagacagacucucgcuuuguugcccaggcuggagugcaguggcgcaaucucggcucacuguaaccuccgccuccuggguucaagugauuuuccugccucagccucccgaguaacugggauuacaggcaccugccaccaugucuggcuguuugcauuuuuaguagagaugggguuucaccauauuggccagaugggucuugaacuccugaccucaagugauccaccggucucagccucccaaaguccugggauuauaggugugagccacugcacccagccaguguuggacauuauuauguuacuguuccuucugcuugaggugguaacucccuuaacucugcugcccacauccuuccucuccuuugagggauggguucauuucagaguaccaagccuuccauaaagcuguugcugguauucauuucuucccuaaacuaguuguuagugcuuccuccuuugaauucccaugacaccuuguguuuucuuucuuacagcuuguauguuaaaaugccacauaauuucuuaauggucaaauccaucuuuucuggauaaauuauuugaaggcagggauguuauguucagcuuuguguuuuggaaguggauuuguuuguuuuuaguguguaguaagugcuaaauuaggugaaguucugcuuauuauauagggucaacaucucuugcuuauucucucuuguuugguaguaauauuguuuaagacaguauuuauauauauauauuugagauggaguuucacucuuguugcucaggcuggagugcaguggcguguucucgguucacugcaaccuccgccucccagguucaagugauucuugugccucagccucccgaguagcugggaauacaggugccugccaccacaccuggcuauuuuuuuguauuuuuuuaguagagacggaguuucaccauguuggccaggcuggucucaaacuucugaccucaggugauccacccaccucagccucccaaagugcugggauuacaggugugaacuaccgugcccagccuaagacauuauuaauauauuuuuaaggcaaauaucucuuucugcauggcuuuucagauaaauucuucccugaguaaauaguuuucuucagcguauuuccagagcaccuuguucacaaggcuauuuaauuuuugggugcauuguaauacucuauaauuugugaacccuuugagaccaaaugccgugucuuaaccaguuguuaauuuuuugucucccuccuucccuccauagagcuccaguaggguaugcccuugaugugcgaugggugcucaaacauuuguugaacaaauaaaagaaugaaugaucuccaucuuuuaaaauaccagaagauacuagcauuaauguuacgaauccacauaaugauugccauaugucuguaucuuccugaagauguaagagagaagacuguguuagauccaggaaaaccuuuuaacuauauaauucauuggaaguuuuuuucuggccugacaaauauguggagcguaucuuuacucuuagaauuauacagugcuucuaagccuaauuaauauaugcaugugaggcaauuuuuccccccucuucugcuuguguugugcauccaaagaugauagcuaggagaaauuugauaggucuguugagaaauagcuagucuucuugaaagugccuuaaaaaaaaaaaauucagggaagacaugagagugugaauggguuuuaggcuuuaaugugaacugaagugggcuugcuuagccaaaggagggaguaauugcuuuuccaggauuccaaagauagucuccauagaggcccuauuuguauaaccaguggacaagacacaacacuggcccuuuaguugcuucuagcuguaagaaaagaguggcaaugggcacuguaaauaauuuuaagacacaaaugacagaaaguauaaguuucacaaguuucuaggaaauguuauaaauuauuuuuaaaaauuuuuuuaaagagacagggucuuguucuaucacccacgcuagagugcaguggugcaaucauggcucacugcaaccucaaacacaugggcucaagagauucuccugccuuggccucacaaagcgccgagauugcugguguaagccaccaugcccagccuauaaauaaauucuugagcucaggauuguauaaguuggauauuccuauaagcuauaguaaaaucuauuuuauauguuuuuagcuaguuuuuaaaaaauuauagauacaauaccucuucauuauagaaacuuuuuauaaguacgaaauguaaagaggccguguguaacccaaugauaacuauuauuugccuuuugacuccagucuuuccucuguauuuaaaaagaagcauacauuuaugauuucauuuguuucugcuuaacauuuuucauauauauaaauauuuucauaauagucaauuguaggccauaccauaauuuacuuaacuagaugcuuauugagcaugugagcuuuugguaguguucugugaaggaaaugaaugaaucaauggcugagcucuguauuuucacauaccagugagucucuguuauggcuguacacaucauguaguugggaugauuaaugaaguguggugguucugcauaauuguggcccuguuucuguauucuauggaugugagaguagauuuuauuagauauguuuuuucuccuguucaaaucuugaauuuuucuuuuuuuuggauacauauaaugcccuuuuuuuuuuaaaggaacauuauuagaucaaagggaaauauuuuuaagccucuugauauauagugccaagucacuuuccagauauuuugcuuucaccagcaauauaugaaggugcuuuuuuuagugauagcuauaaaacaaacaaaggaacagcaaacaacaacaaaaaugaaaacucuuaaacuaaauuugugcaugaaauauacaaaguuuggauuauuuuuauauuuuuaaaaauguagaucaguuauuugaguucauucuugcugaguuuguuuuucauucuguaaaacaggugauuugaugaaggcugcugcaggagaguucgcagaugaucccugcucuucugugaagcgaggcaacaugguucgggcagcucgagcuuugcucucugcuguuacccgguugcugauuuuggcugacauggcagaugucuacaaauuacuuguucagcugaaaguuguaaguauacaggccuaugucuguaauuuguucuaucacaggaagauugcuacuggccuuccuuaguucaguauuccuuaggauuuaguuugguuuugaauuugguuuaucucaauggaccagagauguuuuuguuuaauuuccacuuacuccucuauuccaaguauauaucauccuggcucuguucugagccaguguugucuuggcuguaaugaagaacuuguagcaaagauacuguuuugacuccuucccuuuuuccaguaaugauuaaauauuuuccuuguagaguucuggaguugagaaaccaagauacauuaaauuuuguacuuuuauuuauuuauuuauuuuuuccauuuaacccugaguggacacagcacauguuucagagagcacaggguuggggguaaggucacagaucaacaggaucccaaggccgaagaauuuuucuuaguacagaacaaaaugaaguuucccaugucuacuucuuucuacacagacacggcaaccauccgauuucucaaucuuuuccccaccuuuccccccuuucuauuccacaaaaccgccauugucaucauggcccguucucaaugagcuguuggguacaccucccagacgggguuucggccgggcagaggggcuccucacuuccccaguaggggcggccgggcagaggcgccccucaccucccgcacggggcggcuggccgggcagggggcugacccccccaccucccucccggacggggcagcuggccgggcagggggcugacccccccaccucccucccggacggggcggcuggccuggcgggggcugacccccaccucccucccggacgggguggcugccgggcggagacgcuccucacuucccagacggugugguugccgggcggaggggcuccucauuucucagauggggcggcugccgggcggaggggcuccucacuucucagauggggcgguugccaggcggagggucuccucacuucucagacggggcggccgggcagagacgcuccucaccucccagauggggucgcggccgggcagaggcgcuccucacaucccagacggggcggcggggcagaggcgcuccccacaucucagacgaugggcggccgggcagagacgcuccucacuuccuaggugggauggcggccgggaagaggcgcuccucacuucccagaugggauggcggccgggcagagacgcuccucacuuuccagacugggcagccaggcagaggggcuccucacgucccagacgauggguggccagggcagagacgcuccucacuucccagacaggguggcggccgggcagaggcugcacucucggcgcuuugggaggccaaggcagguggcugggagguggagguuguagcaagccgagaucacgccacugcacuccagccugggcacuguugagcaccgagugaaccagacuccgucugcaaucccggcaccucuggaggccgaggcuggcggaucacucgcgguuaggagcuggagaccagcccggccaacacagcgaaaccccgucuccaccaaaaaaauacgaaaaccagucaggcguggcagcgcacgccugcaaaucgcaggcacucggcaggcugaggcaggaaaaucaggcagggagguugcagugagccgagauggcagcaguacaguccagcuucagcucggcaucagagggagaccguggaaagagagggagagggagaccguggggagagggagagggaggggaagggggagggaauuuuguacuuuuagaggccaauauuaguguuuuucccacuaugaagcuccuguguaauugcuguuuaaauguuagaagaccaugcgcaaacucgagagcuaaguuuggguugcuuuuugaguaguuguuaacaggaaugaaaauuccuaggaugccaucuucuuuacagaccuacauucagaauuuuuggguuuuggggucuuucuuauuuuauagguggaagaugguaucuugaaguugaggaaugcuggcaaugaacaagacuuaggaauccaguauaaagcccuaaaaccugaaguggauaagcugaacauuauggcagccaaaagacaacagguacagucaugauuuggggauauauuaaaguuguucauuuuacuaucuagagggaaaaacucauucuguguguuuucugaaaguaccauuacuuaccuucgccaauauaguuccauuaaaacauuuaaacuaaggugucuuuucaguauugugcuguuaauaaaguuguaauuacauugcauucauguuaugcuccuauuuuaauucuugugaacauuuuaucuuaaguagcuugacaacuugugaugaagguagugucuggagagguaauaggucuuuguguauuuaaggauuaaccugaauuaguggugcaguuuuguucagauuuuuaauaaaaucuuaauccauuuaaauauacuggaauuaucucuguaucagaaaguaucuccauaccuugccccaccagccccgugucuuguuacuuuuuaacuguuucuuauuguuauuaguauuuuccauuguguggcaugaggaucaguguuaacuuuuccaagcuccaguagcccuuugacccuucggcauuuucacuguuggugugcuuugaaacccuuccugugcccuugcuguuggacgcuguguauuucagguguauauucuucaaggaagauccauauauugcuauccaucuucuuauaucuuucauaguccugaucaagcuuacgcuuuacauucuuacuuuaaaacaagccccaagaagaauaguuguuguuagcuaguaccuuuaucaguuaggauacuuugcacuggaguuugcagaaaacccagcucccaaacugcuugaaaaaugggggauuuauuuucucauuaaguauaaguccugaguuaggcuaagugacuucaggguuguuaaauauaagggcuuugcaguaucaucaaggauccagguucuugauauuuuucaucacuaucgucuucagugugccuggcacuggguggcugcagaggcucuuugcaugacaucugcacauaauauguccagugagaacaaaaaggacuguuccuuccauaugucucucuuuauaagcaaacaaucuagaagcuccuaguagacuuguccuaaaucugaauugugcaacaugccuauuccucaguuaucccuggcaagaggaaaggagucugccugacucagaauaauccagauccaccuucugcucuggguuaagggguagcuuuccugaggacagaaacacccgacaaaaggucugacagguaguagaaaguuggguugggaguagugggaguagggaauggauuuggguaggcaacgugcuaugacugcuauagacuuuuuucauuacagcaagaugguugucaguaaacacauaaaaaaauuuuuuuugaggcaggagaucucacucuguugcccagguuggaguacagugguggcaucauguaaccucgauuuccccaggcucaggugauccucccaccucagccuccugaauagcugagacuauaggcacaggacaccacacccggcuaauuuuuguacuuuuuguagauacaggauuuugucauguugccaggcuggucuugaacuccugggcucaagagauccuccuaccucugccucccaagguacugggauuacaggcaugagccacuguggcuagcuaaaugcuauuaaagucuaauauaugacagcuucuuuucugggggcuucuuagucauuugguuauauuuacauuaguauuaaaaaucuaugccauaggguugagaggauucaaauaaauaauauauguacaguguuuaauauagugccaggcacuaagaaggcccuucucaguaggcaguuggugaauaauaguuuauugcuuauauuucaagucauaagaugugaucagacuaacuuauauaugagauccugguuuugcauuucuaguacuuaagauuauacaugguaauauagcuagguugguauacccaaguuaguguaggcucagugugcuuuuuuuuuuuuuuugagauggaguuucgcucuuguugcccaggcuggagcgcaauggugcaaucucggcucaccacaaccuccgccucccggguucaagugauuauccugccucagccucccgucagugugcuuuuauaauuuauuuuuguauuggcuuagucuccaucauauaaauuauaaguaucuuuucuuuuugcuggagcuaauugauccugagaagaacuuguuuaauagaaugguaauccuauaaauguggcaagccggccaaauuacauucacaauuuauuuuaauuaauggguuugauacaaauucucuuuugaauaugugaaguaaauauuaaguuauauuuaaaagauacaauuuggcaaauaguccuacugguuuaaaacguagucugagcuugguuuaugaagacugacuguuauuuagacaaaauaaacauuaagauugccacuauugugcaucauugcaaaauggcggaauaaguaaauagauggguuuuuuuuuguuuuuuuuugugguggacucacauucugucgcccacgcuggagugcaguggugcgaucucggcucacugcaaccuccaccuccuggguucaagcuauucucuugccucaggcucccgaguagcugggacuauaagcgccugucaccacacccagccaauuuuuguauuuuuaguagagacgggguuucaccaucuuggccaggcuacucuugaacuccugaccuugugauccaccugccucggucucccaaagugcugggauuacaggcaugagccaccacacucugucuggaauuuuguaugcuauucaagaaacuuacuagaaaguaaugcuaccugaguuguuuuuuuucuuuuuuccaaagccaaauacuucucaaugccuaaguuuuaauaccauguuccauggaucugugaagaguuccuugaacauaaucccuuauguauuuuuuucauguguuuuuuuuugaaaguaguagcaaaugccaaaguuuucugaaauaagaugucacagaaauauuggaauuauuauauacaugcuggauaaucuucuguuugcccuuccauauuguuucccacccuuguuuacccuauucucugccccaggaaccuaaccugccuggauuucauuugugggcuccugcuugggcuuggugagugggagcaccagcaggaggucaaaggagauagagugaugcuaggguguuacucuuaggccucuuuccugcugggugcccuggguugcuaaaagugauggcauucucuacacaucuugcucccugguuuugguaacugcugccuccucuugucccuucauuccuaaguguccuaccagcuuuguaguuuuucuguauuuuguccauaccuauguaugauaguauagucucuaaacugccuuugagucacccgauuugauuuuauucuauuuuuuucugccagaauuuugaaugauacguauucgcauuuucuuggguuuauaguaagucaugagucauuuguaguuuuccuugggccuaaguuuuuagccuuagccuccugaaagagaauucacugaguagacugguugugggcuccuguguacccccguucacaaaauggucuuuuauaggcuugggccuugguguauauuccaguagacgaaugcuuuucuuggaaauuaaacaaauacuaauuuuguccuaagggcccagccugauggaaacuucauuauuucuuuugggcacuguccauuggccuccuucaguagaauuuauuccuccuauuuaacuguauauuuguaucugauaacuaaccuuuggcuacccaccucuccgcacuacccuuccucacuucuaugagucaacuucuuaagcuuccauguaagugagaacaugugguauuuaucuuccugugccuggcuuauuugacuuaccauaguguuuucugaggucauccauguuuccaugaaugacagaauuuugucuuuuuuaaauggcuaaauaguauuccauugugaauauaugccacauuuugucuguugauggacacuuagguugauuccauaucuuggcuauugugaauagagcugcaguaaacacaggaaugcaugucucucuuugacuuacugauuuccuuuccuuuggauacccaguagugggauugcuggaucauaugauuggucuauuuuuaguuuuuugaggaaauuccauacaauuuuccauaauggcuguacugauuuacauucccaccaucaguguauaagaguguuccccuuucccugcauucccaccagcauuuuuuuuccuuucguuuugcuaauagccauucuaauuagaaugagaugauaaccucuuggagguuuugauuugcuuuucucugaugauuagugauguugaggaucuuuccauauaccuguuggucauuuguaugucuucuuuugagaaauguauguuuagcucauuugucuuuuuuuuuuuuaagacagaguuuuagugugucacucaggcuggagugcaguggugcaaucucgacucacugcaaccuccacuucccaaguucaagcaauuccugucucagcuuccugaguagcugagacuacaggcaugcgccaccaugcccagcugauuuuuguauuuuuaguagagucagguuuucaccauguuggccaggcuggucucgaacuccuggccucaaaagugauccaccugccuuggccucccagagugccuggauuacaggugugacccaccgugcccggcuacauuugcccauuuuaaaaucagauuauuugaguuuuugcuguugaguuguuugaguuguuuguauauucuagauauuaaucccuuaucagaugaauaguuugcacauauuuucuccuguucuucagguuggcucuucacucuguugauuauuuccuuuguugugcagaagauuuuuaguuuauauaauuccguuugucuguuugaauauaacauuccauuuuuuccuggccuguagcguuucugcauagaaaucugcguuauucuaaugggaauucccuuuuaugugacuugaugcuuuucacuugcugucuuuagaauuuuaucuuugucuuuugacuuuugacaauuugacuauaaugugccuuggguguauaacuacccacuaauuauaacuacuuuuuugauucaaucucuuuggggacuuuuugggcuuuuuggaucuguauguccauaucucuccccagacuugggaaguuuccagcuauuauuuaauuaaauagguuuucuaugccuuuucuuuucuccuucuggaauucccaugaugggaauauugguugauuuaaugcuauccuauaaguuuugcaggcuuucuucacucuuuuucauuguuuuuuguuuguuuguuuuuccucuggguaauuucaagcuaccuaucuucaaguucugagauuuucuuuuucuuggugaaaucuuuugaaacuuucuauuguauuuuuuauugaauucuucguuguuuucaccauuaaauucuuuagcugcaugauuucuguugguucuucuucaugcauucuuuuuguugaauuucucauuuacauccugauuuuggugaauuuucuauuuguauuuuauuguaucucuuugagguuccuuaagauaauuauuuuauuuuaucuuuuugagacagacuuucgcugucaucuguugcccaggcuggagugcaguggcaugaucuuggcucauugcaaccuccaccucccagguucaaaugauucuugagccuuagccccgucccugcgcccccgcccccacaaccaaguagcugggauuacuggugugagccacugcaucugggccuagauuuuaaauucuuuuucuggcaguuuguugauuucccccuuuuuuuuccuuuuucuuuuuuuuuuuuucagacagggucuugcucugucgcccaggccagagugcaguggcauuuucucggcagucucaagugauccucccaucucagccucccaaauugcuggggcuacaggcaugccauauccagcuuuuuuuuuuuuuugggagcggggguggguagagauagggucuuguuacguuguccaggcuggucccgaacuccugggcucacacugacuuccuuuuuauuggguucuaguguuaaagaguuauauuccuuucuuggugucauauuuacuugcuuucucauguuucuuaugucccuguuuugaugucugugcauguggugggacaaucaccucuucuacagucuuuugaauggcuuuuauagagacuuucccuugcaguuggauuuuagugugcugguuagggaguguguguuggcucuguguccaguaggagcaauaguacagucuucgugcagcuucuucaccuguguucaacaucagcaguaacuuugggugccucaguugccuaggcuguagaaguuugugguaguuguggcagucauguagguccuuggugucaaggguuuuugggguccuccucuucuuguuuuucucacaguagggagacuuagcugacugggucccugguugugucagguaugacacaguguacgagcagcuacuguggcacuggguuccagguacaggugcucgcgguggcuguggggcuggggucccaggcucaggguuuugugaacuuacuguggcaccuggaucuugggauguauugagugccuggcuuuguucucuauggcagaguuggaugucaguugcccauaaagccaggaucugugacucugaggcaccccaguagcuuuggcccaggggccuagguugagguuaugauucuuuccuuagggggcagggcacagcauuggcgugauugggaagaaggggugcucuggagguuugggcccagggagcaggguguauguagcuacaauuugggaaccugagccaauagggcucaguggcaaguuggagccuagaggaugaggcaccaugcaguaaugacucuaggcccccggaugguggagcuuggcaguauccuaggcucugugaagccaggugcaacagcagcacauaucccagaauggcagagcacagcuguugugugggcccuggggaggggagggaacagcacagcgauuacucuacucugcaaggagaggagugucucagcaguucagacucuagagaauccagcuuuagggaaacagaauacuagaguuguuuggccuguacggcgaaugucucugcucagccacuguucuguuucccuuggaugcaggguacuaugucggcucagcccugggaugcucagcugguuuagggcaccaguuccccaggggcaaugugcugcuucagcgcaggccugaggggcaugacuuuucuggacaguccaggcacugauuccuugggaugcagggcaccacuucugcuaaagcacuuggaugcgugacugcucugggugccauuuccuuggauucagggcaccgcuucaaguugggcacuaguguggggugacuccucuaagcagcgaagguacuguuuucccuggaaggggagugauauuguuuggauuuguguccccccccaaaucucgugucuaauuguaguccccaguguuggaggaggggcaugguaggaggugauuggauuggcggggggcgggggggugaguggggggauuucccccuugcuguucuugggagugaguucucacagaucugguuguuuaaaaucucccccuuugcucucuuccuccugcucucgccauguaagauaugauuccuuucucuuugcucugugccaugauuguaagauuccugaaccacccaccccccgcccugccccccaccgccagccaugcuuccuguacagccugcagaaccaugagccaauuaaaccuguaaagguaguccuuuauagcagugcaaguaugggcuaauacagggagagaagagggguagauggaguggcuuccucucuccuuggccccaugaguaaggguauaacaguugcuugcagcuuggggaugucuggccaauugguugugauaguuugguggugacuuagccuuggggaugaagggaagcuguggccgcucacacuaggagcaagacacacuccagccaugguuccauuuccaagaugguauagcacaguaguugcaugggcuguagagggcaggucacagucucguccccuucuuggagggagcacagcaauguggauucuaggcaggucccucagcugggccuagugccuaugagaacugcagggacaguggugaggucuguauguguccaagguguugauggggguugcugaaauccucuugcuuaccuccucgaaguagggagguuuguccugguucccgggugauccugguugggguauagggugguggaggccugguguuuccuucuguuuuccauguggccagccugagauuugucaccaggguuucuguaacuccucugaugcgcuuuggcacucuaucucaauuauuuuuauuaaaauguaguuguuuagucguuguuuuggguguuguuuugaggggggugaaugcuaggagcugcuaguuggccaucugaugucacuguuuuaaacccuuuguaaacauaaacucauuuaaucuucacaaaauaaugugagguagauacuauaacuggucgcauauuaauuguaauagagguuacguaaucuugcaaggucacucaucuaacaaaugguggagccaggauuugaaccuagguuguuuggcaccagaggacagagauacuguguuuuaauuguuccuauaaucacugcugucuagaauauugccuggacauagugguguucaauaaauauuuguuuaacaacugagugacugaaccacuuugcuguacuggaauuggauucuaagugugacgccaaucaguuacuuucuaauuaaguguggcuggaauauuauuugcugacuagaaguguugaaucuccauuagcugcauguuguucuuugacuguaaguguaaaauugauggcagaaguaaggauggguuggcaucaaccuuagauccugugagaaggaccacuucugccucauauugucgacucuggcuucccaacaugcuagugauguaauaaugcuuugaugcuuacauucccuccaucugugugcagagagcuuauugagguauuugaugauaauguaaugcuucuuauuuauuaccuagucuaugaauucuugccuuuugugauuauuuuuuucugaaaacuuggacacugaauaguaauguuacugucgguguuuuauuuguaaauacuuuggacugguuggauuguuugaccauggacccuuuuuuuaaguguagccauuuguauccaagagaaaucuauggcuauaauuuuauauuguuaagagagaaaugagaggaaacuuccacuugaauuuucagcucuugguuagaggcaguguuauagauugcuuagaaguuaguuucuauuuuuuggucaguccaugggauaucauucagauuacauugaaagcaguucuuuguuccugagucugcuugaaccaucacuggguuggugaaguuggggauuaugaaagcuaaaguagaccaagagacucuaguuuuguaaauaaucuauuauguugcuuaauaggucacuuuccucaguaaucuggauuacuuauuggcauuauauaucuugaaaagaguacuuuuaaucauuauucuuauuacaguaaauagugcuguacugugauaguguccguuuucuuuauguaacaaaaucuaauuucuuugugcuaaggcaagagcaguucuaaagagagaaaaaagaacacuuuagcagucaggacaaaugaugguauuucguuauuauuuucaucauagauuaaaauauaucccucauacuuuguaaauaggagucuaucagagauacacugugauaagggcaagacaauuagaaaauggcacacagaacauaugcaccagcuguuuaagcauaaugguuaacccuagcuccuugucauaacucgagucuugaaaugaucaccaauucucuaaauccacaggaucuuguuucugaauauuuagccuaauguagucuuuggaaaaguagaaguugguaauaccauaccaggcaguggcuuaggaaagucauguguugaauaguaauuauggcaccugcuaacuugagaugaccguaagugucuuugguaacuaaccuuuauaagaagcuaugcugaucuaggucauagauacuuaggaggaaugccaaagcugauugcaaagcauuuuuauaaaacgguagacaauuuaaguacuuaaaggcaaaugccuucccggaaaacuuuuagagccccucagauuguggugaaggcaagacauuuagaaaaugccacacaaaacaugugcaccagcuguuuaaguguaauguuuagucauagccccuuguugcuugagucuuuaaaugauaacugauucuuuaaaucuacaggguccuguuuuugaauauuuagccuaauguacuguguuacagggcauuuggagugcugugagcuauuacuugcaaauuuagauuccaaaugagaaaagaauucuaggaggaaaaguaagcugucauguuauacaagguuugaauaaagaugcaaaccuaaauauauacugagaugaaguuucagaaaaaggaagccaguuuggugucucuaaugccuaauuaggaacucaucuagaaagaugaaccacuaaauagcuaagucagauggcuaauugaguaauugacuuuguccuuucuaacuuggucaauuuucuguuacuguuuacacauguaauacucaaaauguuuaaauuuauacucuaggauuuaguuaaugacauuaacauugacauuuuaacauguaaaauaagaguugggcuaccauuuggugauuauuuagaguuaucaccuguauucuucuucugugguggugauccauuuuuacuaaagccuuuuuuucccuucugaguauugugagugaaagagggauaccagaaauacccgcuucccauucccaucuuguguauuuuuggcaucacuuauuugucgcuuagcauaucuacucagccuaccaaguagaugccaucauuaguggaaaugaugccaaggaccucaaauccuucuuacuguggauuauaauuaugggguagaagaaaugaaaaaaaguaguuuaagaccguaucuauacagagucuuauaaucauagauuggggcuaugaagcacauacgccucaacuuuauggcuuacugaccugcgaacuguuuaauguacuguguaagaaaagugugguucuguguccuaaagugguuuuugggguggggagcgggagaggaggagauacgugcuugucagaacagccuugugauauccucaccuauuuauguaguucauacauaccuguggcauccugucccaaauuucacaaaacucuuacaauaaaauuauguaacuuggcugggcgcgguggcucacgccuguaaucccagcacuuugggaggccgaggcgggcggaucacgaggucaggagaucgaggccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaaauuauguaacuugauaaaaaauaauacucauaauaagucuuacucuguuugacuguaucucuucaugaucuuucuaucguugguugguauagguacauauaucuauauagaguuguaaucaagaugcuaggcaguuuguuuugucuuuuauuuaaugccuuauuuagugcugugcuaaguacuuuacauacauuauccgauuuaauccucaaaacaaugauaagaaagguacuguuacugcucuucuuugacagaaggggaaccuuagcccugaggguuuaaaauaaggucauaaaauagccaggagaaaguagaagugggugugggguggauucagaucuaggucugugugauuccaaagcucagaaucuuaccuaccaaaccauacugccuucuuugugauugacucucaacuagauuguuaaugaaaauaaugugucuaauuaauagaaauucuaacuuuucagcauuuaccagcaaauuuuuauaugaguaaagcccauauaaagagugcuccaauuucuuguuuuauuuacucuuguaggaauugaaagauguuggccaucgugaucagauggcugcagcuagaggaauccugcagaagaacguuccgauccucuauacugcaucccaggcaugccuacagcacccugaugucgcagccuauaaggccaacagggaccugauauacaagcagcugcagcaggcggucacaggcauuuccaaugcagcccaggccacugccucagacgaugccucacagcaccaggguggaggaggaggagaacuggcauaugcacucaauaacuuugacguaaguuaugcuuggguggaaauuuccagcucuugaccaucccccaaaagauaacagauuucuggggaaaagugaucaaggcuucugaugauagcucaauuuccacuuagaucuuuaaucuaagucaaaagaaauuaugaaucaucagucuacuugauuuuaacuuggccuaaaacauuuauuuuuauuuuuguuuuuaguuugaauuaaacuucuggauucuuuuauguagcuuguguuuccuaugaggucauucuuuacugaggauauggguuugguucauuucaaccaagauuuugaccuucuggcagaugugaagcuaugguagauacagaaacuaaguacacguagggucagcccccuagaggcucguggucuauugggagauagagaaacaucauaagugacugcagcaaaaguaccaucauucuaaucuuucuugucugccuagauauacuucuuuucagugacuaaauuggaauaaugaacagaaauuuaaucaaguggaagcaaauuugggauuaaaauacuuucuuagcauaaugccauaauuacuuuucauaaaugaugcgcuaggucuguccuguguacacaacucuuaagguuaacuuuuugguggguuauguguucuuaauuccuacccacagugccucuuggcuuccaguagauggcagcaguauaaguuuuuuuuuuuuuuuuagggcuuuaaaaguaacuguuggggcuaauuaaaaaaaaaaaaaacaaaccaaaaaacagaaauuguguuccaggugaccagcauccuuucauaaaguagggaugcuaugaaauauagaauaaaaaaaaauuacaauggagugcauuuuguuuuuaaguuuuuccuugccuuuaccuuuucuuucuuuugccacuuuacuuucgcuuagguagcugauccuuguugauaugcauggccgauuuaagacuuuuucauaaagcaagaaggcaguguuaagucuaaagaccaugguguuagaacucaguuuuuaccauggagcuuuaaacauuaaauuauuuuauaacaaacucuuauggugcauguuaaaauuuacuagcaauguuguuuuuccccccuucaaaauuuggcaguauuagguaucuuucaggguaguagcacauuuugcccuaaguugaguaauaucuaccagaagcuacuuaacuucucagggacacagguauuuguaaaaugaggguuugugcuaaaugaucucaggcucauugaggcucuguuacucuauuaaaauucuaugaccauucauuucucauuuuuguuggccagaaagcauuuuguauucaguuuugaccagagaaauccuguaauaaccuaaccuuacaaaaaaugaucagcuaaaauguguagguuaauaaugaacugaagguauugcauguucaguuugaaaacugaggguucuuuggaagggaaggaagaaauguauacuuauuggaaaagggcaagguuuugguagaaaaaauuuggcauuuaaguugaaaucaauaaggacauagucucuguaaagaaaaauuaaagccauaauauuugcacagacauuuaucagggugaggauaaauuauaucaaguggaggaauuggagggaggccaguagcugcugucuugaggaugccgauguuucaccuuguaccuauagcuuacuugugaccagaccucacuaaaugcuagaaaagcuggauguaaguggagucaggagggaaggggagacagaaaaaggauuuauucuuauuggagcaguucuuccucacagcuuagguuuuugggaggauugcuaucaucucuuacagaauacuagaggucuuugaggaaaggaagucucuaauuuagacauaacaggauaaauuugagacugaauuauuuagaaaacuugauuagauguguaagaugaggcaaauagauggaaauucauuguaaaugcauuucuuucugaaacuuuaagguuagagaucaguuuguaugugugcgcacacguguauauauuuuaagagacaaagucuugcucuguuacccaggcuggagugcaguggcacaaucauagcucacugcagccuugaacuucuggguucaagugauccucccgaguagcugggacuauaggcgugugccaccaugcccaacuuauuuuauuuuuuuguagagacagggucuugccucguugccuaggcugguguucaacuggccucaaacaauccuccuucaaucucucaaaguguugagauuacaggcauaagccaccacaccuggcuuguuuggcuuuuauuuuuuaauuuuuuuguggugcaacaguucuaaauaucacauggcaguuuuauauucugcaaguaagagguaacuuuuauuuuccuuguaauucucaucugaugauuugaauugcuagucuuauacggguuuaccuuuagauguucagaauaaguugugugagcaugauauguuuguauuugugguaucauaccuuaucaugccuuguuuggcuacauagcauuacuuccacugcuuucuuugaggagugaucaacaguaggccaucuucugugggacagccccuuaccugcuaagaaguauaacuuucuuucagauguuggaauuuuuguguuaaaucuugauauuacuaauaacacuuuucucaccuugaauaaagaagggaacagagaugaguacuaacauucgguaauacuuucucugcagaaacaaaucauuguggaccccuugagcuucagcgaggagcgcuuuaggccuucccuggaggagcgucuggaaagcaucauuaguggggcugccuugauggccgacucguccugcacgcgugaugaccgucgugagcgaauuguggcagaguguaaugcuguccgccaggcccugcaggaccugcuuucggaguacaugggcaaugugaguuugacagcuuuucuuugaaguaagauauuuauggaugaggaguuuucuauaacauguuggaucugagauguuuucacuauaaauaccaaauauguccuugacuccuugauuuuugggaguaggucagauuuuuaaagaaauggauaaauggcuaaguggcucuuuccucucuccagcuuauugagaaauuuucaacuuauaaaaaucauacagugaauaccuaggaaauuuaucuguauucaucaauuaacauguagauacauguguagguguguguauauauaaauguauauguauguaugguauauacacaaacauccuuuuuucccccgaagccuuuggaagaaaguuguagacauugugaugcuucaccucuaauauuuuagcaugccucuccaaagaauaaugaccuucuauaccacuaaaguuucauuaucccaaguagguggcuaauuuugggcaaaagggaauguugaaaaccugccuccucaauauuuauaguugugaaaguuuuuucgugaaccauauugaaugucacaagaguagauaauugccaaguagaguuacauaaagcaaacucuggauaguguuuuugaauuuugaagguuugugcauaaaaacccaggcuaugaaauuugauacccacuuuuuuuuuaaaaggccauagaaaauucuauauuuguugauuuuucucuguugccauaugucuuucuuuuuuuccuucgcuuauacuucuucuauucugguuauuuaaugcuagcuuaggguuccugucauuuagaccuuggacccaauauuuuacuguagcuaauuagcaauaaauuaaguaaaaauuauaugaaaucauuuuaaggggaagaaggacaacaacacaaauuaguugucaucacuagcguuuuuuaccuguuuaacaccuaaaaaaaagaucuugguucuuucucauuuguucguuugccauacaucuugucuguucacuuacaggccuguaaaaguuaaugggugaugguaaaucaugguggaauuccuagggugaagaugaaugccuuccucuguuuaucuugucucuaccauacugugaaauuagugaugcauauugaauuuuuuuaaagccauugcccccugggcaugaugguucaagccuguagucccagcguuuugggaggcugagguggguggauugcgugagcccaagaguuugagaccaucuugggcaacauggugaaaucccaucucuacaaaaaauacaaaaguuaacugggcaugguggcgcacgccuggucucagcuacucgggaggcugaggcggaagaaucgcuuaagccugggagguuguggcuacagugaaccauggucgcgccacugugcuccagccugggcgacagagcgagagugucucaaaaaaaaaagccauguuuugauuauaggcagucuacuuaagaaaaaugagauuagagguuuuguuaaaucaaauggaaaaagugguuuuuaagucacagugaaaaugugggacacauuuaaaaauccauagcuaagauugaacauuagaaaauauuuuaaaagauggauauguugcagaauggcucacaauguugcagucuuaaacaggggaacaaaaacucaugguaaguggaucagucaucugcuaucauggguagugcuggaaaugguguaaaagugucuuauguaguuaugaugaggaaaucacuucaaaaacagacuuuggugggaaggaggaugugauaaaucuguuccgauugcuccguuuuagagccuccuaaucagucuauaagauaucccuugagucuugagguuggucacauucuugggccaaucaccccuggucaugaguaaccuugagguuucgaaaccuagagugccauacaaacaguacugucuauucaugccaucaguguaagaaaaggugggaagcacucauuuauacugaagacauggagacugcaguagcauucuuaaaugaaaacuggaacaaugugugaugugaggcugaaauuugaguauuaugguagggaucuugaaagaaaucuuggccgggcacgguggcucacgccuguaaucccagcacuuugggaggccaaggcagacggaucacaaggucaggagauugagaccauccuggcuaacauggugaaacccagucucuacuaaaaauacagaaaaauuaccuguaaucccagcacuuugggaggcugaggcgggcagaucacaaggucaggagauagagaccauccuggcuaacguggcgaaacccugucucuacuaaaaauacaaaaaaauuagccggacauggaggcgggcgccuguagucccagcugcucuggaggcugaugcaggagaauggugugaacccaggaggcggagcuuucagugagccaagaucacgccacugcacuccagccuggggaacagagggagacuccaucucaaaaaaaaaaaaacccaaaaaauaaacaaacaaaaaacagaaaaauuagccaggcguggugugggggccccuguagucccagcuacucgggaggcugaggcaggagaauggugugaauccagcaggcggagcuugcagugagccaagaucgcaccacugcacuccagccugggcgacagagcgagauucugucucaaaaacaaaaaagcacaaaagaaagaaaucuucuugagauuuagaaauguauuuuaggagauggucucuggguauguuucuccuaaagguaaaaaucuuuaguuuccuuuuauugauucacguaacagugaacaggcuugguccugucaaaaagcacuggagugaggauaaacggugagggcaguggagcacacuugaagaaagcuuagaaugauaaaagggucuggaagaagcagaagcaacuggggauagauuuuugcuuauuuaugaagcauucaaaaacauuuagaaccucuagugagugucagaauauaaccagcaaugucugccugucagucaguucauucugaguaugugacacaugcaaagcaguguguugggcacaauguaagaggaggaaugaggcucugaucccucccuucuggaacagacaaaguuucuauaggggguuuaaugggagugucaucauagguacagccaaaaugcuguggaaauugcaaggagguugagguuauuucuaucugggaaauccaggaggcuuucucuucuagaagauuuauuuuguaaucuuuugguuaacuucuaucuugauuuuaaaaaaaugguucauuuuauuucuguugaaaaauauuagacaaauuauguuauguggagaauugaaaucaccuacauuaauuaauacuuguuuacuacguggaacuuuguauaaacauuguuguaaaguccagaaaggcucacauaauauucacuuuuucuguuucuuggauucucucauguuguuauuaauauuuuuauggacacacauucguaaagugucuucuuucuucguuuuguguugcuuauuaccagguuccacuggcuuuuucucugaggcagugauucuuaacuuuggaugcacauuacaguccuugggcaacuuugauguuucagguguaccccagaccaauuaagucagaaucucugcgucaagauccaagcgucaguuauuuuaaaacacuucccaguugauuccagugugcaacuaagguggaaaaacugcucugguaguuuauucuguuugucccuuucuguccccacugccauuaccuuacuucagugucuccucacuuucuccauuuuccacuuuguucugccugcccaggccaggcugagcuccugucuuuaguacuagggcauuguucauuauguucuggaaauucccuuccuaccuauguaaaccuaaucuacucuuucuucaggccccacauuuguuuuucaucucuuugcugaaggccauuucaaacuacaucaucuuacauuauuucuuuggugcuugaaguuuugugccuuauuguauacucccuugaauuguuguuuaauugcauuucuuuuauccauuuuauucugcaacuagguuuuuaagccuuuggaacaugacaacuccuuaaaaauauucauucauggucuaguauaaugcugcaagaggugcucaguaaaugcuugcuuaaugaacucaugcugguuuguaggaaugaauaaaaugaauaauuuuggauuuucauggugcuaaggagguaauagugugguggaaaaaaccaaagaccuuuacccuuaugggccuuacauucuacaguggaugaaggaggaggcugugugguuuauuucuacuuccuauuagaucuuucacuauacagaugacauuuguugaaaaaauuaaaccaaauacucuggaauaagcaauuaagugaaagugauaucuuagagcagaguuaaauuuaauucaucagcugagggccaaauccccuuuuaaaguuuccaagggucaggaggcuagcagccuuaauguuauugcuugcauagugguuugaugaagaguugguagguagucuuggcucuacaacuaacuuacuauacggacucuaaggaaauauugacauaaaaguaaugcauuugaccucuacuuacuuaacauuagggaaauaucacagacccaugacaguggagguuuugcgacccuucaguguauccuuguaguuucagagaugacuuccagguuuccuugaaaugaaaugugguuauugugguuaaguuuaauuuguuuuggcucugucagccuaaaguugcuuugccugugagagagaaaaacagcuuuggauggauguuauaaucuuaaaagguuuaaaagugaauggauugaaauuaaaaugaaauguaauuaaauuugaaaaaguuauuaccauuuuuuuucaugauugaaauucagacaugugcauuaaauuacuaaaauaccacuacuauuagcauuuagggauauauauuuucagguuuuuuucuuuucuucuucuaugcagagcauaaaauaacaguuuuaauucucucaguguuuucugccuauaaacaugaaauauccguagaacuagguuucagacuauuaaguuaauggguuaaaacagucugcugucugguuaauggguuaaaauuucuguuuuucaaauacauagcugacuugguugcccaguuguguguuuuaauguucucugaguuauuucagugcuacugagaaagacuucugaagggcucuaugcuuuauacagcugacuucuuuauuucaugccuuucauucugcugagggauaugcugacuguuaauauguuccuuucuccguuuuuuaaggcauguguuuuuccaauaguagaauuuauuggaacuaaacuugucucuguuaccauaccccccuucaacccugacuccucaaugaacaaauaagcaaaaccuacccuuuccccaaaaccuccaaaucugaauauacuuaauacaaugucugaaacauaaaggacccucagucuuugaaaugaacuccauuugguuuugaccagagcagucuugcccagcaggucauggucguguuugacugacuggcguuagggcuuauaauugguaagaacaaacacaugccaugggcuuaaguaguucuagcucucugcuauucagugugguagccacucaccauauguggcuauugagcacuugaaaugugacaagucuaaauugaaguuugcuguaaguacaucagauuucagaguuaguauagaaaaaagaaugugaauuaucucacugauauuauuuuagauauauuggguuaaauaaaaucuauuaaacuuuauuuuuaccuguuucuuuucacuuauggcuacgagaaaaaucauauuuacauugguuauauauguaucuauaacuuguauauauguuauaaaaauuauaugggugguuuauuucuggcuugcauuguaucucuguuggauaguucuaaccaauaaguaaccaaccagcuaaggugaguagaugagagguuaggaucaacuuuguucaauguccagaauggcaugguaguccaugcauaguagcuauuauaacuuguauucuuuuaauacuuaaaacuguaguuuuagauagaagaaaauugguucaauuuaggaccuuguaaggauaauguuucuuaaggauacauuuuaucuuuguucuugccugaaaacguuggacauaguaguuguaggaucccaaaagaagaaugcaguaacuggacauacuuugguuggacuggauguauauuugaggaauaugacuauguuaauacaucaaguauaaaauuuuaauucgauuuggguaaauuugauguggauuguaugaaugguaugcagcuaauguucauuuucaaagaucuuuugaaaagauauauuguuauuauagugaagugaagcacucaauuuagauguuaauccuuucucaguuuugcaaaugccuuccuggaaucucuuuagcauagccagagcuuuugaaggacucugaagagcuuguuacugcauuauguuguggcuacacuuuucuuuucuucagaauuagaguagcuuaauuuuuuccugauuauaaaaguucuguguucauuauauauuguccauaaucccaccacucauuuuuguguauaacauuccagacuuaauucggaucuguguauauguacacuuauaucuguucuuuucuuaccuuuucuuuuuaaaaauguuguuaguaaugauuguccauacuuuuacacugcuuaccauaugccagccauugugcugagagacauuuuauccccauaauaacccuauugaguugauaauugcucaaaaauacauauacacacaggugcaguuugagcucagaucugucugaccugaaagucugaacucuuaauacuuuuaccauuguacaucgucccaaguuaacaaauaugauuuuauaacaucuuaaugguggcagaguuuuccauuaaaauuaaauacccccagaacuaaaauaaauacuggaaucuaaauuucaguauuaaauuucuaaaauuggauauccuagacuaaguaaaauagauccaggucugggauagcugcuugaagugaguggaaugucacuugccucugugugaagagacugccaaacaggcuuuuugagagcaguaaagcuuuuuaaucaccugggugcgggcgggcugaguccaaaaagagagucagcgaaggguggcgggauuaucauuaguucuuauagguuugggauaggcaguggaguuaggagcaauuuuuugugggcaggggguggaucuuaugaaguacauugucaaggguggggagaauauugcagaguaccuucuuaagggcaggggaggauauuacaaaguacuuucucaaggguggggaggguguauugucacaaagucaauuuaucaguuaggguggggcaggaacaaaucgcagugguggaaugucaucaguuaaggcaggaacuggcuauuuucgcuucuuuuguggaucuucaguugcuucaggccaucuggauguauacaugcaggugacaggggauaugauggcuuagcuugggcucagaggccugacauggagcaaaagagcuuuuagaguauuuuccaugcuagacuggugguacuugagugcuguagcuguuuaaaugggcucugugguuugcagguacagaggcugaguuuuguuauacaguuaugguaugauuuccaucuuucuuugaacucuugaguuuucugcaagagaugcuuaccuaaauuaguaguccauaguucuguagaggcauuugaagauuauuuuauugaauuguuaguguaagcuuuucugugagcugccuaauaaacaggauuugggagaguuuauauaaguagaugaugcauugaaugcaaaauuugagccuguguaggacuugcuuuuuugacagcggcauuuauuuuuauuuuuuauuuaauaaauuuuauuuuuacuguauauguuuaagguauacaaggugauauuuagauauacauaguuaaaugauuacuacagugaagccauuuaacauaucuguuaucuuagaguuaccuugugugggugguaagagggccuaaaaucuacucucuuagcaaguuuuccaaauacaauacagugcuauugacuauaggcuucaugcuguagauuagagcucuagauuuuuuauuuacuuauuuuuugcucugucacccaggcuggagugcacugguacgaucacagcucacugcaaccucugcgucccugauucaagugauuuucaugcuccagccucccaaacauaauagcuggguuuagaggcuuguguuacuaagccuagcuaauuuuuguauuuuuaguagagaugggguuccgugcuauuggccaggcuggucucgaacaccuggccucaagugauccaccugccuuggcuucccaaaguguugggauuacaggugugagccaccauggcuggccaagaguucuagauuuauucauccugcauaacugcaacuuuguauuccuugacauaaguguccccuacucccaccauaugguaacccaccuuucuacucucuuguuuuuauuuauuagagaacauguaaaaaucaugcaauaguuuucucugugucuauuucacuuaguauaaugcccuccaaguucauccauguuguagagcagcauuuauuuaauuugaaaacacuuugucaaaaauuaauuugugauuuucuuacgguucaagauaaggaguuuaaaagaucuucauaacucugagaaagacaucuuaccccaguuauauuuguguugcuuucaaagagguuugaaguacuucccauuuaugagcuauccuggcauugcgcauugcaguauuuagcaggcaaguucuuaaucucuaauaccagaaagaugcauguuuauguauuuguugaagugaugcuggccugauggagcaguagugguuuugaaaucagaaugauggagcaggcauguaagccugcccaguguuaggcagcagguggauaggaguuuagccuccucaggauugcuguuagacuguccuuuauaucacuuugugcuguuuagccaucaagcaggguugaaaagacuucauaucuaaaguaguauuucugaauuaacagguaauaaccucuaaauauaucagauuauuaguaauuaucucuagcugguggggcgaugggcacuauaaauuuucuuugauauuuuuucccacauuuaaaaaaaguuuuuuauguuguuaaugucacaaaguuuaaaaaacuuagaccguuagauuugcgugucuuagauuuuuagguuuuguuuauaaucauacaccguguucauuuccaaagcacuauuaauauggaaauuugaugguuuuucacacauuaauauguugauucguccuuucgagguaaugauucauucaggacuaguuuggcuaaagugguuaguuugguuuuauaaaaaauuauaguauacauuucuaucaagucuugaagugagacucaauuaucucucugugauagcauuugcuucauucuuuucuugcaguguauaucaaagcgauuuuugaccuuggaaguauaaaauugugaagguagaauuuggaagugacguucguuaucauguggucuagggguugacaaauuauaguucucaggucaagucuagccugccacuuauuuuuauaaauaaaguuuuauuggaacacagccauacucauuuaguuguuucuuccuucuccuccuccuccuucuuuucuucuucuuuccuccuguuccuccuccucccccuccucuugauccucccccuccugcuccuucccccucccccuccucccuccccucccucuccuccccccccuuuccccacuccuccgucuucucuucucuucuccucucuccucucucuucucucucuccucucuccucucuccucuuuuugguuuuguuuguuuguuuugagacagggucuuauucugccacccaggcugggacugcaguggugcaaucacagcucacugcagccuugacuucccaggcucaggugauucugccaucucagcuuccccaguagcugggacuagaggugugcaccagcaugccugacuaauuuuuuguauuuuuuguagauauggggucuugccauuuugccaaggguggucucaaacuccuggacugaaagcagucugccugccccagccucccaaagugcugggauuacaggugugagccaccaugccuggccaaguaguuucuaaagagaccgcauggccccagagccuaaaguauuugcuauuugguccuuuauagaaacuugccaauuuuuaaucuguuucaaucagcuccccaguagcugggacugcaggugugcacugccaugucuggcuaaguuuuguauuuuuaguagagauaggguuucaccauguuggccaggcuggucucaaaguccugaugucaaaugcuauacccaccucagccucccaaaguucugggauuacaggcgugagccauggcacccagcccaaccaauuaauuuuucugaagguuuuaaauuauaaauucaguuucuucaguagauauaaaacuaaguuauguauuguuucuuggguaaauuuuggaagauuguggcuuucaaugaauuaguucauuuuauccacuuaguugauuuuguacgcauggagauguuuguuguaaucucuuacuauccuucuacuguuuagcaucuguagcaguauucucuguuucauaacuauucuugauaauuuguuuuauuuuuucuuucuuugucaaucuggccagaaguuuaucaauucuagugaucuuuugaaaaauccagcuuuggguuucauuaauuuuuuuuuccucuaauacuuccaauuucaucuguuucugcuuuuuauuuauuuauuuuucugucugcuuauuuuggguuuauuuuauucuaucuuuacuaguuuccugaggugagaacuuagguuauugacuugagaccuuucuucuuuguguaaagauauagugguauagauuucccuaaucuaagcccugcuuugucugcauccgauaaauucugauacguuguauuuucauuuuaaaauuauuuuuauuuuuuuguuguuguuuguuuguuuguuuuuaagagaucgggucucaucguguuacccaggcuggucuugaacucuugaguucaaaugauccucccaccucggccucccaaagugcugggauuacaggcgugagcuaccgugcccggccuauauuuucauuuuuguucaguucaagauauuuuaaaauuuuccucgagucuucuucuuugaucacuggcuuauuuagaaguauguuguguaauuuccaaguauuuggagauuuucuugcuauguuucuguuacugauuucuaguuuaauucuaauuccauauggucagagaacauaaacuuugcaugauuucaauuuuuuuuaaauuuguuaauugagccuuguuuuaugacccagugcuaccuuuguaauguucuguuugcacuugacaaauaauauguauucugcuuuuuauuuuuuuuuucuuuuuugagacgaagucuugcucuguugcucaggcuggaaguauagaggcaugaucucggcucaagugauuucuccugccucagccucccgaguagcugggauuacaggcacccgccaucacgccuggcuaauuucuguauuuuuaguagaggugggguuuucccauguuggccaggcuggucucuaacuccugaccucaggugauccacccgccuuggccucccaaagugcugggauuacaggcaugagccaccgugccuggccuguauucuguuauuguuggguggagugaaagugucacuuagaucuaguugguugauggcauuguucuauagcuugcuguuuuuuuaguugggggaaagaucuaauuauucuaagaauuacugagauaagaguguugcagucuccaacuuuaauuguagauucgaccauucuuuauuucaauucuuggauugccacuccauguguucugcucaggaucuuuaguuacauucagugggacagacaggguggaguauauuuauuacauuuagccagaaccaaaacucaaccaguguuuucaaaacugagucugaaacuagugaaguguuaggccaugguuacacccauguuugaacaguuaggacuagaacuaaggcuucugauuuuuuaguccagagauacuccugguggugcucuucacaugugaugccauggaugaugagcaguaagcugauacuuccauagaauagaacuuguuaaagcuugaucaaguaauguaaucuccccagggcagcuuucuuggcuggaauuggggucauuaauagcugccccucuaacugaccuuguuaaaaugcacagagaaucucucaaguaagaccaaguaaaaccgugaagauggggauauaaugggugguguuauuaaaaaauaucaagaugccuuggaacaaaagaacagaaaauaaaguguagcaaagaauagggugaacagggaucuggauagguggggaccaagggacaugccuucugugacaggugcuuuauagcuuucugugucugcuccauugcuugcucucugccucuagcaaagagccaaaguggcagucuccauuuccagucugcaugauuuuguaguucaggcaucuaaucauagcugacaggucucucccucuccucucguguguuugugugugcaaugccauguuuggugugaacguaaaacuauaaaauguaugugcaaaugugcaaauugguguuuuuagggaaaaauauaauauaguuucuccuucaguuauucuuuuuggcccaaggaguaggcuuuacuuuuuggcaaaguugucauguguugauaauaaaaaaucgauuuauuaaaaauauugugauuguuuaaauguagccaauuaauaguugugggaggccaccuauuuaguuuagaaugcccauaugugacaaacauguaaaacuaaaagcuuaucaaucauaacuuucuacccuaauaguuuuuauccauucauuuuacauuuuuuuaaaauuaggugucuuagaggauuuaagguaguaaauaaaaacucauugugacuagggcaguuaaggauuaaacaaauuggguuuguguguucgguuugucugcccucaaacuagccauaauguuuauuuauuuauuuuuugucuuuaacccucuccuccccucauuaaauauaguuacauaaaaggaugccauucugcuuuucaugauggguaguucagguucugucaugagcauugaguuuccaaacuguccuugucggagacaggagauuuccuccuuucugacuucagaccugcuguguugaaaguugccucuuugguugauauauuucucagucauaaugccaacuuagaagggcacaagucuguggaauauguuuuuauucuuagaugggauuauuuuauucauuuucaguugaaucuuuguucauaucugaugacugcuaaugaaguccuugccagcaacucaauggcuugcuuauuuuauuuuauuauguuguauguauauauguauguauguauuuauuuauuuuuugagauggaguuucccucugucaccugggcuggagugcaauggugugaucucggcugacugcaacuucugccuccuggauucaagugauucuccugccucagccuccugaguagcugggauuacaggcgcccgcuaccacgcccggcuaauuuuuguauuuuuaguagagaugggguuucaccauguugaccaggcuggucuugaacuccugaccucaggugaucaaccugccuuggccucccaaaaugcugguauuacagacaugagccacugcaccaggccuguuuugaagaggaauauuggauauauagaaccaaagacuguugggcaccaauuccauuuggucauucucucaaaacugccauuagggcuuuuuguaaugucauaauuuggaaacauaaggaagauauuuccuuugaguuacuuuaugcugaaauaacaucuggucaguaaauauccuacaaguauuacuuucagauguuuugaaaugauuggccuccugcucugguuuuaaccccaguugaagacacuuuaauguuugcaguuuauaauaaucuaccaaguugaauacagugugacaucguauuucaaggcuuccuuaagggcuaaccguccuuuaaauuuaacacuggaacauauuagccugaauuacuucuccuugcuuugagagagaauuacugguuuuauagauucaaacaugaaagucaucuucuaggagugaaaagauuaauguuuuggcuugcccuugcucuugugucuguaagaauauugcuuacuauuuccugguauaaaaugaccugagauauuuuauuagaaaaauuauaccggccggggcaacauggcaaaacucuaucucuauaaaaauauuaagaauuagccgagcaugguggcacacaccuguaguuccagcuacucgggaggcugagguaagaggagagccugagcccgggaaguugaggcugcagugagccaugauggcaccacugcacuccagccugggaaacagaaugagacuucauuuuucacacaaagaccaguaauacugaacuguaaucuuuuaagcucauacuaauaaacacacuuguugccaggagcagagcauauuguuuauguuacuuugaagauucuguauuuuugcugaaaaauagccgaagccacuguauauaggaaaauuguuuguuuucuaaaauuggccauuaauauauacuauuuagugauuucuguugugauaaaggauccucucaccucccucaccuuuucaaaacugguuuuucuuaugccguuaaaguuuuucaguuaaggaaacagacucaaggcucuaacccauuuaugccagagguugcaaauuuuuuguuguggaaaaucagaccuugaugaugaccuugagcaguaggauauaaauagcucccagaagcuuagcguugcaguaauggaacaccaggccuaaauggguuaagaaauuuguuugaguuuucuuuuucaaagcaauauuaaauguuguagcguucagauaaaaauccaauuuuaaaauuaaaauuucuaaucauggcaguuaaaaaacaccugacaccauuggccaccucuuacuugcuuucuacagggcuuucauauuggccaacuguagagguuaaaaaucaaacuacucuuuucaacuagguuuuucuauccaaugcuccauuaaccauuuucuuaaaaccacucugaaccuggaauuacacuaauuuggggguuauguuaauaaacagcaauaauuguauauuuuggauuuaagguauugaucaagugugaauuauccuuaacccucaagauuugaacagauaugaaaguugguuuaggaggaaugguuacauacaagauaauuccuuacagagugagauguaugauuuguuuaaaaacauuccagcagaaaaaccaauggaaaggugauaaaugaaacaagaaagcagaaaguugaugauuuuuaaaguuugguaaugguuaagugagggaguucauuuaguauucucaauccuuuuggugguuauguuagaaaaaacucauaauaauuuuuuuuuuuaaaggacaugucaucaccaugaugguuaguugaguagguguuagcauguuagaugucugagagcacaguccuugccauauguacacccuucggagggcauuugcaugcuuugcaaccccuggaaggccuuguuuuaucccacucaguccucuucucacucuccauuuuauaggcuggcuggugccuaugcugauucuuaagccaauuagauucucuuggggauuuguauggguaaauaaugggaaaaugaugcaauuaguaauggaaacugaaaaaggaaaugaugccauuauguagagccagggucauaggggucuugacaaagugaacuuauggcugaguagcagcuaugaauuagauaggcagcaaagagggugagaaugggucaggcauuugagauuggagaaugggauagccagcuaagaggaguguccugggcuuccuguauggccgcuucuaggggcaguggcccagcuguacuuggguucuucuguauauguguccuugaaguaaaacccuuugucacuguauucaauuuggguuucuggauucccccaaaaggagucuacuguaguuacugaacagugcagaauuuucuuggcuaaauuaaaaguaagcacuuuuuuuagaaggucaaaagugaucauugccuauucaucuaggcauuccauugugcaauucuuaaggcuuuuuuuggagacuuggcccuuccccaaguaauuuaauuuuucuuuuuaaaccaaaguggaagcaaguuuguggaaagcaaaggaauaaagaauggccacuccauaggcagagcauuuuaaaaauuuaaaaauuuuuaaaauuuuaaaaauaaaaguagagaugggguuuugcuguguugcucaggcuggucucacauuccuggacucaagcgauccaccugccucggcaugcccaagugcugggauuauagacacaagccaccgcaccuggccccagagucauauuuuuaaaguucugucuuguauaguacgaaaccuuuugucucuuagcugcuugacuuuuauauaauuuaguagugauguuuacauuguucacuagacuuugauugaauugaauuuaauaaauggcaguaaucagguguuuuuugguggagggguuagcuugcugucuucagguuuccuaugcuugagaauuugccucaacacaauuuuagguggcuguaacacuauuuuguuggccaguauaauuuuagauuccucacuuugguuguugguuguuaaaagacauagggagcuuuguuugacucuaaaucuaccauugucugucucuuuccuuuucuuugguguucuuuuuuaggggacgaaaguaagaauugagaagaucuggcuuagauaaugcuaguaauggagauuuuaaaaaauuaccuauuauuuuauuauuauaaagcacuagagcaaguauagaauuauguauaguaaguaggauauacaaagaaagaaaagauuggcauucauuggcucuggggagugggcuaagguuaaaacaaagauuuagagucaaaaauuaauuagugugcaggagacagcaaaccucuuggcuuggugggaaugaaaaacuauuuaauaagcauaacuggcuagaagcagucuucuuuccccauuaguagguggcucacugacauuguccuagguguuugaaauguuuguuuuucucccuuuaauuugcuccuguguauaaaguuacugccgaaggagccaggacugaaucagacuugagcaauacggggcuuguggaaagagauguuuugaucauauuguuauuuuugugucauaaaaucuuagauuggcaacuuucuucuaggguggauuuagccuuugauacauuuucuuaggcccacgaaaaugagcugcuaaaguagaaaugaauaaaacuauucgguuuagccucuagacagugacacauuaaggacuaaugacugccaaaaggaaaugucaaacacuaagcuagucuacuuucuuuggcagcugagaauccggugaaucaacaguuuuaggggguguauauuuaauguggguggaggaagaaagugucuaacauucuuuaaggcccuguucagcaaaguuggaauuggagccugauucuaccuuucuaaacacaagaaagucacaugcuauagaaugagggugguuacuguuugucacguagauaguaucgacuaagacauuuuaaaauguguuuacaggcuuugucuuuauuuucauuuaauuguugguaggugcgaagcagcaugcauuugugugugagagggacauacuucagaguuuugauugccuuggucccccuuuucauaaacaggaauuaucugaagagucuuguggaagagaauggauaaaacugugauccuugaggcauaaggagcaaauuuagacugaauuucuacuaaauuacuguuaagaaaaggacaacaaauuuagagcuuuuaagcuuauaaccgaguaugauugccauguccuggguacuugauugccauguccuggguacuuaacaguuuagcacuuaaauauucacauauagauauagggucagggaaugauagcuaaaggguacagguuuuuuuuguuuuuuuguuuuuuguuuuuuugagacagauucucgcugucuggcccaggcuggagugaaguggcgcgaucacggcucacugcaaccuccgcccccuagguucaagcgauucuccugccucagccucccaaguagcugggauuacaagcgcccaccaccacgcccggcuaauuuucauacuuuuagagacagggucuaauuuucauacuuuuagagacaggguuucaccaucuuggccaggcuggucuugaacuccuggccucaggugauccacccuccucggccucucaaagugcugggauuacaggcgcgagccacugcgccuggcccaaggguacuggguuucuuuaggagaugauaaaaugcucuaaaauugacuguaguaaugguuguacauaucugugaauaaaccaaaaaaacauuaaauuguacacuaucaaugggugaauuuuaggugaccuauaucaguauauaaucuguaucaguagauaauuaucuuauauauuuguaaaauuauuuaaagauauuuacaugcguuucacaugucaguuugcuaaugaugugauauguauuuuaaauuauauuuccuguaggaguucaggcaauuuguucaucuuacaugaaguaaagaguauuuuucccauuuugaaacacggccugugucuguuauugccaccagaauuacauggucuacauuaaauccuauauuguguacacuguugaccucuuuaaucuucugacuuuguaugggacaaacuaauggccuacaauuuucugugacuauuucauuuaaauuauacaaauguugaaugaaggauugcugaauuaaaaauaguuaaaaaaaaaccccucaaauuauacugaacaggugucauuucaagcugaguguuuuucauuugggggcagggugucuucucucugaaaaaguguuagaucucuacauuauguacauuguuagcccuuaaagauuuuugaaugguuuggauuauuagaagauucugcauauaaucaccuagaauuugauuauacagcucugagaacuaugaaaaggaacuaauuuuucuauuaauuacauguuuggauuauuauuugcagucagagcuuugggguuggguauuuugguugaaauauuggcacucuuaaauacaugguaguaucugaaagcuuuguucuaggcccacuugaaggaauugcaaaaaaagauguagcagaaguuuuaagugaagugguuuguuuuagcaacauuaacuuauuuacuuaaaaauagguuuuuacuuuuuugcuucuauuggguaguacuuguaguucaacagcauggauuuucaccuuuuggagggaagaggagacugacaacauuccuuuuuaaagccggcguagucccucccucccugucuccuucccugucucccucccucuguuuuuuuagagauaggggucugguuacauuguccaagcuggucucgaacuacugggcucaagugauccuccugccucagccucccagagugcugagauuagaggcaugaguggcaggccgaugucauaauuucuuagucaaaguauuaguugaagaauucaaauauaauguccccuguccacuuuuuauuguugcuuuauucgggggauauuuacuuuccuuuugaaaagaaaauucuugaagagaaaccugauggugggauuucaggcacuguggcaggaaguaagaaagauguguuacgguagagguggucacccuuagaucagugugggcaguugcuuguggggcauauuuugggggaggggcauuucucucuaaauugauguacuaggagauagagcauauuuuugcugccccaaguaaacuuuugaugcauuacaaaaaggaaacauuugggcaacucccauuucuguugcuuuggagcuuaauagucauuaaguuuguguuucuuuaugugguacugaguaaaagcugaaaguagcagagauuguauaggccaguauaucuuuuguuaguuuugaacuuguugggagcacuuauaauuaccuguguuucuagagauaaaucaaguggcaccucuguuucuuuaaguucuucuuuaccuagcugagauucaggggucuugcuucuuggguaauaaauucuaccuaauuugaagcuuugcuuuccuuccagagauguuugaacuacauuuacuaaugcauauaugcuguuggcauaaagauaaauuuguuauugaagggauuuucuauggagagacuguucuagucuugacagcugcacugagcaugaaaaguuaccuaagcuuucccaagucuauguuuccucaacugggaacuggggaugauaauggugccuaugcacccaucaugguugcaaguguauagaaaagagucauguaaggcacaaccacugcuguuaauacuaguguuacuauuaacauugcuauaacuaauaauuuauauuugaauuguucacacuuuaaguccucuuuuuuuuguuuguuuguuuuuuuagcucuucugauuuccaguaguuucauagagccauugcauuuaucauucuccuccaagagcuuaguucucucucugcucccccuuuucuucucucuucuuuuacagucauggucaaauacauuuggagaauuuucccuuuuacauguguauucugauaauaaugucuaaagacugugucccuguugacugugcugcauagcuuauuuuauugcucuccauuugucuuaacugucuugccugaaguugguagcuuuauuccuagauucauaauaugcucucuuuacuauuaaaaugugcauuuugauugggccuggcauacuuuuuuuugagauagagucucucucugucgcccaggcuggagugcaguggcgugagcuugguucacugcaaccuccacuuccuggguucaagugauuuccugccucagccuccugaguagcugggauuacagguaugcaccaucauacccagcuaauuuuuguauuuuuaguagagacaagguuucaccauguuggucagacuggucucgaacuccugaccucaugauaugccugccucggccucccaaauugcugggauuacaggcgugagccaccuugcccugccuggcauacuucuuuauuguuaauucugaguuaucuggcauggggaagcauggcucugaucgucaguguucauucucugaauugaguuuuguauaggcaucucuguauaaaauuucuugauuauucuuuccuacugguuuuggcuuuauuuggugauugcauuugaaguagacuguuuauuugaauacuguaacuauucauguaguuucauguucauuuuuuauaaguuguauuuccucucuauuuuuuuuuaaaauuagcacuagaggaaaaagcuauuaugaauaggguuuuguuguuuuuguuuuaacaaacccacuaucucauuguuuaagagaauuuacacacccuagaacugguugaauaauuaaccaaaaacaguaaaccuaggcauagccuauguauuuaaaaaacaaaaacaaaaacaaagacgguaggacaggcagugugaggucuagaaguucucuuucccuuucauguuauaacauucucugucuuuagagcucuuaaaccucugaagagaaaaaucuuauuaggaaaaucuuuauaguuaagcagggcugacuuugaagugaggcacgugcgcuggcugguaucaucacuccacuucaggagaugugaacaguugccaucagauguuaucuaugaacuuacucauuggauuaaugguuauuugcuucagaaaacuaaagaguaauaggagagcaauucauuugcuggcuuucauaggguucuuguuuugaaaaaggucuguuguugaacugagauccuuacaguugcauuuccuuauaccugauaaaaaguuuuuuuuuuuaauucuuaaaauaggcagugcauuuacauggcuuaaaggggucuaaaagaguaucuaaugagcauugccucucaucccuguuaccuagccauucaguuucucuucuuacaguuucuuguguaucuuccagaaauauuuuuuguagauacaauaaaacacacacacacacacacucucucucuuaagauuuuugugucuuuugacuuauauggaaaguuauuauacuugauugugaaauagguuuuacuaugauaauuugcugaccuacacuuauuuuguuuuuuuccucuaaaacaauguuuuccuaauguuuauuuacuuugcucuuauggcuacccagucugauuccacaugcccucuuuuggccaaaccauccgcaauuugugcucucccugucuucuaucuuugccuuccuucuucuuucuuagauauuuaauccuggaugccucuauuucuauucacuguacuauggcaucagcuuauagucccuuaauugcaaugaacucuaugaagcucacaugucuagaauauaaucacuuuggcuucuuucauguuugaauuguuuuucaaccaagucagaucgaguggccuuagucuaggugcucuguuauugacuguucuguauaauguugaggauacuucuauuuaacaaauaauuaauacuaauaauaguacaucuuacuguauuaucuauguagccauuaggcauuuaccaucuucuuucaaauguuuaucuuacgguguuagaucucuuuauacuucauuaauuuauuuuucacaucacagaugguuuaaagucuucauuuacuauaacaacuuugaagguuuuacuauuucacuguagucucuuucaguuuguguauccaacgacuccuguggucuuuagcucuggauccagggucuuauccagaaaaucuucauuuuguucuuucuuaauuuuuacugaggcucucugguuuuagagcccaaagauggaugcuucuacagauuuaaguuuuaccuauuaucacuacaaaacaaacagaaacccugucuaauaagucuuuuggugauugauauuaguuucugcuuucuaauauuagaucuuuaacuuuagccaugcacaaacguucuguuaggggaauauugagcauuaccuuaagcagugguaaaaacuggcaugcuguguuaugugaagaaagaagaugauucaguaaacaaacaaaaggcauuuauugccuugugccagcuggcaucaguauagaaaacaugcaguguaaugucacccaugauauauuccugggaaguugagguucaggauaauuccacaaaaugguuucuguguagaacauaucauggaugacagggggcagagaaugcacacugccuuugucguuuucauuguugggcucuuaucucaacugagccucauuuccuauccugaugggcauucuugugccugaucucugucugcagggcuucuggggcccuugacuucacauccuccagagguuguucaguugaucauggcagcuagucaucauagaaggugaugcuacuuugccugugggugaagguggacucugacagcaucuuugaagaauaggugauuuuagucucuaagcaggagagguguacacgugguuaacaugggugcuaccuggcugggcgcgguggcucacacuuguaaucccagcacuuugggaggccgaggggggcagaucacuugaggccaggaguuugagaccagccuggccaacauggugaaacccugucucuuaaaaaaaaugcaaaaauuagcugggcgcgguggcauacaccuguagucccagcuacuugggaggcuaaggcuggagaaucgcuugaaccugggaggcggaaguugcagugagccgagauugcgccacugcacuccagccugggcacagaguaugacuucgucucaaaauaaauaaauaaaggccaggcaugguggcucaugccuguaaucccaguacuaugggaggccgaggcaggcggaucaccuguggucaggaguucaagaccaaucuggccaacauggugaaaccccaucucuacaaaaauacaaacaaaacaaaacaaaaaauuagccaggcaugauggcgcgugccuguaaucccagcuacucggaaggcugaggcaggagaauugcuugaaccugggagguggagguugcagugagccgagaucgcaacauuacacuccagccugggcaacaagagcgaagcuccaucucaaaaaaauaaaaaauaaauaaauaaauaaauauauaacaugggugcuacccaauuaguagugcuauaguucuggagcaggauuuuggaggucucuaaugggccuggcguuaacccuuuaaguacuugaguaauagggguauggaauauuucaauacuuuuaacauugccucaguguaacccaugaagaugagccuugccugugaggcugugggcuaauagccaaauaccuuccuuccauauugacauuuuuuuugcuuccaggcucaccucgagguacuuccuuucaccucuuucucgggcaguguucuaggauagugauuccagcuuuuucucuguuauacauuauuuucuccacugccuucauacuuuacauuucugcuucuuuggggggugggggggguacacauuugucacuugcuuuccuuuccaagacccagggaaucucaugacuacuauaguucaguuacaguuucuuccuauauaggucauauuucguguucaauauacuuguaagaaauuagacuuaacuuuaacauguacaauuauacaaaaauguguaaaggcaaagguaaucuuuuaaaauuuacauacacacaugccuuuuccauaaaugaaauuuauauacaugcugauuccccugauuucccuccuucccuucuccucccuccuucuacccgccucucuccacauuccacauccucuccuccuaagaaccaguguuaccaaucuggaaucaauaacuguauacuuuccuuugccuauagauuccugcuucccuucccucuuuucgcgcgcgcgcgcacacacacauuuuugcauagguguuugccugaucaaagugggaucauuguucacaaauguucacaaaccugcaucaucuuauucaucaguaacucauggaaauccuugcaagccuucugguuuaccucuaauuuguucauuuuauugcugacuacacuauguauuugaccacuccccucccauguguuguguguuuuuauuucagugugcuaacaguaggcauuauuuguuuuaauuuugcugaucugaugagugugaagcaguuguucauuauuacuuuuuuuuuuuugucucgaacuccugaccugaaguuauccucccgccucggccucccaaagugcuugggauuauaggcgugagccacugcacccggccugcucauuauuaaaguugcauuucccuugaccacuguugaauucaaauaaucuuuuuaauguacuuguaagucauuggauuugcuuuuuuaugaagugucuguuuguauucuuugcccauuuucuacugucauuuguauguuuuucuuugccggagcucuugguauauuauagcuauuugucuuuugacauugcguguguuuucccccgccuuuuuuaauccuuccuagccagcggaaguauauacuuaaaaaaaaaaaaaguauugaaguuuuguuuuuguucucagguagauguguuuaucuuuuguuuuauggcuagaggauuuccuguuuuggguaaaaaugucuuucucacuuagauuacuuacaugcacauaaguuugggacuaucaggguuaaaucacagaagcagaagaacuaggaaagauguguaaggaauuuauuauagggauuugacauuuuacaaucaugggcacagauuaaagaguuuaugugaggcuguugcuuuuauauuucuuuucuaaaaagggagaggacuuuucaauuugguguuucuagggaagaaccuucacauuucaaaugaggguuugaaauaaauugacauauuucaaauacagauuccuuugcaaaaaugucaugggugauaauaaauugccugacuuugagcuuuuggguuuaaagaaaauucuuuucacauagaccauuuuaauuguuuaagaucaaaauucauuugaccugggugaauggaagaagaagcccaaucauagagcuggguuagugaagguuuuuggagccuuuccugcuauagcauucuaugauaaaccuuccuuucacaauuaucauugauauuacaucugcaagacuuucguacuuguaaguaguuuuaagaauauuuguuuuuauuuuuuuacccacaucugcaaaaauguguguggauaucugcgaauuauuuauggauauacaaguuucugaaugcaagcacugaaugugacucuacacacauucaacugagugguucuuuuucuaaucaaguaagagcagucaguacaagacucaaaaucacagggggagccaaacuuaaaaaaaaucuuugacaagaaaugagcuaaauaauggcuuucucuuugaaauaaauaggggcuauuuugucuugaucuggggccauuugccuccauuuccccccaacugaacacauguacuugugucuguacacacacucucuuacauaggcuuaagugaaaaguguaaaugcuagaggaacuuaagugggagaaggaaaggaggacagaacaguucaacagacuccucagacugcaauagcguaaaauauagaaauuaugugguacagugaaaauagaauaaaggauuuaaaaugcagaauugauuugacccacuaagccucucuauuagaaaaacauuucccaguaagccucucuguagacauuuuucaguuccuucuuuggauaauuuuuucucauguuacauuguuuccccuuauucucuguagacacuguucauuaaaaaggguaaugauggcuuauguaauaaugucauccuguggaugcacauccaguguacuucauacuccacgggacauacacuuugagugauucuccucccagcauugguaauguauuuucacugaacucacaucuuuugaguacccauuauaaccauugacagauacuuuccauuucagagagaaaaaaauauugggauuuagagugugaagagcaaaauugguccacucaaacaccaaacccaugauuggcuuuuuaacugucauuuuguuuguuuguuuuuguuuugagacggagucucacucugucacccaggcuggcgugcaguagcgcgaucucggcucacugcaaccuccgccucccggguucaagcuauucuucugccucagccucccgaguagcugggacugcaggugccugccagcacgcccagcuaauuuuuguauuuuuaguagagacagggauucaccauauuggccaggcuggucucgaacuccugaucuugugaucugcccaccucagccucccaaagugcugugauuauaggcgugagccaccgcgcccagccucaacugucauguuuuaaaccaaacaagcuaaccagccagcacuuguuuuuucuauguauagauauuaauauaauuguggaugcaggaaacugcaaaguuaccagcagaugcccuuuacuuucagugagagaaaauucaguucauacuggguuaaacugguuuuuguuuuuuccuguuuccuaaaaauuugcaucuaggugaguuuucaucuuccuuuuaaaaagcuuagaaugcuguuuuaccagugguuuuuaguugcuggcacuugccaggagguguuuggggagucuacaauuuuguacgguguuuggugggugagacaaggucuuuacuuugucacuguaagcgugugucuuuccuucuuauaaaaagagcuggaaaagcaguaagaguugauuuuugguagguacuuuccauuuggguuggcuaaguaaaaauggcaguagaauuuuacugucugggauuugacaguuuuuguaguuugccuagguagagaaauuugaguuguuagcuagucuugauuguaaugaaaaugugaaaagaaauguauguuauuacuugagacuuugaagagcucuuauuauuacaauuuuugaaagaaucuuucuaaagaaggagaaaguaugugacccuggagaggaaacuagggacauuauagaguuaauuuuggguagagaaugaagggauuccaaaauccugaaacuuguugauacauauuuuuugaaguauaacccucaagaugucauuucuuagcuuuaauuucuguuaagaugggaaguagauaauggcuuggggcuuuuauuaaaauuauauugauagccaugccacauacuucuuaacaaaaccagcaguucugcugagauuuccaacagugaagccauuaaugaaccucuuguauaugaacguaacaaauuaaaccuuauaauaagauacucuuuuguagugugugagggaguaaaauuaacauugucacuacacugugauggugcauuucuuucuuuuccuuuuuuuuaaagaauaaaacagacagggucucacucuguuaccuaggcuggaguguaguggccgugaucauagcuuaccaaaguuuuaaacucccaggcucaagugaucucccaccucaccacccaaguagcugggacuacagguguguguuaccacacucggcuaauuuuuaaauucuuuguaauaauggggucucgucguguugcccaggcuggucucaaacuccuggccucaaaugauccuccuguguuggacucccaaagggcugguauuacagacaggagccacugugccuggccugcauuucuguuuaauauuugcaccauguuagggagcuagaaauuauuguuuaaagcuuuuaagaguacaugacuaagauuggcagaaggguggauuuuacuaggguaaauuggacucaagcaagaguguuucccucuacuacaagguagaaacuggaccuuucugugccuaauucaugagaugaaauccuuauugagauuugaaaagaaaguuguaaauauggaaguauuuuagagagaaauuguguaucuuuucagaaaauaguuuuagacuagagauuaauaaugaacacuugaaaguugucaugggaacuccaaggcugucuuuaguacauucuggugaaugaaugauuucucucauguuuuucccucaugccccagucugcugcccauuucucuuggagggagucauguucuuuuucaccugaccauugguucuuacccuuugccugcccuuuaaauaaauuucuuuccuuuuuucuuuaucucccuuaacagccuuuuucuaauaguggaaguuacagauuuuucucugcaaaacaagaaaaauugccagaauacaucucucuaagucacugcuuuggucaucauauccuagccgucuucagaaaucuggagugacugcucuugucaaccauguuaaaucuaagcucccuuccuagccccagaggcuucuuguuauuugguccuacuuuggccaagcccagaguaacuucacuauuaaugggcaucaugucucagauuacuggcucuggccuucucuguacccagccauauugaaauccugcuguuccuuuuguaccaagcucaaagcucauuuauccacugcauucguuaaaaaaaaaaauuuuuuuaaauagagauggggucuugcuaugcugcccaggguggucuccaacuccuggccucaagcaguccucccaccucggccucccaaaguacuggcauuacagaugugagccuaccacugcauucuuaagugccuuccuauuuucuaaauaucaguaauauuaguggcacuguccauuuguauuuaaccaucaaagcaugaagcaugguacuguuaaugcauaaagguuaaaugauuuauacaaggucccauagcuaguaaguagaggugcuauacuuugaacccagccuggcuccagaauuugagcccuuaaccacugugcaacacuguaaggacuaguugaaauuaauaguauauuagauugacaguaccauaacuuacaauuguaauucccuuucagacauuuuauuuugaaaauuacgcauguagggaagcugaaagaauuauacagugaaccacccacauaugaauccacuucuuagauucuauuaaauguuuaaauauuuccuuugagacauauuuagccaucccuguauccaucuuacuguuuugaugcauuucaaauucaguugcagacacuuguacauucaccucuaaacacugucccauaugugucauuaauuagaguuaaaaaaaauuuuuuuuuuuuuuuugagacagguucuugcucuguugcccaggcugaaaugcagugauguuaacacugcucacuauagccuugaacucgugggcuccagcaguccucccaccucagccuccugaguagcuagcagcacggguaugcaccaccauaccugguuaauuuuuuuauuuuuuauagagacagggucuugccauguugcccaggcugaucuugaacuccugggcucgagugauccucccaccuuggcuucccaaagugcuaggauuauagguaugagcuccugcgccugucccaguauuuuuaaagguaaguuuuauacauacugaaauguacaaaucuuaagugugcuauuggugaauuucgauaaaggcacauaccuuguaacccaagccucuaucaagauaaaauuauguaauacccuuuuaguugaauauuuggcuuuuuuuucuuuuucuuuuucuuuuuuuuuuuuuuuuuuugagacagagucuuauucugucacccaggcuggagugcaguggcaugaucuuggcucacugcaaccuccgccucccgcauucaagcaauucuccugucucagccucccaaguagcugggauuacaggcaccugccaccacgcccagcuaauuuuguuuguauuuuuaguagagacaggguuucaccacuuuggccauuguuggucugaacuccugaccucaagugauccgccugccucggccucccagggugcugggauuacaggcgugagccacugggcccagccuuuggcucucuuguaguucaaguacaugaguucuacaugccccucagaauuaaccccugcuuuucugauuguucgugaacuuucauugguucuucaguuuauuacauugacuugagaacagggccaucuccagcuuauuugccagcuuacuuggcauggagcauaguaugauugaugggcuuguuauuguagucaucauucugaauuccuaaaugguauacauguguauucuucauugauuaaaaauuccuuugauaugucguuuccagucauuuucaugaauuaagcugaccauauuccuauuuguuuuccaauagcacaugacuuguucaaguggcuuugauguugagggaaugcuucccuugaaaccuauccuuuuuuuuccgugacugccauuuuacagguauuguuuaaagauuucucagacugguuuaggaggaaaggaugguucugugagucucaucucccaucuacacccauucccuuggugaucucaucuaggcuagugacuuuaaauaccuguauucacggaugaugacuucuaaauuuauguuuccagccuggaccauuccccuggacuugucaucucuacuuggacgacuaauaaacauucuaacuuuaacaugucauauauugaaucuuaauuguucugcaucccccacuuuccuaauguguuccacuuaauagucuucuuaaucuuuucuugguauucaguuaguuaaaaugcuaguuacaaauaacagggcucagagcaguggcucacgccuguaaucccagcacuuuagggucgcuugagcccaggaguuugagaccagccugggcaacauggcaaaaccccaucucuacaauaaauacaaaaauuaggcagguguggugccaugcaccuguagucgcagcuacuugggaggcugaggugggagaaucgcuugagcccaggaggcagagguugcagaaagccaaaacugcaacucugcauuccagucugggcaacagagcaagacccagucucaacaacuaaacaaaaaacagaagucuaaccuuucauaaguauaucuaauccccagacucccuucucaauuuaaacugagggcgggguguggugugcgugugcaugcguguguguguguguuuaaagauuguguguguguguuuaaagauugauauaaaauauuugaaaggugagaucuuaaaaauauuauuuuccaaugugguaccucugauacugaaauaauugaugaauaaaucaaaauacugauuauuguuuuuggaaagccagugauuuauguuuuuacuggaaauauauuuguuuaauaauucuaguuauaaauuaggguaauggauuuggugggagugucagcugaacuucagauaaaccguuuauaguuuguccuguucuucauaaucuaucugauucaacacacaucuaauucaaagcaagcacaaauugagugucuaaaugguaccacuuaugcacuguaauuuuuuuugacacuuuaggaaugcugcaucaaaacuaagaaaauuccugaccaccugcuguuagauuuucauguggaauaauagacaaaucuuagacuggcaggguuugguuuuuuuuguuuguuuuguuuuguuuuguuuugauacggagucuugcucuaucucuggagugcaaugacgcagucucagcucgcugcauccucugccgcccgggcucaggcgauucuccugccucaaccuccugaguagcugggauuacaggcacgugccaccaugcccagcuaguuuuuauauuuuuaguagagacgggguuucaccguguugccccggcuggucugggcaccugaccucaggugauccacccuccuaggccucccaaagacuuggcaguuuuaauacgguaauaaaaugggcucuaguuuuuggaaguugacagcaagugucagagaacaguuuugcacacacuggcuugcagggucuaucaggagagaagauggagauguggugaugugguauugucccauuugccugcaggagugugccgaggaugguauauucuucuucucuuucccacugccauuuuuuuccuccugguaaauuacaagggaaaauagagagguagcgcugucaaggcacuccugaacacaaucuuuuuuuuuggagacggagucucacugugucgcccaggcugaagugcaguggcaugaucucaggucacuguaaccuuucagcugucagguucaggagauucuucugccucagccuccugaguggcugggauuacaggcacgcaccaccaugccuggcuaauuuuuguacuuuuaguagagacgggguuucaccaugugggccaggcuggucucgaacuccugaccucaggugauuugcccacuucagccucccgaagugcugggauuacagacguccaccaacacgccuggcucugaacgcacuucuuaaugugugggccacaugggcgauccuuacaugaaauaguuacuagugccuaauguucgugucuuuuuuuucuauuuggaucaaaaacuggcagaacauacuuucaaaugaaaggucccagcuuucuuguggccaauucuauggaaucccaagaaaacuggaaugaaagauuacugccuauucuuaaagaauucuacauuucugaaauguuugccauaucuucuacgccccaauucacauuccccacucccaauuaaaaacagcaagagagcaacuuuuauuacagguaugaaggguguuggggacuuuauuuggucauagaacuggagugagugcuaauuauuaaaaguaaaaaggguacgucuuaaauggcagguauucuuggucuuuuaaaagugaaagcaaaaugaauaaaugcuauuuuauacuugaaucuguacaaagagcaaagagaagcguggacugaaaagauagcucagaugagugacuauauuuuuuauuguaauuuccaaaucguguagauuauuuuguagcugauaggcacuuaguuuuguggauuugggagaagcagguaguaagcccacggucaagagaugugggaaaguagagaaaaguuguggaugaaggaggagauaaaaggauuuuccuuguuggauaaacuagauuauuaucuuggaaagacaaugccaagaaaguuguuuucuugacuugaagaaucugggucauaagaucugauaaguucugauaagauuguaugucuuucauugagauagguuaauucugagcaagcuuuauauggaauagagauuucaguaauauggaggauuacucuccagcuaucacgaaacauacccuccugcgugcauugaacuaauggauuauguuuguguuuuuaaauucucauaccucuccugcccacaccccucaauaauucuggcaaaucugccuuggaaccaaaccugccacaauuggaagggcugcuuccuaaauuagaugugauagacuuaaaguacauuuuuuucuaaacaaaaaggaacguaauagugauccuuaauucucagccauguauuuuguccuaaaauauaauuguccaaagcugagacaucaaugagauucuuauuucuuuugaaaaaauaguauccuuuuaugauaauggauaguacuuguuguccuauauaauuuuacugaacaaggaaaagacaucacuugauuuuaagugacuaccuuauucagaaggaauuuuugaguuagggauuuuaaaccuuuagaaauuuagccuugauucauaaagccaaacgagaguaauaucauaucuaauauuauaguacauuuugcaaagcagguuacuugacggugagauaaugugguaaguuuuauaucaauauuagauguaaaaaguguaacaaggcuguugaggcuuacugaaaguucuagcuaauuaucaguucucauuuugaauacugcacauuaacuuagagaagaaagacuagaaaguaggguuuuaggaagcagcacaugggucuaacaugucuuuaaugugauuacauucucuauuugauggaucuguagcauuucacucucuacacguugcuauuaaaaauaauaaaacaguuuugagcauuuauucugugcuagccucaggacuuuaugugaauaaaucccccugugguuguuacugcuauuaauucuguuuuacaggucaaaggcccaagguacauaaagguugaaggacuuguccagggucagaggcucaaguguggaucagggcuccuaacugcugugcaacuuaacuugccccuguugaaaaucuaggugguuuuuuuuuaauggcuucuagaaagagacaguuaaauuucugacuuguucaggcuaaugauugcuucaucuuuuuuuauauauauauauaauuuauuuuuuuugaaacagugucuugcucuguugcccaggcuggaggguaguggugugaucacggcucacugcagccuugauuuccugggcucaggugaucuuccuacuucagccucccggguaguugggacuacaggcaagugucacuacaccuggcuaauuuuuguguauacauguauuuuuuguagagacagaguuuugccauguugccccugcuggucuugaacuccugggcucaagcaguccuccugccccaggcccccaaagugcugggauuccaggugugagccacugcaccuagcugcuuuaucuuuuuaaauguguuguuucuuaggaaauuaguuauuguguuauagauucuuaccuaaggagaacacguaugauuaucaucagcauuuuacagcccaguuggguucuucuugccugcugcacagaaaaagccaguacccugagacagcagaauuugcagcagagaaagaguuuaauaaucgcaaggcugauugagguggacaagauaccuuucaaauccaccucccaaagaauuuggagacuagguuuuuaaagaugguuugguaagcaggggcuagggaauggguacugcugauugauugggcugggcaugaaaucauaggagugucgaaacuguuucuugguauggaucaccaguauagguggcgucaguugguccacuagaaugcagucugaaaaauaucucaaacaccagucuuuuuuuuuaauuagaugggaucuugcucuguuaucuaggcuggagugcaguggcacgaucuuggcuugcugcagccuccacuucugagacucaagugauccucccaccucagccuccagaguagcugggacuacaggugcaccacacccagcuacuuuuuguauuuuuaguagagacaggguuuugccauauuggccaggcuggucucaaagucuugaccucaagugguccuccugccuuccagagugcugggauuacaggcaugagccacugcaccuggccuuuucuuuuuuuuagacagagucucacuguguugcccaccagucuuaaguuucacaguagugauguugcuuauagaagcaauugggaaaguuacaaaucuuauuaugaccauuggcuaagugacuccugagcaguaaacaauuauaaaaagcaagcuaggaaacaguaauagccuacuguuuuaacuaugcuuagaucuuaucagaauaauuuuaaccuuaccaccuuucauuaauuuuagaaaggcaguuucagaccaccaacgagaagaaggguaguuuuugggaggggacuaugaucauccuugcuuuaaaguuaagcuguaaacuaaauuccucagcuaaauuauaaacuaaauccucccauaguuagcuuagccuaugcacaggaaugaacaaagacaacuugugagguuagaaacaagauggaaucaguuauguucgauugcucucacuuguauaauuuugcaaaggugguuucaugcacaaccagagauguuguaugaaauaugcuucuguucauuccugauguaguggaagauguguuuuuuguuuuuguuuuuguuuuuguuuuuguuuuuggagagggagucuugcucuguugcccaggcuggagugcaguggcgcgaucucggcucacuacaaccuccgccuuccagguucaagcaguucucugccucagccucccgagaagcugggauuacaggugcucgccaccacacccggcuaauuuuuguauuuuuaguagagacgggguuucaccaucuuggccaggcuggucuugaacuccugaccucgugauccacccgccucugccucccaaagugcugggauuacaggcgugagccaccgcucccggccggaagauguuuuuaauuuuaaauuguacuccucguguagaagauguguaauauaauguaguagguguuuacugggugucccuuguguguuggagcccuguugucuggucccagggaugugauaaagaggaaacaccagcugcugaaagugcuugguucauucuugcagaacuucuaggcuccacccacccuugggucacggcaaaguuuaggucaucacagagugcgcagcaugcuuguguaggcuccuuacccuuagccuuuaucaaggguccugaugaagaacaacucugccuguucucuagaaccuccuuagagggacaguccaacguuguuccuacagcuggcuccauuuuauaaauaauucacagguuuuuucacuuaagugucucuuuuuccagcgaaaccaaugugcugcuuuauccgaugaaagcuguugguuuuauucuuuguuuuggccaccaggaagaucagggccaaauugguguauaguguauacuagaaauaaugauuucauugcuguacuaggccuuucuaaccccuuuuuguaauuuaucaaaacccauuagaucugguaaaauauguggacucacauacaauauuguauuauaauuuuaagacguucuugcauccugaaacguauucuggacccuugggguuaagaguccugcuuuugaucuuuuuauaucuuuauuucacuauucuguacauaguuuuauucuaaguuuccuugacuguauagaaguagguuauguguaaaugauaaauaacauuguuuuuagagguuuuggguacugagcaguugcccuccauguauuugacagcgaggcaaugggaaauguuuuuguucaucacaagaggaaauuuuuuggcccucacgaugaugaaauugguaggcuaauuauaaauggcugcagaggcugggugugguggcgaacgccuguaaucccaacucuuugugggcugaggcgaguggaucacuugagcccaggaauucaagaccaaccugggcaacacauggugaaacucugucucuaccaaaaaugcaaaaauuagccagucucauaacccggucuggaaauaauuaauuaauuaaaaauggcuguagaguuuugguacaaugauuuuccaggaaaagcaaccuguagauucuguuguaacucauuuauuuauuuauuuauuuauuuauuuauuuauuuauuuauuuauuuauuuauuuugguacaaauacuagggccuaaagauggaagucuuaugcucuaaacacaauugucaauagauauucaguaaacuuaauguuuaugauguuuuuacaccucuucugugugguuuuugguaaaaucuugaugaaagcuauaaaaaggcuuuggcaauugucucuagggcugcaguuuucauaucuguuuccuaagugaggcaugaaccauuggccucugcccaucaggguugcuguuagcagaugcuucuucaugcuggauuucuauugggaguuccugacuuggaggcauugggcaagccuuugcucuucagccuccauauauagaggguaguauuuucauuuguaggcuucgcaggauaggaugcuugauuguacuugacuuuggagauuucuugcucuuuacuguccucuucagauaguagaaggggagguuuaagauguguccuuuaagaguauucccaaaacaaguauugaggauaaaggucaaauucaugcuaaggagaaauguuuuugcaguagcuaugacuuucaccucuuuuuccccuucccucuuuguaaaagacaauuuguaguacauuuugucucucuaagggagacaugacuaccccaaauuuuuaaacagaccaggaagaaucuauuguauauuugagugggaaccugagaaugcuguggcauauagacaaaauuaauuaaaauaacugauaaaucagauguagcuuuaaaugggauuuucaaaauuaaaauguaggagaauuauguuaauaagcucugcuuuuaacucuaucaaguauaggaauguguuccuuugugcaauuuaaaaccaccaucaccuaugcccucuagugcuuaugggaugaguuugacaauagaauuguguucucuguuuccugcuucugcccugguuacugcugauauuccuggugugagaguucucuuagucucucugaucccagcuucccuggcauugggaaaaggguggcuuugccuauuccuccaugugguccugcuauggggcuguggugcuggagaaacaauaagugcaucugggcaaacacggcagacuacuggcagucagcuccuggaagccagggcaguuuaugcccuagcacugcccagguguagaauccuguccugaggauguuuaucuguagcaagccaaggacauuauaguugacccuugagcaacauggguaugaauuguuaaggucuacuuauauguggauuuccucccaccugugauacuuauauguggauuuccucccaccugugauaacccugagacaguaagacugacuccuuuucuuucucuuccuucucggccuacucaaugugaagacaacaagaaggaugaaggccuuuauggugauccaguuccacuuaaugauaaauguauuuucucuuaugauuuucuuucuuucuuuuuuuuuuuuucuuuuuuuuuaagauggagucucacucugucacccagacuggagugcaguggcaugaucucagcucacugcaaccuccaccuccggguucaagcaauccuccugccucagccucccgaguagcugggauuacaggcgcauaccagguugccuggcuaauuuuuguguuuuuaguagagacaggguuucgccuuauuggccagacuggucucaaacucuugaccgcaggugauccacccaccucagccucccaaaguacugggauuacuggcgugagccaccaugccccaccaugauuuucuuaauaacauuuucuuuucuccagcuuauuuuuguaagaauaccauauaucauacauauaacauauaaaauauguauuauuuugacugacgguauuaaauauguguuaucuaauauggacugaccguuuauguuaucaguaaugcuucuagucagcaguagcuauuaauaaaaauuuuugggaagucaaaaguuaugcagauuuucgacuguguggagcaggggguuggcaccccuaaccccaguguuguucaagggucaauuguaguuuaaaaucuucccuuccuuuucccaucuguacucacugagucgucauccaggguggaggaggucauguagggaucuucaugguccuaguguguaagcaccugugggaccucccuccuaggaguggcauggaaggugcugcugggauggacaucaaccaacccccaagguagaggccaagucgcuguuggcuagauacaggcaauugguaccuuuccgaagcucucugugguguuaguucacuguaauggaggauucagagaggggcagccaacuccaugcccugugagccugggacaguuguuuguccacuugcucaggcucuugacagagcagcuucuuacugcaugacagcuuuuuaggcacucucccuucucaccacuuuaccuuuacuuucuucuuauccuaguuuuaccucucucugaagacagguaaugauuagcugccccuuuuuucaguggacacauuugacauuguagaggaacauggaauaaaacaacuguucauuuaagauuucuaugucugucacaaauggcuuuucaaguuucacaugucaaaauugauagguuaucaaggaaaaguaaaaagaaggcauucacuuuuuacaguauacacaauuuuaauaacaaaacuugccuguacacugcucuuuauguuacccuccccccucccaaaacacccugcauaauaguauuuucuucccacccucaacccaucugcccaccucccacccaaaaagaaaaauggcucuugaaggugauugaacacaauguauuuggacuguacuuugaguuuccagucucaguguugauaggaagguucaccaaacauuccauauaucagacuuaaaaaaaaaaaaaaaaaccgcuaaggacaaaaauguuaguugaaagaguugcagagguuuccaaauguuugcaauagcagaaugaaagcuuaaacaguaauuuucuauuuguuuuuggccuuauucaaguacuaugaguuugccccagguuagauagagaaauauuuaauuaucuauagauggccuuacugucucucucucuuuuuuuuuuuuuuuccuggcucaagggcuuuagucaauaagauaugaaaaguaugcccccaaacagacuuuucagauaggucugucgcuguauuccuguauuaggaaaacgaucauguaagucagcuguuaaaaauauucuuuaacaaauuuuauauugauauccacacuucagaaaaagaacaggacauuuauagcuuuuuccccugauagcuguguguaggaagugugccuuaagaaaaugaaaugccuguuuugaauuuuagaauucaaaccuagugcuacauagggcucauuuuuauuggaaagauggagucuagcucuuggugacuagcauuagaauaagcagauggauuuuaauaauuaguggcguugggaaguucagucaauuccauuuauugaauugauacagaaauuaacuuaggcacauuaagaaauuacauguguuaguacagauuuuuggcuuaaaaaauuaguaucuuugcuuuuugaugcuggcaguggguauucucagaguuguguguggauuuacaaguuuaucagcccacucuuuucagaaaggugauugaaaucccugucaugcuacagaaaugaauauaaacgauuucaaacuaguucuugguuucuagauggguaugguaucauagucuucuuuagcuuuccuuuuuccagagagauuaauuauuuuucugguucuuaauggucauuuuccucuaaucuuaaaaauagaaaaaaaauggaguggguagugguggugaagaggauaaaaccccaucaaaaaacaaaagcucugacacuguguaaccaagauccgcagcguugcugugaugcuguuccguucuagccaguugguaaagaaagcacagaugacuaacagucuaaucuucaaaccugugcugauucugaaacacaaauggacaaaaaugaaagaaaaucuugccuucuacaggcaauuaaaaagggagguuuuugcuuuuaaaugagaaaggaaaauaccuuuuugguacuacugucauucacuuuucuuaaaggacauuacccagaaaaauggaaggcaaaaaauuuugauuuuuuucaacuggaaaguaugccucgcuagccuuggcuaugcuguuccucugaauuaguaaauggcuggcuuuuccaauuugcuuuuguccguacacuaaggauuuugccaguuaugguccuuuaaggauuaagguggagauucccagccaaagaaggggauuucuuacccaucccacaguuuaaaucuuaauuuuguuugugguuugaaaugauggaaaauacuccucugcuguccuucagggcugauggaaucuugugugcucaggacacaguuguguugugaccaagcugucugucaccugacaaauggcaauggucauccugauaaauggguugguaaauuuuagcucguggugcucuuauuuguaauaggggcuucuaauucagccugucuguggggaaguagggcgcugugcucuaugcuguuaaaucagcuucugucucugcccagacaagcccagggucugguuuaacaagagacaaaauacucaccacucgagaucaacugaauugaacugggcugagacuuugacaaacuaaucugcccaccuuaaaaaagagcacauuuuuacuguaauuugugaucuugucugcuuuuuaccgagagauguuaggugaaggguacuaagguacccaucucuuaguauuaaagaagaaaaauugugauuaaaucuuacuggcuaaacuauagccuuaacauguuuucaguuugauccugggaagaaaaaauaugcccugaaugaaggauaucauguugauguugauguuggggaaaagauaacuugaaaaaugguaguggcuuucucuaagguuuuaugucuuuuuucuacauacaguaaauggcaguuguaaaaaaugcucauuuucuaaaaucaaguuagugcuauaauuuuacaguuuuuucaauauguggaacaauguuuauggaaaaguucugugugaaugaguagcuugcaucuaaauuccaaauauuuaauagguuuucuuuagaaaucauaauacaagaaacugaauaccugugguucuuuucugcaugaaaaauguggcauccuuaucauuuguuaacuauggcauguuuauauuuacauuggaggaucuaccccucuucccuuuucagcagcagguccuuucccuguuuggugcagauuguguauaaucauuguuggcugccuuguaacuccagcuaaccugagagucagauuucaaaaucugccuuuccuuuuaaucccucaccucugugcugccuucaaguuaccacuguguggcugcauaggcaugucgaguuguucugccaugagauucaucucaguggugcuguuuucuucaccuacacugaacuacacuuacagcgugaaugcguaucuuuauugaaagaucgaaauguauuauauaauaguuggaaaguguuuuuuuucaugguuccuuuguaauacaauaagaaucaguguuaagccuguugcuagccaauuauuuuuaacuuggcucuuugagguuugaagaucaggaaaaagcagaagaaagagguuuaaaccccuuugucaaggcaucuuugaucaugauaguugagagagagagcgcgagagugugugugugugugugugugugugugugugugugugugugcgcuuuuaaauuggagggagcaugucaggauuguuaaauugacucaguuugucuuguuuaucuccaaaauaucuucuaaaucuuuuuucacauauuaauguaaacauaggauuuaguacauuaauuaguacaaugacaguuuaaugcuaguuuaaaacaguugucuaaaugccacaaaaaucauguccauuauaagucaaacgagaaauguauaagaaguugguguaauuauuuaggauugguuucauuguaaugagaccuuuucacagucacuuggauucauuguguaaauauauuaaagagucacucagcuuauuagaauuacauuaaaggguucugaauucaugauauggacuuugauaauaucuacuaacccaggcagaaacucuggaaggagaauguuuaauauuuaccagucuucagcauacaugaaauucuacuucccacccuggcaagaaauugaagauuugaguaaauaccaaauuaucauacaagagaacuuuacuaagucuccuuuuaagcagcaagauaguugugguacaugggauggagagcagugaucaaacagguauugaucuauaucuguuucugcccaauagcuucuuucuaaauuguuuucaguagaaaaaaauaguauauggagaccuuaguguaaagguuuacacacgauuguauauaauuacauacauuucuuauuuugaaguaagcauuuuagacuuuccaacaggagugcaaauuaaugugagcauugauucauuuaacacuuaaaauaugguuucauuuaaaaaauuaaaaauacuucaacacuucaaaaacuaagucuccacuuaguuuggaaaauuaggcuuaaugucaccauugguaaaaauuagauauguauuuagccucuacuauguaaaauagguuacuuaucugaugugauuuuugaugauggguagauauuauacuucacauucuuuguauggcagcugcugacacuugcacuguccauaaccauuaaugaugaugaaggguccuucauggguggguucauauucauuauacgguccuuggucugacauguuugacauauggagucguguuugggaucggagcugccugugguucugaaccauugagcacugccuaauucuucuuaaagugggagggcagcacuuccuggagaugaacacuauaaaaauaauaaaaaagaaagaaaacaauaaagccauuguucccguaauuacccgcugagugaagauggcauugucugguucaggaaaguguuccucgguaguaacugcuaugccugcaguaguugggauuucuuugucucccacaugguaacuugaugagcuuauucuuuuuguauauucagugguuggaucucuauaaguuguagccaugacagugacagugguugacaaauuccagcagagcugaaauccauggacugcaucuagaauauccucuccuuggguguggucaggacuguggcauaggauggaguguucccaccgaccuuggaaacugcccagccaggaggccagagcacauauucgggcgcugcauucccacagauugccagagagaccaacgguugugagggaucucagggaguuuaagaucuuggaaucaaggcuguuuaacuuguuguuauccaugaggaguauuuuaagauugggcaucguuucaaacacugucaagucgauggcuuugauuucauuuccagucaggucuagcuuuucuaaagugccccagguccacuccaucccacaugucaaguugcugauuuuguuccauuguaagaagagcgugugcagacugcuuagccguaggaaaugagcaaaauuaaucuucgucagcugguugugcucuaggugaagcucucucaguuuaauuaauccugcaaauccauugcgagccaaacuucgcaaacgauuugugcucaaauccagaaacuccagacuacgacagucccagaacaggcguacugggauaguccgcagggaguuggaacguaaaugcaaggucugcagcuuccgaaggccauagaagagcucugggugcagagaugacagcugauuaaaagacagguccaaauuuugcagguuaaucaguuggguaaaaguuguguuuggcaaguaaaauauuuuguuggaacuuaagauuaauuccuuaaguuuauauaguccuugaaaagcaucuucuuuuacuguugaaauuugauugugaucuaaguggagccaaguaaguugacugaagcuggcaaauugaucucuuucgagcucugugaugugauugugccucagggacaggcccagagagcccuugucuguggcguuuggcacugaguggaagcccugagagucgcaguagaagagcagcuucucgcagcggcauuuggguggacacgccauacccagggcaggcagcauuuuuaaaaccauacucauugcauauauugcugccagcauaggggccccuaauggccacuugaaauguaagccugcagaauauaauuuaaggaaaacaagaagauaggauauuuuucagcagaacauaugggcuauuuaaaaaaaacaaccaccaccaacauuauagcaaaagauuucacugcauauaacuuauuuuucauuuacugcagaaaaauuaaccuuauugguaugacuggaccaaaacuuaagccauuuaaaaagaagauaaaacaugucucugucaucaucgauauaugcuuuuaccuaaaccucaaaauccaaaauaugauggugauuucccucauaaaaugugaauucgguagcuuauuuuaaaagcgugauuccuuguugaauguacaagacauauaaaugcacagacuuacccauucuucugagcacauuggaggcugcauucagucgcgguuguuagacucaacgcagugagucuguaaaaggcucuaacauguaggagccuuugaccaguuuccuguuuucugugucccaggcuuuccaaguaaaauugaauccaccaggacgaguuguuuuuuccuuaggauaucccucuggaaagcauugguuucauuuucugugauugcucugaucccuaaaucaguuuugaauauaaguuauuaaauuucuccaccucuaacugcucagcugguuaaucaaagcuucagucuccuuuccgcagccguuaguucucuuggucuuaacuuguugauggcagauggguggcuuguugcagagaagagcuccuggagcagcaugagugcauuuacugaaaagcuuuuccgagaaacggcacaagaauggauuugcuuaugugcugcgaccacacagaacuguauauaggcugacgucaccggaugacgugucuuuuguuuggguuuuccagaagcuuuacuguuauaaagcaccaugcuuuguaacagcaucggggucguugcaggacccccugauuacaauaaagcgagaaagaagaacuccugacuuaaaaacaugauauuccuucaguguaggaagcagcagugagguuguaauaaaggcugcauucaagaagacccaucugaacagugaguuggguuagcagagugaugauuuuuaaugcuugugagagccaguguuagacugccgauucugcauagagagaucaucuaaaugggcagaagccugcacaauuuaugaagugcugauuuaacaccagccuaugcaagguagugucgcugcacugguaguuuggaaagcuauucaguugccuuguugucaugcuugguuaaaaucaaaguaugacuaugauuugcuuuagauguguugauaaacuagcuaagugggcuuggcuuguuugucaucaagagcuuaacauuauaaacgaagaauaaagggggaggggaagcuugcaaaacaaagcaugugguuauuuuuuucuuugagaauuucaggggaacucuaaaaagauuucucuuucuccuauuuuauaacaauguuuugucgccauacugauugaaaaaauaaugcugaguugaucuuuaaauguccuccugggaggacaaggcagguugauacagucauuuuaaugcacaugcccuaacagcaaagcagagaugauuuaggacaagugauaccguguagcuggauucugacauggccccuuguauuuuaccucagaaucucaccuacuccauaacuaaaagccuccgcugguacugagguuggugguugugacacugaaauaauagagcauuugcacccuaguucccagccaccaaguggcugacuuaacugagccuacugcuguuguuagaaccugucuugugaauacaaaaggucacucaugcuuuggacugggauuuuuguuuugacuugauuuugcuugcccuaacuccaguuucucccuguugaauggugucuucacuuuucagaccucaguuguggauguauagcuccauguuuaguguuauauaaaugcaaaagauguuucuagauguuauauuuucaggccugacaaagguaagcccuuuucuacaucuugccuuauugauuugacccaacauaccuauuucucccauaucauuggcacuuacccuuugugggucuugucucagaccuaaggacagacaucuuuaaaacuacugauggugucugugaaacaagaacaucguuggccuuuuugguucugagggauucaucccacugggcagaucuaagaaguaauugucuuggguaaaauuuuucuguuguaguguugugcuggagugagagcugugagacuccaaggucccuuccuuagggcucuguguaaaggugcuaugaaaacugcagcagugcaggugugugguuugaguccuccuagaagugaucccaagguagaauuagaaguacaagaggcaaaaaugccuacgaaguacaaagggagacagaaggcagcaggaaugcucugagagucuucguaccacagggcaggucugacaccugugaagggacagaggaagcaaagaagaugagauuggcauugugguucuuagacacauuuuguaggcugaauggaaauucccaagccaaaguugccagugaacagacucuugaguccuuaguaaugagccugcacuaguacguccucuuuguuccuucuugcugguuaaagaagggaaggaaacaaguccugguuuagacccggggaaugcuacucccccucugaccuuaauccuuccuauagucucucucaauaggcuagaacuucuuaaccugguuccauaaacugucuugugaaauuuuuuugcuuguucauuuuucuguggauaagguugaguccgauuccuacagggucucucacccuagguuucagagcugcuguucuacaggaacuugcccccaaaaguucuaaggacaguagucucauaggaguggucucuuaaauuucuuuuuuuuuuuuuuuuugagacggagucucgcucugucgcccaggccggacugcggacugcaguggcgcaaucucggcucacugcaagcuccgcuucccggguucacgccauucuccugccucagccuccugaguagcugggacuacaggcgcccgccaccacgcccggcuaauuuuuuguauuuuuaguagagacgggguuucaccuuguuagccaggauggucucgaucaccugaccucaugauccacccgccucggccucccaaagugcugggauuacaggcgugagccaccgcgcccggccaaauuucuuaaaugaaaauaagcccuugggauguuguaaaugcccuuauugaagucagcuacccucugaugaaaaaaacccuuugccacgcaggagaagcuggauuaaacucuucucucaaguaacuacguuaguuccuuggggagaaaagcauuuuagucaguuggauuagagccaccaugauuaggaaugaguuguguguuaacaugcagaaggaaaagcaucuccgugcccuuaaacucuugguuuuuagucugcuuggccuaccucuuaaauacuaauaaauggagacuacuuaaauuauauuaucucaguacuauuauaacagauuugugggcaaggaaaauugcccagagaagcaucagugcaaucaagaguaauuauuuuuugaaggccucugaggaagugggcacuaaugcuugcaguaucauggugcccagagagcacagccccuuccaggucaccagccaucuuucucaccugcccacucuuuggguucaagagguucaggcuguggaaccaaagaagacauggaguuugccuuaaaauugguagagugcagaguucccauugauggaauuguguaucauuuuuuggucuuuaucuuucuuuagcuaaaagggcuacauaucuauuuuucuaaacuuucucuugguuuugcuguagagcagcuuuuuuccgcaaacauaugacuuugacuuaaaguggcaauacuacuucuggaagguacuguccauaugaucuguuucaauuuucauugcuuuagauguucaugauaaggcaaaggagaaguaaaaucuaaccugucuccucucuguaaaugguuuuaagcaaauuaacugagucaaguggcagggcuuagauggcuguaguugucugcauuccuccacaugagaguuugcuuuucauauguauugcugauuagggagaguuauuccccuacuuggagaagcaaauguacagauauauucaugaaauuuccuguucuucugugggagggaggguagagagggagcuuuauauuugcuuuaugcuaaaaaggcaaauguuucuuucaucauacccagcuccaaaaauuguguaugcccuggcaccaaaguguugcccagagguguuuuggaggagcauguuaaaauaaaccuuguugcuggcagucucaaucccugcuuuuaaaaaaaugauagcuggccaggcacagugguagccuguaaucccagcacuuuaggaggcugaaguggguggagcacgaggucaggaguucaagaccagccuggccaagguggugaaaucccgucucuaccgaacauacaaaaaucagcugggcacggugacaggagccuguaauccuagcuacucaggaagcggaggcaggagaaucgcuugaaccagguggcagccugggugacagagugagacuccgucuuuaaaaaaaaaaaaaaaaaaaaaaaaagccauuuuuaggguggagguccuagauguugugugucuuauguccucugccaagaaccuuuuaagguguuaacuggcaaccacauacuuaggcuuaugucguagccagacuuguauuagaguaaguggguuuuacuagcuugucuuuuuuugaaagagaagggaaucuuucaauaguagagugucuacauuagacuaccagaaucuccauuucugccuggauccuugucuccaucccuuccuucuguugauuuuauuuuguuguuguguuuuuuuuguuuuuuuuuaaaaagacagugucuucacucuuucacccaggcuggagugcagaggcacgaucauagcucacuguaaccuugaacuccugguucaagugauccuccagaguagcuaggacuacaagcacaugccaccauacccagcuaauuaaaaaaauuuuuuucguggagacagggucucacuauguugccuaggcuggucucgaacucuuggcuucaagagauccucucaccuuggccucccaaaguuucugggauuacaggugucaaccaccaugccagcugauuuugauuuuuaaaguccuuuuguuaucuuguuaguaaacacaacugagaaagcaguagaaggggauucugauuacacuaacaaugguaagcaguguuucuuuggaugcaccuuacacauuuugggacauauccuucuaguuuuggauacaugugcacuccggcaguuguugcuguuggggaaguuucagggucagaaucaugugacaaccugcuucccuuguauuuugugcccagggcuagauaguucagcaagaaaucuuggagcaaugcgucuaaguugggcauuagguuauggaaggucuuccauagaaguuuggacagaugaacguuuauacuauuaagauguuuuauuucuccuauuauagacaucaaaacaaaaauaacagacucuaucuugaaguuuuuguguuuguucguuuguuuuugagacaaggucucacuguguugcccagguuggagugcaguggcguaaccucccaggcuccauugaucucccuccuuagccucccagauagcugggacuacaggugcguaccaccaugccuggcuaauuuuuuguggagacgggguuucaucauguugcgcuaggcuggucuugaacuccugggcucaagcuguccucccaccucagccucccuaaucguugggauuacaggcauaagccaccaugcccagaccaucuugaaguauugauuaaagcacaggcugaaauguuuauggcaaccuccccgccgccccuuuuaaaacucuucuucugcuaguggcuucauuguguucauguuuucccuuuccccucuguguagcaugcuucaucuuuuauucugaaauacauagccaaguuugggguuguccuuccuuucuccucucuacauuucugaguagcuuuugauguagauguuauuuccucuuaccuacauagauggcccaaggggcuauacaaagaaagcuguuugcacaggauagaauuaagagguaagauacccguucauacuuacuugaagaaucguucaauuuuaguggacucucugacccaguugucuaaauuuaagggguuaguuugcauguuuguuggcuauaugcuagcacuuaagguugaugaagcuuggaaaccaucaucugagaacccucuuaauagguucugggcuggaggggcagugacaagugauauggcaaggaaaaaaaaaaacacauugaauaugugauguuguuaaugcaaagaaaauucauaaaaauuuggcccaaagagaacaagaucauuucuuacucuguacgguuuauagcagcaugucagcauuccgucugcaguugagauguugauuccuccuuguauugcacauugcugaaaggggcuuccugaggcuggagagagcagugagguaagacuguccuccuugagagcucgucuugaugcuuguugcguuugucuguguaugucugcagugucuguucugcucuuuguaauuuaagaagagggcauucuuugaaaagaauuugggaauacaggacuauauaaucauuguauucuaagauugaucuacuguugagcuuugcuuaaagcacucccagcaacucuuguuacauguucagcuuaggcagagcccaccagccauuugugggccagguagaacaaccaaggucaaauugcuucuccuguuauucauuaaauauauguuguaugacacuguguugcccagcccacagcaagcuuuuuagcccuacucaugaagacauguauugacucccuaaaagcugcuaguuucccuuaguuuucaaacauuuuucuugauaauucucuuuaaaguucucuuuccucucagaaaccuucuugguugugagcaacagcuugguuaucacuuccuuucucaagaucuucaucucuugcuuuauugaaggucccuacuguauggaugacagccccaguucucuuuuuuauugucuuggguagaagaagcuucaaugcugauucuuauuuggucuuguaaaaugccauaauucauuguuuguuguuguuguugaauuuucuaauggcugaggagguauuuuaucuaacuagaucuuccuguuaaacuaaucagaccuccuguuuguuaccuuuuuaaacaguccuuaaauguuaaggguuaaaacacuguauuucacccuccucuacccaccucaggcuuacucuagauuaaaaugaggauagaaagcagagguuuauuugaagucuuauauucuaacuagugacaaggaagcagagacugaugacuugccacacagauuacacaugaaguccuauaucuuuuaaaugugucucuaauugguuauugguuucucauuucauucauguccaaugggagacagacaagucaacagguaguuauccuaagguaugauuugagaaggucuuugagaggaaacaugagauggugugguagcauucuguggggacacugaacuugaacuuagggcugagguuggcuagcagaagcuuccacaaggaaguaguuucucaucugaacgauggguaggaguuggaaggaggggagaagaguauuuuauguaggugagagagagcacggcaugucugaagaacaaaaauguaugugggugggucagcauggaagauggcagagugaccauagguucauuaaagcaguaggaaugaccagguuccauagggagaauguguagaagaaggagaaaagaaagccuuuguuuagcggaagagguuauguggaucuuucaauguagggcacuuuuuaucuaagaaguauggugggaugauauuuguuucgugcagucagguugaguagcuuuuuuguagguucaccuggaaaccuuugccuuuucauuuagggacuaaaaugugccuugagaugccaccagcaaugccaggaacauauuucaucccuuccaaacuggcaaggguuggaguaaaaaguuuccucacuacuuccaguaauaguuauacgcuacaggguugcuuuuccuaagguuauguuugaguaacguaauuuuuguucaguuaaugcuagaaauaaaaaaucauaacuuuaaucucaaaagaaguagaaucuuguuuuuguuuguuuguuuguuuuuugagacggagucucgcuuugucacccaggcuggagugcaauggcacaaucucgguucacugcaaccucugccucccggguucaagggauucuccugucucagccucccgaguagcugggauuacaggcacaugccaccacgccuggcuaauuuuuguaauuuuguaauuuuaguagagacaggauuucaccauauuggucaggcugaaaccaaagguuucagcuuugaggcuaaaggucucaaacuccugaucucaggcuguccacccgccucagccucccaaagugcuaggauuacaggcaugagccaccgcgccuggcagaaucuuguuuuaaaaugagcaagcuuuauacuuuccucaagcucaguguuaagguugugagugugucuauguguacucaucucuauuacauuuuaaaugauugguacccuaaacuugcuauuuggacuguauuuuucuaaaaugauacugugauuuuaaaauggucugucuaguauaacuuaaagggcuuaguaaauaacugcuccuaaacugcuccccuucugauuaaugaggcauaaaccucuauuuccugcaauaacaagaaagacaaauugauuuuuuggguaguuugacaaagacagaauuaacagauucaugguguggguugcauugcaucuuaaagugaauuuugcugugugacuguaauucuuucaaaagucaaauucaaggauuugguuuuacauaacuugaacaguaaaucuuuuuacucaaauugagaaaauuccugggcauuucagguuguaggggauugggcuuucaugaagucuacaugcucaaccuuuggguuucagauucuaaguguuuucuagaacaaaugaucuauuagaaacaccagaaaaauguggcuaggaacaauggcaaacuuuacaggguuuauuuagagaaauuuucuugacgugagugcuugaguaucuuaaggaauaugcugagacuuuccugauuaaagcauuaauuaugaagucaguuugauugugauucaguuuuagcuaccuuugucuuagauccugguauuuugagcuuuaagauugccaguaaauaauugcacgucucaagcugacuagugucaacaagaaagagucaaacucuguagaauguuugaagaaauaaauauucuagggcccaauaugaguggccaaggcccaaggcacagucucaagaacauauucccaaggugguugggucauaccuugauuuuauacauuuuagggggacagaauuuauagguagacaucaaucaacacauguaagguguacauugguuugguccugaaagccuggacaguuugaaaggguugguggggggcuuccaggucauagguggauucaaagauuuccugauggcaguuaguugaaaggauuaagcucucccugaagagcuaaaguuggcagaaagaaauguuuguaguuaagauaaauggaggcgggaagccaagguucuuguuauguagaugaagccuccagguaguaggcuucagauauuagauggcaaaucagauccuaaaaggugccagauucuuaguuaaauuucuccuaaaucaggaaaaaaccuagaaagggaaggagauucucuacagaauguagauuuuccccaaaagugaccaauuugcagggccauuucaaaauauuaauauuucagauaaauacauuuugggguaaaauaguuggauuucuuucagggccugcuaucugucaugugauguuauacuagaguccauuuggaauuugguaucuuauugcuacaaauaaucugcuuugucagucuuaagucuguuuuaauguuagugcuggacaguugugccugaauuccaaagggaggagaguauaaugaggcacauccaacucccuccuucccaugauggccuaaacuaguuuuucaaguuuacuuuggaaugcccuggcugagaaggggguccauucaguugguugguugacauucaugacccugaauaaaucaguuuauuccugcagguagaaaucuuccuauuugaaugaguuuuuguugagaccucuccuccccaucaguauuaauggaauauuuaauuugauuggcaguacaagagugcuagggggaaaggcuuaaggaaugagaccauaaccagauuugauagugaucauaucaauuuuacuuauauuucaacucuuacuauucccuguugucuccuuucugcccuuugcuaaauaaccuauaucccucaauauuucuaacaguccauagagagauagguggcauuuuccacaauugacagguaagggauaagagauaaagugaauaacaaauguacauuaaaggcacuuaguaaacagaucuccccauuccuaaccauucaucugcucuacuggcuuguguacuaagagcauacccauaccaaaaugucuugagggcauccaaagggagaacaaugggcuaaauuccuuuguucauuuguaucucuccuauuauuugcugacauguuuuucagaaagaaccguauuuguuuugcgaaaacaagcuuuuaauauacuuuauauauacuuuauaguuuaaccuacaugauguaggcauuuccagggacacaacaaucuccaccugggauuuaaaaaaagacuuuuguuccuuuucuuucaacugcuauuuuauuccauuugauucugcuuagaauguuacccuggcaaaucucgacucagcaccuugaccucugaagacaugcuguuuuacauaccacuucaagagugacuagcggguucuuuucugugcaauauaacugcauuaaagcuuagucuaggauuuuuuuaaagugaccaaaguaauccuacaaagcauuaugauuugagcugcauaauaaacauuauuagcucugaccuaucagguacaucuuaguuuuuaaauuuguuguuucacauuguuucagugccaggucccauuuuucacaucuugacauucuucagaucucagaguucaucaaaaucagguguacccuguucuugcugcaguucaaggagagcugcuucauuaauaaaauugguguaugcugaaccuugaguuaaaauauaaauuuaauuuuuaaaagccaaacuuuaagcaaagcucuuugucucuuggcuucucuuauuuuggcaaaacucccucaauuccagucaucagauaauguggagcccaagaauuguaagguuggguuuuuaugaauaaagccacauaacaccccucugcuccccaguauuuuccaacuuugaguuuaagaaguuguacugcuuuuucaguguugacaugagcacaaauggcuauaggcuaucauuagguuucuuuguaaaugaauaaaaugcucaucucuuuuccuuuuauccaggcuggacguaaagaaagaagugaugcacucaauucugcaauagauaaaaugaccaagaagaccagggacuugcguagacagguaaucuggaugaaagugcugauuguuuuucuaaguucucaauuuuguaguuuugauuaaaauccuaauaagcacuggccuuauauuuuuuuauugagagaaaggauggauuuucacaagaaagugccuaucuuuguuuuguugcuaauaugcuucuuaauggcuaaucaaauuucaugaagacaugggauaauacagucucacuguguuggacugaauaaguuagcucuagugugaaaggcauguacagguaggaaaauaaauuuaaaaugacuuggagaccugugaaaauaauccugaaggaucuuguuguauugacuauguacaauagagacagaaauuucaguuguuuaucugacuugcccuauacucauuacacacuugcaguucccuuagauccauggugaaauguuuccaguuccaaauaugguagguauagagauauuugaggugcugaauuuucugaguuaguaaauacagaguagagaaaucgaaccuuuuaaugauaaaugaccccauuaacauuuggagucaaauugaguuuuagucuuuaaagaaguuagaguugauuuuauaaagcaauguauuaagacuuaagaaguuguaauacagacaauuuuuaagagguaauggacagauauuuuauugcuuaugucugauauaaaacaaaauuaaagauaaaauauaucuuuauucaauuuccuuuuggugaagcaguaucagaaaugguuauaaagagaaccuuaaguuuuaagguucauagugugugaauccuuucagauaagccagauaacucuuuuuucucucuucucuuuuuauuuagccaauuaggcuaauuauauauauauuccaaggcuaugugccaguucaacccagagcugcuuucaguucagcuuuuguauuauuuaaguuguaagcccuaguuuuguaauucccaagaaaaaaggauauugucuuaagaacugagauucuguugcugaaaugcuguaacuguaguaauguaaaccauugucuccaugaucauguuuccuguguuguagauuauguaacugcauggcuuacaugagggguccucauguaagugcagcaagucuaccguaagcuucauuagauuuaaguguacaagagaauaaaaagcaaucuauuuaauaccuuuuugguagaaauaaaaucaaauuuuuacaauuuaaucauuagcuccgcaaagcugucauggaccacguuucagauucuuuccuggaaaccaauguuccacuuuugguauugauugaagcugcaaagaauggaaaugagaaagaaguuaaggaguaugcccaaguuuuccgugaacaugccaacaaauugauugagguaagugaauuagcaguuucauugacuuguaggcaacuuggugaaguguggugaguuuuaaucacauuauuuaaucaguuaaaauuuguaagggcucgcuuaacauacaacaugucugagaugauagucuuucauuaucacuuaacaucuaaggaaaacuaccauuuuggucacuuuacauuaacuauguacguuauuaaauacuaacaguuccuauccuagaagccuaacaucuccacuuaaugcaaauaaagauaaaucaugacaugacuagacucaaaagauaggauagaaagcaacaaugccuaagaaccagagcucaggaaccacacugccugcgcuugcauccugacaagcuaaccuaaccuuccucaauugccauuucuugucuguaaaauuaggacacugauaauaucuaucuugggauuauuuugaggaccuaaaaagaugauguaugucaaaugcuuagcuuuaugccugagacauagacucagaccagucuuguuuuaaaagcagagaaacugagcccugacauggggcuaauuaguuacauuugcuugguagaaaucuguauguuaguaguugguuuguaggguggcaagaagaaagagugaaucgugacuuauuucgcagguaaguuaggcuuacuucuccuuuugcuaacugaaauuauguuacuuaauuuauucauuauugcuguauuuuggaaaugggacacaaaauaagcauauauucaaguuauuugauuuuguaaucuuaaugcagaacaucuaauacuugguaaagauauuccauauaccauaugguaagcuggucauuguguaaaaacagaaaacgggaccuuauguaaaaugugugucucguacuuuugaauuuauagugauauuaggccacguuuuguuuuguuuuuauuuguuuguuuugaaacugagucuugcuguguagcccaggcugaagugcagugggacaaucucagcugacugcaaucucugccuccuggguucaagcaauucuccugccucagccuccugaguagcuggaauuacaggcacccgccaccaugccuggcuaauuuuuuuguauuuuuuuuuuuuuaguagagacggggcuggucucaaaacuccugaccucaagugaucuacccgccuuggccucccaaagugcuaggauuauaggcgugagccacugcgccuggcuaggccacguuaauaccauaaaaauuuuccgaggaagacaccaguagucacaucgugcauuacuaauuuuacaucauuuucuuugaacauuaaguguuauucugaccugaauucauuauuuacagaauacauaggucagucugcuauuuaaguuaaugauucuggcauuugaaacuaaaauuagaagacuuugauuuuguaucuccauuaagcauaaucuuguucacaauagucacaugacagcaugagguauaacuuccagauacacacagauugcgcucaggaagccagucucuuguaaguagcauacauauuagaaaguucuuccgcaugguaggaagcaaggaugcugccagcccaaggccuuggguaccaguguggugaagggcugaguguggcagcugaagagagggcaguccuugucuguauuggagcauccuuuauuagggccagcugcauuauccucugccucuccagccuaagagagcugacauuugcugagcaccuacuguguaucagcuaugugcaaguacaguguacuucccacaacauuucucagguaaggaaacagguuuacagagguuaaguaaguugccuaaguucaccuggcuuacaucccuccaauaaugagcacugugcacucaagcucacuggcuuaguggacagccuaauaccccacugaagcauugagugggcgaggaaguauuggagaccuugcuccaggagcuuuuuccaagcuuauauauuuuauuguauuucauuuaauucugaacacuacuaaccaaaggcccccccacccccaccccccagaauugagaguuugguguuccccaucacagcucaguucugaccccuuucuaaccucucuucucuccacacccccacacguuaacuaugcauuaaaugacacauggcuuuucauugcuugaggcauaaccauaggcuuuguagucccauucugcaaacaguuaaauuacauuuacgguaauagagacacuaggauguauaauugcauauguccaugaaaaggaaauaaauuuuuaaaguguuguagaagccucaaauuccugacuuauggcagaauuuuauucuucagugacaaggcuucuccuccccuaccacuuuuguauuauaaugaaacacuuugaacuagucagugacuuguuuuaagcaaagguaaaauauuucauugugaguguuaauuucuugacugcuucauuucuucuuguucuaacuggauuaaaugucuacaggccaacuuugguuuuaagggccauuugccauuuucccugggguguaagggaagugagagugcuauaugaaaguugggcaggguugauggugauaagccucuggcaagagaggagagguucagacauugcagccacugagaagucugccagauguguuuggguugagugcuccuccuaaaauacugcaauacaguucugaugcuaaucaccagaaguuagugcagaccccacagguuuagggcaugguccccaauaagauuugccuucacuucacaugucagcugcaaguucugggguccccaggccaccuguacuucugaccagccagguacaaaucugagggguuccuaugacccaccucagguuucaguaauccacuagaacaacucauagaauauuuuauuauaaaggauacuaaucaggaccagccaaaugaggagacacauaggauggagucugggaaggucucaaauacagagauucuaugccucuuccaaugaaaucaagguucaucauccucuugucacauugauguuucaccaaccagaagcuccacugaguuucaguguucagaguuuuuauugggguuucauuauggaggcaugaugauccaauaaugauauaguugaacucaaucuccaguccccuucccugaaagccccaguccucuaaucacaugguuggccccauauccugaggaaucuccuuagcauaaacuaucagggcuugccaugcaugaauaacauucuuccauuacuacugaaauuccaaagauucagagguuuccucacaggaauccaggacaaagaccagaccagacaaauuauauaauaccuccccaucuuaaagguauguggaaugcaugauuuuuagguagcuugacuacacaggccagcuuagcaugcugcagagucauaaacaccaccuggaagagguaaggcagggcaaguuuguuucugcagcuuuuugucgauccuuuuuaugguuguuacccagugauuuaccacuugucuuauugggugcuauuugcuuugagcuuuccuuuucccuggagaugcucuuuucugagucaaguuuuuucuucuccgcagggaaucugaucccaucucuucacaccagagugagugguccuuucucauagaaucauagguucuuagucugguguguaaaucccuuucacuuguaaucuuuauugucaugucuguauuggauccuucagcagugggaaacucucccuccagagacagcauauuuaacugguaugguagauucucuggcuguuagaggaggggaguuacaaccuccuuuuuuuuuuggaaccucuccuguccaugugcuugcugauuacacacaugugaauuagaaguacuuuaaacauaagauuaauggccgggcacuguggcccaugccuguaauccuaacauuuuuggaggcggaggugggcagaucacuugaggucaggaguucgagaccagccuggcuacauggugaaaccccaucucuaccaaaaauacaaaaauuagccgggcaugguggcgggugccuguaaucccagcuacuugcgaggcaagguaggagaauugcuugaacccaggagguggagguugcagucaaccgagguugugccacugcacuccagcuugggugacagagcgagacgccgucucaaaaaauaaauaaaauaacaacaaccacaaaaacaaaaaaccauaagauacauaugugaaaggaaaauaaaucuugggacccccaaaucaguaagcuaaagggaaaaaucaaucugggaacugcuuaaggcaaaccugccucccauucuuugcaaagucauuucucugcuguggggauaaaugcauaugugauugauugcuuccuuuggaaagggaaucagaaacucaaaagaaugcaacuguuugucucuuaucuaccuaugaccuggaagccccuucccuccuucgaguuguccagccuuuuagacagaaccaguguacaucuuacauauauggauugaugucucaugauucccuaaaauguauaaaaccaagcugugccccaagcaccuugggcacaggacuuccugaggcuguguuacaggcguguccuuaaccuuggcaaaguaaauuuucuaaauugacugagaccuaucucagauauuuuggguuaacacauacuuacauauuuucaggaugugauauagaaaaagaauauaaaauauggaaaaagaauauaaaauagcuuaguuuuuuuuuuuuuuuuuuuuuuuuuuuuugagacagagucuugcucugucgcccaggcuggagugcagugacaugaucuuggcucacugcaaccucugccucccaguuucaagcgauucucugccucagccucucaaguugcuaggauuacaggugccugcugucacgccuggccauuuuuguauuuuuagaagagauggaguuucagcauguuggccaggcuagucucgaacucccaaucuugaucaagugauucgcccgccucggccucccagagugcugggauuacaggugugagccacugugcccggcccaguaauaauuuuuuauauugcuuguauguugaaauaauuuuugguaccuuuuugccuuuuuaaugugccuacuaaaaaaauuuaaaaauucaggcugagugcgguggaucaugccuguaaucccagcacuuugggaggcugaggcaggcagauccccugaggucaggaguucgagaccagccuggccaacauggugaaacucugucucuacuaagaauacaaaaauagccaggugagguggcaggugccuguaaucccagcuacucgggaggcugaggcaggagaaucacuugaacccgggaggcggagguugcaguaagcagagaucgcgccgcugcucucuagucugagcaauagagauagacuccgucucaaaauaaauaaauaaauaaauaaaaauaaauuaaaaauucuucaguggcucuuguacuuuuguugaucuagaugauuucccugagccuuuuagagggucauuuuugucccagcucuccucugaaugcccuucacucaaggccagcccucacggaacaccuguuccggggucuggggaugaggguagagcaguggaggcugucaucauuccggaaggagacugcccaguguaucccaggaugccuucagccuuuugggcagcagccucacuuugugaugcccauugagcucacaguuggucagcaucccuaggcuuuccauacauaggugcugcugcucagugucaucauguucguuccuaucagcguggauguggguggguguuuggcucuuauguauggcuuugaaacucaucuaguauaaccuuauauuccaucucauguucuguccuaucaggauuccugcugcauuuuuccacauauuauuggcugcccccuuccauuuguguccuuucuuuaaaauaaaauaucuuuucuccuuuuauccaaccugauguuuuauuuuuauuuuauuuauuuauuauuuuuucuuauuuaauuauuuuuuaaaauuuauuuguuuauuuuugagauggagucucucucugucacccaggcuggagugcaguggcgcaaucucggcucacugcaaccuccaccucccagauucaagugauucuccugccucagccuccugauuagcugggauuacagacacgugccaccacgcccacguaauuuuuguauuuuuaguagagaugggguuucaccauguuggucaggcuggucucgaacuccugaccuugugaucuucccaccucggccucccaaacugcugagauuacaggcgugagccaccgcgccuggccuauuuauuuuuuuugagacagagucuuguucugucacuuaggcuggagugcaguggcaugaucucugcucacugcaggcuucgccucccgguucaagcaauucucccugccucagccucccaaguagcugggauuacaggcacccaccacccugccuggcuaauuuuuguaguuuuuaguagagaugggguuuugccauguuggccaggcuggucucgaacuccugaccucaggugauccacccgccucagccucccaaagugcuaggauuacaggugugagccaccaugccuggccucugauguuuaaaaaauguugccuaagauuaggcauaauauagagccuuuacuuuucuuucucuuuuuuuuuuuuuuuuuugagacaaggacucacuuugucaccuaggcuggugugcagugacacaaucauggcucacugaagccuugaccucccaggcucagaugauccucccaucucagccuccugaguagcuggggccacaggugcaccaccaugccucacuaauuuuuuucauuuuuugcagagaugggguuuugccauguugugcaggcuguucucaaacucaagugauccuuccaccuuggccucccaaagugcugggauuacaagugugagccacugcgccuggucuacuugguuucuguggccaccucccuagucugcacugccaucucucacugggcuucuguagcagccuccugauuaugauuaugauuaugauuaugauuaugauuaugauuuucuagcacuaacccugucccuccccugacccacccauccuguggcuucuagguaagccuggaauaauauucaaaaauccagauucucaaccauggccccuaaguuucccugccuacaacugccuuucguccugugucucccuugcugaaugacuucugccauaguugacuaguuuucaucuuugaccauaccuaaacaugucaccaccugugcccucuacccacaugucacuucuguagagaaacuuuccuggaacgcuuauccccuccauugcauccucuagcagucauuuuuucauucaccaguuuuacauccuuuguagugcuucuuacuaucugaaacuauugaauuuauuuucuuauuugucuggcccccaccccauacuccaaaagaauauaaguuaucugaggacaugggccaagaauaguaccuagaauauaguaggugcucagcaacuacuagaugagggaaccuauugguucucaaaguuaauaaacauuagaguugcccaggugcucaacauucagauuccugggcuaccacccagcccccuccccaagauucugauuuagugggcugaagacuauacuuuagaaaugcagagcucuacauuaugacugaucguccuuguuaguggacuuugucuuauucugaaguauguguaacauuugcacaaaagagcguuguaaugcaucuugcauauauacccagugugcacaaggggaaugaacugggaaaacuugugggauguggagauggugggaaaaauuuggagauuuuuuuugaaaagguuaacugacauugauuugagcaguuuuuuggggggggggaugggaguggcuagaaugaagcuuucaaaaaccuguagcaaacuuccuguauuugagggagaagaaaauuguaacaaaauucuuaaaauaaguauuuauagauuucuuaguauguccuggucacaguucuggacauuaggaauauaguagugaauacaacaauaaucucuacucacauaaagauuaucuuguacuaaauacguauuuuauauaauguauauauuuuuuacaauguaguagaaauuguacugaggugauacgugcaaguuguccauuuuaucagaguuugaaaugaaaguugaacaaaagcuguuauuucaguagcauuuuaauacaugaccaaaacaaauuuggggcagauguguugauucuugcuaacuugguuuuuggaaaucuuaucuguugcuuugauagaaauacuuuucucccagaccaaauaaaacaguauaaaaagguuaugcuuuaaucuggaguuucacauaaaguugcuucaaauaugugaauaguuccugaguaguauuagggcuaacacccacucagaaguggaaguguuuuaugaugccuuguguguauaucacacuauggaaauaagauucauuucaagaauaaaaaccacauauugacuauugagguuuuaucgacagaaguaaauuccucuagucccccuguguguacacagugucagggagucuguguggugcaggcugccuauuggaucuuuauuauuuuuugagaugugguucuugcuuuuuugcccacacuggucucaaacuccuggccucaagauauccucccuccucagccucccagguagcuaggacuacaggugcacaucacugugcccaguucuggguccuuauuuuaauaagaaucuuuugugauuuuacuuaaaagcaaauagcagaauauucgccaugagaucucucuuaacuguuauuuucugagggucuggcugggaccugugaccgccucauacugcacuucucaguggaaucugguaacucccugcaugguauugaagccacuucucuugugugaagggugcauagauguuguuuauccucaaggccagugaguaaggggagcaggagccagagggcugguauuggugggcuggauggcucuucccuuuaccauuuucuucuguucuggaguguagcauagcacugagggcauuucuuucaucuguuuauaaaauaacauggccuuucaaggccaugguaaggauaacaccuuuuauacucaccccuuucuccccuaucaaguucaugauuucuuuauguugcucuucaauuuaaaguguacugaggugaagaauuuauucgcuaucagaaauauuaaccuuuuugucaauaacgcaguacccauguguccuuuuuaauugcuucauuccuugcccaccuccuuuggcugugagcagcuuaaacagccaaagagcauuguuuuaccuuuuauuuugcucucuucugaguacauuuucaauuuugugaauugagagaguggcauagggaaaaugccauuaaugaaauccugccuauaaaaaugauauauuauucauaugauauauacagugauuguguuucauccuuuccccgcuaccaccaguaacuucaguccaaaauccuuuccccucagcuccagaccuuguauuaaaauguggcuguuauuauaaugaauuugcuacaauaagauucuauuccauggacuaccuugugaauuaagaaccaaaaagugaauguaacuggcaugcuuuugagcuguuaccuauaccucacaccgcaccccccccccccccgcccccgcccagcacacacaguauuucccauuaucuggaacuucauaggcuauggcuuuauugguuugaaauguauauuuuaacugcaaauuggaugaucugcauuauaacuuuuauuccguaguaugcugauaauaugugguaaaguggccuugaaaaaggcucuguaaggagcauuugaauuaaacacugaccugacgugacuaccugugacaucuuggguauuuucucaguacuguaggcugauauucuggcaaaaagcaaauuuuaaaugaagcuucaguuuucucagauuauggaauguuuucacgagagaaguuagcuguccuuggggagaaugcugaccuuggauuccagaauucuaagcauacuagcuugauuuuucucacauauucaaggguuuguaaguucagacccuuacuuuuguuugagacaaaauugucuuacauguguucuauuuuuaacacuuugaccaaaaauaagcuuuuuaggcagaauuuaacuaccucgucacauuaugggaugaucaagcaaaggcaguuggaugaaccuuguucucaaggggcaucaggauucuucuuuucucuuggagcauugguaggcaugacuaaagaagcacucugcccaaccuuugcucuguuccagaaaagagaugcaguuuggauacagcuuuugauacaguuuggguauuugucccugcccaaaucucauguuaaauuguaaucuccagggaccuggugggagguguuggaucaagguguuuggaucugucauagcuggugcugucuuugugauagugaguucuuaugagaucuggucauuuaaaaguguguggcaccuuccucccccacccccccccaccccuucucuugcucuucgucuuaccgugugauaugucugcucccaccuuugccuugcaccaugauuggaaauuuccugaggccuccucagaagcaggugcuacuaugcuuucuguacagccugcagaacugugagccaauuaaaccucuuuucuuauaaauuacccaaucccagauauuucuuuauagcaaugcaagaauggccuaauacagccuucuuguuuccucaucaguagagcugauggauuaauguuuagagaguaccuuugcuagcuuuacuuauaaauuauucacacacuuagguagacuagaaguagagaacuuuaaaagugguucauauaauaccaugugaauggaaaugauuacaagaucaucugaguggugaucugcaccacugcacuccagccugugugacagagugagacccugucuuaaaaaaaaaaaaaaaaguuauccuaaagcuuuacuacgacaugucuaaguguggauuucuuuuuauuugccccauuuggaauuugucuucccaagucugaaaaugauauuucaucccuucugaaaaacauucagccauuaucucuuucagcauugucuuucccaucauucucucuguucuuucuuugaaauucuugguaguuaaauaguagacuuucucaguuuaucuugcaugucucuuaaauucuuuugugguuuccacauuuuccauaagaugaaaauaucuugguuuuucuaaagaauuuccucauuuugacuuucuagguuacuaauucucuuuucaguagaguuuaagucaauaucacuuuaaauuucuagaagugguagaaauuacuacuuuuuucuugaacuucuauuuugauccuuuucaaaucugccuaauuauuuuugagugucuuuuuccuuaucuguacucuucuguuaacauaaauauauuuuuuaaauugcauuuucgaucauuugaguauugcguuauuauggaucugauuacacagguggugguuuugcuuauucuugcccaagacggcucauuuccuuguauacuuuuguuuuuguuuuuguuuuuuuaauuugugaguucacauuccuggaguuuuauugugggaauucuuugaagccuguguuuagcuuaccuuccaugagguaaaauuuucauuuauauuugcuucugccaccugcuuagagguacuacuaauacauaaccucuuaaauguaaaaguuuucugaaccauauacauaacauaauuucuauaccuaaaccucugccagcuuuugauuagaauuuggagugggguauaggggcuuuuucuucuuuuccucccugagcgaaugcuuagacugagaaauacccucuuuccauggugacuuucuugaucacucuuaggguuggucacuuacuaggguuguugccuuuugccuguuccagcucugcgcagucucugaucugagucaucuaccuugagaggacccuggccuuggcccauuaaaacccaaguucucaucaugaaauggugccucccugcaaaaccccccaccacccaccagaggaaacacuguuuuggcugauugcuuacuucucugaaguucuccuuucucuuuucuagccucugacaauuucucuuaauuuuucaccugccuagcucugcauuaaaaauugaaaaagcauuauuaaagcauaaucuguauaccauaaaauuaaccauuuuaaguguacaauucagauuuugguaaguuuacagaacugugcacccaucaccacaaucuaguuguagaauuuuucuauuauccaugcauacuucauuuuucaguauuguaagauaucuuauuucuccuaauaagaucaccaacaccuuucccuggaaauuggaaagguaggggcuuaucaucauuuccccuguggguuuggaaguaguuguuaaaaacuuauugagugccucugaaauguuaugaccugcauuugggacuuuuacuuuauguacgacaaguuuguaaaaguugaguuuuugauuuuauuguuauuuuugacuuuuagacauucagaucauuuuaaagaagaaaacucgggugcuagcuuggcccaggggcacaggggaagagaugaauguuuugaacucuguuccuuugggcugcugcugcguuggugggucauuauuuagacuuaaaagcucccugucccacaucucuucucacuugcuuacuccuacaacagguauaaacuguuaugagagucagucauuaauuuauuaucaagaacaaaaagaaaucuuaucuugucuuccuacaaacauuccaggauaagaggaacucagccaaauaggaagccaggagcaguuaaggaagugggaaacaacuuguguucgacuucaguaaaucauaaaucuauguauaauagagaaaaauagucauuaugguuacagaaggagcaggauugaaauaaagucauaaugggauuuuuuccuaaaugaaacuucauuuaacaaauuuuauguaaguaaagaucauccaucguggaguaaagguagagccuuccuaaaagacugaaaaaguugucugucauguacagaugucuaaucuguugaucugacacaggggggcugugagucauuuccucaacagcucagauuugagcuuggguuuuccugaaaccagcaaaacccaaggccgauuguuuaaauguuuucugaaaccugcucuuccgcaagguccaaacuuccacacaguaggcacagaugguacaaaagagggcugccugaucucaaacuagugguuguggugucagucuuagccuaccucuucgaauagugggaaucagagacauuuuaguuguuaauacaaguaacugugguaggaaagauaauaauuuauucuccuaacaaauccagagauacuucucacuguucuacgaagucuuggcucugcuggguucucuguggaaguuaacugcuccaaguguuuuucuuuucucuucucuucucuuccgcuccccuccccuccccucuuuucucuuuucucuuuuuugagagagucucgcucuguuguccaggcuggagugcaguggcgccaucucagcucacuucaaccuccaccuccugaguucaagcaauucucaugccucagccucccaagcagcugggauuacaggggcgugccaccacgcugggccaauuuuuguauuuuuaguagaggugagguuucacuauguggccaggggugggucucccaacuccuggccucaagcaguccgcccaccucggccucccaaacugcugguauuacaagcaugagccaccacacccagccucuuucuuuuuuugggacauggucuugcagucauggcuugcugcagccucgaccuucugggcucaagcuauucucccaacucagccuuccaauuagcugggacuauaggugcgugccaccacacccagccaaugaaaaauuuuuuaauguauagagauggggucuugcuauguagcccaggcuggucacaaacuccuagccucaagugauccucuugccuuggacuggaagccacugcacccagcucagaguguuucucauucuaaccucaggaucuucuuuagucucauuguuaauaguuacgucauucuagagccccagauuuuccacagaaagaggcauuuaggaagcuccucuccucgcccucuccuuucacuguagucaggccugacacuaguaugugagguuagccucucagagagcuauggucaugauguugcauuugcacauuugucauuguuagaagugaguagcccugucccuggggggugaauugaagcucauucaucuggagaagacuguuagugacaggcacuccuuccuccucccaggccuccugaaauaggcagugugcucuuguagaacauuacugcuucaacaguacaccagaaauauuuuaaaguaauguuuuaaaauaaagaacaagucuuccauaaccuuuguuuuguuaguguuuguaaucaugaaacagaaaagaugguuuaacagccauuucagccuuagccacacacuacccucaugugucugauguagagaguacuuacguaaucuuuugcuucuuuuuuaaaaaucuuuugcuucuuaauuuaaauauuuuucugaguuuuaaggauucauaagauugagaauauagauugaaauaagauugugcuaguagugacuguccuggauccagcauucaaguggccuccuaaaugauuggaauaggcagggugcugggcaccucaccagggaucuuuguuuuuuguuuuuguuuuugagacggagucucgcucugucgcccaggcuggagugcaguggcgugaucucggcucacugcaagcuccgccucucagguucacgccauucuccugccucagccucccgaguagcugggacuacaggcgccugccaccacgcccggcuaauuuuuuuguauuuuaguagagacgggguuucaccguguuagccaggauggucucgaucuccugaccucaugauccgcccgccucggccucccaaagugcugggauuacaggcaugagccaccgugcccgguacaccagcgaucuuuguuagucacaaaaugcuaauuuuuucaaugaucaucaucagauuuuauguuuguuguucaaaaugucgucuuaaggcagugaagcaauagaaguuguagauuacucuucaugaacacaucuaauucaagcuuucuccuucaaugaauauuuguuuccuuuuuuuuuaagucuuacauuuuacaaaauuuaucuuaggucauauuuugcagugauuuuuuaagcaaacaaauagaaauccccagucaucucuguagauuugucauccugaaaagaaaugucucucugcuuggguccagaugacagagaagguggaacuguaagugucagggaguauaaguguugcuucuuuaugugacuuugaaggacucauaaacaucagagaucugacuuuccaguuccuuuacauuuuuauguuuaaauugcacguuaacuucuuuuguuucuccuuguguuugggcauugcaggauucugauaguuagcagucuuauagaaagcugauaauccuuaacuguagcacuacaaacaacugccguaauaguguauaauuuuucugauguguuuaugugcuuaaguugggcggaggagugaaaaucaaagguuauugccauugcccuuguuuacucuagcauuuaaauucccagaaagugccucugauauucaacugccuacgccuuuaucauucauaacucaguuugcaacugggguaaagaugugucucaguaccguguauucaguugggcccagauauugcuaauggaauuggcaagccuguucauuuagaaauauggauaagugaucacagccuuagcagucacuacgcaguaacauuccagagcuucagcaaaggaaguaugacacaaccuggaaagauuguuccuggccacgugagcuguaucauugagauggcuggacgggaagguaaagauuucgguucaaauuaagccgcaucagccaggagagauucaagcugucaguguuuuugagaacccaguugaagggcaguuuugcuuuuaacuaugaaacauaaccaguuuccuuuuccacuuuugaucaugauugccuuugguccaucuugauguugucuucauguuauuuuuuuuuguuugaaaaauugucugguguucaaauaaaauucaucuugccuuaaauuaagcaucuauucccugucaaaugagcauagcaccuuagaguuuuuuauuuccuuccuucaagaacacugcaaaacacauuuuugaggauaacaacaguucuuuccugaugcccuugauucuucagcuuuucucaccuuauugcccauacuagaagaaccuuuuucugaaguuacuguucaggcggguuagaggccaugcaaagcaugugaguuacaggcccugggaucuuucaagguuuugccaccaaccugcaaugugauguauguuaugagucuguauaguuugcuuuguguagaguuaaaaauguguccucaucuaaguaaauaaucaggcugugagaagggaggcacccuuggugcccuugucaucuguuccagaauggucagagguagggccagguguguguuuuuuccuuagcagucaaaagagaaaaaucuuuaaagauuauuuuuuauguuuauagguugccaacuuggccuguuccaucucaaauaaugaagaagguguaaagcuuguucgaaugucugcaagccaguuagaagcccucuguccucagguaaaguacaacugacacuggugacagcauaaccaaauuaaauuuugauucaaguggagaugagguuuauuuuguuaaguuuuguuuuguuuuuaggauuuuagauggaagucuuggggacagaucacugacacagaacccacauaguuuggaauauuuuuuguuuaacauuaagugacauuugcacgggagauuacauguuacuccuggcccuucauugaaaaugcacagugggcugggcacgguggcucacgccuguaaucgcagcacuuugggaucccaaaguggaugggucaguugagcccaggaaucugagaccagccugggcaacauagcaaaacaccaucucuuaaaaaaaaaauacauauuuuggccgggcacaguggcucacgucuguaaucccagcacuuugggaggccgaggcgggcggaucacgaggucaggagaucgagaccauccuggcuaaaacggugaaaccccgucucuacuaaaaaaaaaaaaaauuaggugggugugguggcaggugccuguagugccagcuacucgggaggcugaggcagcagaauggcgugaaccugggaggcggagcuugcagugagcugagaucgcaccacuacacuccagccugggcgacagagcaagacuccgucucaaaaaaaaaaaaaaaaaaauacauacauacauacauaaauacaaaaauuagcccaacaugauggcgugcaccuguagucccagccacucaggaggcuauggugggaggcuggcuugagccugggaggcaaagguugcagugagccgagaucacaccacugcacuccagccuuggugacagagugagaccuugucuugguggguugaggaagguauggugccuuccauugcuggaaaauacaggguggcagugaccacagucuccuugagggagagucuacacccuccuugagggccauuugugacaucuggccauccuggaaccaugagaguuaccucacacuauucaccuauauucauuuuaauggucaguauuugggucucuguguuggaggaaaccaaauucacaagcuagucucuuuauucuguagugucauaaagcagccuuaugauacagauaguaacuuaauuuggccagcuucugaagugaaagcucaagaacuugucuccauuuauaauaguauauuggaagacugaugaugaagcuguguuacacaucuggcccucuagaaagacucugaagcacacaugacagcgaaugcuuuuuaagugcccaguguguugccugccuccugugagaagagcugaguuuguuugucuggcuugacacuccuugucauuccagggauuucuaaggaguauaagugaugauucaguagaagagguuuccucuccacuuucccauguguaaauugcucauggcauacucugaggacuuaccucucuuuacauguccugccagaaggcaguggccucaaauaaaggagaguaagcagagggacuggagaaaugaaauagaggucauaggaaugaaguugcuauguuaugucugcaaccaauuuuaaaauauucugugacuauuauuuggcuuuuuucauguaaauaaucccugacauucaagguaggcaaccaaaauaaguaaagccucucucggugguuauuaaucugucauucucauugcuacauagguuaguagggcauuuguucuaacaccuaaccauguggauuaauuugccaaugagaguugcucugccuuaauauuacugugauggacccauugugaauucacaucaucugauagacauuuucccaguguuaguccaguccugaaaucugccagucauugacagcugcauagauauuugcaauggauccaaucaccacauccagaaggaucuuggauggccaaguuguaugagacagauuugaauuuggauucuuucuucaaguuuguuugccauuuacccuaucagcacuuuguuuuuaaugucuuugguuuuccauuuggucuugaaaugcuugaaaagcgacaaugcuuucacaaaucuguggaaacagaugguagcauacacugaucacaccuaccaagaguauuuauauaaaugaucuuaaaacccaggaaaaaaaucacacggagagucuaguagauccuaaugaaaaugauggugugcauaaccuguguggccaagccaugucacauggguuugaguuagccaucagaaagcaaugugucuuccucucccuugcaguuucauuuuuccuacuaaaacagauuucaagaggaauaggcuuuaggcagacagugcccagaccacacuugguacuggguauguguccugaaaaaaaccauguuuuuucaagugugauuauucuucagauucucaccugggcucauugcuacucuugcucacaaacugcuaugcacacaggacugggcagguucaguaauggcaaauaaaguagguguuuacagacauggucacagcaaacugggcaucaugugcuugauuuucaguaaggcagcuuugacuucaccccagccccguuauugccagaucccuuccuccuccuccuucuuucuuguuucuucuucuuuuuucuuuuuuugagauggagucugacucugucacccaggcuggagugcaguagcaugaucucugcucacugcagccucugccucccagguucaagugauucuccugcugcagccucccaaauagcuggaauuacaggcaugugccaccaugcccagcuaauuuuuguauuucugguagagacgggguuucaccauguugcccaugcuggucuugaacuccuggccucaagugaugccugcuuuggccuccaaaagugcugggauuacaggccugagccaccacgcccggcccccuacauuauuuuaaacaaaaauucugcaauucagauuuuucugucaugucucaauuuuaaacaauugguaacuaauuuaaaguuuuugaaaucuuugaggaggauaacucaaacucuucugugugcugccucuggccugcuguggcccguguguuucaugcucagaggaucucuccuucaaggaagcgaagggcugucccucggaggaagagggccuugauuguggagaccucugccuccucucuugugggcagugaucacaagcaccacggauccugauuuugagguauucccuuccaaggucuaggcaaguuaaucaacauguuagguaacuaggguaguuaguuaauucacuaggagcuuaauuugguguuuuaauaugcugcagcauguagccaaacauuuauuauuuuaaaguguguguuucuuuauaguaaggcuacuguugaccucucuucacaguguggaagaggugcucagugcuucuaggauguauuuuaguguuuuaugccucaugcccaggcugcuguacauaggcagcacuacaguuuggaguuggcuccuauaugcuauuuuuaguuucugguggggagaaaugacaggugggaccauuagaggaguuuucauccccaugccccccauccgcccuuuuuuuuuucuucuucuucuucuucgagacagagucucgcucugucacccaggcuggagugcaguggugcaaucucggcucacugcaaccuccgccuccaggguucaagcaauucuccugucccagccucccaaguagccaggacuacaggugccugccaccacgcccggcuaauuuuuguauuuuuuaguagagaugggguuucaccuuguuggucaggcugaucccacccuccuuggccucccaaagugcugggauuacaggcaugagucacugugcccggccuuucauccccauuuuaaaguuugcccuauagcaaauuaacuuuugagagacauaggaaaauccauucuacaguacucacuuuuuagcaguuaaacaacuuuaacuggaaacauuugagauaguaaaguugaguucaggcccugugcucacaucuguaaucccagcauuuucagaggucaaggucgggggaucauuugaagccaguauuucaagaccagccugggcaacagagcgagaccccaucuccuaaaauaaaagaauuggcugggcaugauggcgugcacuuguagucccagcuacucaggaggcugaagcaggaggaucgcuugagcgcaggaguuccaggcugcagugagcugugauuauaccacugcacuccagccugggcgacagaguaugaccccuuugaccccuucucuaaauauaacaucaaguugaggaagaaguaaucuaaaaguggcuauauuuuguugggagaaggaacccacauuuuuuggcgauuuguuaucauuaagaaaagaggagguaggucggcucucucucugcauugccuucuacuugauggcuacuuucucucacucuuuucucuggaaagggaccugccuccauccgagcagagcgccccggucucacaaacuuuuacgaggaagcaguuuacaaauugguuugggaagagaccagaaucuguacccuuuguaucccaggcauuauguuuugcuugugaaugugcccguuuuagucuauaguagcugcuuuaaauauuuuaauuuuuaaauucaaaaccauuuggugugcuggucaggaagaagaaacaaaaacacaaaaaccccaaaccuugcaaacagcagcagguuucugacauuuugagucuuuaaaaucagaggagggcauuuuggagauuaucucacucaauauuuuuucuuaguucauuaugcaagaaugagcauuacacauucguauuaacauuaaguuaauacaaaucuggcacuuaaauaauuuauaaugccugguuuaaugcauggcuuuucuuggaaauuuacacaaaggaugaauuaaguauaugaagccucuacuuaucuacauuuuuuucuuuccuccccccccacccuuuuuuuuuuuaagagacagguuuucacucuguuacccaggcuagagugcaguggugccaucaugaaucacugcagccuugaccuccuagguuuaagcaguccuugcaccucagccucugaguagcugggaccacagguggacuccaccacacuuggcuaauuuuuaaaauuuuuuguuugcccaggcuggucucaaacuccugaggucaggugauccucccaccugagccucccaaagugcugggauuucagccugugagccacugucccaggucucuuuuuucuuuugguauuucucacucacuaaauugagaaguuacuucugaaauuguucauucuuccuucugccucccuagauuuaucuuccauauugcuucuucugucauugugcuuaugggaacccugaucauauuuguggcugacaugcuugacacacaucaaauaagcauaaacucaggcuggccuggccccuagcucuaggugggaaaauacauggcccuuaaaggagcaccccauacauacaggacggggcagaccuguggcuucagcugucacuuaaccuauuauuucacaaucaugggaccaucugucuuugaaucgcuucacuuuuccacuuugguauucucuaaucugguuuuuuacaaagcaguuucacagagaacucaagggagaugcuucuuacuaaaaguuucucugagcauuuucuguauccucccaucucuacccuucugugccucccaccccuccuugacugaggucuacagguaacagccccacagaggugcugugcucuuuucauaaggcuugccuguugcuuugcugauuucuguaucuuaaaauuggaaaguguuuccuacuuuucuuuuuuuuuuuuuuuuuuuuuuuuuuuggaaaaaucuguguauauuugguauuaguucuuuguauguuugggagaauuuaccagugaagccugguaacuguuaaacucuagcugggccuggaauuugcuuugugggaagguuuuuaaugaugacugcaguuucuuuaauagacagggauauuuaggguuuuuuuaauucuugagugagcuuugguaauuugucuuucauuaauuuucuacucuuuguuuucuuccuucugcuugcuuuggguuuaauuugcuccuuuucuaguuuuaaaauuggaagcuuuaacucauugccuugagaccuuccuuccuccuuuucuaagguaacauuuaaacauuuuaauacuauaaauuucccucgaagcacuguuuuagcugccccacagauuuuuauuaugauguguuaaauaugguuaggaugggcaggaaggacucacugagaaagugauguauaaacaaagaccugaaggaaaugacagagcaaaccacggaggaugucucaggggagagagcuccaggcagagagaacagcaagugcaaaagcuuggaggaaggagaucagauaucuaaaacaaguuuagggacugcagggccuuuggaggccuuggucguaggccuuuggcuuuuaauuugagaugggaaaccauugaaggguuuugaguagaagagugacaugagcuuacuuagguuguaacaagaucucggccaugcgcagugccuuacaccuauaaucccagcacuuugggaggccaagacacagugacuacuugagcccaggaauucuagaacagccugagcaacauagugagacccuguaucuauaaaaauaaaaaauuugccaggcaugguggugcaaggcuacaguccuggcuacauggaaggccgaggugggaggauugcuugaauccagaggucgaggguauagugagccaugauugugccccugcacuccagccugggugacagagugagacccugucucaaaaacaaaaaaccaagaucucucugacuucugugaagagggaaagaagcagagaggcucuuuaggaaauugcaguacacagaauaauggccucccaaacaugucaauuuccuaauucccuaagcccaggaauguaucaccucacauggcaaaggggacucugcagggaugaauaaauuaaggaucuuuagauggaaagauuauccuagauuaucccaguggacccccccccaauauaaucauaaguguccuuauaugagggaggcaggggcaucagaggcagagaagaaaauacagugauggaagcagaggcuggccacaagucaaguaaugugggcagccucaggaauuuggagaaguuaagggcuggcuuuuucacuagaaccuccagaaggaacacagauuugaugauaauguuguugauuuuagcucuguaagacccauuucagaauucugauguccagaaacuguaagauaauagauuuguguuguuuuaagccacuacauuugugguaauuuauuacagaagcaauaguagacuaaaacagaugguauuguacuaauccaggcaagaguacaguggauauggugagcacugguuagagucuggauauauuuugaaggugaacuuuacugaaggauuagaugugaggugagagagaaaaagagucagggaauauaacacaguuuggagccuaagcagcuggaaggacggaguucccauuuauuuugguaaggaaagaugguuuggggaaagagauaaguuuuggacauguuauuuuugaggugccuauuagacaugcaagaugcaugucauguugagggcagaggucugaacaggauguguaaaugugagacaucaccaagggagugagucuacgugaaggaaagaucugggaguggaacuggggucccuaacauugagaguuucaggaggugagcaguggccagcacaggagccugaggaagcacugucaggaccagagccccggaagcugacugugucuuagaagccaagugaaagaaaaaaaagcgggggaguuucuaggaaaagauuagaugagauugcccaggggugggaagaguagaaagaggagagaaggcagcauaggacugagcuuugaggaaaucccaacaccuuagaagaagaugagagagcaaaggagacaaagacaaaauagccagaaugauggaaacaaaacggaaauaguguuugagaaaauccaacauccauuccugauagaacacuuuacaaacuaggaaaaggagggaacuuccuuagccugauaaagaaucuccaugaacaguugauagcuaacauuauacuuaaugguaaaaacugaaugcuuucccuguaugaucagaaauaggacaaggacguccacccuugccacccuuaugucacacuguacuggggcucaagccaacaacagcauuuuaaaaguuacgaucaguacagugaucgugccuaguugggggcuccuugcaaauuuaauaguaacaugaauuuccauuuuuaaaauuauauaaguaagaguaaacuccccccaaccaauagcuguuuucucaucauuuacacuuuaccuuaaguaagugguccauuccugucccuguuuuucuacugcuguuuugguguuuuccuuauugauuuaccuaauacuguauauuuaaucuguaauauauauuuaaauacagacauacauaauugaauuuauagguugacgucucccauuguuauuuugaaauagaguuuucuaagacauaaauauugugacuaauggugacuuaguauauauggcgacuuaguauauaacugaagugacuuuuuuuuuuuuaacuuucguucaguuuuuuuuuguuuguuuuuguuuuuuaacuuucauucaguuucguugaaacuguucguuucuuuacagauuuaaccuuuacauauuucguuugaaaugcuuugugagagaucugacccucccuucauuuuguauucuguuuuuuuuccuggcauauagaaaggcuguugguuuuuacuauuuuauauugucuuuaguuacauuaaugaacuuuuauucuaagaguuuuuucaggccaggugcuguggcucacaucacucacuaaucccagcaccuugaccaccugagguugggaguuccagaccagccugaccaauauggugaaaccucaucucuacuaaaaauacaaaaauuagccaggugugguggcacacaccuguaaucccagcuacucaggaggcugaagugggagaaucacuugaacccgggaggcggagguugcagugagcugagauuaugccacugcacuccagccugggcgauagagggagacccugucucaaaaaaaaaaaaaaaauucaguugauguacuucaauuuucuguguaauuugcauuggaguaugugauuuuucucauuuuucuaacaguuuuuccuauuauuuucauuucucaccuuauuucuuuggcuagaaaguccauuauauuauuauuuaaccaauggugacaguaaguauuccaauuaauaacaucuugauuuuuuaagguaaaugauuuuauaguuucacagcucagugucauguuggaugauuaaaguagcauguuaaggacauaucuauauauuuuuuuaaagacagggucucaugguuacucaggcuggagugcaguggcaugaucauggcuuacugcagccuuggcauccuggguuuaggcaauccccccaccucggccucccagagugcugggauuacaggcgugagccacugugcucagccaggacaccucuuucuauuccaaauuuaguaagaguaaucagaaaugaguauuuaauauuaucagcugucuuuuguacacaauuuuguaaucaaaaugagaaaacuaaccuuaggcaaggugcuuccccucauuauacuguaugcgauauauuacaaagaaagcauuuuucccuuuguagugaaaaauaaguaaaacgugugauuaauucccugcccauguuuacuuggcucucuucggaaacauuuucacuagccaaauauucuuacaguguauagcuccacucugauacauggauacauuauugaauuaaugaguuaauuaaugaagaaaguggucuuacaauggugaacacauguaguggauaaggaaugacaggaaggaauaagucuuuuggaugaaagugugggagaccacagcauaacgugagaaaaacaaggaucucuucuuccaaauuauugccuaaacccaggcacuuauggaaguguugggcuauuaauaguucauaaacugggauggcuuaguucccugugccugugaaucuauaauugacagucugauaaucuaccaguucuaaguauuaaggagggaagaggaauagcggcaccaaucuagugggccugagucgucuuuagucuguuuucaccuccagccuuuggagggcuaaguuacaacauucuugaauaccccuccaauaaauugggaauuacacccaugauccaaagcaucugaaaaaucaccccagacuccuccacucagggcugcccccacacuccugccucauccagguccagcaguuuccucuugucuuugcuuccuucccaaguugcaugauuauaaacacauuuacugggccgggcgcaguggcuccugccuguaaucccagcacuuugggaggccgaggcggguggaucacaaggucaggagaucgagaccauccuggcuaacacgauaaaaccccaucucuaccaaaaauacaaaaaacuagccagaugugguggcgggcgccuguagucccaguuauucgggaggcugaggcagaagaaucacuucaaccugggagguggagguugcagugagcugacauugcgccacugcacuccagccugggcaacagagggacacucugucucuaaaauaaaauaaaauaaaauaaauacauuuacuucuaauaacccauaagcaccuuguaccuaggaauccuacuaauuauccucucagcgcauuuucauacuacucucauuauucacuuauucaaugaauacagccgaaggaucugaauagacaucucuucaaagaauauaaacaaauggacaauaaacauaugaacgguaccugacaucaucagcuaucaggaugguggucacuucagauccacuagcauggcuagaauuaaccaaaaagggggaaaauaacaaguguuagggaagauguagggcacuguaacccucauacacacuggugggauguaaaaugguacagccacuuuagaaaaagguaaagcagcuucucaaaaguuuaagcacaaaguuuacuauauuucccagcaguucuacuccguucccagagaaguaaaaacacagaaacguguaugagcguucauagcaacaugauucauaauagucaaagaguggcaauaauucaaauguucauuaacugaugaauggcuaaguaaaauguggcaugguaauauaacagaaucuuauucaucaacaaaagggaacaaaguacugguacaugcuacacaugagugaacuuugaaaacauuauguuaggccaggagcaguggcucaugccuguaauccgagcacuuugggagguggucaggaguucaagaccaguguggccagcauggugaaaacccgucucuacuaaaaauacaaaaauuagccuggcgugguggcacacaccuguaaucccagcuacuugggaggcuaagacacaagaaucgcuugagccugggagagggagguugcagugagcugagaucgcgccacugcucuccagccugggcgacagagaaagacucagucucaaaaagaaacacacacacacacuaagugaaaaaagcaaguuacaaaaguccacauguuacaugauuccauuuaucugaaauauccagaauagacaaauccauagagauagaaagcaaauuagugguugcaaaaaaaaaaaaaagaaggggcuaaggagaguuaaugggaaauggcugcuaauggauauggaugggguuucuuuuuggagugaugaaaauguucuaaaacugaauguggugaauguugaacaacugcaaauauacuuuaaaaaaccaaugacauuguguccuuuaaaugggugaauuguagauaggugaauuuuaucucaauaaagcuguuuuuugucuuuuuuuuuuuuuuuggagacaagagucguccuguuuguccaggcuggucucgaacuccugggcucaagcaguccuccugccucagccucccaaagugcugggauuacgagcucgagccaccacgcccagcuuguuugucuuuuugagguggagucucacuguguugcccaagcuggagugcaguggugugaucacagcucacugcacccuugaccuccugggcucaagcaguguucccacuuuggccucucaaguagcugggacuacaggugugugccaccaugcccagcucauuuucuuuauuguuuauagagauggggucucacuauguuauccaggcuuuaaaauuaauauuuauuuauuuuuauuuauuauuuuauuuauuuuuuuuuugagacaacaaguuucacucuuguugcccaggcuggagugcaguggcaugaucucagcucaucacagccuccaccuccuggguucaagugauucuccugccucagccuccugaguagcuggaauuacaggcgugugccaccacacccggccaauuuuguauuuuuaguagagacgggguuucaccauguuggucaggcuggucucgaacuccagaccucaggugauuugaccgccuuggccucccaaguguugggauuacaggcgugagccaccacaccuggccuaaaauuauuuuuaaaccuuaauagauuauacauuuuuugagcaguuuuuuguuugucaaauaugacuccauuaaaaagaaaaugaaaaauacuuaugcuuagaugcaauguauuuuucaugaauacauuuugauaauguaucgagaaccugaaaugccacauuuuuaucacaagauauuuguagugauggauaaccagaacaacccagacauccuacaauaggagaauaacaguguguccauaacauagaauauauacuuaguguuuuaaacauauauuuaaugauauggagaagcauuuaaaguaagaaucaguauaguccauuuuaaguggcauauaauucuaauuguguauuuuuugauguggcuauauaugugucuauaugaggagaaaaaagucuagaauuuagugucacugaaaaugguaggcuugccaccaugaaugaagcuaguacaguuuuuauuuguuuuaucauugucuauaguuugcaaauaaaauauguauuaauucaacuucaccauauaaaacuuacuguuuuacacucuuccccuucaucuuugugauaguuaggauagagcauguggugugaugucuccuagugaaaugcauguaagacaaagccaugacucugaaaaagaguaaacagugaaguuuaauaucuuuugcagguuauuaaugcugcacuggcuuuagcagcaaaaccacagaguaaacuggcccaagagaacauggaucuuuuuaaagaacaaugggaaaaacaaguccguguucucacagaugcugucgaugacauuacuuccauugaugacuucuuggcugucucagguaaugagcugguuccccagagaaguaugugaagauguucauaauuacuuuugucuaaguuguauuaaugggcaaacacugcuaugucuuggcagguaaauuauucuaacaauaauauugugcugguuuucauuuuaauguuaaaaaagcuaucagcuacaggguuuucaagugacagcuucucagcuacuaggaaguagcugggguuggagauguuucccuugauagggcuggucugaauccuaggagcaugaauuagaaaccuggcuggcaaaggcuuaucccugcuuguauagagugaggucuuucaacugggaccgguagaacaccaggaccauccaucccucuugcugccauuguguuuagaaaaaacauugaucugugucuugguggagacugugguuauuuguuaucagccuaugaaacuuaggagaagaagggauucucaacaccaucaccuuuaguuucuuuuuuaaaauaauuucuucccuucuuggaaagccucucuucugucucucagaaaugaucauagucauaguuuaucugccuacuuuuccaaagacuuucugucugcaugaugcacagauagaaaacagagaggaaauauuuaagugccauuuaauuaugaacuugaaaaaauaaaucuggguaauucaccucacaaaaacaguugauuucauuauauaaacauaaacugguaaugacuuaguaaauugcauucauauagaaaauaucugucaaaugcaauucaguguuuaucacacagagauaaauuucaaucccaucuucuuagaguugaguaacuauaaaugcauucuccauuuaacgggaccucuguugcccuuggcugcauggcuugcucucugaaagugccagacuuccugaggccaguggcugugggcagaaucaguggcuaaguuuuuguagggcugaaacuaccugucaccccagggaaccacgggcuagaacguggcaguagggcuugaaacagaagcggggcuuaaguacaugcacagcacaguccuccagcagugaccuauauaagggugacuguguguucugcauaccaaugccucccugucuucacacucucuccuuaggauggguagccuuggcuuaacuugagaaacuggggagcaagccaucuguaaacugcaaaaaguaggggguaaaccauguugcugcaggacugccaaauugcagguguugguacuuuaaaacaaaaaucucauuugcaagcacaucuuugcaggugccagaaaugcagcaauggcuuuuuugggaaaucuuggccuucuguuguuuuucccaaugaaguacugaauuauucuuuuucauugguuuagagaaaaacauuccaccuucacagcacacuuuuaagcaaacaacaaauucugaaaucuaaaugcaaagccccccuccggauaaauacuacauucuuaaaguuacuuuuuugagauuagguuggguaugucucaggcuuggucucaagggauuuucaguccuccuuacagccaaauaaaauguaacagcaucagaugucccucaugcaccauucgucaaaucagugaagaaaagggauucugcagcagcauuuaguggauucuaggcaauaucuuuagggcauaugacauaaaagaauggaaaagagaaaucaaauucuuuuaacagauacacuguugucuggugaguguguucaguuuuuaugcaaauguaugagaguauaagagggauugauuugauggaaaggaguuuagacaguuucuauuuagcaaauaaaaucauggaacaauucuuucagucaaagguggugguguuuucagagcaucugaauuuuagaagucuaccugguguguuuuucugauguucugucacagcccugcuuaggaauguuacguaauuaaaucauuaauagggcaaggccuuucuucauaacuccucugauuuauguaauaugcggagacaagcagaugccugugcagguuucuacugggaugaccaguuaauuuucagcauucagacuccuuuauguucuuacguacaucccuuacccaugguagcuuuggcaauuuuuuuuuuuuuuuuuuuuuuuuuugagacggagcuuugcucuuguugccuaggcuggagugcaauggugggaucucggcucacugcaaccucugccucucaguaguucaagcaauucuccugccucagccucccgaguagcugggauuacaggugcuugccaccaugccuggcuaauuuuuuguauuuuuaggagagacaagguuucaccauguuggccaggcuugucucaaacuccugaccucaggugauccacccgcuucagccucccaaagugcuaggauuacaggcaugagccaccgugcccggucuaggugucacacuuuuuauuucgggggacuagagauauuuccccaucgcuccugacacacagccuaggcaggugucaucugcagcagucacgggcaguauuuagaugggaagccacaucuuggcccugacguggcccugccacauuugccaguguccccuggcccuaaagcauagcggugcuuugguggacccauagugagaugggcuuguuuuugaguaggggcugccuggcaagugcccagcacaggaucuggcuuuugagguaggugggcuucauagcuuuuacuaaaugaacagcagggaugcacccugacuucuuggagugguuguuuucuacugucuccuggggcuugaggcccuuugguacagagugagagguuuuauguaguauuugcauuugugauuuuccaccaucaaauucucuuacacuccauggggccuggauauuggcuauagcacuguccagucacugagaaccuguccaagaggaaaucguuuauggaguagggcuucagcuccuuuguucuggauauucugccccauuggcuccagaaauucccucauacuuagaacaagucauguccugauuuguggcucaaaaaguaauggucaucuuguguauaaccuggugcagccaccaagaccccgaugccagcauuuuaugaggcuguagggcggggggaacuuugaucauugucaaauaugugacagucgcacuugcauagaaaaagaggaauaugcaugauaaccuccagggaggagggguagggucuccucacccccaagcuauucuaucccaaaugcugccuuguaaauauuggagaugguuuaagaugcuggcauucagcagaccaagaauauauuuauauugaccaaucccuuaaggagagugguuugaaauucaucaaagugauaaagacucuuugaauuucacuuggauuguauuugauaaacguuuuccacggaaauguuauugauuuccauucucugugcuuacauguugcaguuuuggcucccuuuuuuuugaagaugcaagugguugcuuagagaagcucuaauuggguuuauuaaauuuuuuacuaaaugcucuuagaaacaauauauaugcauuaaaugcuuuggagcaacacuuggagugguaauuuguacuuuccuucauuaagugucaguguccaaagaauuuggucugauugggaggucauuaaauaccuaauuauuauuguaccuaaauguugguuuuguguuuaauagcagaaaugcuaaacuauagacaguuucucucuuuggaggaaguggugaaguuagauuaguggugauuuuuuuuuuuuuuuuuuuuuuugagauggagucuugcucugucaccaggcuggaaugcaguggcaugaucucggcucacugcagucucugccucccagguucaagcgauucuccugccugagccuccugaguagcugggauuacaggugccugucaccacacccaccuaauuucuguauuuuuaguagagacgggguuucaccauguuggccaggauggucccgaucuccugaccucgugaucugcccgcccucagccuuccaaagugcugggauuacaggcaugagccaccauguaaucaaaaaucacccggccggugauuuuuuuuuuuuuaagccuacuauauaguuuacauggcaagccaucagaauaguucaugucacaggguaaauccucuacauaaaguaugaaacauuguuuucauuuucuuugugugcagcagcccugcauacgcugcaugccauaaagauacccagggcagaggguacaaagaagaggcucuauugcuacacguuguagacugacauucugacaucuuuuauggagaaugccaguuggcaugguuccuggggggcaauuagguaccauacuucuacuuuaaacauauaugcuuuuuaacucgugaucuaacugcuagacauuuucucuaggggagugucacaaauauuugccaaaauaccuguauaaggauguuuucuucaaccagaaugucuaaggaaagacugaauaagugaauuauagccccuccaucuauucaguaggguacuaugcagccauuaaaauggaugagguagaucuguagggccagaccuagaaagguuuucaagugaaaaagauacaauaguguccauaauauaauuccuuuuauauucauuuacauauaguugucuguauuuuguauggacuguuauauguauguguaugaauuuuuuucuauuagaagcacaccuauaaauaauguauugaacaguuguucauggguacagauuguugugucuacucauaguggaccuaugcuguuuccuuagcuaaaaugauguaugguuucaguuaagugugggcagagccugucccccucuguugaacaguggacucgcaccuccccccaucagguucaguuguggagagcaggcugggugcucuguccugggugugugguagccucagcgaggcuggggcuuuccuagagacaaguguuucaugaggguagagaauauuacuuuggucagcuuccugaaguggggaauauuacucuaaaaaauggcacacucuuuccugguuuagguucaucuagaaggcggccaggaugaauucaagaaagucuaaauggauuaaaaaaaaaaaaaaccguagaaguaucuagacaaagguuaaaaaauccuugguggaaguuugggucacuuuugaacggaaaggaaugccauacuucauugauucugaaauagggaugagucuuaaaaucaaugauaugagaaaacacugguucuuaguuuugcuaucaacaugauuucuuucaauuguauuccuuuccuuuccuuagcaaugcaaguuucaucuuaacgguauuguguuagauccaguaaagcagcaguuuuuaacccaagaccucguaugguaguccugcucaguacauuuguuuagcuugaauuauuagaguuuauauauuuuaaaaaugcuugugaugggcuccaaauccauuuauucuuguaauugguuuaaauaucccucuuaaaauguguuuauguuagaaguuuaauauguuuacucuuuucauuaguucagugguauaaacccuggcaagucucauaauuuguaauuaauagagaccaaaauauggucuuaacuauauugcaguaaucuaguuuucccuucucuaauaagaauucuuacuguuuccuggccuucccuggaaagguguuuuuuguuuguuuuggcuuuuguuuuugagacagagucucacucuguugcccaggcuggaaugcaguggcgcgaucuuggcucacugcaaccucugccuccuggguucaagccauccucccgccucagccucuagaucuguaucauccacuuuaauggcugcauaguucccauaauucauuuauccacccuucucuuggagauuuugguugcuuucacguuguuacuacagaugaguucgagcaaacccuuuguggugggguuccuaaaaauuuauagugucaggcuuuuugcuuugaggaaaaauaguuuugguguguugcccaaauucagcuguaugacuguuaggagccacccaucagcuucauaggagucagggguuuucaccucuagggacccuucaaauaucacaauaagcccaucuguguaccaugaagaggguuauuaaauaguucaucucacaccucaggguccucuagaggaggcuucaaccugcuuuccagcaccuucuccuaucccagggcuguacuggcuucuugguagauugucugaauaucaucagcaucuccuggaaggagagggagaggggacaguggacuuuuguucuaauuuagccuuuccuuuauuugggacauagagucagugaagcuagaggaagauaaguuauugaugcuucuaugauaauuuucugccagaaaauuacagaacagcugugucucaaagaugggcaugucuccuguuuuuuuuguguguguuuuuuauuuuuuguuuuuuuuuuuuuaaaaaccuggaaugaagauuguuauucuugggggugauaacagguuuaguuucugucucugucacuagucacuggucucuccaaugaaguauauguaaaacuuucagcacuguggcuggcaccaagcaaacaauaaaugauagaugccagcuuacaguugccaccuuuucauagaaagccuccuuccucauucaacuuuuugcuuguucuccagagaaucacauuuuggaagaugugaacaaaugugucauugcucuccaagagaaggauguggauggccuggaccgcacagcuggugcaauucgaggccgggcagcccgggucauucacguagucaccucagagauggacaacuaugagccaggagucuacacagagaagguucuggaagccacuaagcugcucuccaacacagguacgggaacucucccuuuccagugcucgcacacaccgcagccucagugaggcaggccaccccauuagcccagcccuguggugaggaaggaggaguugggaacucagauuuggucucauggcacaucgggcuccugagaagcuggucauagccaaauucaggccucacaagcauauuuucuucaucuguaucucaugaguaaucacgggacuaauucuaaacacacgauuuaagaugaauuucugaguuaaaucuccuauuagugaguaaagacuaaauuaagguaggucccauucuuaagcaaggcuucaaguuagucucacuucaaguucucaaccauccaaucucuguugcagagaaaaagaugauuugagucguaaaauacugcauuuaauuuauuucaacuguaaauacccuucacacagguagaagcagaggcucaucauaagccucaccucuuucugucuagcugagugauucagggagggccaggggaaugaugcugccugcugaccaggguaucuacugugccucuuucuccacagucaugccacguuuuacugagcaaguagaagcagccguggaagcccucagcucggacccugcccagcccauggaugagaaugaguuuaucgaugcuucccgccugguauaugauggcauccgggacaucaggaaagcagugcugaugauaagggugaguaacugcauuucagacgucuuaacagcuucuuucuuaucauuugcuaaacuugagcaaugcgucauucuagaacucggcagaugcgguggcaguauauuaaaaccaugaaucuaaaagcuguuagaaugagauauauuuaauuacguugucuaaaaugacuguuaguugcaaguuagagcccaaacuugggccaagaaggggagcuagccugaguugacgauuuaauuuaggauaaacagucucuacaacaugaggcuucaguuugaguuaggcaggaaauuauagaaaauaaugguucucaagcuaguaucagagaaggaaguauuuucauaaugcggauucaaguuauuguucacaugaagugccccucucuucggaggggcugcaggcagacgggaugauggaaccccaggguguuggggggaggagcggccccaggugaugcuccuaggcucauggccaagugccgagccccuuuccccauagccagagugccuggagggccucugucgcaggggcagaggagaaaggggccucuauggcaucugugauugagcucccggcauaccguccugcucucugacaacuauuccugucuucauucaagaaucauccagccccugggccucucaguuucuugaugucuuguccuccuccaccucaaccucacggccauagcuguaccucagcuuuugucacugccugccauugucuuugucauccccagcagccuagaucuauuguucagguugcgcccucgaguccugcaacucccagcgagccuuugagucuacuguggggucuucagucaguugguccuccccaugugucacucagccccuuguguccuugguucaguccuuuguuagcuuugaguccauaguugaauauacucacuccucugcccugcuguuuccucacaccugccuugcaaggugcaguccuggcaagauccugcucuccugagcacagugcagauggccacagccacgcugauggagccgcagaagccgcggccauuugugcgcccuugcugcccugcaacaggcguccacccacccacccacaccugugccccuguccuguuuggcccacuugccgauuucguugaggauacugaggcaguuagugcguccaccccucugcaucccaugucugugugcucuaccuuccuccuagcaccaugggcauugcucucggugcuucuggccaaggccaucccuugcacgucuuuguacuaggaucccagcuucuucacccccugccuccuguaccuuuccccaagccuaugaugauuucucccauuuuuagggggaaaaaaaaagucucuugacccacaccccuucucagucuccuuggcugguuucuccccaucuccucagccugugaaacacggguguggccugcugggaaguccuugaccucuucagaguccugucuagaggccgacucuccuaaguuccacaccugucugcgcaccuugccuccucccucucacuugcuccacccaggcagcacauguuaguugauagugacuccgucuucccuugcucgggcccagaccucgaaucuuuuauuucccuuuugucccauaccucacaucugcuuuaucugugaauucuuuuggcucuccguucacaguagagaaccugaacauguucucacccucgucuaagccaccagcaccucucacccggguucaugcaggugccacucagcugguucccuguucccauccugggugccuacagucucaugagccacagggcagccagagcgauuucuguaagcuucaaucagaucauguuauccucugugccagcgucuccacaggccgccacgucacucauucuuuaugcuggccuacgaggccuucugggacuggaaccugucacuucuccaaccuuauuuccugcugaucuccucuuguacucaugggguuccaggcaagccggugacaugggggcagugagcuaagccccccuucuguggccuccuugcuauucacgcaguucccugggccaaugccccuuccccacggccucuaugcugccacccgcccccccuucccccuccuugagagcaccuucucgugagacuuuuccaaacacccauauagaauuaaaaucucccuuuauucaucacugcuuucuucauagcacuggucacuuuugaugugucauauaauucauuugcuuacuuuguugucauuucuuccauuagaauaugcgagaggaauuuuugucuguuugucacuuuguaucuuuagggcccagaacagugcuuggcagagagauaaugaaugaaugaaugaaugaaugaaugaaugaaugagaguacucgguuuucuuggcaagaacgguucuugggucugcgauggggugcuggggagguagagaugauguuaggaggugguccuuugaaaagccccuuaacugauugauugcaugccagucccgaaggcaugugugacugcagcguuaaaacugucagugcuggcauuguguuuugugccaccgaguccaucggccuccaggaccucacaccgacaugcugucugguccccugcgugagcguccacuguucucaccucaucaagggacaggcccagccuuugcacagcacguucuuggugguuccagaauguuucuugcauaucuucuuguuugaaccucacugcaaguccuugggcugggcuuggacuauguccugguacacagacgagagacucgccucacugcccuccugucacaggccagccggcugggcugagcgccaaccccagcuguucugccugcugcccccuuacugauaacugccagaggacaacauuauguuucaagucaguagcuaaucaugagaggcugguaguugguacaaaauaagaauuuuauuucauaauuaaagcaaagagcuaggaccaguaaucagucccuuggguauuuacucagcccucaccugccauauucuccccucuuuucuuuugaugaaagucaaaagaauacuuuaaaauacauugccuauuuuuacuccuccaagcagccuugguacccuaacagaaggcccaguuauuuaauuuucuuuuugucauaaaguaggaaaguuauacaaauccgcuuaauacuauacaaaacaccucuauuuuuaagucaguaccuuuucuacccaggacaguucucaucuuugucuuaaaaugccgguguuggggaaguaaauuaggaaguaaaaaccuuaugucacugggcacaaguggcucacgccuguaaucucagcacuuugggaggccagggcaggcagaucaccugaggucaggaguucaagaccagccugaccaacauggugaaaccccgucucuacuaaaaauacaaaaauuagccgggcaugguggcauguugccucuaaucccagccacuugggaggcugaggcaggugaaucucuugaacccgggaggcggagguugcauugauuccaagaucacgccacugcacuccagccugggugacagagcgagacucugucucaaaggaaaaaaaaaaacaaucaugucuuacaaagaaauagugaauugacucagugauagcaauugagccccacacacagugaaaccagcccaggccugcugugggccaggcagcccagcgugugcaccagugaagcagaggcucgagacaaaugcugagugauuuugacuuuauucaccauacuguucagaacacugcacauuaaaauccagaauucugggccuccgugcaccuggccaagaggcucaggguggcugggggcugguggcccagagaugugucugaccugugaucuuugucuggguggcagaccccugaggaguuggaugacucugacuuugagacagaagauuuugaugucagaagcaggacgagcguccagacagaagacgaucagcugauagcuggccagagugcccggguaaggaagcgcuccguggggcaguucagcuugugcugccgacuuucccuguccccuuucuuguuuccaggaaaacacccucaguauucagaacaccguuucucucucucugucucucuggcaguagacugaaguuaaacuaaguuguggcaccugcuagucaaauguagccuccucagcuagaggcagaccagguccugggccuccucugcagugcccugagcuuuaguuuaugauagagcccugggucagggaagggcuaagauuuagucaaugcaguguuuguugaaaggaucgugaaauuugaaaaagauugcugccuuuguccaucucgauacuauggguaugaacuauuuaauuauucauggguuuaaaaaauaacagugguacauucaagaaagccagucagagccauugcauucauuugagucauuaaaucuucaaucaauagcauuuauguuuuggggaggaugccaagaaauauuucuaaggagucuuugauuucacuccuuggaaaucugucgugaacagcgagcacaucccugccuuauguccugcucagucaugagcacuuagggaagcugagagggaggagcuccccagccguaggucugugggcuggaggugggcagcaggccuccagguguugcucaaguauggccugagugccagcgguaucucucagcccucuuucuucagguguacauucuaaagccacuuucaguucaucuugaauaguuggaaauguccaucagggcccaccagggaaagggcuccacacuuucaucaaccccuucucucauuucuugucuuauauuaauaagaauuaagcagguucugucccugcacaggugugauuccaaagcuuccacauuagccuuccaccccucgcuguuuccuuccacacuaaaacuugugcucaaaagugggucggaaauucaggcugccauaaguuucugcaaaaaaugagagaaauagcccuucaggcgaaaugaaaccuauuaaagcauuauccuaccuaugccacagauugccuguuggaaauauucuuggcuaaugcacucugagaacuucauauucuuuuuauguaagagcucuuugugcuucugaucacaggcgaucauggcucagcuuccccaggagcaaaaagcgaagauugcggaacagguggccagcuuccaggaagaaaagagcaagcuggaugcugaaguguccaaaugggacgacaguggcaaugacaucauugugcuggccaagcagaugugcaugauuaugauggagaugacagacuuuacccggugagcagcaccccggccccaccaggcugcacaggggcuacuuucuuccccacaggucaccugcgcagcggcucagacagcccaggccauggggcuuuguggacaaucuucuuuuucuacuccaacugugaggggcuucacauacaauaauccuuguucucuucccucuucucagagguaaaggaccacucaaaaauacaucggaugucaucagugcugccaagaaaauugcugaggcaggauccaggauggacaagcuuggccgcaccauugcagaccauguaagugacagacuugccaggugggucuccaagcuccuccuggggcucaggcagcccagccugguccauucaggguaaguuucaugggccacagcacuuuugccacucaucucuaaaaaugguucuuauuaaucccagcauagauuuguaaggauucucuagagcggauguguauguccuggaaucuuccaucgcuugguagccaaaauuaaccucugcuauugucucuuaugucucaguucccucucucccccucugggcaggggccgagagcagccagaagccauguggccagugcuguggaaggcuggugugccuagaugggcccagguuucuucauccucagcacuguguuucucagccaccccgucuucaucccccuauucccucacacugauagguacaaaaauacgguuccuaccgccuggaaauuguacaauacauuucauuugguguuuuaagccugaucaagagaagcucuuucucaguuacaguuuuucucuguaguuaacaagccuccccaccauuuucccugaaauagccaaacucucagccucaucuaggccacaggaugugugagacacaagccuccuuacacaagccaaagauuguaaaggcauccuugacucccacacaaucgguaauagggccuauugcuuccauuggccaaauguaucuugacacaaaccagucuuguccuuucugcagaucuccauagccacuuggacuacuguggccgcucccgauuuccuguucuuuccucucuccacuuccuucugcauccagcugucaauacugucaucugaaaaugcagaucacauggcucugcccugcuuccaugacuacuuagaauacagcucaucuccaguauggucugcggggucucaguucauaccacucucugugguguacuuugcuccagccucacuggaagaaaauguuugcuugcuauaaacacuugagaggugcucuguguuucucccuuuggguaaagcuuucuaggcugguccuaaucugggagccucuaaaacucugagauguggagcgagacaggaacugggcaggggccacccuuuucucuuugaccauccccaacugcuuuuuuucuugcuuuacuuuacucacuugucuuccaccucagccugcagugaguggcuuuugucaucaggcauuaauaacgcaaagugccucagagcagaagaguuaacuauuuguuuacuuagcuaaaaacaucuggacuuuucuccauagccaggcuccugcuugcugagccggcuuguucucaccucgaggggcaugggccuccacccugccguuuggggugaggggauccuuggccagggugguuuccccgccgucauaggagggaagucagugggaggcucagaaggccuuggcuauacaaccagugccaugcggcgcagucagggucccauggacgacuuccaucagcucacccgccuccauccccaagcagaguguaggcaagggcugugacugccucagguaauugggugauuuugcuccagcaagaggagaggaagcaugugagugccacacugaaccuuucagaaacagccguggggucgggggugcuugggccaggccaggauacuugguguuaagccugcucucucuucagugccccgacucggcuugcaagcaggaccugcuggccuaccugcaacgcaucgcccucuacugccaccagcugaacaucugcagcaaggucaaggccgaggugcagaaucucggcggggagcuuguugucucugggguaagcauuagcugaacaaaaagagggccagugggaacgugcugacccuugucagaaaugaaagucaccuccuauccgcauaaacaccugcccugggaaagugugcugugcagaaacuccaaguccugucccagucucuggagaccaaggucuguccaucaucuguucccuguagaacugugacaccugcggggcacugcaagggcugaaaggcuggccuccuccccuuugcuggccacucacuggguaggaauuuuuaaaaaucuuccuugggaccgggcgugguggcagguaccuguaagucccagcuacuugggaggcugagacacaauaauuacuugagccugggagauggagguugcagugagccgagauggcaccacugcacucccgucugggcaacagaacaagacugucucaaaacaaaacgaaacaacaaaacaaaacaaaacuuccuuuucuucccccagagaggaauuaagaguagacauagauaggguguuuucucaaaagcccuucacuccucagagugcuuggguagcgucucuuucuuuuuaccacaucacaguucugaggccuuucucaccuagggcaggggaaagaagagguuugcugaguggauugggguccaccgagccuccauggcuucucuuaaucccacugaauuuccuuuaaaagaaacacuucuuauauugaacauauugagaccauuugcucaucugcuuugccauaaacaucccugucucgauuccugcuucuccucccccacgugcuuacagcucugggaucacuuacagugacuuccaguugguuugagugaauaaacacuugcugaggggugggggugagcaaggcgagguugccucaugucuucuccaaagggucugagggcaggcgcuuccaggcuauuuagauaagagcagccguugaggguguucuucaggaacaggcugcugcccaauccucugcgaccugcccaggcccuggucuugcagaggaguagggggcuccccuucaagcacagcccaccuguguccacgaggcuggaggucaggccggugcuucuuaccaccccugucugccucguagguggacagcgccaugucccugauccaggcagccaagaacuugaugaaugcuguggugcagacagugaaggcauccuacgucgccucuaccaaauaccaaaagucacaggguauggcuucccucaaccuuccugcugugucauggaagaugaaggcaccagagaaaaagccauuggugaagagagagaaacaggaugagacacagaccaagauuaaacgggcaucucagaagaagcacgugaacccggugcaggcccucagcgaguucaaagcuauggacagcaucuaagucugcccaggccggccgcccccaccccucggggcuccugaauaucagucacuguucgucacucaaaugaauuugcuaaauacaacacugauacuagauuccacagggaaaugggcagacugaaccaguccagguggugaauuuuccaagaacauaguuuaaguugauuaaaaaugcuuuuagaaugcaggagccuacuucuagcuguauuuuuuguaugcuuaaauaaaaauaaaaauucauaaccaaagagaaucccacauuagcuuguuaguaaugcucugaccaagccgagaugcccauucucuuagugauggcggcguuaggguuugagagaagggaauuuggcucaacuucaguugagagggugcaguccagacagcuugacugcuuuuaaaugaccaaagaugaccugugguaagcaaccugggcaucuuaggaagcagucccuggagaaggcauguucccagaaaggucucuggagggacaaacucacucaguaaaacauaauguaucaugaagaaaacugauucucuaugacaugaaaugaaaauuuuaaugcauuguuauaauuacuaauguacgcugcugcaggacauuaauaaaguugcuuuuuuaggcuacagugucucgaugccauaaucagaacacacuuuuuuuccucuuucucccagcuucaaaugcaaauucaucauugggcucacuucuaauaacugcaguguuucccgccuugggcuugcagcagaaaaaccugacaacauaguguuugcuaaggcaguaauuuagacuuuaccuuauuugugauuacuguagugauugauugauugauuacuauuaacuacaagguauaauuuacuaucaccuuauuuaaauuuuaugaauuaauuugaauguuuuuuacacuaacuaacuuuucccaauaaaguccacuaugaaaccacgaca

SEQ ID NO: 192752 - RNA, 251656 nt, Homo sapiens
uucuacgugauuuuucuccuuuaauggcacuccugacagaugaggaaacaagcucagagcaauuaagcgacuucccaagguacagagcugcugcuugguaagaagcagagacuugcaacuccugggcccagguuccugcccuggagccuguuccuggaugcccugggcugagcccugcacgucagcagagcccaucacccaaccacucaccugaccccccggccacagggcugugcccagucuacacagacacacagcagaaagaggauggccuucagguuuccauuuaauggccaagccagcacugccaagauguccuccugccugagaagcccacccacgcuggcaccccucagccucacuagcggcaucccaguccaguccugguguggggccucaucucagcuccuucagcaagcuguugacagagcccagcagcuccuggaaguagcccucguccucaccauccugcagcuccaggcuggccagcaccugguacucagccugcaggcuggccaguguccugccgagcuggggguccugacgguagcggucccggcagguggucaggaggacgcccagugucugcagcaccuucucacgggcaucaugcucgggcagcgccaggaggugggccgugaucucgcaccagcccuguucccacaggccuggcaggagguguaccuggcgauacugcugcagcuucucuggggacaucuccugggucagcucagccuccuccucggcgaacaucugccauccgccacagccgcaggccagguaggguggggguggggagagaacacacagggagcaguuagcucacaccuggcuagcucugcccuucagacaggaaggcacgaggcugaccccugagggcccaccucuuccucuauccccaagucugucugucuauucauucauucauccaccaacagaaacacuuguguggugccaggugcugaagaaaccacgauggagacauagucuuacccucaaggagcuuaaggucuagcaggagaauaaaaauuaacuaauucccaaauagcauaaauguaaucuaacagugcagcauggaggcagacaggcuggcuucaaauuccugcuccaccacugacuugcugaaugaccauggcuggcacuuagccucccugagacucaucgucaucaccuccuaaguggagaaacucagccugucuguaaagcgcagaagcccagcucuaucagcagaacauggugggagccaauccugccgggcuaccagcagcgggaaagccaacaccugaaccaugacaagcaggcagguuaccugaaggucagagguagaggguugggagggggcagagaucucccgugcagcuguaggaagugugccuguauggagaaagaaggaaugccugcccuaacuccaggggagaaugaagcacagggaagaugcacaaggcaagagggaagcccaggagaagaggaggccacaguggaccaccugugcuuccugcggcagcaggaagucguggggcugauuggggcuggcagaggaaacugaggaggggugcaauccugcauccugggacaggagaggcugagagguauccccuaguccuuuccuacuucaccccucaguccugccagcuucgcuuccaaaacacaccccaauucugucagcuccaccuuugucccuuguguccugcgauccagugccuccugcucucacccucuccuccagcccccaaacccucacagccuggcauugcgggugauaaagacaaaaucaaucccuucccugggacugcgaggcucugcaggcucugcccccacugugcgcggccuggacccacucacacccacuccugucacucuaacucuccccuggggccucuggaggcgcagcuccgacuuccaggugcacccccgcauuggccccauucacuccacggcucccugcacaccucaccgccacugaccggccuccccugacuggccuucucugcuuauaugcugcugugguuugaguguguucccuaaaaguucaaguguuggaagcuuaauucccaaggcagcaguauugagaggagcugccuaggucaggagggcagcggguuccuuacgggagagcgguuguuauucuagagagcaagcccggcccagcaugcuuuuuuccgcaagugcucuugcccucucaccuuccacaauguugucaugcaacacaaaggcucccgccagaugcacccacccaaucguggauuucccagccucccgaaucaugagccaaaaacugccuuuucuuuauauuauccagucccggguauucuguuaaagcagcagcagacagacuacaacacaagcucaggggaauucucugauaaacaucugccugaaagcucagggacgacagggacugcggauuauuuucccagcacccggcacagcaggcagcacaggcaggcagggucccccugcggcccuucagcuccucagaugcaccagaggccauggaauccaaaccccaggcaggcaucucaccacugcagaagcccagaugucagggcauggucucucaguagagguccucucacaggccaagguacauaugaggacugccuggggccuggcagaccccagcacccugaugggggugucacauugcccaugggaauuccacaguccuuggcugucaugacaacaugcugcagugauccccgagcugcauggcaccccuccaucgugguggacagcucaugucccuccaccuucaggcagcucuggacccaccccuagcuuggcuaggucuucauucuuaagcgcugcaagaggcuggacuuagugacucacgccuauaauuccaauacuuugggaagcugaggcaggacugcuugagcccaggaguucaagaccagccugagcaacauagugagacccugucuacaaaaaacgaacaaaauuaaccaggcaugguggcauggaccuguagucccagcuacucagggggcugaggugggaggaucacuugagucugggaggcagaguuuacagugagccaagaucgugccacugggugacagagagagacccugucucaaaaaaaaaaaaaaaaaagaaaaaagaaaagaaaagaaaaaagaaaaaagaaaucacaagaacagagaagcccugacugccucagcccaaguacaguguguccuaaaucucucuggcugaaauuuaucugcuguccucccugaaagaagagggccauuucuguacuguuuguagagagaugccaguccuccccuccccaaucaugucagcaccccaaagcuuccagaggcaggcucccggggccggcagccucggggcagccuuggugagccugccuggugguagugugcuagcaaugugucagugccauagugcccaggaugccagggcugggggcagcagggacacacacccaagacaccagagaacagagcccaguuucccugggaaaugcccagccagcugacauguccuucuccaggcucacuggcccagucccagaaccugaacugugcccaggccuuaucaauuggaucugagcaccacauggcugccugcuguucuaagaaacuggauuucugcagcuuuaacaagagaagagagagaaacaggcaaagacagagaguuggggagagacagugauggacagagguggccacagccaucccgacacugccugggagagaaggccugggggaggcgugugcagagggagugaggggcccagccuccaccauucggcagcaguuccagcggcugcccagcccugcuccacuagucggcaugcggcucuucuggggagcguguggcccgagagaggcaacugaggaagcccugccaaugcucucugcaguagcugaauuaagaauccaggccuggcugguuuuccucucuccuccuuaauuaagaugcuucuucaagcuugcaaacagggcugggcaccaagucuccucccaaguggcaagcaauugggucccugagacucucaagggcagccacucugaggcccugcccagagccaaagcucacagaggaggcaccuccacguuucuagaauccgaagagugagugccauucgaaggagcucugggcuguucuacccccucagccuuuuguccccucggggccuggucucggcugcuccaaggcuugccucauacugagcccucugccugcacacuuggccgugaccauggcuggcagggccaccucccacuccucaucagcccucagguuucagcuuagccaccacaucucacaugacauacucccugacguccccaaucucuuccaacugucugucuguccauccauccagaagcacacacaaagcaaacaagugacguccgcagucucuuccaucugucuguccauccacccagaagcacacacaaagcaaacaagaggagacugggugggccugggcacucaccuucuccgugaccaggucguagagcagugugaccacgcgcacggcgagcaccuccgugcccuucuccugcaccaggguccucaggaccugcagccccccgagcuucaggaacugccgcugggcauaggggaaguggcgcagcagggagcacagugcaaacaggaccugggggcacagacccagggguaggugaggggccaagcgagcuggaccugcccugaggcccagggaaggcaggcagaggugccccaaauuaguccccauuccucccggccccaccucaguuacagcuauaccccagaacccaggacugugaggccaggagggacucagacaccuucaacauuaccaagugaguaaaugggagguaaacagaggccaagggugggaggccaggaguagggcccaaggccacagcacaggagcugcccccaggccucuagucaccucggcacacugccaucugcuuuaguugaguguaacuucucccccugugccacccagcagaugaugcucaggcccccaugguaacaugcacagccuggacaggaacccuuuccuuucaggccccacacguguccuggaggcugggcaggaggaagggcauggaaacacaccuucuucuuugcagugagcggcugcuccguggccaggaugaccagcagcuucugcagggcucccccuucgauggccuccaccuggaccuugggguugcuggggaagaagcacaggacagcaugacuacccugcccagcccagggaucggauggucagggaacugagcccaugucagccaucccuggggagaaacaagaacaacagagguucccacacggggcaagucaaacucagcuggggaaacaaagaccaucuggcacagacccacgugggaacagcggcccacagcacaggugacagggcugagugcucccaugccagcccccacuccccagcagccaaggggcuggagugggcugggaaggugaacaaccucuacuacuguaaagacauuucgaugccgaaggugcuccuucagcgucccucccguaggaagccuuucuuggcgcuucccaagccagugccggauguuccuuccuccaugacccaagcacaucacacacuggggcaauuacuaaugggucuguuccccucugggucuggugccccaaggccagggccccaucccucuccucuccugggucggcacucagacugcacauagaaaaugcuugcgggagaaggcaggaagaaagugcaagagacaggagccucugaauacccaggcagauccuaaaacaggacaacccaaugccucccacugggcucccacucuauaacagcagcuacugucagcuucucugcccuguauucucagcacucagcacagagccugccacgucacaggucccuggacaguagggaaugaaugaacgacugaacgaacgaacgaaugaacaacacguguacacaaccaugaacauaucaauagauaaacauacugcacuaaaguacucaaaacccugagcugccucuggaacuccucuccccauucugggcuagagaaauagugaugugauuaaaacauuucaggcccagaccucccagaugaagggaugaggggccuggcggggacccccaucagggcagggugccaugcaggggacaaggccgggaucccucacaggaugcccuuuugcaggcuccuugcuuuucaagauugcauuagggaucaauuaaggagcaagugucaagcacagggaccagauagucaggcccuugggcaggucagggcuccccucucagcagcccacaugugaggccccagagaaaagaggggacaggcacacaaaagccugaggccaacaacaagugaaggggccaagccagcagucagaugguggcugucacacccauccaacuagcccacaaaggacaccgcagucuaccaaagccaccgcaugccucuggcugccugcccuuggcaugaccacaagcucccagagacccaaaaagcaccuguuccuccuaacucccaacccuccuggccagggggcccucacgguguccuugagagugagccaggguauaaggaaacaaagacaaaucagaaggagcuggcuccugguccuaaacccagaaaagacacacugugccaccguacaggagagggcccgacacacagcaggcgugcccccaaagcuggcugaauggaaugaagauagcuccccacuucuauucugaccaggaacaagcuucaagguccagagcagaccgagcacgcugagccagcuuucuaaagagaaaagcuccuuuguaccacgugucacucuguagccucucagccagaaaggaaguacagggugggugccagcccgucccacagcaacuccaccccugugucugcagagcagccuggagaugggccagagucccuggggaagggaggcugacagcuccucuccagauaggcaggcaggcgcuggcgcaggggggccugggagcugagcugcuccccugccccccacgacuugagacaggcagcuguuucaucaaagcaugagcuaauuagggcugucucugccaucaugugccuaaggaacgcucacccaugacaggaggguccaggaagagaagacgaccacgcugagagauucacacaaacaucaaaugcugcuuccccaagggggcugagagaucugacaucgcaucagccuuugggagcacugccaaggagucccaucccucaugggcccucagagcagcagagacaaggcccuccaaagacagcacaaagcucaucacagcaccccaucaucgcagccucaguuaaucacccagggcugggcaaccaaagcccuuccacuuucugcacugugaccagggcaaagagaagucccuucucuucagaaggugggcugaugugggucgggagccacccacagccaagccagcagcagcccagucccacccacucugucccccucaggcaggcucuucccaccccauuuagaguaggagagaagagagcuccaacaucagauaaguaaaucggagagaaaagagaaagucugaccuuuuguaaauugcugaaaucagguucauaaggcaauaaauucauguuuucacccacagccaagucuguggguacggcaggaccaugggccaaacaugggcugugacagugcacagccuuggcagcccugggcccaugcccugccuggccucuucacaugaucagcuuaaacgagguacccauggaacccugggaacuccaggccuuaccccaggguucccacagcuucaggaguuuccuaaaaggccacccugugaaguggccuuuuagggcugcccaggcaagggguugaagaaacacagcagaggaagagggggaagaugaggcuugcgcuuccagcugcuccucaguccauccaggcagggccaguagagcugaagguuuccugagcaaucacccaccaaggguagaaucugcuccuagaaacagacccucucgccagucagcucugccuugggcuuuaaaugcucacagccuggggcugggggaggcaacuaccaaaacagcucagagugaggccucuggaugugcaaggaccagggccugcaggacccuugcugggaaucucauaagcaaugaauggcucauggccuugggcaaguuuucaccugugaggcagagcuaggacuacccauguaaaagacagaacaguuaaugaaugccaaaaugccacacugcuagccaaugcacuguggccaaaagauaauuacaguaggcucacuacacaaagaggccagaccacaucuuugagagcacagcuuuauuuggccuggaugccucgagcacauaucauguauggcagccccauccuccuccagccuauggacucuggaccagagcugcggcccaccccuggagggaccaguccugcuggcuggaagguagguguccugacaguuggggaucugaguuaagggggcgggggccuggcacgccucaaagugacaucaguggcgcuggugugcucaaagucaacagaaggauauuaaggacguagcucaucuccgaugcgauaaaugagaauaaaccuuguucagggcuaagccggcuggacuaaauaaauaccauuagcacuuggauuacugggauguucacaaucagcaggcaagucagcugucugugugcagagggacgacagcagcugcuacucuguaaaucuugcagggagaugggcuggggguggggcaggcugcaaaaauggaagugauugcauuugcaaaaaccaaagaguuugggucagggugacagcaauuugggcaaucagccaagagucagaggucauauuuuagcuaacugaagcuaagcaagugucuggguggaaggggacugaaggagcugaccacagggaaggcagcccagcucggccagggggcccaggagauugcugcccagcacacaccccggggcugacuucacccuugggcucagggcuggcuacauaauuuucaggcccaagugcaacaugaaaacguagggccuuuuguucaagaauuaucagaaauuucaagacagugagaacagagcaugaagccaagcacgggcccuuuugagugugggguccugugccgcugcacggguggcagggccaacaagguaugugcacggaaauccugcuccagggucaaccaaccggaacaacaagggcugaaaaguaagcuugaauuucugaaaaggaaaacaacuggaaaaggcagagcucuaggaugggaauaaggaugagggugacuaguuagaugggggccaaggaaaugcuaagguguaacugaagagagcuucugugauugagacugccaggccagaccaggacaccagaggcacagcagagggaugugcucacucacgcguccucgugacauuucuaagugcaacaaauacucuuuucauucccuuagaacaggaaaaaacuauuauuuuucuucugaaaugccucugagaugaugccaugcacugagggcagagggcacaucucagggguauauggggccaggcucaaucauucaccugaugaagugcagcucaccuucuugcccagaaagaaagauuuccucugguggccccaccuugcuuaugccuuaauguguggccuccaucaucugggaaagcaagaauuugcaggauguguaauccugaaauagauggguucaagagacaucuauauuugccugccauccagggaugaguggggcuagguaaucaaucaguuaagauacaaacaauuggcugggcgcaguggcucacgccuguaaucccagcacuuugggaggcugaggcgggcagaucacuugaaaucaggaguccaagacuagucuggccaacauggugaaaccccgucucuauuaaaaauacaagaguuagcugguguggugucaggcaccuguaaucucagcuacucgggaggcuaaggcaggagaaucgcuugaacccaggagguagagguuucagugagcugagaucacgccacugcacuccagccugggcaacagagcaagacucuaucuuaaaaaaaaaaaaaagauacaauuaccgaauugaauaaaaauggaauagguuuaacaacaacaacaacaaaaaacaaaaaacaaaacaaaaaaaacacuguacaaaucuuccacuacaaagucaagcuuccaggaauaacaaaacacaugagcugcacaucacuuuguguugggaccuguauggccucaggaguuccaucuggacacuggggaaaggcagggcuaucaucugaccccuucauguacagcccccaacuggaagccacccacguaagcaacuaugagacacccacuccucaccacaguaacagcaacucacaagagggucucuagacccuacugacagacacacacacaauacacacacacagacacaaucaucugcccaccucugaggagauaaagggaaccucagagggaggggcagcaaaucaccuuccugagggucaucugguagcucuccaacacagcccugugucacaaucaccugggcaguuuauuuccugaaaccauuucagacuagugcuuuaaaaaauuacagaaaauaggccaggugugguggcucaugccuguaaucccagcacuuugacaggcuaaggugggaggacugcuugaguccaggaguuugaaacuagccuggacaaggugguaaaauccccgucucugcaaaaguaaaaaaaaaaaaaaaaaaaaauugccgggcauggugguaugcaccuauggucccagcuacucgggaggcugagguaggaggaucacuugagcccaggaggcugaggcugcagugagcuaugggcaacagagugagauucugucucucuaaagaaaaaaaaauuauagaaaaguaauuacacaaaaaaaugacuuacuggaaagcugcaagaauaguaaauaaacucccauccagauucaccaauuguggacauuuaccacaauuuucugucucucuuaauauuuacacagauuuucuuuuuuaaaauauuugagaguaauugaagauaugaagacccuuuaccccuaaacauaucaguguguaugucccaagaacauaaccaaaguacagugaucaaaaucaggaaacuaacacugacacaguaaucuacagauauuuauucagcuuuugccagcugucccaauaauaguccuuaccccccacucuuuccucuuuuuaagaaacacuuuuuuuuuuuuuuuuguagauggggguucucacgauauugcccaggcuggucuugaacuccuccuagcuucaagcaauccucccgcccuggccuccuaaaacguugggauuaccggcaugagccacugcacagagcccucucaauaauauuguuuuuagaaaaauaauuuugaccccacguccgauuuaugcccauacgauguacacagcagccugucuccuuggucuccuuucaucuggaacugucccuuagucuugucuuucaugacacugacauuuaugaaaagugcaggccagugguagaauguuucucaguuuggauuuguccaauguguucuaaugauuagacugaggcuguggcuuuggcaggaauacacaaacacaaugccguaucuuucucaguguaucacauaggagggcaagugauguccauaagucucacaauuggauguuuucuuugcauacuugguuauggugguaucugccagauuucuccacuauaaaaauacuauuuguuccucugaaauuaauauuuuguggggagacacuuugagauaugaagacagccuauuccucaucaaacuuucauguagucguuuuggcaaucauugacaauucuugcuuaauuaucccagguuaagcaucuuaaguccaaaaaucuaaaauccaaaaugcucuaaaaucugaaacuuuuugggcaucaacaugaugcucaaaggaaauguucauuggagcacuuuggauuuuggauuuuuggaucagggaugcucaagugguaaguauauaaugcaaauauuccaaaagccaaaaaaaaaaaagaaaauccaaaacauuucuagucucaagcaucucagauaagggauguucaaccuguaccaugauguuugucaaaugaugauauucaaacuccugucuuuauuuuucuuguuucuaucuuuauuugcuggcauucuaccuaaaagaagagguuuuccuucuuuccuauuucuucauucauucauuuacugguaucaguauggauuaauagauucuuauuuaaucuauggaauggcauccauuucuaucauuuacuucaaugcucaaauuauccuuaaucaccaggcauuuucaugcuggcuucugugucuuuuuaacauguuuccaucacccuuuaauauuuucuuaccuucuggcacaggauguucuuguacaagauauugcucuuuucccgugccagccauggaaucagccauuucuccaaggaacaauuggagcccuuuuugaaaauacagacuccaagcccuacccugcauauacuaaaucauaaucucagagaacguggcuccgaagaccugauuuuucauaaaugccacaugugauuccuacguucugaggacaagcauuugggauaacuagagucaaugcucaaccuuuuauccaguauagcaucucugguaauuggcagcccaguacuugaagacuacaucaucaaacaaggcagcuuuacgcuaguuuaaaacuccuccaauugccagaaaaacauauucugauacugagcugaaaucugcucucaugaagcuuauacccucugguccuauacccucugguccuaagucuacccuugaagaaagaaaggguugccugaucuuguccugacaggucagcccuucugaaaguugggagcagccaaccauccagagaaagcuccccucucacaacguggccucacgggauucugcagucauucucagggugacucuugaaacucuccacuuuccugacaaugcucuaugggacccuguuccacuuacugaugaaucccuacagugguggugcccaaaccuacccucagggauccaggcuggacaaccccccacccacaguccaaugggccuggcugccucugccccagggccacucugccccuaaugccucaaucucuagauuuuuguuaguagccucacagagcuuacaguggccugccuaggucaaaucccuaaaggcugcucacaugaucuucugaugagccaggggguccccaacauggcucugaagccaagcacagggcuucgauuuuauucuuacuaaagaauaaauauugucaggaggcaaaaagcaaauuacaaaugguaugggugauaugacaccauauauuuauuucuggguggugaauuuuuguuuuaaacaaggaaucugaauuacuuauaaauuagaaguuuaauaacaauaaaauuuaacaugccacuuggcuaccuagacccuuccuccuagccugucacuauucuuuuggauucucacugucauguaucuuacaugguuaucucuuccugauccgugccaucuguucccacaucuucacaugagaaccagaaugcagguuagacagacagagucugccacaagcucuuuggcacaucacuacagugaaggcucuguugacauugaaccacuugaaccauuucuaaauaaacauugauuaagucugauuguucaagcugcuacaaaucuacgucuuuuuuuuuuuuuuuuuuuuuugauucagagucucaccucacucugucacccaggcuggagugcaguggcgcaaucuaagcucacugcaaccuccaccucccagaacucaagcuuaauucucaugccucagccuaccacguagcugggacuacagacacacaccacaacacuaaccaccaugcccaguuuuguuuuguuuuuguuuuuguuuuuguauuuuuaguggagagaagguuuugccauguuggccaggcuggucucgaacuccuggccucaagugaucugccagccuugaccucccaagugcugggauuacaggcgugagccacggcacucggccucaaaucuacgucuuuauuaucauuucucuaucugaucuauuagauuauuaugagauucugucaaaugauuuccugaaacgcagacuuccucugugucuauuauaccggccuaaucugccagccuggcaaaucuuaugaaaaagaaaauuagaguugggaggaacuugagacagucuucugggguacugauaauguuacauuucuggaucuggguggugguuacaugggugucuccacuuucaauaauucaucaaguagaauguguuaaacuuuucuauauggagggaugggggagggaggacuuaagcauuaaacuaguccagcaagaccugguuuuauggaacccacacuaacucuaagaaaugaccucuuuucuuuaaaaauacucuuaagucacaucucaaaaacuugcucuguuauuuugaaaaccagaacaguugcccauugugucuccuugccccucucccaauccccauaaugccauaaagauuucugcacacaguuugaugaugaugucccuaaguuucugucuggcauuuaauuuuucagacccugucuaauuuggagaagccagugguucauuuacacuuuuuguacacuccuggucucaaguuccacuuaacucuauguuuguuuuacuuucugcaggaaggccauucuccuugagagagaaggcagaggcaaacagaauaagcaguaaggacagagaugcccucuauggcaucugcuaaaucaccugauugaaccagguggccuaaagccuuccuugccaucccucucacucucaacaguagcugcacaggcgccuuuguuguucuuaguguuucccaggucucacccaucuggugcuccugacacuguucucggagguugcauccacuucucuauuugcucuugguuacaggucccuuuuucaucucuagacaaaaucucagcucgaacugugcccccugaagccaugugggucucuuuagguggcucccuguucccugcaguaaucacucgugacucuauuaaguacacuucauuuuucaaacucuaagucaucuuuccuuuugaagcuccuguucagacaucauaucuacuuuuuccuggacccucugaaauuuacuuucccuaaaacucagaggcagagaguuuuaccuuccccuuuuagcuucuccaaacacagucacuuucugcugauguucucuagacuuuuuuuuuuuuuuuuuuuuuaccagacagauccuucuuguugcucagaauauaauuucagugaggcccuucuccuuauugcuuccuuaaccuccugagagagaaaacugucagaaaagagaauuaagaauuaaagcaagugaagaauuuauugguuucuuuuuuuuuucuagaagauuuccaacugcccagauaccccgugcaccacgccaguuugcuucugugccaguuuuauaauuucaauugagaaagccucuucuacacggaggguaaagaguugacaauuaccucagaguugauugguugguuaguuuuuuggugggcuaaaagccaaugaccuggacuuuuuccauuuuuuuuuuuuuccucuucaccaaaaagcccaaacccaggaagcaaaacacugagugcugcucuggagucagagagaccuaggugaaaguccgagauucuaguguuuucagcugugugacugagguaaguuacuaagccucucuguaccucaguuucugcauuuguaaaacagggauuaauaacaauaauauuuaucucaugggauuguugcggggaugaaaugugauuuuauauacauaaacauacccagaguuccuggcaaaugccaagcauuaggauaacagcuguuuuaucauaauauaccauuuaacaaaaauuauuauuuuuacuuuucugcuaagacagaaugccaggguuuucaggcuucucagaagggagaggagcuaucuguguugggggacaaagaagaccucccacugaguggccuuagauucccauucucagcuccucugacuggauagacaaagccaguacagaaggaauucaugggggagaaauguaauuaacaagcuagagggagagauugggaggaaggaucaaagcagcuaauuagaacuggcuaaagggagaccacaggguagggaacauggaagaaagcgggcuaaagagaauuaucugcagccucuaauuauucaaagaaugucccugaguaauugucucaggcagucugagggaggcaaggcaggaguaacaagguuaagcagaagaaaauuuaagcuaaaacauacgggagauuuuucacacacugagauuuaucaacuuuauuagagaacacagaggauguuauuuuaggucuucuauacucaguuggugguauaacuauccccaugucugguggcugggggagagcggaggaggccagacccugcagggcaagaggggauccaaggaaauggcccacacaauccuugcuccaagcuuauaggcaacacaccuugucaacccgcccuuugaggcucaggaaagagcuuccuuccucacucagaucugcacucccuccaaccuccacauccccucacccuccuuguguucugucauaaacuugauaaacaugauaaaucucacugugugaaaaaucaucuccucaaucagagccaguggaaucacgcagggccuauuuugcguuugccacacaacuguaggaauguuuaugaaugagccaucucuuaauagcaaaagaaaaggcaaugaucguaggacggucuauagcugaaaaugacaacacugaaauacuucguuuacaggauuuggaagucguauagacuacaaaucucucugcugugcaacacacauaacaaguccccaaaauauccuuuguuugcugagguuuugcucagauauuuaagguucugacaguuuaaauauggugaacaauauggugaaccauccaaauauuuugcaucauugguauuuggaaagaucuuuaagaacaauuaguucuaguucagagaggcaagugcagcacccaggcucccgguuuuccgugggggcggaucaacauggccuccucagcuagcugcauuucacagggagucucaggccccccuagcauggguuuccuaggccuggccacuuggcucacauuguaacagagaagaaaacugggcagauccgcugacuccucagcuaggcgcgggguucaccaggucucacuggaggcugagaaaaauacagagcuucccggaagcaggaacaacacugggaggccugaccuugcucaaggcccuuugaccugacucaccagaccggaaugggaaccuaaaggaaaguggagacuucccauucuguggaaaucuuuaagaacuggagaaaaguuccaauuacuuacagcuucaagggacagaaugauggauggcuuuguuugcaaacaugcuauuugucugaggcucuuuguccagucagcugguugacaaauacugaucacgcccagugugcacagggaccucaguuaagaauaccagggcuagagcaaagaacgaacauaguuccugucucuaucagacaaaauuaacagccgacagagacgcgcagagagccacucugagagaagccacugggugcaaggguugucugaaaaauggaggagcugagcaggagggcaugcuggaggaaugaccuugacaagaucaaaaguuauuaaaauaggaggaggaaagcuaaacuucuguauguacugcccaacugaaggcagaugaaaaccuccuuuuuuccccaaaagaaaauguuaagaaucaccuuccacagacucuuuuaacucuauuucugauaaaucauuaaaaggccuucugcuggaaucacucaaauaccaaagaaaaaguuacacucguaaaauaguuaaugucaaaacguaaaugguuuguuuaagauucagcaauuguugcugaaucaaacacaaaaucucuauggcuugaauagcaagggaaacaaaaggcuugacgauuuagugcucguuaaagccugucuggcugaauuuuagauugcaacuuaaaagaaaaaaacauuaaaccaguucaagugugaacugacauaugcacagcaguuuucagcugccugcaaauggggcaaggacacagccuggaaugugacuugcacacgccauggcugaguauggaccaauguccaggguacaagggcagggccugagggaacccgacaagaaagcguggggaagcugagcccaggggcccaccaggggcugagggugacgcugggaagagggccaauccccauuagcucuuuccugcagggaggcugggggcuugagaacaaucaaaugcuaggcaggggcuucccucuugccuggggagguggggaagcaacagcuuuuugcugucccuccccuuuucuggccuugcuugucagacacuuccaugagccacagugggacuccugcccuuucaaaucucaucacaggccuggugacccccacaacccucaaaucggguguuagaaauaguccuuugugguagguuuguggggugcugagcagaaucuuugucuacauucucuugccuacugggauauaaacgcuuaaaauuucaccaucugggauuuacuucuuugagucuuaaagacaauucugucuuucaggguccucuauuaaaaugccauugucccuggguugggaggacccuguauaaguagggugaccacauaauuuauuguccaaaccgggacacuuuugagagugaaaggggcacaauuaauuacugcacugggacaagaggcauaaacagaacauauggucacucucuguauaaagcuuuguguuaaguucuauggaagacacaaaggugaauaaagcacuuucaugguccuggaaccuggaccuugagcugaggggcaggagauccugggaauaggcuaacucuaggcacccacggagggggauaacagcacuccagagggaagugucauggcagcuuagcaaagaccaagggcucuggagccacacagauuugacuuugaauccuggacuucuuucuguacaaccuuaagacaggucaauuaaccugccucucagcucaagguccagguuccgggaccaugagagugcuuuauugaccuuuauaucuuccauagaacuuaacacaaagccuuauacagagagugaccauauguucuguuuaugccucuugucccagugcaguaauuaacugugccccuuucacucuuaaaaguaucccauuuuggacaauaaauuauguggucacccuacuuauacagaugaggacccagcuuccucaucugucaaaugaggguuacuucaugaggcuaccgaggauuaaaugagauaccaaauguaacaguaccuggcauguaauuuucaacaaguucaauauugcuagcauaaucaagaccagccuuccacucaaacccccguuacugcuggaaaugucccaagucagaaggugggggcaaggcaggaagagaaaaccacuaaaauggcagacuuaguuuagcuucccuccaaacuaauccuccaagggccaccacccagggcugggcagugaaaggaccaggaucacaguagcuccugaggaguggaccacccggccgccuugcucuccuggugccccuuccuccuggucuuaggcuucacacacugacccagccccucagcuacugcuccauccucaacuccuggaggcagacaccacccaccaggcuuccucaggccauuucccucggcgggcggguguagggggguggugacuuuccaaagugacugagcccuguccugauggccggguaaugcugucuggugggcacuaguacaucuuccugugccucuugugacagaaaugccaaaaacaaacaaaacaaaaaacccgcagccccucaucgccaugagaggaggggauucuggaggccaccauuuaauagcucucaagugcuuuucaagcauuaaaucaugccauccucaugacaacucaaugaggcagacaccauuacucccauuuugcucaucaacaaacugagucauagaaagcuaaguaauuuucccaaggucacauagcuaauaaguagcagagucaugaaagcucuagaauaggagcuaagaaaacuggauuccacuggggacacgccgcaaauuacuagccuaauggccaggaaggaggccuuaacuuaucucaauuugacuucuauuauuugucaagaagcugugcuacuucaccaauggaccugcugugaguaucgagugagauagggcaggugaaaucacuguacagguguuuacuauuaugaugcccuggcaacauccuccaucguuguguuucugagagcuggacccaguauggaggaggagaauccugguacccugcuguucuuuccucccuugggcccugcacacucuggcucaagguaaaggaggaauuacucuaaagcagugguuuuccaagucugaucucugggccagcagcaccagcaguaucugggagcuaguuagaaaugcaaauucucaagcgucaccccagacucacgaaaucagaaccauuaggggaggggccuggccaucugcauuuuaacaaggcuuccaggugcuucugaggcaugcuuaauuuucagaaccgcuaggcuagaguaucccuggacagauaacaaccugggccucucucacccuggugggccugaggcaggacccagcauuggccagaagacccaggccgugagggccacugccccaaagaugaaaagcucccaauaaaacccagaccuacauggcugcacugaucaaaauacaauaaagaagaaagugagaaaucugacaaaaagaaaacgcagcuucagugggggucaaaauacaacaaucuucugugggagaugagaagcauaaaagggacguuagauguucaaagaaccaaaugucacaacgacaaaaaauacaagaauaaagacaaaguguggauaucaaugccacaugggccucagucuaaugauggcaguugcagggaacagcagcccccccaggacuagagccugcuuucccccgcccccaacacgacagccuauauaaauagagucuugaggaaaaaauuaccagcaauuagucaugaaucugcuugcuggaaugaggagaaacuuguggaaagucaccagaggcucuggugggaaaagcucagcuaaggaggccacgcagacagggcaagagcaagacgacuaagggagaaggccugugggguguuccugcaaccuuugaugccuuccaagucuuaaccuggaagggaaaaugaagggccuggccacugggcuauaacgagcuccaaacugggcccacauccaagucggaaguccuuuaaugugugcuugggcuggagguggggcaggugaaugaggaggaagagucagcauagcaggcccugcccuggguugcagguaccuuggggggaugaggcgguagagcacagcuucugaccacagugccuccaccacagaaagccugugccacacagguccuccccuggccccuggggaauaugcuucagaagcagugacagcagcaggcucagcguuuccauucaagaggucugcugaaaaugacccuguuucaggaccaaagugaugaggagggaggaccucucuugccccgaugaauuucucaacucaucuccaucgacagaggaaucucagugugcuguguuccccaccgccucugccugagcgcccugccccugcccguccccaucuucaucuggccaguuccuacugcaagaacccuucagacacgaucuccucagagaaacacucgcugaccuccugacccucacagggccccugcuaugcauuccuggggcccuccuucuuuccauccucuuaacagaccugacaagaucagcuuccccuccuaaaccaugaacucucucaaggaccuggacugugccuuguugucuguucaacugugaccucacucuagaugguagagcccaaugcccagcaugcaauuaacaggagcugccugcagacacaaggcuggcucuguguccccucccagcugagacacugagccccagcacuaggcacguggauggguugggcacaugaccucccucccuuucugagcaccuugcccauuccaagagcucacggaaucagacuccgcgacugcccugaguucugacuucucuccccaucucccugcacuuugauucucuugaccauggguccuccucacugcauauccccugccugcuugagaaaagggaugcagcccagauggucaauaacccccugagguccuccuccuaggaaugucuguauuugcucacaaagagaaguuuauauauauaaaaccaagaaacaaauuucuaaugguauuaauugaauuuuaggcaguagcagaaagaaaaaaagauuugggaagcagggaguuucacuugauuccugaaaucaccucuaguagguaaugcccaccucugcugugucuaagaucagcccugacucaaucuuaggauuaggcaccgccugccagccauggcaggacaguccacagauauguccccagguggccacugucaccuccuuucagccugaccucagcuggcuguccuccuugacaacaguccucucuggcugaagacuggaaacuguaggcuagagcuccugcuuuccuuucugggacucuaacacaguaccagcccaacuuuccaugccucugucaggucagcaugguaucagagauggcuguuuggccacucuccuccugcaauaauacuccacgcuccaccaaccccuguuccaucugagagccacucacagucagcucugcccgaggucccugauagauuggcuggugccaaggauccauugaggagauggcacagagccacacaggggagcaacaacauuggaagagggcaaggucaaguugacaaauaccauauacgaucagaaagaauugcaugaaccgcaguggcauaauguagcauaacagauggauaauuagauuuauucuaagagcuguaaaaguaaguaauuaaauaaaaauauggaacaaugaaucugccacagagagacaucuaacagccucacaagggccuugcagcuggcacgagcagccugggaaggaagcagugggcaaggaaccucuaacacugcccugauguuuuaggcacaauaaauuuagcaccagcucacacugggcacaaggggacagcuugaucucagagggggauaaucacacccauggcugcaacaguacugugcccugggaguauggccucuugucugcaucuggaagacagcagccugagguauuccgauaaaugccccaccacuggcauguuuggaaaggccccugcaaagcaagacuggcagauuguauuuaucuuugcagaagcagaggcagagaggaagggagaugaaaauguaugcacagaugacaggauucacugccaccaacaaaggcaggcugggagacccagguucaggucuccacucuccucccaaaggaugguggcagauggugaggguacaguuaccacauaagaaacacaaggcaagcacccaaugugugcaaagcaaaguguuagguacaggauuucaccagggaagcagcuucccuggacaugacauuagcuauuuggaagcaaacagaucaguuggaaguuguuuuguauuaguuaggacucuguuuuuaagggaccaaaaugaaauucagaggaauuugaauuccuuugaauuccuuccucaucuauggaaaagagaguguacugggucccauuaugaagaggcaugacaaagguaaaaagcacagcuggguccagaggcuuaaguaaugugccaaggcccucucucagccugcaccucuaggcuuugcuucucuccaguuuucucccuguaaacagccaaucccagcauaaagguaacuacauccucccaagugguauagaauuccagggaagauccuggccaacauggggaaaccgucucuauaaaaauacaaaaauuagcuggguguggcgaugcgcaccuguagucccagcuacuagggaggcugaggcaggagaauagcuugaaccugggagggggagguugcagugggccaaaauuguggugagccaagauugcgccacugcacuccagccugggcaacaaagagcaaaacucaaaaaaaaaaaaagaauuccagagaagaacuuugauugguccugcuugugugacacacacaccccuggaccaauuacuguccagauggaagugauacugugaguggcaagucuagaucacaugaccagcccuaacugggaagggaacagguggggcauaaagauuaacagccucaccacaccauguggcacuggugaagagauucccaaaggaaaggaaguauuauuuuccaaagaggagaacagaauguguugagagaccaaaaacaacauaaaucaagagccuucauagcccaccacauuguuuuauaccaccccaggccaagauacuagaugauaauugacuaucuggggcuggaaugggagguggccaagucuauuaacagucugguuggagauuuguuugcagagaucccaugugaccuaccggcuugaaaugcuccaaaggcccugcugcuuguacuucuaaaagcagcccauccuuguagaccugccccugagaccaugcacaggacuuuuucuacuucaaacagcuccacuuaggaaaucuacacagcacuaaaagcauagugaggaguucccccagcagccaacucuuugcaggguuuucucaccaacuaacuugaaucuucuucucagagcacagaccauaaagauuaacuccccugaaccuggaaaccucagcaccuuugacgggggucaagagcggggaugaggcucagcccagaguugcuccccauucacaccaaugguuucacaggauagcucucuauuccaauauaccccuacauccuggagagggagggaaacucagcauaauagcugcaaaaguagaaaacuucccacauccccagcaccacaaaagcugccacuuugcucaaugccuagcacaaagggcucacaguggggcucuccccacaaccuggcuugaaggaagagagguccuuggccuuuccucaccuccagggcccacggcacacucuucuaacauccucacugggcuccaaccaacaggcucagucaucucucuggcuaaauaucaaagcagcuucccuucucaagcguguccaaaacucaggucuccuucaggccacacagaugacacccuccaaaagcccagaaugagcucuguagggucccuggggagagcugagacauaggaggccucguuguuccaaggccagcuggggauaaggguuauggggaccuuuggaagccagauccagcaggagaaucaugaggcuucaguuccugagcucugcacauucuuaagugauuccguugacuucaccaacaaccuggggcccgccgaaagcaguggugcuagccaacaucuggucaccaaguucuuucugccaccauuacuuguccacugagccugucccuagaaaugcagaaagacaaagcucagcucccauguggaguacuuaaaugcucuagccaugccugguacucacagccacauuugaaggucugguucaacgcagccaugcuggguccagauguaagaaccucaagcugggcuaaaaagcagcuuucccaugggugaacccucuggcucagagcuccucaggcuggcucugcugcugcuccacacaugccacaauuuacuacagcuguuaagagccccagagacaagaaagcuccuccuucccacuuguucccugcccuucuucagcacaggcuggaaccaagcaccagccaaaccuggagagaaccucagaaacuaugaccccaccccacaaacugagcucacacaauuuuucuugagccacaaacuaauuuuuguuaaucccagagaaacaguucaaacagcaacuaaccuuuuucuuccuucacaacuauuaaacuuggacaaauaccucaaaauaguacaugaaccaagaguuuaauccuucuccccagaggcaaagagaggacuauguggguaacaugaggguaaaacccuggguccaccaaguccaggacaaacggguccuggguccucaggcaagggggacagaggggcaauaagagcagaagggaggacaacccagggcugaggccccagugauggggguagagaagcccuuguucagucccagcauggagcugaggcuggccacaguauuccuacaguacagcaggagcgacaccugccugccaccuggcugaagggaucugggcaaacugaugaguccacccccaagcccaagccaauuaaagguuauccuuauacaauuaaagguuguguaacauauguaacaaaccugcgcguugugcacagguacccuagaacuugaaguauuuaaaaaaaaaaaaaaaaaaaaaagguuguguaagaauaaaguggcccagagaaugaucaugaaugcuaaaacacagaauccaaagggcucaugccagaaaacccaacagcaacuucugugucuuauuuuauaauaaguaauuuaaauaauuauaaaucauguaaguucaugguaaagaaaaaaaaaaucaagcaguauagaagagugcaaaauagaaaggaaaagucccuguuucucagaccaucagagguaagagcagaguuuuuucuuuuuucuuuugagacagggucucgcccugucacccaagcuggaguacaguggugugaucacagcucacuacaucccugagcucccaggcucaacugauccuccuguugcagcuuccuauguagcugggacuagacauaugccacugcaccugacuaaauuuuuuuuuaauauagagcugaggucucacuauguuacccucaaacuucugggcucaagugaucuucccgccucccagaaugcugggacuacaagugugagccaccguguccagccuugacuaauuuguuguugugauuguagagacuaagucccacuauguugcccaggcuggucucaaacuccaggcucaagugauccuccugccucagccucccaaaguucuaggacuacaggcaugagccaucacgcccggcccagauuuuuauaucacauauuuaaaaauauaugugcaauauaaauuuauauauaaaucuuuacccauuuacuuuuuauaugaauggaucacgcuucuacacaugcuauuuucaauguagagacccuacucuccagaaagaagaggcuccucaggucucuccgugcaccccuugauaucaaauugagcagcaaacagaagagaacagggguggcuggucauauuuuaaaagacuccaggauacacuaacauuccagaaccaaaagcuaaauccaaagagcuccucaggaaagcgugaacucggcugcaacggggucucucucuacaggccagggagagggaaggcagccuuuauaaaccguuccucuugggcucuccugccuguggcuguuagcuucaccucccccaacuugccaucugagggccuucauucuucacugucaugccugucaccaccucuguccucccccuuugggccugcucuacagccuccgcacugcucugaaacaucaccacuggcaggacugugcaacugagaacaacaggagaugaccucacggccuuuacauucuaaugccagcucccaauuacuuguacuguugaauaauugaaagaggagaauaauccacucagcugauuugggaagccagccaggcacacagauuaucucagagugaauuauucacacuagggauaauugggaguugcccaaacuucuauuuguaguucaggcaucacguggaagaacauucgguauggaaaguaugaaagcuggagagggaaggagccccuguuuccgggccuggguuuccuuuauguugcuugggaagucaaugcuccucucucggucucacucagagucggugagcacaaugaugaugaugauauuaacauuaacaauauuuuagugacagcucuugcuguauuuccuuacaaugugcuguguucugugcuaugagcuucauguguaucauccuacauuaucucauuuaauccucacaugagucugugaagcaccacugucuucuucaucucugagcugaggaagcugaggcuuagguuaaguaacuugcccagagauauacagcaacaagcuguauguccauccauagaccaggaucuuacucaagaaguucuuuugccacacaccucuuaccucucccacuuuuaagagucuuccuuacacaagacauaaaacuguaaaggauaaaaacaccccauuuuuaguauaauacugucuacucucaucuugaaauuacuggauuucaagguaagaaaaauggcucccuccucugaagguuggcaagaagccuauaggaaggggcuggucagcuggucaauccauuucgagaaauccagugucuggaagcacaagccacuggcagacuuccagaagagcucagccuucucucaugaucaaagacucaaaaaugaaaccacuguccucccccugacacgccaccacuucagccaagaggcagcuacugagcugggcagcucagcaccgugaggccagagcaugggggaagggcauaggcucagugagcugcaaggaacaccugccucagacaaggguccaugaggugacugacugucccugcauguguggggucuccuuccacagugccuaggacagaguccccagauacuagguguggugccagucuccagcacggucaccggcgauccccaccagcgaucccagccuuuguguuggugccucccacauuaacuauagaugaucuaugugaccaaaagaauaaagaggaagugaugaugucgaauucuaaggcuaggccacaaaaagaacugaaguuuccaucuugcuguccuauguuguucacucugggggaagccauggggagaccugcacagcccuguggagaaacucacagagagagaaaccgaggccucucaccaacaacuggcaccaaccagccaggcguguaaacuggaagcagauucucauacccagucaacacccugccuacauuuccaaauuccugacccaaagaaacagaaaaauaauaaacuauuacuguuguuuuaacccacuacaucugagaauaauuuguuauacaacaacacauagcuaauaaacuggacaagagggaaaagagcugcuucacagcauuguuuccagaagugugacguauccauagaagaaccaaaccuggugucagggccagaggccaccaaaggcccugacuaagccccuaaggucuuagaacacuauaugagaaaaaacaaugaccuucacggcccagauauuccagcccuccagucaaggaaaagcuugcagaaaauauucacgaugcccauaccucugccuccagucaggaugacaauaacaacaauauuagaagcuaccauuacugaaugcuuacuaugugcccggugcaugcucaguauucuuauauuaccucucuuuuuuuuuuuuuuuuuuuugaggcggagucucacucugucacccagacuggaaugcaguggcacgaucucagcuuacugcaaccucugccuccuggguucaagugauucuccugcuucagccucccaaguagcugggauuacaggcacgcgccaccauaccuggcuaauuuuuuguauuuuuaguagagacgggguuuugccauguuggccaggcuggucucaaaccccugagcucaggagauccacccgccucagccucccaaagugcuaggauuaacagacuugagccaccacgcaggccauuaccucccuuauucuucauugcaauccucagaggaagcacauaguagggacucaauaaauauuugcuaaaugaguaaauaaaccaccauuaggaguucgucucuauaacugaucuauguccuuuugguauaauuucaacuuucuauauuacguauuacuuuaacguuugaaaagcuuacacugagaauguauuacuuaaauagaggaaacaauauauaugaaauuaaaaaaaaaauuuguagggcaagcaaagcucuaaucauuaugugccauccaucacguuucccagagaagugcaccuccauccugagcugacucucugagagcuucucacacauccugagcuucucacacagcuucucaagagcuaccuggauccacuagaaagcccauucacacagcacccuguguugcuugacccuccagauuguccuccaacucagaggaaggaaguagguaugcugcuagcugguggaaguggcaggauugcucuacucgucucaggaccaggugccauggccaaagacagccccagcaauugaaaaucaggcagacaucacgguccugagucuggacagccacaaucuuaugaugagaguagccacaaacauggagagacaugaagcuuucugacucuauauccuaaucuggggaacaauaaucuucccaguuaugaagcacuaucauggccaucagaucuaccacccaaaauccugaugagaggaggugacuugaacuagauaccaggaagagcuuccuacuaucagagauuuaagauaacaagguaggcagugcuguagucugaaaccaugaagaguuccuucucucccgcaaagcaaucagaggaaucuuuuuuuuuuccuccuuuuuuucuuuuugacacuaggucuugcucugucacccaggcuggagcacaguggugcaaucauagcucacugcagccucaaacucuuggacucaagcaaucuaccucccucggccucccaaagugcugggauuacaggugugagccacugagccaagccaggggaucauuuuuaaaauguaaaucagaucuuguuacucccuuaauuaaauggcaccaguggcuuccugcuacccuuagaauaaaauccaaauuuaguucaccuaggucucuaggugcacugccaacuucgccaaccucaccucuucuuagucuuucuuuagcucacuccauuccagccacacucaccuucuggcugcuuccucaacuggccaagcuugucccuaccucaggacccuugcaacggcuauuccugcugccuggaaaacccuuggccuaauguacauauggcugacucaaucuauauuugaguugaggccagaaugacaucucuuuggaaaagucucuguaacuaacucaucuaaagaaccuuauaucauccuauuuuauuuucuucauaacacguuacugacuuaaaaaugcuuuauugagguaaaauucacauaccacacaauucacccauuuaaaguguacaacucaauagcuuuuuguguauucacagaguugugcaacauaucacaauuuuaaggcauuuucauugcccccccauaccuauuacuagugccccccgcaacucuccccaacccccacucccucagcacuaggcccuacagauuugaauauuccagacauuccacagagauggaaucauccaguauguggugcuuugugacuagcuuuuuucacucugacuuuuuaaaaguuucauccauucauaacauguaucaguacuucauuucuuuuuauugcuaaauauuccauuguauggauauacuacauuauauuuacccauuucucagucaacagauacuuggguuguuuccacuuuuuggcuguuaugaauauugaggcuaugcacauucauguacaaguuuuuguguggaauaugguuucacuucucuuggguacacaccuagcauuggaauugcuggaucacaugauaacucuauguuuaacuauuugaagaacuaguaguguuuuucaaaaugguuggaucaauuuacauuuccacuagcaguauaugagggucccaauuucuccacauccuugucaacacuuguuauuaucuaucuuuuugaguauacaguguucucucauugugguuggguuugcauuuuccugggaguuaaugauguugagcaucauuuccuguacuuacugcacauuugcauuaucuugucuggacagcuguccauucagauccuuugccuauuuuuuaauuggguugucuuuuuauuguugaauuguaggaguuuuuaauuacguuguuuucuguugcugaguugcaaacauucuuuagguauucuagauaaaaagucccuuaccagauauaugacuuguaaaaauuuucucccauucggugguuuuccuuuucacuuucuugaugguauccuuugaagcacaagaguauuuaauuuaauuuaauuuuauuuuauuuuuuuuuugagaaggagucucgcucugucgccaggcuggagugcagugcaugaucucggcucacugaaaccucugccucccggguucaagcgauucuccugccucagccucucaaguagcugggauaacaggagugcaccaccacgcccagcuaauuucuguauuuuuaguagagacgggguuucaccauguuggccaggcuggucucgaucuccugaccucaugaucugcccgccuuggccucccaaagugcugggauuacaggcgugagccacagcacccagccaagaguauuuaauuuugaugacauacugacugacuaaaaaaucaacuucugacauguaaaaagaaacaccuaucugucuuguucaccaccacauccucagucuagcaaaaugccuggcacauaauagguagucaugacuuuuuuaaauaauuuuuuuucgagacagggucucacucugucacacaggcuggagugcaguggcgugaucucgacuuacugcagccucugccucccaggcucaagugauccucccaccucagccuccuaaguagcugggacuaccagcacaagucaccauacccggcuaauucauauuuuuuaaugaauguaugaauuuuuagggccagaggagaugaguguugggaugggcuaugagagagggcuccuugccaggaggcaggggugaacacagugauaucuggaaucauuucugucuagaggagcuguaaagagugagagaaugcggucuuccacaagagcaugggggcaguguuagaugcaacacuccugagaagugaacggcaucaucaauaacaaacucccugacugaaaugcucagguagucauccugucuuuucagccacccgggugagcaaaagacagaacaauggcucaggaauggggacaacucaggcaaaagggccuagucacaggggugagguucuuuccagaauccucagcacacagcaacacccccaaagggggcucuaggcucuugcuuuacaaaaaccgcuaggggccugugugucagcauggcugacaggaagcgguuauacugaggaaaaagagaugaagucaaaagauaaaguugacagauauuaggguuguuuccacauuuugccuaugaacuugccucuucuagccuuugccaagaacaaugaaauaagaagucugaagagcugaauguccaugccagggugcuucaucaaagcaccucagggauccuagacuugacugccgagaggaggcauuuuagucaggcaaagagguuggaggugugguaugggugcuuaaaguuggcuaagugcuaaaaaagguggacaguuuggacaaccagucuaugagucccauggcagggaaggagguaaccuaagagacaagcagggguccaaaagagaggucuggaaacucaucaguugcagcaucaagaaagguauucaaaggcaagggcccuugcccuuccaucccagacuuccacugugucacuuuucaugagggaaaggaaggagggcacagugaguuuuagaggcacaugcaugcacacacacauauauggaguugccucugggaauguaaauaaauauucaugaacagcucaguguaugaaaagcaaggacagaggaugaaaaauggugccaauuagaaagaaagggugguaucuauuuuuaaaguggcugaauaaacaguaaaggauugcuugcuaaaaauacugugcuugacccccuccccaguggcagagucccucuccugugcuugguaacaacaggcaaacucuccucccaguguggcaggucuaaugcugccauggcagccucauguucuuaugagagguucacccugggccagguaugguggcucucgccuguaaucccagcacuuagggaggccgaggcaggcggaucacuugaggucagggguuugagacuagccuggccaacauggagaaaccccauuucuauaaaagauacaaaaauuugcuggcucugguggcgcauacuuguaaucccagcuacuugagaggcugagaggcugaggcaggagaaucgcuugaacccagguggcggagguugcagcaagccaagaucacgucacugcccucuagccugggcaacagagugagacucugucuccaaaaaaaaaaaaaaaaaaaaguuuacccugggugccugucuccaguaagaaggagauuucuugugagaagcauucugggucucggaccacaagcugauaauggcacucaugccucagaggugacucagguucucaacagucuccaaaagaucccuuggcaagagggagcaagugaaugcaggacuccacuggagaauccaacuauggaggcaucagaaccaauguaacaaaaaaggaggggagaguccccaaauuauccuccccagaguccagaucauaugggaguauuucaugagagucauuucaugggacuaguggggcacugaaaucaaguuucuuauccacugcccacuccugauacacaugcaccaggauauuccccccugggauuagaucugacugauggcacaugaaaauaaaggcaaggagugaagcucaguaugauucauggacagagaaaacaacaggaacccaaauuguaugugggccagugaugggcagggacuggaguuucuguucugucccagaugcgcaaaucucacccaagucaguccuguaggaaaagcacuugcucucccacgcucacgccugcucucgcgugcucucaaucucucucucuuuuuuuuuucucucucucagcauuuaucaccacuuggcaccacacugugguuagaagucuggcuuugaagucacgcugccuggguucaugucuuggcucugacacagucuagcugggcgacacuaggcaaguacuuaaccuccccaagccucaguuucuccaugcauaaaauggaaauaguaauugucuuuacuccauaacaguacuuacuuggccagauucaaugagagcaugcagugacucucagcucggugccugacauguuguagguacuuuuuucuaaauauucuucaugucuuggucuagacucuaaacauuuugaggacaguaaccaugccaaaugcaucuuccuauccucuaagaguguaacagaguugaaauucaguaaacuuuugucaaaugagcuggcuucccugagcauguuugccaugggcaacaaacccagcuggcaaaugcauuuguccaguucaccggccccauuuguucucaucaccucaagauaaauccucccaaccaccagcaaggugugcagggugggcagcaucugccccucccuccauuaggaaaaggugagaauaaauuggaaaacaaacagccacaggcaguauuugcagcuccucagagcgaugcccuaucgauuuuuaagugucacuguuaauaacaacaacaacuggcagugauacaacauuuuucuuccaaaacaaucagagcauuuuauagagacaauuucaucuaucucuccauggcuccagcaggagcaggagaauauuccccacuucaaguaaagggcaggagaggccaagggguuuggccaaggucacuguacaagucagugggaugccggugcuccuggucucugcggcccucugcaucccuggauggcaucucccuaggacagaacuucccuagcauaguucuuuucagauguuuagcaaaguuaaccuuuuaacaaaacacccauggguggaggguggcaucaagcacuauuccaaaaagcauccucuuggcgggaagcccuuagacaugaccacuccuuggcuuagucuuccucuuccugugugccaucaagaaucacaccuaccaguugggcgugguggcucaugccuguaaucccagcacuuugggaggcugaggcaggcagaucaccuaagguuaggaguucgaggccagccugggcaacauggugaaacaccaucucugcuaaaaauacaaaaauuagccaggcauggcggcuugcaccuauuagucccagcaacucaggggggcugaggcacgagaaucacuugaacccagaaggcagagggugcagugagccaagaucaugccacugcacuccauucugggugacagagugagacacugucucaaaaaaaaaaaaaaaaaaaaaaaaaaaaggccgggcgcgguggcucacaccugucaucccagcacuuugggaggccgaggagggcggaucacgaggucaggagauugagaccauccuggcuaacauggugaaagccuuucucuacuauaaguacaaaaaauuagccaggcgugguggcagaugccuguagucccagguacucgggaggcugaggcaggagaauggcgugaacccgggcggaggagcuugcagugagccgagaucgcgccacugcacuccagccugggcgacagagcgagauuuugucucgaaaaaaaaaaaagaaaaaagaaaucaaucacacccaccuaguaguccagaggcuggagugccacacaaagggaggcagagaaaggacagguccaaucuuacccaugcgacacacagauguguguccaaggagauucccguccaaccacccacucuacccugcccggacucccacgcuccaccccuccccaacacagaacucuacucccaagagugacgucuggcagaaacuaugaacaugaaugacagugaugcccaagcagacagacacagucucugugagacacaugccaagugagcaucccuccucccagagauggacccuaaccaccacuagacaagagcuuccucugcuggaaacagcucauccagccaucuccaugauacauacccugcccacagcucugggcaucaggcagauaggugggacaggaggccacaaguagugugugucauccugaaggcuaaaaucaaagcuuccugucacacugggcuaugucgggggauuagcaaagguagcuaauccuggugcagaggauagguuccaaucaagaucugaaaaaucaaaggcugaggaaggcacugaauaagaucuccugcaccuuauauaaccagcaggcucaagugucuggucuguccucuugucacugaauagagcagcugugcuugcaggacuucaggagaaacagcacucaaggcagaugagagauaauauccaggcucaaguacaaaagaggaaugaacuccuuagaaccuggaugccaaggauuacuuagucucaggcaggacugauacuaucccaccaacccucccucucuuacgguguuuuuuuuuuuguuugcuuuuguuuuuuuuuuuuugagacagagucucacucuggagacucugucacccaggcuggagugcaguggggugaucuuggcucacugcaaccugugccuccuagguucaagcgauucuccugccucagccucccaaacagcugggacuacaggcaugugccaccaugccuggcuaauuuuuguauuuuuaguagagauuggguuuugcccuguuggccaggcuggucucaaacuccugaccucaggugauccacccaccuuagccucccaaagugcuaggauuacaggcaugagccacugcacccagccucuuaugcauucuugaggccugugagcucuagagaaucaggcauagccucccaagugggauuaccaaccccuaccauccccuuauacccagacaaaagcaggaaggaaaaucugaccacuucuugcucuugagggcccaagcuagggugugggcaaaggguccagcugagucuaagcuggaaagcagggcgaugccucugauaagaacaaaggcuguaucagacacaggggaugagaugcuucucaggcgcuauucuucacaaaggggacaccagcaaaauaggcaaauuaaacucauuugugccuggcacaacggcagcaguggaagcuacagccagagcagcuagaggggccgagguaauggcaggacauggcagugggcacauggggagaagagaagcagggcucagcucuuaucucuauagcauccuaaggguguggcaugggcccugguucaccagcucugaugugggaccaagaaaccucaccuccaucccuuggggauauuuuaaguauguucaauuuugagagugccagaguuaagaaaugcugucaggggaguuguuuuuguguguuuuuggucuccuucugagauggcuuugcuguacuuguuuccaucuagggaugagugagaucccuuaugguucccuuugaccugccugauuagcgauuccacaggaaaacaccucccaugacaaaaugaaaguagacuucaagccaccuuccuucaggcugacuccuguguaaaugagcugccugcagccugacucacggcagcucaaaauggaaaaaugaagagaaacaaaccaguguaguucaaagguaagggugagacuugccuaucacgugaagcuucuaugggccuaacccagcacgcugccagggacuuggcauggguauacaauucaggaaggaaggaacucagggcacacuucucaagccagaaagaaccucauaucuagugcucuuguuuucacagagacuuaaagucucacagaaguaaaaugauggcuuaaaagucaguucucugacugucgacccaagacuguaucccauguguccagacuccugaguucaggacuaggucagagucacacugagucaggggccccuguacauauuugcaucaccucccaccccauggccauggcuagagauaagugguggcagagcugugggcgggaacguggacuuccucccucagcgacuggccagugaaguagagcccgcugaugaaggcaaacccugcaaucuccagcuccacagaugauguucuguacuaacaggcucccuggcaaggcagcagggcacccaucauccuaauggacuuugugauuaacauggcuaguccaccuacagcgccaggcccucucccuucccucccucuggauugcaggguccccacaggcagcagcuaccccaggugucuguuugauccaaacauuaaaaaagcguccauucacuauagcaaagaggcaguuauuucaaaccuauacauuaugcaucccugcuggaaagaaaaaagagcaaaauuaaauuaaaauucucucuggaagauuucugcccagaaagacagaaaagcacucuggaguuguaccuaguucccaacuccaagcagcucucugcugcccuuccccugcuuccccuccuggcuggacagcuccagaugugucucugaguuucaaugauucacucuaaugauaaugcacccucugaacaaaucacggacucugauugauuuaggacgcaacuugcacaaauaccuguaaucuaguucuaaucuuguuuguuuccauuccaauuauccugcaucaaugguuuaaaaaugggaaccgucuggugcauacauccaauccauuuuaauagaggauaaaucuggguuauugugacccuuuccucucccaggcgcaggacaacaccagcccucucaaggcacugauugggcagaaucagcucuaacucuauucaacucuucaaggauucaauuaaucauaaagccaauuccauucuaggcuccaucugucuugccuccuucggggacuaauaaucacucacuguguguuuuuacacacuaguugaacugaaauuaagacugauuucaucauggaacacucaaaaagaaaauacauuucuugaagaaaaauuucagagcuacuuuaaaguucuguucagauaaagauauuuguaaauauaaacaaaaacaauuuuaacuucaaacuucuugacauuguaaaauaauuccugcccccaaauccuuggaaaagggcagcuucucaggagaaucagaaacuccugagauuggaucagacaacagaaagacucaauuuguccuugggcacaacauagguaccuaaaacaugggaggggaaaaaaaauugggucaauuugauauuugaugcacuauuuuguuuuauuuaugauagauuauuuuauuuuauuuuauuuuauuuuauuuuauuuuauuuuauuuuauuuauuuugagacagggccuggcucugucacccaggcuggagugcaguggcaugaucacagcucacuguaaucuccuuaagugauccucccaccucagccucccaaguagcugggacuacaggcacacaccaccacucuugguugcuuuuuguaucuuuuuugguacagaugggguuucaccauguuggccaggcuggucucaaacuccuggccucaauugaucuacccacucggccucccacagugcugggauugcauuauuaaaaaaaaaaucuaacuagucauccauucugggaccagaggacuuaaccuaaaauuuagaauuauuuuuauuuugcauuaccuauucaugaaggcagggaggucagggaagauagggcaccauauucuuuucaauguguaggaccucuagaaguuuucagcuggcccugaggagucuaaacccucacacuccucuaaagggcaugauauauggcuuuuguauuccugcauagccuggcucucauagaagcauuaaagugacugcccuggcaaacacucuaaauggagcccucuuacuacacccaucucauccccuacccugaggauaaucucuuuaccaggagcaugaccauggaaagggccacggcccaaccagcuggccaccuggaucuagaagcaagccuaacuugucagcagguuucaacagagaaaaugaaaauaguugagcuuuuuauuuuuugagacaagaguuuugcucuugucacccaggcuagagugcaauggcgugaucucggcucaaugcaacauccaucucccggguucaagcaauucugccucugccucccaaguagcugggauuacaggcaugcgccaccaugcccagcuaauuuuguauuuuuaguagagacaggguuucaccauguuggccagccuggucucaaacuccugaccucaggugaucugcccaccucagccucccaaaguguugggauuauagaugugagacacugcgccuggccaaguuuuuuacuuuuuacuuuuuacaauuguaaagacaaagcauuugggccucuccagaguccaaagcuccugguggccauuguacgccuagcacagacccguacaccugguucuuacagaacagucccagcacaauggagggaacaugcugcagccaaggagacacagcauguggcuucuuuauugccuuaacagauuuuaaacuaaaauuuugaauuacacagauucccaaucagaacuaaugacauaggcauuccaaacuuaacaucaaagauguuuugugagucauauuggcucuaaaaaaccaucaguaaucacuucuuagacacaacaaucaaauaccuccuucguuuaaacaauaaauuuugccuacuaauaagucuaauuaauugaagcacugucauuuuuaaacguaggucaauguaagcauuuucccaaaaguuuccaccugagucauucuacaacuauugaaagcaaagaaacuaucuccuaagaagcucuuuauggacugauaaagaaugauauucaagauacagugcuaccagccugaccaacccagugaaaccccaucucuacaaaaaauuuuuaaauuggccaggcauggugguacguaccuguggucccagcuacuugggaggcugaggcaggaggaucgcuugagcccaggagguugaagcugcacuaagcuaugauugcaccccugcacucuagcuugggugagagcgagaccguaucucuaccaaauaagcaaacaaaauacuuauauaguuaaacagaaaaaguaaauuacagaaugaugaaucuacaguaaacugccuuucauguaaaaacaauauauggaaauauuuacuuuaacauggaaaaauaucucuagaagaaacugacaacacugguugccuugaggcagggaagcaggguagcaaagggacacgguggaaggacacaguggaggauacuuuucauauccucuggugccguuugaauuuugagccaugugacuguauuaccaaaucagaguugaaaacaugaaguuuaaguaagucaucucauagacaguaaucuggacacuuaccaaaauacuacagagaagucagaccauguuccacagggaaaacaagaaucuuauauaucccagccaggcaugguggcucacaccuguaaucccagcacuuugggaggccaaggcgggcagaucacuugaggccaggaguucuagaccagccuggccaacacagugaaaccccaucucuaccaaaaauuacagaaauuaucuuagucauaugguuugaaugaaccucuguguacagacuucacgaacaccaucaagauuagccauggcaagagaaaaauggggcccccaguggucacuacacauaucugagggcagauggcagcagcacaggagggagggaagaaagagaggaaggaagacaggaaggaaaggagagagauacggaaggagggaggggaagaaggcuggaaacaagggccgcacuccuuuauguaggacaccuuuugcccucuaaggcaucaucuagcuugauaagcccccaacaguuucucuccuuugcaaaaggggaaacugcagcucauuuaagucacaguucauagugaguuacagggguggagaggguggcuuuacaugaacuuugcaggaacacaucacuucugauccuaggacuucucuaacugcacgggaaaugccaucugaaggccaugucuuauccugaaaacucagaguuucugacucaucuucucauucugacugccagcuggcucuguggucuugaacaaaucacugcagcagagguacugagugggaacagaggcuccuccauucagccacugaucacuguccauggcucuuugggaaaggcaugcgugcgacaggaauuucacguuaagggucacagguaggcaccagggcuugcgucuuccugcccucucuuccuggaccgcccagcaaguuuacuccuggucccauuuuuuugcuuuggccuuugcuucucuuugaaucuuuguauccaacccaaugugagcguacacuuacccaagaguuuuccaucuagacaaugaggacuguggaaagacacuugcucagagcaaaggcaccagugugaccacuaugagggaagguuguccuaggaugcccacagagaucccagucuaaugccaaacagcaacucuaaccagggcagccuuuagucucaacuccuugccaugagaaucuaaaugaccagauaaccguagaagguaaccuggggaggacugcugggaauugggcagaugacuuucauucuauuuucuagaugcuuuccagcuggcuuuuuauuuauuuugagacaggguuucauucugcugcccaggcuggaguccaguggcguuaucauggcucacugcagccucgaccucccagguucaagggauccucccacuucagucuccaaccaugccuggauaauuuuguuguuuuuguuagagaugggaucucacuauuuuguccaggcuggucccaaauuccagggcucaagugauccucucaccucagucucacaaagugcuaggauuagaggcaugagccccaaacaggccccagcuggcuuuucuuuucuucgugacagagucuugcugaaguccaguggcgcgaucucggcucaccgcaaccucuaccuccuggguucaagcgauucuccugccuuagccucccaaguagcugggauuacaggcacccaucaucacaucugucuaauuuuuguauuuuuaguagagacgggguuuugccauguuggccaggcucgucucaaacucccagccucaggugauccgccugccucagcuuccuaaaguguugggauuacaggcguuagccaccaugccccacccccagccggcuuuuuaaaacagucuuuauccuuuccuuuuuccgggugaucugaaaaaugaaggcuucaugacaggagucucuauagccuacaccauccugcaauugccagucagaaagaguaggaaggccugagacauucuguuuucuggcguguuggccagaugcucuggauggaggcuggggcaccagggccagcuauaaucuuuucccagcagccuggcugaaguagcugugggaccaaggcaacugauuaaaugcagaauaaaagcugagagaaaaugggauagaaauaaauuagcuuuagaccucaaggcuguguaugcaagugaaaugcaguaggggcugggaggcagcaugggaagucagucuuagagauuucccugaaacaaagggauuauggauuguccaauacaaggaaauccuucuguuccacagccacaugacagccucuuuuacucagggcuguucauuccacauuuugcacacauucugagauaaugggauacacuaacucccuaaaaaagccccaagacucccccagcaggccuucuauccaggcagcacaggcugcaaagcagggcuggucaucaucaggguacagggucgauauuuccugccauccuucaauaguugcccucccucuauccuugacagauucuccacuuuuaaguauugaacuaugguuacagaagaagagcugcugggagagaauacaucuaacugaucagaauuuaacaaacaaacacucaaaaguauuuggcagaaggagagaagagaagaaauacaacggagaagguuccccaucuauguccuugugacuuaaauaucacagagaacccauccagaaggggcuugauccaaaaaauggaccauagcagcagaguuuagaagcaugcuuacucuaguuaaaucagggcuauuucuaaaaaggcuggucagagcucucuuucagguuugcugccaaagggcagaagccuguagguacuggacuccugaugaggcucacuccagucagugcccacuguacaccuucuaaugcauacgcagaccauggaaggaaagcaaggugcagaacggauguacugagucccauggcaaucacuacacgacuaugggugcuaggcugaaugaggagaccuugccacaaaucccaccugcucccucccuaucauuaccuauauccuccagauauccaagucaaaagcuugugugagugaugaagaaagagacuaggaaccccacucaagaccuucagagagauggcccuuucugagagagucugcuagcucuucaaacuauagaaagaacaugggcuuugacaucaaugcuuuagguuugaaguguaaccaucccauaaguuaacugcaugcucuugggugaggacccuccucugugaagccaaaauccuaccccucacucuggcaguuguugugaggauuaaaugagacaguauauguaaagccccugccccuagcaggcuccuuuuccacagccagccuuucucauauccacagcauaccugguccaggugaguccaguacucucuugguaugcuaugcucuucuacacauaagaaauagaguaauugguaauuuuucagguuaucuuuucaaacaucaaaaaaauaaauaauccuugggcgcuaaacuacaaggacacaaaggccuaagaauuauauaauggacuuuggggacucggggaagggugggagggggugagggauaaaagacuacacacauuggguauaguguacacuguucuggugacaggugcaccaaaaucucagaaaucaccacuaaagaacuuauccaggcaacuaaacaccaccuguucccaaaaaacuauugaaaaaaguaaaauuuagaaaauaauaauuaaaaaaauauaaauaaauaaucuuaugcuaaacuauuccagagccaagagaaaagagaaacuuuuucuuuuguaacugaaagcuagcugagauggaagcugcuaguggucccccacaaucuguucucccauucuuccacaguagcagaauuuuugcugggcaaauaaaguauaaagacuauauuucucggccuccuuugcagggagguauggccaaggcacuacguuuuggccaacagauuauaagcagaagcaucauuugacagcuucugggauccccuuaagagauuuuuaagugcccuuuaccuccucuucuaugucgcuccuuccacccugcucccuggaaugcagaucuugccaucugggaugaugaggaagggcuauuccuuagggauggcauccuagugugacucgaaggaacucaagacccaagagucuacccacaauacaguugccacaccaacccaaagcugcugaccugaagaugcuguuuacauggaaaaaauaaauaucuaucccauuaugucauuuucugucacuuccagaaauaugaugucuaggccacagccagacgcauccuuguguaauuaccucccauugggugugggaauaugacaugcuuccaaccaauggaauacggcaaaggugacaagauauauacgacuauguguaugugauuacacuacguaagacgguaacaucuguuuugcugagaaacacucucccuugcuggcucugaagaagcaggcugccauguugugagcugcuuauggagauagccauguggcaaggaacugagggcagccucccaccagcaacaaacuaaggucuuuaaucugacagccugcaaagaacugaacucugccaacaaccacaucaguuuaaaaggaaaugcuucccagucaagugccauauuagacccuagcuccagcugacaccuuggacuacggcaaugcagaggacccgacaaagucacacuuggacuccugaccuacagaaaguguaauauaauaagugugcauuguuuuaagccacuaaguuugugagaauuuguuacauagcaauagauaacuaauacaaugaccaaaaacauuuauuucagaaauguaaggaugauucacuacuagauaauauauaaauaaauucaucaaccuauggaagauaucauauuuagugguaaaauauuagaaucauucccuuuaaagacaggaaaaggauaaggaugucuacuaguauuucaauaaacacuguauuaaaggugcuagacauugcaauaagaaagagaaauggaggauaaagauugaaaagaaacaaaauuauuuuuauauuaaaugauacgauuaucuacaaauaacauccaagaaaaaauguaaacuauuagaacuaauaagacaucagcaaguuuguuggcuauaaagucauauaccagcaacaaacaauuauaaaauaaaaacuugaaaauuaaccucuuuacaauaacaaauacuaugagguaauuaggcauaacaaaagagauugauucacuaccuauauggaaaaaauuaugauguuuuauuaaaagaugugagaccaucuaacuggaaagacauaucauguucaugaacagaaacacauuuuauaaauauguuaauucucauaaauuaaucuauacauuuacugcauucuagcuuaaauauccaguguuuuguugagccucacagaguaugccuaaaauccauauggaagaguaaagcgccaaaaauauccaaggcaauuuuuaaauuaauaaauaauagauguacauauuuuggggauacguguaauaaauuuuuaauaaauuuaauuuccgggacacacguacaggacaugcaaguuuguuacauguaaacaugugccauggugguuugcugcaccuaucagcccaucaccuagguauuaagcccugcaugcauuaacuauuuauccugaugcucucccaccucuugccccccagccaaccaccccaacagguuccaguguauguuguuccucuuccuguguccauguguucucauuguucagcucccacuuauaagugauaauaugugguguuugguuuucuguuuuugcauuaguuugcugaggauaauggcuucgagcuccauucauguccugcaaaggacaugaucuuguuccuuuuuacagcugcauauguaccacauuuucuuuauccagucuaucacugaugggcauuuggguugauuccaugucuuugcuauugugaauagugcuguaaugaacauaggcaugcaugggauacaugugcuauuuauuacauucauauaauuuguaaauaucaaaucaguauaauugggauaucuaucaccuuaaauauucaucuuuuuuuuuuuuuugagacagaguuucacucuuguugcccaggcuggaguguaauggcgugaucucggcucaccacaaccucugccucccagguucaacaaauucugccucagccucccaaguagcugggauuacaggcaugcaccaccacgccuggcuaauuuuguuuuaguagagacaggguuucuccauguuggucaggcuggucucaaacucccgaccucaggugauccgcccaccuuggccucccaaagugcugggauuacaggcaugagccaccacgccccaccuugucuuuucuuuaugcuagaaauauucaaauuacauuccaguuauuuugaaauauauuauacaacagauuauuguaaacuauagucacccuacugaucuagcaaacaauggugcuacugcuucuaucaaacuguauauuuguaacuauuaaccaaccucucuucaucuccucuuuccccuacuuuuccuagucucugguuaccaccaaucuacucuuuaucuuuaugagauccacauuuuuaucuacuauauauaagugagaacaugugauauuugucuuucuguacuuggcuuauuucacuuaacauaaugaccuccaauucccuccauguugcugcauauuaaaggauuucuuuuauuguguauaugugccacauuuucuuuauccauuaauccacugaugggcauuuugguugauuccauauuucagauauugugaauagugcugcaauaaacaugaauauguggugauuucuuugauauauugauuuccuuucuuuuggacauacacccagcagaauugcuggauuauaugguagugcuaauuuuaguuuuuugaggaaacuucauacaguuuuccaaaguggcuguacuaauuugcauuccuaccaacaauguaccccuuucaccacauccucaccagcauccauuauucccugucucuuugauaaaagccauuuaaacuggagugagaugauaucccauugugauuuuaauuugcauuuaucugaugacuagugaagcugagcaucuuuucauauaccuguuggccauguguaugucuucuuuugaaaaaugucuguucagaucuuucgcccauuuuuaaucagauuuuuuuuugcuauugaguuguuugagccccuuauauuuucuguuuauuaauccuuugucagauggauaguuugcaaauuauuuuauuccauucuguggguugucucuccacuuuguugguuguuuucuuugcugugcagauuuuuuuuuuuuuuuuuuuuuuuuugagacagagucucacucugucgccaggcuggagugcaguggugcaaucucggcuuacugcaaucuccaccuccuggguucaagcaauucuucugucucagccuccugaguagcugggacuacaggugcgagccaccacgcccagcuaauuuuuauguuuuuaguagagaugggguuucaccauguuggccaggauggucucggucucuugaccuugugauccgccugccucgaccucccaaagugcugggauuacaggugugagccaccaugcccagccugugcagauuuuuagcuugauguaaucucuuuugucuauuuuugcuuugguugccugugcuuuugaggucuuacacacaaaaaaaucuuugcccagaacaauguccuggagccuuucuccaaucuuuucuuuugagacaguaucuugcucugucaccacagcuggagugcagcagcacgaucacagcucacuauaaccuugaauuccagggcucaagcaauccuccugccucaccuuccugaguggcugagacuacaggaaugcaacacugugcccagcuaguuuuauuuuuuauagagaaggggucucacuguguugcccaggcuggucucaaaccccuggccucaagcgauccuccugucuugggcuccccaaaugcuggaauuacagguaugagccaccacaccugguuuccaauguuuauucuaguaguuucauaauuucaggucuuagacuuaagucuguaauccauuuugauuugauuuuuuuguauauagugagagauagagguccaguuucauucuucugcguaugguuauccgguuuucccagcaccauuuauugaagagacuguccuuugcccauuggauguucuuggugccuuuguuaaaaauggguuggccguaaauguguggauuuacaccuggguucuggguucuguuccauuggucuuugugucuggguuguuuuguugguuuguuuguuuuguuuuuuaccaaugccaugcugauuuggucacuacagcuuugcagguguuuguuuugagacagagugcucuguagccuaggcuggagugcaguggcgcaaucuuggcaaacugcaaccuccaccuccagguucaagcaauucuuccaccucagccucccgaauagcugggacuacaggcgugugccacuaugccuggcuaauuuuuguauuuuuagcagagaugggguuucaccacguuggucagacuggucuugaacuccugaccucaagugauccaccugccuuggccucccaaacugcugggauuacaggcauaagccacugugcccagccaacuuuguacuauauuuugaggugagguagugugaugcuuccagcuuuguucuuucugcugaggauugcuuuggcuaucuggggucuuuuguaguuccauguaaauuuuagaaucgucucuuuuauuucucugaagaauugcacugguauuuugauagggauugcauugaaucuguaaauugcuuuggguaguauuaucauuuuaacaauauuaauuaguccuauccaugagcacggaaacuuuccauuuuuguguguccuguauuaaacucuuuaugcugcuauaaagaaacaucugagacuggguaauuuuuacuuauuuaucuaucuauuuauuuugaggcagggucucacucuguuacucaggcuggagugugguggugugaucacagcucacugaggcuucaaccuccccaggcuccagugauccuccugaguagcugcgaccacaggcgcgcaccaccacacuuggcaaauuuuuauauuuuuuguagagaugggguuuugccauguugcccacacuggucucgaacucucagguucaagucaucugccugcaucagccucccaaagugcugggauaauaagcgugagccacugugcucagcugaggcuggguaauucauaaagaaaagagguuuuauuuuggcucaugguacuccaagauauacagaaagcauggugucggcaucugauucugguaagggccucaggaaguuuauaaucaugauauaaggcaaagcaggaacaagugucucacauggugacagugggagaagggagcagucccagacuuuuaaccaaccagaucucaugugaacuaacugaggaagaacucacuuaucaccaaggaaguggugcuaaaccauucacaagggauuugcccccugugauccaauuacucucccaccaggcccuaccucuaacacugggaauuaucuuucuuuuuguuuuucccucaugaauaaaguaggaugcagaggauuaucuuuccuuuuuuuuuuuuuuuuuuuuuuugagacaguuuuguucuugucauccaggcuggagugcaauggcacaaucucagcucacugcaaccucugccucccagguucaagugauucuccugccucagccuucggaguagcugggauuacaggugcccgccaccacgcccagcuaauuuuuguauuuuuaguggaaaugggguuucacuauguuggccaggcuggucucaaacuccuggccucaggugaaaugcccaccuuggccucccaaagugcugggaauacaggugugagccaccaugcccggccgaggauuaucuuucaacaugagauuuggaggggacaaauauccacacuauaucauguccaauucaauuuuuuccaucaguguuuuauaguuuuccuuuuauagaucuuucauuucuuuuguuaaauugauuccuagguauucuucauagcugcuguaaauggaagugcuuucuucuuuuccagauuguucacuguuggcauauagaaaugcuauuggcuggaaacgauggccaagccuguaaucucaaagcuuugggaggccaagguaaacucuuggccucaagcaauccucaaggaguucaagaccauccugggcaacauagugagacccuaucuguguaaaaaaaaugaaaauauuagccaggcaugguagaguacaccugcaguccuagcuacugagguggaggcaggaggauuguuucagcccugagguuauauagggagcuaugacugcgccauuauacuccaguaugggcaacagagacccugucucuaaaaauaauaauaaagaauaaaugcuacugguuuuuguauguugauuuuauauacugccauuuuacugaaaucguuuaucaguucuaacaguuuuuuuuguggagucuuuagguuuuucuaaguagaagaucuguuguuuggaaggcuaaggugggaagauugcuugagcccagcaggucaaggcugcagugcaccaugauugcaccacagcacuccagccugggugacagaguaagucucagaaaaagaaaaaaguucacuuugucuaaacuguuucuuccuuuccaauuuggauggccuuuauguuucucucuugccuaauugcucuggccagaacuuccaguauucuguugaauaaaagugauguaaauaggcaucuuugucuucuuccugaucuugcaggaaaaguuuuccauuuuucccuguucaguacaauguuagcuaugggucugucauauauggccuuuauuauuaugagguauguuccuucuauauccaguuuguugaggguguuuaucauaaagggauguuaaauuucauugacuguuuuuucagcauccauugaaaugauuacaugguuuuuguucuugauucugguaaugugacauaucacauuuauugauuugcauauguugaaccauccuuguaucccugacccaaggcaauuuuaaacaugaauaaggaugaagguuuuguucuacuugaugucaaaacuuauauaaagcuacaguaauuaaaauaauaugagauuggugcaaggauagaaaaagagaccaauggaucagaauacaaaccaauacaaauaagagaauucaguauauaguagaggaacaauuauacuucacuggggaaaagauagacucuuuaguacauaaugccagaacaacuaguuggccacaugauaaaaacuaaaauuaaaucuauaucucacagcauacauaaaaauaaauauuaaaauaaaaacccgucaaaacuuuauacucucagaagauaauauaggcaaauaucucuauaccucaaggaaagauuucuuaaaacacacagagaauaaacuucaagaaaaagauggauaauucugacuuucuaaaaauacuuuaaaaugucuguaacaaaagcaacauaagcaaugugaaaugacccgcuacacacaagaauauauuugcuaugcauauaauugacaaaagacaguauccagacuauauauaauucaugaaaauacauaugaaauauauaauuacccagauuauauauauaauauauaaaugccaacuaaaacauaaacaaaagacucuaugggaaaaaauagggaaaagauauuaagaggcaauuaaaaaagauggcuguauugaaaacacacaaaaaccuacauaauccaaaccaaaaaaucucagagcaaucuguauaguauaauuccaauugucuguguguguggggggggaaacuacucaauuuauauaguagucaggaaagaguaaauucaaaagaagaaugagauacuauaccauacccaucaaauuggcaaaaaauagaaacucuaauacaaaacauugacaaggauauggagaaauaggaaccaucaaacacaguaugaguuuuuugaaacauagugguuuauuuccacuagcaaccacuuuggaaaacaauuuggcauuaucuagugguacugaaaaugugcauauaaccuagcaauucuacuuuaaggcauauauccuagggacauacuugcauauguacccaaggagucaugcacaaggauacucauugcaacauuguguauaacagcaaaauaacuggcaucaaucuaaauguuccuuaacaaagguuuucaaauagugggaugcuaaacuaagcuguacacggagcuacauguaacaacauagaaaacuacuaaaacacuaucuguguguguaugugguaggggggauacaaugaagacagauauauaugacaaacuauaaagaacagauacugccaggcgggcacaguggcucaugccuguaaucccagcacugugggaggccaaggcggguggagcaagaggucaggaguuugagaccagccugaccaacauagugaaaccccgucucuacuaaaaauacaaaaauuagcugggcgugguggcgggcgccuauagucccagcuacucaggaggcugaggcaggagaauggugugaacccgggaggcagagguugccgugagccaagucgcgccacugcacuccagccugggugacaaagugagacuccgucuaaaaaaaaaaaagaauagauacaauaggccaggagugauggcucacggcuguaauccuaggacuuuaauaggcuaaggcaggccuaucacuugagcucaggaguucgagaccagccugggcaacauggugaaacccugucucuacaaaaaauauaaaaauuacccaggugugguggcacucaccuguagucccagcuaccugggggacuggggcaagaggauugcuugaacccaggaggucgggcugcagugaaccaagaucaugccacugcauuccagccuggguaacaaaagugagaaccugucucaaaaaaaaaaaaaauagauaugauacacaccaaauucagaacagugguuaccuccgggggugaacaaagggaaauacaaaggauuaugaaagggucaucaacuauaucuaauaucuuauuucuuuaaaaaaucugaagcaaauauagcaaauuuuaguuuauuaaaucuggguagugagcguaagauuuucugaacuccucuuugaaauauuucauauuuuugaaauaauacaaaaauaaauaaauacucauugcagaaaaggcuuuacuaaguaucucauaaaaaaauagaaaccaugaaauaagcauccauuuucucuaaauaaacauuuuaaacuuccauauagaaauguaucauaaauaaggaugaaagagaaauacaaauuuggggaaauauuugcaaaacagaagauuaaucccugaaacauaaagagcuguauuguuuucaacaauguccuagggcacaaauugcuccacaaaugaaucaaaucaacuuugcccccuuugaaggaauaguugcugagguuacuguuugauauuucuucugauccuaggagggcuccuuccaacuggcuuacuccccgguucccuccugagaacuagcccacguauaguuugauucugaugcuauauccaugaaucucucccaguuucauuucaccacaaccuccacaguucuucaaaguguccuuagguuugaacuucugcaugcucuguugcaaaugcagucaguuccuucgggaagagauuaagagcuaucuguuuuauggccuaacucaggccaaaccucugaguuaggacccuggagcuagagguggaaacaauaacaagguucugagugcucagugaguugggggacagcagcccaaggcccuucgucacauggaaccaccaucucaggagcuggggaaaggcaauuaggacucuaguauucucugugugccacagccaagauccaagauagagcuuccauucuacaagcaggagaugagcugaagaagggacucucccaccccccaacucccaaacucucaaaugcaguugccugggacuuggccuuagcaacagguagcaaggggcaggagagaaguguuaacagucugcuccuucugggaagcaagcccuuggacuugggggaaagggagcucugggugcuuggcugcagcaguuuggaauggcgucuccacuucaccaagcuggaagcaggcagugagggagacgucuuaugugagauaacacagacucccaccuuucacaccaaauuucacagauuuccuugagcagauguuucuuuauuuacucuuugcccuugggacuauucccaaagacuaauuuuuaaauaacguacacaaguuuuacuaggagugggucaacaaagcuccucacacugucaagacagaagaugaugucuccuguaucauuuaaauauuuuaugaugagcauauauauuaucugcaaaaccaaggaggacauuaaaaauaaaaacagagaaagagagagaaacugaaagcugguaggagguaagaaaguaagaacuuccagaacaguaagagaagcccaugcuggcugguggccuccuugccagucucuguaguuccauucuucucuuugcuucaauaaaugaauuauacucuuucuaauaaccucagcccgugaacaggaccuuaaugagaaaacaggcacaccugaaauaacuccaacuuugggaagcacaguggauuuuuccuugaauccagaugucuaacgggaggugaguggaacaccaagagaggaauguuguaggcaauggaaccacaguggaaacagcuguggagaacugaugaaaauuauaucaaacagagccuagugucaggccaagcaacuaggcuaagaauaccaaaagcacugucuucccucuuuccccacuccugguacuuugcagcuaaucugucuucauuauuauucgccugcuuuaauuuuuaauuauuaguuuuugagauagggucuuguuauguuucccaggcuggucuugaauuccuggccucaagugauccuuccaccucagccucccaaagugcugagauuacaggugugagccacuguaccuggccucuguuuuuauaacccagucuuucugugguuucacuguuaccagaaauggauuucuccugaaucacugugcaugggauucaguggauuuccugaaucagaauucauguauuuuaucaauuuaaagagguuuggaaaaguaucagccaaaccucuuuaaauagagguuuauucucuuuauucuucugaaacucaugugagaccuuuauauucaaaucuucacaucucuuaaccucuuuuuucauuuuucugucuaugcugcacuuuagguaauuucuuccauucuauacucuaguuuacuuaauuacucuucagcugugucuaaccagcuauuuaccuugucuacugaauuccuaacugcaauuagauuuucaacuucaagaaguucuauuugugaaucaaccuaacuguccauuaaugaaugaauggauaaagaaaaugugauguacacacacaauggaguauuauucagccagaaaaaaauaaagaaaaacugccauuugugacaauacaaaugaaacuagaggacauuauguuaagugacauaagccaggcacagaaagacaaguauugcaucaucuugugcauacguggaaucuaaaaaaauuuaucucauaaaaguagaguagaaugguacuuaccaagggcugggguaaaagauaggaugucgggccagguugcuggggcaggggaguauugagauguuggucaaaggauacgaaauuucagauggacaggaggauuaaguccaagauaucuaucauauagcauggugacuguaguuaauaacaauacauugcauuccugaaaaaugcugaggcagggauguuaagugcucucaccacaaaaaugauaacuuaugugagcaagauuagucauuccagaauguauauauauuuugaaauaucauguuuuacaaaauaaauacauauaauuuuaucugccaaguaaaaaaaaauuuuuuuuaauuuaaaagaaguucuaguugugucauuuucuaaucuguccauugucacuuuugauagccuauuguuuuuuugcccauacuuuugauaaaaucuuauuuaagcguauuauuuuauauucuguuuucugugaauuuuacuaccuauaauuuuuuaaauuuuuauuuauuuauuuauuuauuuuuucuuccuuuuuuuuuuauuauacuuuaaguuuuaggguacaugugcacauugugcagguuaguuacauauguauacaugugccaugcuggugcgcugcgcccacuaacucaucaucuagcauuagguauaucucccaaugcuaucccuccccccuccccccaccccaccacaguccccagagugugauauuccccuuccuguguccaugugaucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacguaugcaugugucuuuauagcagcaugauuuauagucauuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauagugguuuugauuugcauuucucugauggccagugaugaugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuuggcuuuuguugccauugcuuuugguguuuuggacaugaaguccuugcccacgccuauguccugaaugguaaugccuagguuuucuucuaggguuuuuaugguuuuaggucuaacguuuaaaucuuuuuuuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagacaguuguagguaugcggcguuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggugaugcaggcucuuuuuugguuccauaugaacuuuaaaguaguuuuuuccaauucugugaagaaagucauugguagcuugauggggauggcauugaaucuguaaauuaccuugggcaguauggccauuuucaugauauugauucuuccuacccaugagcauggaauguucuuccauuuguuuguauccucuuuuauuucauugagcaguguuuuguaguucuccuugaagagguccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcugaucagcuuaaggagauuuugggcugagacaaugggguuuucuagauauacaaucaugucgucugcaaacagggacaauuugacuuccucuuuuccuaauugaauauccuuuauuuccuuuuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugguuugcguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuuuguugugucucugccaggcuuugguaucaggaugaugcuggccucauaaaaugaguuagggaggauucccucuuuuucuauugauuggaauaguuucagaaggaaugguaccaguuccucccuguaccucugguagaauucagcugugaauccaucugguccuggacucuuuuugguugguaagcuauugauuauugccacaauuucagcuccuguuauuggucuauuaagagauucaacuucuuccugguuuagucuugggagaguguaugugucgaggaauuuauccauuucuucuagauuuucuaauuuauuugcguagagguguuuguaguauucucugaugguaguuuguauuucugugggauugguggugauauccccuuuaucauuuuuuauugugucuauuugauucuucucucuuuuuuucuuuauuagucuugcuagcggucuaucaauuuuguugauccuuucaaaaaaccagcuccuggauucauugauuuuuugaaggguuuuuugugucucuauuuccuucaguucugcucugaauuuaguuauuucuugccuucugcuagcuuuugaauguguuugcucuugcuuuucuaguucuuuuaauugugguguuagggugucaauuuuggaucuuuccugcuuucucuugugggcauuuagugcuauaaauuucccucuacacacugcuuugaaugcgucccagagauucugguauguugugucuuuguucucauugguuucaaagaacaucuuuauuucugccuucauuucguuauguacccaguagucauucaggagcagguuguucagcuuccauguaguugagcggcuuugagugagauucuuaauccugaguucuaguuugauugcacuguggucugagagauaguuuguuauaacuucuguucuuuuacauuugcugaggagugcuuuacuuccaaguauguggucaauuuuggaauaggugugguguggugcugaaaaaaauguauauucuguugauuugggguggagaguucuguagaugucuauuagguccguuuggugcagagcugaguucaauuccuggguauccuuguugacuuucugucucguugaucugucuaauguugacagugggguguuaaagucucccauuauuauugugugggagucuaagucucuuuguaggucacucaggacuugcguuaugaaucugggugcuccuguauugggugcauauauauuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuaugugugucucugcacgugagauggguuuccugaacacagcacacugaugggucuugacucuuuauccaauuugccagucugugucuuuuaauuggagaauuuaguccauuuacauuuaaaguuaauauuguuaugugugaauuugauccugucauuaugauguuagcuggugauuuugcucguuaguugaugcaguuucuuccuagucucgauggucuuuacauuuuggcaugauuuugcagcggcugguacugguuguuccuuuccauguuuagcgcuuccuucaggagcucuuuuaggggaggucugguggugacaaaaucucucagcauuugcuugucuguaaaguauuuuauuucuccuucacuuaugaagcuuagcuuggcuggauaugaaauucuggguugaaaauucuuuucuuuaagaauguugaauauuggcccccacucucuucuggcuuguaggguuucugccgagagauccgcuguuagucugaugggcuucccuuugaggguaacccgaccuuucucucuggcugcccuuaacauuuuuuccuucauuucaacuuuggugaaucugacaauuaugugucuuggaguugcucuucuugaggagcaucuuuguggcguucucuguauuuccugaaucugaauauuggccugccuugcuagauuggggaaguucuccuggauaauauccugcagaguguuuuccaacuugguuccauucuccccaucacuuucagguacaccaaucagacguagauuuggucuuuucacauagucccauauuucuuggaggcuuugcucauuucuuuuuauucuuuuuucucuaaacuucccuucucgcuucauuucauucauuucaucuuccauuacugauacccuuucuuccaguugaucgcaucggcuccugaggcuucugcauucuucacguaguucucgagccuugguuuucagcuccaucagcuccuuuaagcacuucucuguauugguuauucuaguuauacauucuucuaauuuuuuuucaaaguuuucaacuucuuugccuuugguuugaauguccucccauagcucagaguaauuugaucgucugaagccuucuucucucagcucgucaaagucauucuccauccagcuuuguuccguugcuggugaggagcugcauuccuuuggaggaggagaggcgcucugauuuuuagagcuuccaguuuuucuguucuguuuuuuccccaucuuugugguuuuaucuacuuuuggucuuugaugauggugauguacagauggguuuuugguguggauguccuuucuguuuguuaguuuuccuucuaacagacaggacccucagcugcaggucuguuggaauacccugccgugugaugugucagugugccccugcuggggggugccucccaguuaggcugcucgggggucaggggucagggacccacuugaagaggcagucugccgguucucagaucuccagcugcgugcugggagaaccacugcucccuucaaagcugucagacagggacauuuaagucugcagagguuacugcugucuuuuuguuugucugugcccugcccccagagguggagccuacagaggcaggcaggccuccuugagcuguggugggcuccacccaguucgagcuucccggcugcuuuguuuaccuaagcaagccugggcaauggcgggcgccccucccccagccucgcugccgccuugcaguuugaucucagacugcugugcuagcaaucagcgagauuccguggguguaggacccucugagccaggugugggauauagucucguggugcgccguuuuuuaagccggucugaaaagcgcaauauucgggugggagugacccgauuuuccaggugcguccgucaccccuuucuuugacucggaaagggaacucccugaccccuugcgcuucccaggugaggcaaugccucgcccugcuucggcucccgcaccgugcgcgcacccacuggccugcgcccacugucuggcacucccuagugagaugaacccgguaccucagauggaaaugcagaaaucacccaucuucugcgucggucacgcugggagcuguagaccggagcuguuccuauucggccaucuuggcuccuccaauuuuuauuuauuuuaaaaaauuauuaauagagacagguucucgcuuuguugcccaggcuggucucaagcuccuggcuucaagugauccuccugccucagccucccaaagugcugugauuacaagugugagccacugcaccccaucuagcuauaguuuuaaaaguuugauuaucuguuucugcugucuuucacucauagugccuuauuuuuuaugugcuuugugauguuuugguugugagcucaugaucauaggaagauuuuuguuuguggggaugcucugaggccuggaugugaguuccuccaaagaggauuuguuucugcaucuaccaguaacccagaaauucugccaauuucaaacuacguuuuaaaaaaaaccuuuucccauggaaauuuucauguauauacuaaaauacagagaaugguauaauaauccccauggacucuucacucagcuuucaaaauuaugaagucauagcuagcacuauuuuaucuauaccccgacucagccaccuacccaccuccucagaucucaaaauaaagcauaauggagacauccuaucuuugguuuuuguuguuguuuucugagauggagucucgcucuguugcccaggcuacagugcaguggcaugaucauggcucacugcagccucaacuuccauucucaggcaauccucccaccucagccuucugaguagcugggaccacagaaacauaccaccagacccagcuaaauuaaaauauuucuuuguagagacggggucuccuuauguugcccaggcuggucuugaacuccugggcucaagcaauccuuucacuuuggccucccaaagugcuuugauuaucuaugaccaugcuacccugaaugugccugaucucaucugaucuuggaagcuaagcaagguugggcccgguuaguacuuggaugggagaccaaagugcuggcauuacaggcacgagccacugugccuggcccgacauccuaucuuuuacccauaaauuuuucagcauacuucuucucuaaaaaggcucuuuuuuacaaaaacaaaacaauaccauuuucacaccaaaaauuuaauauuauccuucauauuaucaaauaucaaguaauuguuuaaauguucccaauuaugucaugauuuuuucuuuuuucuuuuuuugcagauugcugauuuggucaagauguaaacauaucguagagcuccagcaugggggcucacgccuguaauacaaacacuuuggaaggccaaggugggagaaucacucaagcccaggaguuuaagaucaaccugggcaacaaaguaagacccugucucuacaaaacaauaaaaaguaaaaacuagccaggcauggagcauaugccuguggucucagcuagacaggaggcugaggcaggagacugagucugcaguaagccguguuugcaccacugcacucuaggcuugggugauacagcaagaucugucucaaaaaauaaaacaaaaaguacauacauuguaacuauaauuggcugauauucaucuuaaauaucuuuuaauuuaugggcuucaucccaucucuuuauuuuuuucucuuguaucuuauuuugugaaaaagccaguaauuugccugcucuacgguuuuccacagucuggucuuugcugauugcaagucuauuauaucauugaaccuaucaccuguccccaauauuucccuuaaauuggacaucagaucuagaaguauguucaaauucagauuagauuuucuaucaagagugcuuccuaugugguguuacacuguuuucagaaggcaugucagacucaguuuccuuaggaaacagacugaagaucugcaggcauuuuucucccuuccacucaaagccaauuugccuuaauaauuccuuuuuaguggaagauuuucauuuuucuaauuauuucauggccccuaagcuuugucucuuguccccuaaauuaugauuccuguugaaaccaagagcucacagucacuagggaauagcaaauguucccaggucagcugucagguucaguguuuuguaucucuuaggauuugagcuuuccauuauauuugcuuuagaauuucucucacuuucuuacagggcuaccacauaaagaauaugacauuauuaaauuccccugcaguuacacagagcaguggcucuacaguuucuuguuggcugaauuaagcauuuaaagaaauguuuaaguauuuaauacaacaucuucagguauuugaacuaagagaguuucuugggaaaugugcuauuugauagauugagaagucucccagugcuguuuugcuuuguuucaucacucacuauuuaaauguuaauuacaaaaauaauacauacucacuggaagaaaaaucaaacaaacucaaagcacagaaaaauuuuaaagccuccuugcucuugguggcuuucuuucucccaccaauuuuuggugacuucaauuuuuguguuagaccauuuauguucaaagcauccacaugaaacuuacccucuauaaggugcugugagcaccacagacuugaauaccaguucccaugcucaagaagccuucaaucuuguugaggagauagaugaaagaacuggcuuacaacagagaaguagauguauuaaagagucaguuuucccagcacucugggaggcugaggcagguggaucaccugaggucuggaguucgagaccagccugaccaacauggagaaaccccaucucuacuaaaaauacaaaauuagccgggcaugguggcacacaccuguaaucccagcuacucgggaggcugaggcaggaaaauuacuugaacccaggaagcagaaguuacagugagccaagaucgcgucuuugcaccccagccugggcaacaagagugaaacuucgucucaaaaaaaaaaaaaaaagagucaguuuaggaguccaacaacaaaugcuaauaaagaugaugauaaaacaaagaacuuugugugcugagaguuauguaaggaagaaauuaagaaggggauaguagugaaaaaaucugaagacagccacauagaggauguggagaaggcagagguacaucacaaagacaaauucaagcgaaaugcugaagggacaaguuuauuaagcaaaguggugccucccuccccagaaugaaggcuuaguuucugcaguacucaggauagcuggucagagucagaggucauuuuccauucgucauuauuugccauuugaaaaaaguaaucagacuuugaauguagcuuaagagagcuaugacuauccaauuuccuaggccaaucucgguuaauaugcuaaucaguuuaucagaugcaaaaggcuugagcaccucuccugucacuauaagaguguggaaaaaugagcuacuagagacaagaggucagacaaguccuaggggucacauuugaacuuuuauucaaacacuggcaucuccagugugugaccucaucccaaucuccaaccuucuauuuucugggccuucagccaguggggcuauacacucauuuccauggccuuagauuuuaaagggucaaggugcgguaucugaaucauccaugauuacaucauuaauaauaaaaacagcaccguccacucagccuccaacguucucugaaaaacaauucauguccaagguaucaauuuauuccuuuguuuuucauguauucauucaauaauuauuuccugagcacccacccaauacuagguccuaugcuauauauuagagagacagcagaauaaagauagaaaagagaucuuauccccuaaguacuaucuaauaagggagauuaacaguaaacagguaaccaaccaaauauauaacugcaaauugagaugaaugcuaugaagaucaacaggauuuuuuuuucauuuaaaagaucugagagggauuuuggaaauauccagaugaauucauaucaauaugaauauaugcucaguugcaaguaauggaaucaugauuaacauugaucuuaaaaaacaaagacauuucauuaccucucauaagaaaaaucuggaaguagaugguuccaaaaucacgaaaguggcuaaacuacaucauaaauaacccaguuuccuccuccugucuuucgccucuauuauccuccucagcauguuggcuuuuuguucuugugcuucucaccucacugguccaagauagcugcugcagcuccaagacagcugcagucaaggcaggaagaaguggguagggucuccuuacuauguuauuauaagaacaaaauccuucccagaggcuuccaagcaaacaucucuuuaugucucauuggucagaacugggccacauggccaucucuaaacuaauacacauccauagagaaugggauuuccauguuugcuuuagaccauucauagcgcauuuccuagaacuggggaagggaaucuucugccuaaacauguugcugcccucacauuaucgagguuccuuaguagaugaaaaagggggaggccaggcacagugaugcauaccuguaaucccagccacucagaaagcuggggcaagaagacugcuugagcccaggaguucaagcuguaguaugcuaugaucacaccugugaagagccccugcacuccagccugggcaacacagugagacccugucucuaaaaaaaaaccuuaaaaaccagaaaaauggggaaugauugucuaguagacaacaauaguagaaauuaaaauccacaggacuuguucacuaaguuaaugagaaagugaagaaggaaguagacucaaauaucacucaaaaguuucaagcuuggagaacuacaauagucacaaugccaagaacagauaaaaagagaaugugggaggaaaaaucuaguuugugaaacaauaaugaguuccacuuucuugaguuugaggugcgaugagacagugugguagaaacguagaagaccacaggagaaaggcuggacuuaaauguagacacuagagucauccacagugagguuggauucgaaaccacaggaauagauaguaccauuaugggagaaaaugaaaagagagaaggaggacaaggcuggaggaaucuuugugaauagcuacaauuauuaacagaagauaguaagaugaugauguugccaaaaaaggaaaaggggagugagugauuaauuacaaucauccccaaaccaagggacuauaaugacauggcagccaagagguaaaguucccuaaggaaaguggcagccaacaguuugacugccacaaagaugccaaugaugacaaaguacucuugaaaaauuucagggauaguacucuugaaaaauuucagggacagaaaccagauuguaggaauaguaguuucaaguacauuaauuuaaugcccaugugcacucauuuguauuccuuucugucuacucuuuuuuuuuuccccccugacagggccucacucugucaccuaggcuggagugcaauggugugaucauggcucacugcagccuugacuuuccaaguucaagcaauccucccacuucagccucucgaguagcauagcugggaccacaggcacaugcuaccaugcccagcuaauuuuuguauuuuuuguagagacaggguuucaccauguugcccagguuggucuugaacccuggcucaagcaauccaccugccguggccucccaaagugcuggaauuaugggcguaagccauugcacccagguucaaagaguuaaaauuaauugguaaacccucagcaggaagagcacaacuaaggaaauuaagagagccaacaaagcaugaggugagaggggacaagguugggggagggggauacguucauuuuauaaagggauauauauaacccaaaaucugccaaggagguuccaaggaugaugccaaggauaaagggggaagaacagaaaccuguucuggggauccauuguaaaaguacauaaucucaccaugacuaauggcacauguacauccuuuuuuguacuagguucaguuccaugacauccugcaaacuguggaaaguucaaaaguacugcaaacaugaaugcuuauaagcccauguaauugcauaguaauucauacaugugcagaugagaacauggguuauuaaagaaggauacaggacuccaaaggugacugaggcaggggcaugagaacagcaaagucaguguuacauggggcaggcauacuaguuacuugauaguuuaacuccugacgguuacgagguaaaggagauauauagggagcuaagaggaaaacaaaagcaggcggcuaguuugcuaagaaccaaaaccagauuacagaaggcugccuggccucugaaauucacaaagccuuuucgagacuccccuuauacagaaacacaaaugacuugucuggaacuccagagacuccugguaggucagacugcagacagacacacacaagugccauuaugagauuaaaucaggucacagaaaggccaaugaaaguauuuacuugaagaaggagaaagcagguuugagauaaaagaaaaaccauuaaaagacgaagcugcuaaaagcaucagcaccccuaccccugcauaucuuuuuauguaagagcuugaccugccuuauaugugggcaaaaacaggaaaaugaacgugugugacccauauauaagugugaauaguauuuaaauaaacuuuauuucaguggucauguaacauuuaguagucaugucaauuacauuuacauguacucucucuucucgaucuuggaauaauugcuucauguuuaacaccaggaaauagaucucuucauccacacaaauguauaucaaaaccuuauuaagcaauuaacccaagcaggcaaauaaaugcccucaaugaagcagcaggauuagcaacaagagaccggacaugguggcucaugccuauaagcccagcacuuugggaagccaacauggacagauugcuugaguccgggagacuggccuggacaacauggugaaaccuugccucuacaaaaauuauaaaaauuagccagauguggugccgcguaccuguagucccagcuacagagauggcugagguggaaggaucaccugagcccaggaggcagagguugcagugagccaagaucgggccacuguacuccagccugagugaaaagaaugagacccugacucaaaaaaaaaaaaaaaaaaaaggguagcaccaagagauacaugguagaauauaagcgacuuaacagaagagaaaaugaggaagauaaagguuuuuauugcagaaagaaaagaaauaagaauuacuauagcagaaacucauaguauaaaggacacauccugaugagggggaugauauugauaccaucuugucacugacaggugcuuuacaaccguuuucacaggucauuguauauuauuugauacucacucaauuuuaugaaaugcagagaacaccuauuauuguucccuguuaacguaagaaaaaggugaggcuuagaaagguuguccaugggcacacagauaggaaauaguagaaacuaaacuugaaacuagauugacuguagguccaguggucugccuaauccuccuaaauacccaaacaucuggacugacugagcaguauucaugcccaucagcagaaaacuagaaagaauaucuucuagauacuauccccagugcuaggacuccaugauuccagagugcucacuaucaucugaacacccucuugauaaagagcaagcucaucccaucacuguguuguguauuugugcacauguguggcagguguauacacaccuguauacuagaagcgguuacagaggugcagagccaauacuuaagacaugaagaguaaaugaugaauaucagacuagaguacugaaaccuaccucuccauguagaaauauccuuaccuugcaucaaguuccucuuugcagaaaacauugacauuuccaugguguuugggagccugcuguuggcuuccaaaagcucuggcgccauaccaugcugucacgguaacagcccuccagugagccaucaaaaaccuagcuagaacauuuugaauacagcaguuugcuugccaccaaaacacuaaauugcaauauuuuauauuuaucucuauuuaaauuuuaguugaugcugcauaaauguuaacauggucuuaagcuaauacaaucacagaaaagucuuaauaacaccacacauuggcacagccccugggugaguuacgggucugcaaagcaggcccaacgcauguuucucaagucacuuaauuaguccccuuuaacuaggaugugacaugaaaaugcuacacaguuucccccaaguaauguauuuccagaagcaacggcaagggacguauaggauaauuuguucauauuaaagguagaauaaaaguacucgggaguaaggcaaagauuuccaaaaagggucuggagagagguuaauaauguuggauuuaguucuuuucuggccugagaaguaaaaagugagcuuuaguaaguucucaagccucuaaagccuuauaaggcuaagacccuggauuuccuggacuuccucaugacugaaaccgcagauacuaacgucaaacaugcagauuuuccaucuuuccaguggcugcacaggaggagauuucccugggcuuccugggagacuuugguucugggaggugagaccaagggagguggaguugcccuugaggccagagccuugacugucaacaccaccaacacagggagccagggcuugaagauccaggcagaguggugauaacggaaacaaaggccggcagugccucuccucauggaacaacuccuccagcuuucccagcucugcccuucaacuuacuaagaaaauaugcugaaugccuuucagagugagagagcaucagacugagauucugauuuaaaaaacaagcacagauaaagcacaaaggaaaucuucucgaaacaaagccuauaaugguaaauauguucagaauagcuuuucuccuguaacaucgugaccugcaucuaagcaucuaauagccuccacccaugcccuugcagcaagaaucagaauauuuguuccuguuuuaaaggcacaaaugguccuaagagcagauuuucaaaaaugggaggaacaauagcuccaauggaccaauugcagcaugcagauaucuugaccuuugcaggugguguagaaugauguggugccuacauaucuuuuggcaucuacucuuucgagaugcuaccuccccacuccucuugccuuaucagucuuccaucacaagccagacuaacugaaauucucaacaauuuccaaccuagagagggcgauaaucugacggcauguacauugguuccagacaacuagggcaagacacauuccucccugaaagcacccccuuggucaggcucaucauuuauucgucacuagauguagcuuuacugccaaaagaccuacucuuguuuauuccccucccucucuacuauuuauaguuggucuaacuuuuuacaagcuuugaauaaaacagagaaugugaccuaagauguguuauuaaauguccauacacauaagaugggggaacagagagucacagauggugacaacauggguaaaaauuccuaucuacuuggaauaagggcagaaucaaauuuuacucuaguuucauugagaugacacugaaaugucaguagcaacaggcacauucaaguguacccuucuuccaagcagaucaggccaagcaauucuggccauugggacguccauuauacugcucaccuggaaaaggcagcgcccagcacaaacgcagcauacuccuucacgaggggcucugugcuguucagcccauugaucaccacuugaagaccaccaaaggaaagcagguccugcgcauuguccaucugcaacagagccacugcuuaguacagcauagccaucagggacaggaaagcuguucuuagagccuuucuuuuggugacuacccaaaaacaaauuaaaaagccauggaaaaaucaauaauggccuuuuugacuaagaaaagguuuguaaaaaccaauuuuuuaauacucuuaaauuugagaacuccuaauucaucuaacacgauugaugagcaccugcgugggaaucagcagaaaugacaccuagcuauugcuuaugccaaacauguccuggaaaauucuaauaucauaaugagucacaaagcuugcuccuaauguacaagcuguuaacacaaagaaucuggcgucaucagcaccacuaaauggugccaugcuuccugcugauguccaaucccaauggggacaguggaggcagauuuuuaaagcugauuuuaaauuagaagcuagggacuauaaaaggagcccuguuauugggagggggguugccguaagagugcuggggaggggggaauaacaauaguaccuuucucuugcaucucagguugacugcaucugaagacauucaugauaaaauaugcaagaaaaucgcucucccaaagguuucugucuaagccugugcuacuggcuaguggcuauguaucagacagugcagaacauuucuaucauuacauaaaguucuauucaacagcauuggucuaggcuaucauuuaagcuccaaauccccaaguccggauucucucuuuuacucuauagcggaucucauuacccacaguuuauuaguacccuggaacaagacaacucgcuuuccucagaaaggucacuggauccuguuuucuacauguacccgcuacagucucccucgaauauaucuuuguugccacaaaggcugcaucuugcccauaugcuaaucccacgcuaucaaucaugaggaaaacucaggaagcugaagcccaacaacuguggcugcuacccaucuuucuccuccagauuccacagggccccuucccaacugcauccuugccucucugaacuaggagaggacucugacagagaaaucaagugugaggauugguauuugacugugcuaguguuuugugguggccuagccuguuguugccacuugaaaaaucauauucauacacauuuggauggaaucuccaugacagcagggguuuugucugucuguccacgcuuguagcuccagggacuaggauggugcugagcauaugguuagguguucaaugaauaacuguugcauuaaugaguaugaauuugaucagaaaagaauguuccugaaauaaagcuccagugugaauaaaaaggcaaucugggguaucugugccaacaaaaugaaugggccucugguaccgcagacaugaaguaauggcuaaaccagguugugaaguaagcaugaagucugcucugccauguggccccaggccauggacauuuuucugccccaaacuguucuuaugaagaggaauaacugguugagccacagcccagcuaacuagggagacucaggguugggugcuuugcugacauaagcaccuuccuuccuucccuacaugcucuaauuuuacaauguaagaauucacuaccuauucuuugguuguccuuccucuggguuuucuggauacaaaacuauggcucagaauccugucauaccacgccuggaauggccacuuauaaagcugguaugaguuccuagcagagcagcugccacucggucagcuccaaagcaacacagcccagaaucauggaccuucuguucuagagucaguuuaucuacuauuacuacaaugauaauucagcaugauagaaaugcagacauuuauauaagcacuucagccuuuuugggauguuuucucaugguuuacuucacuaacagugaggaagaaacgauucauucugcccagugcacaucaaaagcugggccccccccuggugacauacaggagaaaccaugaccauagcccagguccacagcuccccaucucggucuggggccaaaacuguucucaggcugccuucgggguggggugggacaggcagagaggaagaggaggagggagugcaggagggaacuaugccaacacccuggaggaaaggaaagaagcagggcacugauaagacaaugagagaaugggaaacagcgaaggggaaaaaugguggcacacagcugaggagacacgugggagaaggcaaauguacugcccgagguagauggggcggacggaggccgcuccucauaaauaacucaccaucuguuuccacacacaagguuuugcuuuucacauauccuguuuaauaauucaaauauggcugugaggaagccuggcagaccugguuuggguccuuggagccuacagcuccucaaaccaccauucagugagucuggaaugagaaaggacuggggaaguuccuggcuaggaaagugccaucuuccuuaaaacuaguacuacaucaccccaagcccccaucacaacugggacucgggccgaguugugucuuacuuaaucccccagugaaaucacagcuuaacauugcugcauggcagccugaugcaccagcccuuccagucaaaacaccaaugauccagaacauuucucugccaacagacaaauuuggcuucugccagggacugauuuugggaugaccucaggaugggucuggugagguggccugugaaagcagaauggggaugucaccuuagggaagacacugccaagugacaaagagccuacaagggaaaacaaagaacuuuguuggggcaaugcuagcccaagccuccuguggacucacacccuuccagguaugauaagcucuccagucauuuugguguuucaugugcaagagcccauggugaccugauaccuaaagauucauccaaauauguuaagaugagaaaaaauagaagcugucaacaucaaaggaggacugaguuggcaaauaaccccuuauauccuuaauccuuuaaauaucucuaauggaaaagcuguuggaguucuugguuuuuacccuggagaguaagacuggaaaggggaaagagaaccgagguucauuuuuuuucucuaagaggaucagaguccugcuauuugaggccugagaaagaguuaugagcagagaaagaagaugaagaggcugccccauaauuccuauggauacagugcauacucauccucuuucaccacagaugcuggcaaaauccuaaaggaagaaagcaugucuuuuagcccaguuuacagagaacaagggcacugucgugcauggugcaugggaggacauugaggaucugugucuugacaaggaucucaaacaagccuuugauuaugauuacacagccuccugggccacuguugccccuagucuggauuacugcaauagccuccuaucuggucucugcuucuaccaagccccccaccugcagucuaauucucaacacaguagcuggaggaauccuuuuaaaaguaagucagaucacaucauucuucugcucaauauccuucaauaauaugcaaguucacucuuuuccauggccuacaggcccucuauauucuuccucccauuaucucucugagcuguauguacuucuucucugccugcucucagcuccagcugauucaaacacacuaggcauguucccaccaccgggcuuccacacuugcucuuccuccagccagagaugccccuucucaaugcugccaguuccuaucucgccauaguuucuauuuuucuacaguauuuauuaccuacaaacauauuacauauaauuacuucuuucuuaugcuugucuaucugcuucugcuagaagguuaagcccuaauuuuguucauagacguaucucaagugccuggaacagugccugggaguuaguagacacuugauuuauuuauugaauaaaucaauggcuuuuauuggcuccuuguuagcuccaccuuuugagcuuaauucaaaagguaccaguugccuuugagaaacagaguggccaaaaguuuuagagcacagaguuuagggucagacagaccuugcugcaaauuccagcucuaccacucacuaggcuggaugaucuugagcaauuacauaaucucucugugccucauuuuccucgguuauaaaaugggauuaauagugguaccuacucauagggcagccacggaagucaaugaauuaaugcauacagagcacuugaagcagugccugguauaugacaacacucaacaaauauuaguuauuauaagucugaucaguuacuucccugcuucaaacucucuagugguucuuaggaucaaggcuaaaaucauaaagagcaugauaucuccaaccucaccucuccagcccccgaaccuucccacuucaucuaugcuccccuccaggccgcugugcuccagucacuccaaucuuuuccaggcccucaaucuccccaagcuugucccugcccuagaaucucugcacauguuguuuccucuagcuggaaugcucuaaucuaaggauuggcaaacuuuuucuaaagggccugguaguaaauauuuuugacuuugugagccauauggucucugucacaacuacucaauucugccauuguggcauaaaaacagcaauaaacaaugcaugaacaaauagggguugcugugccccaauaaaauuuuauuuaggaaaggagguguugggccagauuugaccuaugggcaguaguuugccauccccugcucuaguccccccucuucacccagccaaccccaaucauccuauaacgcuuggccuaaaugucacauccucugagaagccucccuuauuguccaugacuaggcucuaaguucuccaguuacauauucuuacaucacccucuggagcccucauuacaaucuuaaauuaucucauuauuuaauuaauuuguucaauuguucauuauucaauuacuuccucuuccaggcuauaagcugcauaacuaggacuaugucuauuuuaucucugugguacccucagagguacuaaagaagguaccacuccacaugaaaaagagguuggcuggccaggcaugguggcucaagccuguaaucccagcacuuugggaggacaagguggguggaucacuugagguuaggaguucaagaccagccuggccaacauagugaaacccuaucucuaucaaaaauacaaaaaauuagcugggcgugguggugcacaccuguaaucccuguugcucggaaggcugaggcaggagaauagcuugaacccaggagguggagguugcagugagccgagaucgcgccacugcacuccaggcugggugaccgagugagacucugacucagacaaaaaaagaaaaagaaguuggcucuggccucuaagacuguaucuuacuacaaaagauaacaagacuagauuaaaaauagucugugcucugggagagaaguaaagauguugaugcuauuuucuuagggcuuagggaagggggauuuauuuuuggagcuguuaaaagucugacuuauggacgaagaaauacaguaccugauggacauaauauucaagaucaaagagcgcagcaaucuucucuuccaaacuggagcuggaacuauugaacuuguugaucagccguaccaugaucugcaugucagucucaaugacaacauucagcucaucaaagucuuucuucaguuccucaauggggcggaagagccgcuuuaccucagccugccuugccuaaggagagcagcaaagaggugauuaaauugguuggagacaucugcccaagaugucuguggucuaccauggaugcccauccucaaaaaacugcugcuccaagacucacagucuucucucaucuaugcuaucaaaaauacuaauacuuucuaagaugcccagagaagacagcccucaaagucugccuauauaggccucagcucuaaaaacacacucaagauguuccaagauucgcuuauucaaguccgauuuccaauauucaggaagaauagaaaggcuuuuugucacaaccacugaguuaaggggaaguaaugcaaguucaucuucaaccucaaaccacauaugaaacagcugagaccuaagguagaauaacccacacccuacuucuccacuucucacaaucauagacuaucuuggccuugcccuacccaauccaacaacauuuuagggaaacuuggacauagaaaacuauggguaagagcugucacagcaggagcaauuugcugaugaaaauuaaaucacugucauuacugucaaucuaaccacagguguacaauuuguucaacuguuugaaauggcuaaauuacuauauguacuauacucaaaucucgaacaauuuucucugaauccuuccccacuccacucacauauaaaaacuuuaaaaaugaaguuacauuagaggugaauaaaagacuuuaauuaaauauuuuauacaugugacacuguuuucuucccaauuugagaagauagugccuauaaagagagucugaaaagucacaguggcuuauguaucugucuuccaagaaaaacuaaaaggcacagauauuuauaaaaagccggaugaugaacagcugucagcuccaaauugcucaucuauuaccuauggguuuuucuccccaguuacaagcacuccauagaaacaccaaccaaagaaaugaaucagccucucuuaaaaaagaccaagcuccuagcggagcaaucacauccauggggcgccacauccugauucucugggcuaaaauaauaugagauacucucccugcacccagcuagaggucucuggauggcugccaaagccaagcaaagaggucugggaaggcugagucacuuucuagaacugugagaugauaggcaagugagcacaauaagaaacuagugacaucugucucacaaaaacgaugugugccuggcucucaagaaggccucaaaaaaaaaaaaagguuuuggccgggcacaguggcucacaccuguaaucccagcacuuugguaggccgaggcaggcagaucacgaggucaggaguucaagaccagccugaccaauauggugaaaccccaucucuacuaaaaauacaaaaauuagccgggcaugguggcucacaccuguagucccagcuacucgggaggcugaggcaggagaaucgcuugaacccagaaggcagagguugcagugagcggagaucgugccacugcacuccagccuaagcgacagagcgagacuccaucacaaaacaaaacaaaacaaaacaaaacaaaacaaaacaaaacaaaacaaaacuuuuacuuugaaauaauuauaaauucccaagaaauaacaaaaaauaguacagagagugucauguacccuucauccagcuucccucaauguuaacauuuuacauaaggauauuacauaaggauacaaugucaaaaucaagaaaaggacacagguaccauacuguuaacuagacuaaacaccuuguuuggauuucaccaguuuuuacauauacucacuuacauguauguguguauguguaucauucuauguaauuuuaccugagauguagacuuguguaacuaccagaacaaucaugcuagagaacugucccaccaugaucacauaaucuacuauguacuacuccuuuacaguuauacuuuauccucccaugcuacucucuuacaucccugugcccugguugucacuaauuuauucuccauguuuauaauucuggcauuuaaaaaauguuauauacacagugguucaugccuguaauccuagaaguuugggaggccaaggcagguggacaacuugagcucaggaguuccagaccagucugggcaauauagugagacucucuguauuuauauuuuuuaaauucuauuuuuuuaaacagagaacuggccagcaaagaugaaagcgcagcaaauaaaugaaaggugguaacuuuggcaaugaaauuugaauugaauguacauggaguuauagaagaaauggcugacugugggaauguuaacacugccacuguugaugagcucuagaugugcagacagagggacucagcaaaggcaaacuuacagacacaaauuaggaaagugauaaaaaggaugaaaugacacuggcaaaaaacuucacauuacaggaacucucugagaaauuucacaacauugaaaguacgaagggugaaauguuggaggcucauccauacuuagaaagauguaugauaauuagccaagagagaaaagaugcuugcucuaugucauaauuuuuuuggagucagggucucgcucuauugcucacguugaagugcagugguacaaucacagcucgcugcagucucacccuccuggacucaagugauccuuccaccccagcgugaguaguuaggacuacaggcacaagucaccacgccuggcuaaaauuuuuaguuuuuuguagacaugggguuucgccauguugcccaggcuggucuugaacuccuggcucaagcgauccacccaccucagccucccaaagugcugagauuacagaugugggccaccauacccagccaaguuuuuaguuuucuguaaaaacuaaaaauuuuagccaggcauggugaugugugcccauaguccuaacuacucaggcugaggugggaggaucacuugaguccaggagggugagacugcagugagcugugaucguaccacuucaaccugagcaauagagugagacucugacuccaaaaaaauugugacacagagcaagcaucuuuucucucuuggcuaauuaucauacuucuuucuaacgagauuagguuauaauuagauuauaaucucagcacuuugggaagcugagguggguggaucgcuugagccaggaguucgagaacagccuaggcaacauggcaaaacccugugucuacaaaaaacacaaaaauuauuugaauuuuuuggccaggcgcaguggcucacgccuguaaucucagcacuuuggaaggucaaggcagguggaucaccugaggccaggaguucaaaaccagccuggccaacuagagaaggugaaauuagagagaagaugaaaccccuucucugcuaaaaauacaaaaaugaccaggcauggugacacaugccuguaacuugggaggcuggggcaggagaaucacuugaaccugggagguggaggcugcagugagccaagaucauaccacuguacucccgugugggcgacagagcaagacucugucucaaaaaaaaaaauguauuuuuugguguggcaugguggcacacaccuguagucccagcuacccgggaggcugaggugggaggaucacuugagcuguaauccugccacugcacuccagccugggugacagagacccugucaaaaaaaaaaaagcaagaaagaaaaaaaaaagaauucuuuuuuuugggggguagaaaaaaacuauuuuuuguagaaaacauagaccauuuccgggcuauguugcccaggcuagucucaaacuccuagaaucaagcgauccucccaaagugcuaggauugcaggugugagccauugugcccggcauaauucuaaauguuucuaauguuuuaaauuacagugugcuaaauaaauauuacuauugcuuuuucauuucuauauauacuuauaaccaauagcaauguaguugcuuuaaugucuggcaaaacauuucaaggaucauggaacaaucauaauuuuucccuugauuauguuaagauuguuuugcauaguuucagugugcacauuuucacaauuccacauaacauaaaaugaggacugcugguauaugauaugcaaauauuuccuuccaguaguuuaucuucugaucaucuuaacaggguauuugacaaaacaaaacuuuuuaauuuuggugaaguccaauuuaucaauuuuuuucuuuuauaaaucuuacauuuggugccaugucauaagaacucuuuaccugguccuaguucccaaagauguucuauguuucauucuagaagauuuuuuuuuucuuuuuaguuucacauuuuacauuuaaaucuaugaucuauuuugaauuaauuuuuuuuaagguaugagguuuaagugacagcucauuuuuugcuuauggaugcccacuauuugcugaaaagacuauuugucuuccauugaacuacuuuugcaccugucaaaaaucagucaguuguauuagugugggucuauuucuagguucucuacucuguuccauugaucuaugauucuuucucuccaccaauaccacauugucuugauuacuauagcuacagaguaagccuuaaaaucaggugguguguuuucuuccacuuauucuucuuuuuaaaauucuagcuauucuaguuccuucaacuuuccauacaaacuuuagaauaagcucaucuacaaaaaaauccugcugaaauuuugauaggaauugcacuaaacuuauacauucagagagaguuaacauuuuuacuauguugaauguuucaauccauggacacagugugucacuccauuuaauuaagucuucuuugauuuaacuccaucaucaucuuucacccaacuuuuauacuuuugagcauauagaucuuauaucugucuuguuagauuuauuccuaaauauuucauuuuuaggggagcaacuguaaaugguacauauguuuuuaauuucaauuuccaaauauucuuuguuaguauauagaaauacaauugauuugcauugucuguauaucuugugacauugcugaacucacuuauuaauucuagaagacuuuuuuuuggaggcucuuugggaguuauacauggacaacugugucaucuggaaaaugagauaguuuuauuuuuuccuugccuugccuuacugcauuggcuaugacuguguugaaugagugguaagagugaacauccuuggcuuguuucugaccucaguggcaaaguauucagucuuucacuguuaaguauaauauuccaugcagacuuuuuguaaaugcuuguuaucaaguaagguuucuauuccuagauuucugaguuaucaugaauggguacugaauauggucaaaugcucuuuguguauuaacugacauaagaugaugugauuuuucuucuuuagccuacugauauguuggguuauacugauuauuuuuuguacacugaaccagccuugcauucugguaauaaacuccaugugauuauauauaaugcauaauucuuuuuacauauugcuggauuugauuggcuaaauuuuggugaggauuuuuguuuccauguucgugaggaauguugcuauguaguuuauuuuguacucugucugguucagguauuagugugacacuggccucauaaaguaaguugggaaguguuccucccucuuacauuuucuggaacaaacuguguagaauugacgccagugguuuuuaaauguuugguuaauaucuccagugaaacuaucugaaccuggagacuuccuuuauagaagguuuuucacuacaaauucaaguuuuuuuaaugguuauaggacuacucguauuauuucauauuggguaaauuuggauaauaugugcuuauaaaacagcuggacuauuucaugaaaguuaucaaauuuauaugcauagaguuguucauaguauucucuuacuguauuuuccuuuuaauuucugcaggaucuguaaugauauuccugguuucauucuugauacagguaauuuuuaucuuagugcuuuauguguuugucagucuuguggauuuuuuguuuuuguuuuuguuuuguuuuuuguuuuugaaacagagucucguucuguugcucagacuggagugcaguggugcaaucuuggcucacugcagccucuguuuccugggcucaagugauucuccugccucagucucccgaguagcucggacuacaagcgugcgccaccaugccuggcucauuuuuuuuacuuuuaguagagaagggguuucaccauauuagccagacuggucucgaacuccugaccucaggugaucugcccaccucagccucccaaagugcugggauuauaggcgugagccaccgugcccagccauguuugucagucuugauagaaguuuaucaccuuuugguuucacugauuuuucucuacuguuuucauguuuucaauuucauugauuucugcucuuuauuuccuuccuucugcuugcuuugagcuuguuucgaucaucuuuuccuaguuucuugaaguaggaccuuccauuauagguaugagaccuuacuucuucucuaauauaagcaaauuucccuuccagcuuuaguuggauccugcaaauuuugauaaagugcauuuucauuuuuaaucaguucaauguaucuuuuuuuuuuaaccuccccugagauuuccucuuugacuugacuggagauuuucuuccuaucuaugacugguuucuaguuugauuccauuauaaugagagaacauacucugccuaauuucaguucuuuuaaaacuguugagaucuguuugauuacucaggauauacucuauuuugaggaguguuucauggacacuuaaaaagaauguauauucugcuguuguagaauggaauguuccauaaaugucaauuaaauuuuucugguugaagguguuauucagcucuuuaauacccuuacugauccgcugucuaguaguucuagcaauucugagaaagggauguugaaauccccaacuguaauugcggauuugucuguuucuuucuuuuaguucuguuaguuuuugcuucagguauuuuuauauacaaauaaaagugguacauacacauuuagaauuacuguauauuuuaauggacuggcccuuuuaucauuauguaaauugcucuuguuccuaauaauuuccuuuaaucuaaagucaacuuugauauuaauauaguaacuccugcuuuuuaauuaauaucuguaugauaugcuuuccauucuuuuacuuucaaccuacugucuuuaucauuauauuugaauuucuuguagaaagcauauuuuugaaauucauuuaaaauucauuaugaaaaucuguuuaauugguauauuuagaccaauuauaaaacauuuuacaauuauuauacauuuauguuuuaagguaauauuuuuauauguuagagcuuaaauacaccauuuuauuuauuuuuuuuguuuccuccaguuuuuguuccuguuucccauuucucaccuuccugugacaaaccaagguacauuuuauauaauuccuuuuuggauuaccuaugcuuuugaguguaacuguuuguauaguuuuuaauaaugauuguucuaaguauuauaauauacauaaguaacaucauaaucuacugguaucaauguuuuaucacuuugagugaaauguagaaaccuuaccuccaauuauguuuaauccuuucuuccuccuaauugucuucaaaauuccucacuauacauucagaaacagaucuugucauaauuuuugcuucaacuaucaaacaauuuuaaaaacucaaaaacauaugcaugugugucuuuauaacagaacaauuucuauuccuuuagguauauacccaguaaugggauugcugggucaaaugcuauuucugucuuuaggucuuugaggaauugccacacuguuuuccacaauguggaauuaauuuacacucccaccaacaguguauaagcauuccuuuuucucuacaacccuugccagcaucuauuauuuuuugacuuuuuaacaauagccauuauaguuggugugagaugguaucucacugugguuuugauuugcuuuucucuaaugaucagugauguugagcuuuuuuucauaugauuguugcccacauguaugucuucuuuugaaaagugucuauguccuuugcccacuuuucuuuuaguugucaaaugaaccuuuauugaaauauuuuccuuugugcuuaacuagcugggcauuccacugcaccacuguugaugucaucuaugaugucaugaggugacggccaucaacacugcagcccacaaacugagcaguccccaggaucucuuuaaugguucuagagaguucucuggcuaaagauuggugccgcaucugucaaguaauguugacaaucucaucacaagugauauuuccacuguguuugauguuuuuccauuucuuucugucccuuggcaguuccuugagggcuuugacgaucagggcagaggcagaaggcacugccucaaucagggccugucuguucugaauggccaguuucacuguaauccucagaccccuccagucaccggcugccuuggcaaugucaucaccaaccuuuuucggagacagacccagggggccaaucuugggggccagugccagauaccagcaaugauaccugugccagcacagacauggcgcccauuucacccuccgugcaucucagguauacaacuuuuuuuuuuuuuuuuuuuuuuuuugagauggacuccugcucagucgccaggcuggagugcagcggcgugaucuuggcucacugcaagcuccgccucccagguucacgccauucuccugccucagccuccugaguagcugggacuacaggcgccaaccgccacgcccggcuaauuuuuuuuguauuuuuaguagagacgggguuucaccauguuagccagaauggucucuaucuucugacccgugauccacccgccuuggccucccaaagugcugggauuacaggcgagagccaccacgcccggccaggcauacaacuuugaugucgcuggggucaaacuucagcaguuugcccaguuuguaaugggguuguuuuuuucuuguaaauuuguucaaguuucuuacagaugcuggauaucagaccuuuguuggaugcauaguuugcaaaaauuuucucccauucuguagguuguuuauugauaguuucuuuugcugugcaaaagcucuuuaguuuaauuagaucccauuuguuaauuuuugcuuuuguugcaauugguuuuggcaucuucgucaugaaaucuuugcccaugccuauguccugaaugguauugccuaaguugucuuccaggguuuucauaguuuuagguuaagucuuuaauccaucuugaguucauuuuuguauaugguauaaggaaaggguccaguuucaauauuccguguauggcuagccaguuaucccagcaacauuuauugaauagggaauccuuuccccauugcuuguuuuugucagauuugucaaaauagcaaacacauggaaucaaccuaaaugcccaucaaagauagacugggcaaagaccauggaauacuacgcagccauaaaaaagaaugagaucuaucccuucaagaaacauggauggagcuggaggccauuauucuuaacaaacuaaugcaggaacagaaaaccaaauaccacauguucucucuuauaagugggaguuaaaugaugauaacacacggauacuuagaggggaacaacacacacuggggccuauuggguggaggaugggaauagggaggggaucaggaaaaauaacuguuggguacuugggcuuaauaccugggugaugaaauaaucuauacaacaaaccccuaugacacaaguuuaucuauauaacaaaccugaacauguaccccugaacuuaaaaguuaaaaauuagaaaauaaauaauaaaaacucaagaagaaaaggauaggcugcauuuucccuauuuuuuauucauuacauuguucuuucuuuauuccugauauuucaaguuucuuucuauuauucuuuuuucauucuauuuggagaauauccuuuagucauucuuucagaguaggucugcuggugagaaauuuucuuaauuuuccucucucuaaaagugucuugacuucccuuucacuccugaaauauauucacggcuauaaaauucuguguggacaguucauuuuuucccccagcaauugaaaaauauuccacauacuucuggccucuaugguuucagauaaaaaauucaauaucgcucaaucauuguuccccuauaguuguguuauuuuuucuaguugcuuugaagauuuuucugucuuuaguuuucagaaguuuaacugugauguaucuugguguugauuucuuugaguuuauccugucuggaguucaccuggauucacuggauucacuuuaugaaucugugaguuuaugccuuucaccacauuugggaauuuguuagcccuuguuucuugauuauuuucuagccccauauucuuucuacucuccaucuggaauuccaaugacacaaauguuagaucuuuuguuacaguuccacaggucccuaaagcucuguuauuuuuuuucuccaaucuaucuucucuuuguuguucagacuguguaauuuuuauuuaucugucuuuaaguuuacugauucuuuucucugucaucucuguucugcuacugagccuaucuggugacuuuuaaaguuuuaguuauuauauuguucaguucuauaauuccauuugguucuuuuuucuuaucuucuguuuccuugcugagacuuugcuucaagggugcucauaauugcuugcugaagcaauuuuauaauaguuguuuuaaaauucuuguuagaugauuucaacuucugagucauuucaguauuagcaucugucucagucuucucaggcugcuauaacaaaauaucauauacugggcagcuuaaacaacauacauuuauuucucacaauucuggaugcuggggaaguccaagaucaaggaaugagucgacgugguuccuggugaggguccccuuucuggcuuacagauaaucaccuucuagcugugucuucacacgguagagagagagaguacuggucucucuuauucuucuaaggacauuaaucccucuugagccuaacccucaugaccucaccuaaaucuaauuaccuuccaaaggucccaccuccaaacaucacauugcaggguuagggcuucaacuuauaaauuugggggagacacaaacauucaauccauaacagcaucuguugauugucuaauucaaguugugauuguccugguucuugguaugaaaaguaauuuuuaauuauauccuagacauuuuggguauuaaguuaugaaauuccagauccuacuucaucuuuuucaguagguagacauccuauuuaggcuuaguauacugguucuggcuuacuuguguggguuguggcuccaacaacaauuuaguuuucagagcauuguagugcuauucuggucugcuuccuuugugugcuacccagaggccaaucuaaaaaccugggcagcauuccacacuauaguucaguuccuaaacuuuuuguuguauuaauucuggucaguuucuuguaugggucacugaacggguaugucuaggacuucauaugcaaaaucccuuucucuagcucuccucucucccaaaucguaccccuacucucuaguugagaagggaaacaacuucaccugccaccacuggaugcuggccacugggaguggaagucuagguuccucccugggccucuacugacaccacuuuggcgggagaaucgagcacuguuucacugcugcuggccugaggguggaaguucauacuucucacuuauuccacuggccccgccccagagagggaagcagaaugcugccucacacugucucacugccuccaaguuggggguggaaguacagacucuucauucaccccaacagacaccauguuaucagggaaaaguaaaaaaccauguuggugcuaccaggcagaggacagauauucaaguucccugcuuagccucugcugacaccacuccagcaggauaaacagccugcuacugucagaugggagauggaaaaucagggugcacacuuggucuguugguaauacaccagcaggggaagcagagaguauccauugggcagaggaugaaaagucaagcucucugcucagcucccacugacaccaucuugguggaggaagcagaacacugccuucuaccacuuuuuacugccuucuaccacuuuuugcugccaggagcagacgugaguucaggccguccacuuggcuccuggcgacccugguggaggaaucagaguacagcuugcuacuaccaccaaauagcaggcagaaauccagacuccccaccucaauguccacugcacuggcacuaagugggguggggagauuuucauuaucuuuggcaggaguuggacagguauuguaaauaagguuucuauccuguuaggaugcccuuugcucaauucuuugucuagaaauagcaggcuuuucuuauaacuuuuuaaaaucugcaccaguugacauuuucaggaugugggauuugccaacacucagucuaaaauauauagaggacaaaaagaaaauccaaggaacucacugaugucauuccccaagcuccaaggucccuagccagucugcugccuucugacuguguuuuagagucuuccuacauuugccuuuaguauuauguccaggguuuuuaguuacccuuagcugggggaauagggagaaauaagucuauuacaucuugccaagaaucaaaagcuuaaaaaggccauaucuuaaaaaacaauaauuuguagaauacaggugaacaauagcagacauaauaaaacauaaaagcaucaagcaauuuguauggaaauagagggauaaguagacgagauucaaccauaacaaccaaaucugcugggagagacagcuuuuccaagaaccaaggaacuccgggaaagacugauucacuuaaaccuaccaagcuaccgauggauacaauauaauugauguucucguccccaaaaacauccaguucccaaaaacccacucauuuaauuaagaggauauggccgaauaucugacaguauugucuauauaaaucacaaaagcaccauccuguacuaacaagacaccacauaggcuagguuuaaagauuaauaaacaaaaauaggaugauaucuguagccaaaagcuugauauauguaagaaacuccccaaccaauuucaaauccauuuauuugccaaucccagugccagcucgaugagcacauuggcagugagcugagucaguccagauaggcuccaaaugaaaagcaggagaaggaugccaggacuuagcaccucagugauggugcuaacaaccuaaguuccacauaaguaaggaaagaguaugauagccagaccucagaggugugcagcuggugcaaaugagcuggagcuugggucuugcauuugggugcugauauugggauccccuugcaaggggagaggaguauuuuuucuuuuuucuuuuuucuuuuuuuuuuuuuuuuugagacagaguuucucucuugucacccaggcuggagugcaauggugcaaucuaggcucacugcaaccuccaccucccgguuucaagugauucucccaccucagccucuggacuaucugggacuacagacacauaccaucaugcccggcuaauuuuugcauuuucaguagagacgggguuucaccauguuggccaggcuagucucaaacuccugaccucagaugauccacccgccuuguccucccaaagugcugcacccagccgagaggaguauuuuuaauuacaaaaaccagcaacuaaaacuuuuaaguaaucucuugguuauacauuuugaaauacuuuuauaaauauucauacuuuucuacacuaauugaauuacugggguggggggaaaugccaucaccugagaaaagaaaagccaaacacacucccagggaaagcaaagagaagagaacaagguuaaguggguccuccauccacagagaagacgcugaauaggagcuguuuaauguucccaucagucccacauggaaccgacagugggugggaaggagccaaagcccuggccagucccuguccuaggcacccaggcacuccucugcuggccucaccuguaccaggcagaagaugugcuucuccucagccccuuggcuaauacaucugugguaggacacaauugcgagcauugccuuccuucacccacugcugcugccaccaagccacgugcccucccacaccacauacacucuccguguaggagaagugacuuugguaagaugaguaaagacguggagacugagccugcauuucacacuucuuaaacagguaaacaccaguuuccuaucccccaaaaagguucauuuucccagaaauauuuaguucuaaaggaucagaacaaccuauggcuucuuccaguaauacacaagcugucaagaggcuaaugcugucucucuaggacauuaccuggauucaggggaaggagugaagagguaaauaaaggcaaaugagugcccagcacggugguucaugccuguaauccuagcacuuugggaggccaaggugggcagaucauuugaggucaggaguucgagagcaaccuggccaacauggugaaaccccaucucuacugaaaacauaaaaauuagcugaguguaguggcaagcaccuguaaucccagcuacucaggaggcugaggcaggagaaucgcuugaacccaggagguggaccuugcagugagccaagaucguaccaccgcacaaacaacaaggccaucugggcgacagagcaagacuccaacucaaaaacaaaaaaaaaaaaaaacaaaaaaaagcaaauggggacuguaaggagaagagggagggagaacuuaggucucuaaggcagccaucagagaagguucuuucaaaaacugacaggacucaaacagaaauacagagaaaugacuccaagagcucaugaucuuccugguauagaccugcaccugugagcccucccagacauuaggggcauggccaaggggcuguaauucuucaccuuuuccuccucucauucccuuagcuuguagagaaauuuagagcuggaggaaaccucagucauccucuuguuccagccccauguuuuaaauuuaaggaaucugaagccuagaagaaacacauuugcuacauguucaaaggacaaggacaaggauuccggcuucuugcuuccugggccagcuccucuguucuuuuggaacaagcuugugucuaauccaaguguaagugaggcagagaucugggccauaaagucuacucacuccacucaggccugugauaauggagagaauggcuaccccugcucagugccucaauuucuccaaacauggggagcuguuugaagacaugggauggcaaauagaauucuaaccuaaaccaugacagaaaugcucccagcacuuuuuuuuuaauagucuaaaaggguuucuuauuugucauuaauguucuuuaaauuauuuuacaauauuguuaucccauguuuauugcaagaguucccauaaaaaugauuccauucucugcaaagacaacaaggccaugcugcaggcuuauacucacaggaaaaauaaucacacaccuugucuuccuuugaacucuccaucucugcccccuccuugaauuuugccagugcacucuugagauccugagauguguagguguugguguugauauccagccuguccaaagaaaacugagaguaaagagggaggcauggcuaggcuugguggcucacaguuguaaucccaguacucuggguggccaagauggaaggauaccaagaucccaucucuacaaaaaauuuaaaaauauuaguuaggaugugaugguaugugccuguggucccagcuacgugggaagcaggaggaucacuugagcccagggguucgaggcugugguaaacuaugauugugccaccauacucccacagcugggcaacagagucagacccugucucuaaaaauaaauaagaggggagcaucauauuccccaagaaagaaaaugucccugggugaauggcacccuaagguaagugaggccaggccagcugaguguacuaucauaccuuugucuucagucagccaagggucuaacagagugaccuuaccuugaagcuagaagaggaaagacgcagcugaaaaugggaucauuucaugaaagaggaagcaauggcauggggcagacagaagccauccacgaacagagggcucucagccagcuucucaggaagaaauaagccuggcauaacugugcaaugcucucccucagcacgcugccagggcaggaccucucagagggaagugggcccagccacaaggaguagcaugcacccuuaucuauuaauauauuuuuccaugaaaggggacaacagggcccugagccccacagugugugccugaacugauuagacaaggcagccugucuuuacaaaaacaaguuggauagauucacaccauaagaccaaccuaugagcacaaaggagaggcaggagguaugucucaaccugaccaaggaauggauuugagauacuaaggaguagaaucaaggucagccccuuccacagccagccuccaaagggaggagggaaaggaaccaauguggcuauaaucucaggaaccugccaaagaccagaauggucuccucacaaaauucccuggagcugauccaagccacagcuacacaucuugaccagagagaggacauccaucaugugggagcaagguuuuaccacuagcauucauuuuaguucaaugaacagagguaagcacaagaaugaugugcacgaagggaagaguggaguauggaaugugcuuaacaagacugucagguugguguuggguucaggauuccauauauccuggaaugcccacaagauuucagaggugaggaggaaggggcuacuggccugcucuacuccaggcaggaagagcacaucagucucauagucugagauuccagcaggccucagcucucauguaccaagggcuuucauucuuccuagagaccuuuuagggcucugagaagaacacucgucuucucuaaaccucaguccuccuaaacuaauuaauaauagcuaguaacucauuuauugagcauuuagccauguguuaggcaguguguuaaucccuucaaaguaauauuucauucaaauaguuaucacaaugcuacaaaguagggagagaauccugaaucccucucccuacagagcaucauccacugccaaugugugaggauaccacugccccaccccacauacccaagagggagcuaaguauucaggaaccauagcuugaacacauuaucuccucccucuuguaagacuuggucaggacuaaucccauuauuccgugcaucucuguuuacgccuuaagucucaacucucccaagccaucucucaucacccacucucagucccaacuacauacacacaagcaugcacaugugcacucaaguucacgcacacacacgaaacagucaucugguguucuuacuucauucuucacuaagaaaaauagaccaaaacuucauuuucccaugaucagcucuacaagccaaccugcaccuaagucuauguuuucuacuuuccuuccuauuauaauggaugagugucccugauccuauuaaacuuaguuccagaucgcaguugccuuuacaaaagcuuuaacucccauaauuacaccgcucccuccugccugcaucaucaauuucucccuucagcuggauuauucccaucagcacaccaauucuccugucacuccacagucucuucugguuauccugccauuucccugcucucacucagaguaacacuuuaugaacacauuguuuucacucacuauccccagcuuuuuuauuccuauuuauauugccauuuacuguaaucuggauucuguccucacaacuguacucacacuacuaaucaaaauuaccaauaauugaugaccaaauccgauggacccuucuucacucacuucauguuccucaaccacuaagcagcauuugcacaguugacccucccuucuugaaaaacucucagucggguguggugggucaugccuguaauuccggcacuuugggaggcugaggagggaggauugcuugagcccaggaguucaagaccaguaagggcaacauaguaagauucugucucuacaaaaaaauugaaaauuagccaggcaagguggugugcaccuguggccccagcuacucagaagccugaggugggaggauugcuugagcccaggcuguagugagccaugauuaggccacugcacuccagucugggcgacaaagcaaaacccugucucaaaacaaacaaacaaacaaaaaaaaccuccuuuccuggcuuguuaccucacucucauggcucuuccucuuccuuacuccuucuccaacucuugcugguuccucaucuccuaccugagccacauagcccagaaugccuuggaguucagcccugucaaucuucuccaccucgacauccuccccuaguuacuuuaaaaaccuaucugccaguaaucuccacauuuacaucuccagcccaaccucuccccugagcaccaaucagacucuuguacaacuaccugauagaucuguaucucaaauguuuaacaaguauuucaaacuuauugaaucuaaaacauggcucuugauucuucuccuuauaagucugucccccucccaacuuuucuauuucaauaaauaguaccaacaaccacccaguugcucaaguuccaaaaugaggcuuuauccugaaucugugccccucccugcaccuuccuucaaccucuacacugaaaucauaagcaaguccucuugagucuaccuccaaauuaaaucuccaaauucauucagucucuguuaugauacccuagacuaagccaccauuauguccuaccugaucuacugaaaugacauccuaauucugucuucuuuuguccaccuucaaucucaucuccagacacauaguaacuaaaucacucuccugccuaaaaucuuccaauggcagcugggcgcgguggcucaugccugcaauuccggcacuuugggaggccgaggcgggcagaucacgaggucagaauuucaagaccagccuggccaacauggugaaacuccgucucuacuaaaaauacaaaaauuggcugggugugguggcaggcaccuguaaucccagcuacucgggaggcugaggcaggagaauugcuugaagccaggaggcggagguugcagugagcugagauggugccacugcacuccagccuggguagcagagcaagacaccgucuuauggggaaaaaaaaaaucuuccaauggcuuuccauuacaauuaaaggugaaugaagaacauacaaaaucuuccucaaaagccacaugaucuggcccccacauaccucuccaaucucaucuccuaucgauuuccuuccuucucucuucuccuauagucaccuugaucauuuucuugcuucucauacuugacaaagccuuuuccuugauaaagccugggacuuccuguuguuccaucugucugaaaugcccuaacuccuaaaccuauaaaccuaacccuuuacauaaagaguuaauuauucuuuuuguccauaucauccuuguucuuaccucuguucccugaauugaaauaaggacuagugguaaaaccuugcuccccaauggaugucuucucucuagucaagcuacauggcugugguuuggaucagcuccagggaucucagugaggauaccaauccagucuuugacagguuccugggaucagccacauugguuccuuuccuuccucccuuuggggccaguuaauuaaucuaugauuaauucccaauacuuucauguuuuagaacagggucagcaaacuaucaguaaugaccagauaauaucuuacuucugugcuuauguaccugguuuucugucugccagccuuguggaggcuguuuuguuuauuacuguaucccaaugccuggcacgugggcacucaauagguuuuugugaaauaaauaaauggaggaaguaaauggcccuguccuuagcccaaccuuuuaaccacuauaccauauuggaccuugguaaauguucaacccaagauggcacaacuugaacgugguuuuacccucaguccuccaaaccuaggaggaagaguccaagaagcugguuauuccagggcaaaaagagagauguacuacguugacagggauauggacuaaaaccacuagagauggcaaagccuaaagcauaaauagcaaguggaaaccuguugcuaagggccaacuacaugcaaugaaauaaggcagugcuaaaggaacucucugagacaagccagagucagggucuucugucccaggcuuuagagcccacaagcauugcagcucuagguagcaauguggccagccacacaaccaguaaaaauaguagaaagacugccaugaauuuuggauuaaugggcuguccccaucucccucuaggccaaugguucuuaacucugugggaucacuaacuucuuggacaauuucauggaaagcuauggauuuuguccucuaaaacagaauaaggauauaagcaaaauacucuaacaauuucagggaacugacccugcccuuaggccucuguuccuauuccagugcuaaggggccaggaagacaccaugaaauggaauuggaggagcuccaucccagaaguaggaagucaccaucaaaggcucacugagcucacagcacugaauguucacaccaccuugucagugccuuuggacuucuauucagauagguuugccauuagcuauaaaugcugagaaggaagaagaaagguccagcauaugcuaggggccauuucaggcagagacucuccaaaggaggaaaguaaaaaggcaggaguagggacaaauauuucucccuuauggugugucucuacaguucacauggacggcucugcugucuauucguaaaagauaugaguaacagacaaagcaguacguguucacacugauaaucuauagucaggugguagagaagugaguucucauaguauaaaaaccaacaaauaaacuccaaauuaauaaaauuccucaguauuauuuuuguaaagggauuuuauuuuuuauuuauauauuuugcuuauuuauuuuuucagauagggucucacugugucacccaggcugcaguacaguggcauaaucacggcuuauugcagccucaaccuccccaggcucagguaauccucccaucucagccuccugaguagcugggacuacaggcauaauacacaccacacacccagcuaauuuuugguuuugguguuuuuuucuguuuugcuuuuuuuuguuguugguuuuuuuuuuuuuuuuuuuuuuuugagacagggucuggcucugccacccaggcuggaaugcagugguacgaucuugacucacugcaaccucugccucccaggcucaagugauccucccaacucagccccacgaguagcugggacuacaggcgugugccaccaccuccagcuaauuuuuauauguuuugcagacacacacccugucgcuggugugugucuucaaauccuaggcucaaacgauccacccgccucagccucccaaaauguugguauuacaggugugaaccacuguacccggccccuaacucaauauucauaagcuaagaaaagaauagauuguuuucuucagaaaauaagacuuggauuacaugugagaaaagacuuccuaaaaguacuuugaggcacugaaauauguguguauuguggacgaaagaaguuuggcaggggccgugacaaugacagcugauuauuucuuacaugguuguuagaaaggaguaauugucugaccugggccacuccaaguauaggccuaccuggaggaaugagggaagaugaaagauccuucccaauuuggagugacuguaaggagaacaaaugccucuaucucaauaugaaguagaauuuucuaacagugaaaacugucuaaaucugaacaggcuguuuuguggggugagugccaccugaaaaaagugcacauggaccagcugagugaccuucugacaggcaugucaaggaaaagacuaggguaagaagugagucucuaggaccuccuucugauuacaucuaacugcaaaauacuggguuuuuguuuuaguuuuucugagacagagucucgcucugccacccaggcuggagugcuguggcaagaucuuggcucauugcaauuucugccucccagguucaagcgauucuucugccucagccuucugaguaucugggauuacaggcaccugccaccacacccagcuaauuuuuguuuguauuuuuaguagagacaggguuucaucauguuggccaggcuggucucgaacugcugaccuuaggugauccgccggccucggccucccaaagugcugggauuacaggugugagccaccacgcccgaccugcaaaauacuguuuaaauuauaaaauccaggcugggcacagugguccacaucuguuaucccagcacuuugggaggccagggcaggaagaucacuugaguccaggaguuuaagaccagccugagcaauaaagugagacccugucucuacaaaaaaauuuaaaaaaauuagccaggcauaguggcacacaccuguagccccagccuacucaggagguugagacaaugagauugcuugagcccaggaguuugagguuacagugaacuaugaucacaccacuuuacuccagccuaggcaacagagcaagacccuaucucuaaaaaaaaaaaaaaaaaaaucaucaucaucaucauccaaggacugaguaacacuaaccacacucaauccauaacuaauaauucccagugcuuacacguguuagcacagggucagcaaacugucuguaaugacuggauacuauuuuaggcucugugauccauauggugucugucccaauuaaucaacucugucauuguagcaagaaagcagccauagacaauauguaaacaaaugagcauggcugugucccauuaaaacuuuauuuauggacauuuaaaucugaauuucauacauuuucaugagucaugaaauacuaccuuuugauuuuuuuccaaccuuuaagaaauguaaaaaccaauuucacuugcaggcugaaccaaagcagggagcagucccaauaaggcccacaggccauaauuugcuggucccuguguuagaaauuucauggcugguauuucuacugagcuuucaaaaugcacaauuucagcaaccccugcaacuccaugccucaaccuccuucccccucauucaggaaauaucaagcaaagaaagcaugcuaauucaaggcaacaaaagaaaaauagugacacugaauucucuaaaauugaauaauauaaccugguuauugagaaauaaggcaaccucuagccaguggagaauggcaguagcuucuacuuuuauacuauaagaaggccuguuuuaauacugacuaaugagaggaaaaguuagccugaauuaaagacuuuaaaaugcaauuuuauuguucaccaaggaaguauuacugcaaagcagaaggccuaacaggccuguuuuaaugaauagaugacucaucuguaaucagugcauuaauuguugggauucaaaugggugcucuuaaaguacugggaaaaauaguuucauuuuuaaagcagguuaagcauucccccuacagccuuuuuuaaaguaucaauuugcuuugcaaacuaucucuuuccaaagacuguagaaguaaacuuucauaaaacccugacagauuuaucacaaauucuaugcuauuaaauuucaaauuaaaaaaagccacaugaauuuggguaacauuuuaaguauuacaauacaaaaucaacguuaucacuuagccucccagucccuaggguugacacuguaccuuuugccuuucaaauuauuucggaacuuguccucauauuggaguuuugccucucuuuccccagucugaagauucagccguacgugggauccugcagggacagccugcccuaaaagccaagaagagaaaaggcucaugagguacaaggucuuuggaaggcugucgggauggccagcaagccaacaggacuuacuaguucaugaagacacgacucagcuguguucaguuaccuccucaauccacccaucccucucccuugaacacacacaccacucgcauaaacucacuuugcuaaucuauaaggaaaucuguaagggaaugacguaagaugggcaagaggauucacacuugaaucuagagaccaaugucccccaguuagaaccugcauauuuaagcucuucuaugucuucuugagcuaauaaaagcuuuguguuacgugcagcagguaagugguagauaacuacucauuccucaggacaugcuacuuuaccgucucuuccaugacacccuuccugccccuccucgacagucagucccacagggccccagacagccugccaucccagcaagcuuacaccucaccaccugcaucuguuuaauuaggcuccuucuaugaggcucucuccuuccuaagcacagggacuguauuuccuccuuuuugauuucccagcccuuaggccagggcuuggcacauaaaaguguggcacuuaacguuaugaaaaggaagaaggaagagacuggaaggcaagaggacagagcaagccaaggaggcagggaguggagccaagagaaacugaaaaccuacacccaccuaucuauggagcugauccacagcugggaaaaacaaguguugugaaucgaugggcuauuccuaugcacugcacaaaacuacucaaguauaguuaaaaagcaacugugcaguagcacauacuacaaauggaaugcuacacacauucauucauucaugaaacugcuguagggauggagaauuucagggaaaagguuuuucaggagaugggagauuugaagcaaagauggugcuucugacaaccuggacuuugacucugcuuucuccugccagaggacagcauugccuugcugguguuaaguuugauuuaagaacccaaaucaaugacuuucagaaaaaauuccuccgaaggaagcacacagcacaaguucucucaaauaaucagguaaacucaaguauagaaggauaaugauauaggcaaguauucaccaguucucgcaauucugggaggcccauagagaacucugaguuccaccagucacucuauccccaaucaagaugccagggauaucgcacaccaugcuguugcuguuccugccgucccacuucaguagggaguuucuguauguuuuacuuuaaaaaaugggaaccuacauacaguauauagaaguaugugcauaaugaucucccucuaaccccaaccauuauuuucaaggauaaaaaauacauucaggccaggcaugguugcucacacuuugggaggccaaggcagguggaucaccugaggucaggaguucgagaccagccuuggcaaauggugaaaccccaucucuacuaaaaauacaaaaauuagccaagugugguggcaggaaccuguaaucucagcuacuugggaggcugaggcaggagaacugcuugaaccugaaugguggagguugcaguaagccaagaucacgccacugcacuccagccugggcaacagugcaagacuccgucucaaaaaaaaaaguucagagcgcaguggaaaaauccuucucugggguggcccuccugauaaaguuggggucaaaugaagaaaaaagcgagucccagacuaggaauaaagggaauaccagaguaaggaagccccaugugcaaaugcacugacacggaacccaauaggccacagaagcugaggagagacuaggccacagaacuaacuggaagggcugugggggcugcuggcuugguaccaccaggaagccuggguucauauuccuaggaugggaaaauauucaucaaacagcggcggaagaugguucugggaggagaggaggcugaauacuggcaagaauaacaaagaacuggcaacuucuauccuauuacuaugaucacagggcaagagguaauuucuuuaguacuaaucuaaucucugaaugugugaaggggagaggcugccucaccuggagagaucccaaacugacaagacaauagucccuuccuggaugaaugcuaaacaagacaauagucccuuccuggaugaaugcuaaacaagacaauagucucuuccuggaugaaugcuaaaaugccagcccccuuuacucuaccacauugauacccaaucuaccucccaaacugguugauuuuuccugcuauguaugucuugaaugcauacucuucucuccaucuucccccacugcuuuugucugaaccaucaccaucucugaucugcgcccuaucacagcuuucuaacuggccuccccgauucaccucccaaucaaacuguucuuuaaagcgaaugauuuuucuuuuccaaaauaccaaaccuaugucauucuccugcuucaaaccuuuucauggcuuccuacuauucugaggauaaaaaugaaaauccucacccugguccaugaggcccugcaguaucuggccccagccuaccucuccagccuuguccacuccucauuccugugcucuaggcacacuggucuuuuuccauccuucugaaagaaccaugcuaccuccuaccagggggccauuccaucugcuguucccuuuguccagaagagucuucccacccucagccuccaucuccucauccuuccaaucccagcuaaagucacuucuucugaaaggcauccucuauuuucucagacuagauuuaccugccuccaaaagauuucacagcaccaugaauccuuuauagcacucaccacaaucaguaauuacacauuaguuuuuuuauuuauguagugaauauaaaugcucaccauuuuauccucagggccuauaacaugaccuggcuggcauauagugaacucucaauaauuauuuguuggucaagugaggaggcccuugccuauagucccagcacuuugggaggcugagacgaggggaucaccugagcccaggaguuagagaccagccugagcaacacaaugagaucccaucucuagaaaauaauuuaaaauuagcugagugugguggcucacaccuguaauuccagcacuuugggaggccaaggcaaguggaucacuugaggccauggguugggcaacacagugagaccccgucuguacaaaaaaauuaaaauaaaaaaauuagccaggcacaauggcaugcuccuauaguccuagccacuugaagucugaggugggaagauugccugagcucaggaguucaaggcagcaaugggcuaugaucaugccacugcacucuagccugggcaacagagugagaacuugucucuaaauuaaaaaaauaauaauuauuuguuaagugaaaauguuuaaaagaaagagggaauuccuagcugaucuagaguuauauggaaaggccaagaaggauuuuuacuagggcagguugaguuauaauaguaauuagucauguuaauaguuauuuuuaguaauaaugguacuaauacuaguaauauaauaaaaauaguauuuaaaauuuucaaacuuuugaccaaaguuagaaauggaaaagaaaaaagcauguaaguguauaagcuucagaaguaauagguuauagugugcuaagcucgccaaagaagagacuagguucuuaugugaaucuaguuauuuugaugaaaauuccaaaauuacucccuucacauaagccaccacagggggcaagagcaaccacaacagcauuaacucaaaauacagguuguguucauuuaaaauauacuaaacacgucauggcagcagcaguggcaaaagcaacaggaaaugcaguauuucaaauacuucuccacuggggaaauguccaaguuagaaagauaguauaaucugaccuguauccuucgagagccccugugacagaugaaaauguaccagaacacaggggaagggcaaaucagagcaaagagaaaacaagauacauacagguaacaaguuagggggauggagagcaaggguacaggcagaaaauaaugucuggauccaggaaggcaaacaggccugcaaagccuacagugucuguuuucccaccuccagcuccuucagagcugaucccaaggcugacuauccuagccuagaaaacccauccauauuaagcagaagcccuguccauauugaguaaggccaccucaugcuugaauuuugacucccacugacacugucacugacuucagucacaggccaggacccagauaacaacucuuguuuucuggguugggggauaaucuaugguagacugcaacaucgucaccaauuuuuuuccucccugcuugucacacucucugccaugugacuuuacaguuccuccuacugcagagugugccuucucacaccuugacuuuggauuuugcuuaucacaugcauuggccagugggaugcuagcaaaugggccgcaaacagauguuugaaaugugcuugcaugguuguaucauguucugcuauugucaugaaaagaacaucacugacucucccucucccucucccucucccucucccccucucccccucucccccucucccucuccccacggucucccucucccucuccccacggucucccucucccucucuuuccacggucucccucugaugccuagccgaagcuggacuguacugcugccaucucggcucacugcaaccucccugccugauucuccugccucagccugccgagugccugcgauugcaggcacgcgccgccacgccugacugguuuucguauuuuuuugguggagacgggguuucacuguguuggccgggccagucuccagcuccuaaccgcgagugauccgccagccucgaccucccgaagugccgggauugcagacagagucuccuucacucagugcucaauggugcccaggcuggagugcaguggcgugaucucggcucgcuacaaccuccaccucccagccgccugccuuggccucccaaagugccgagauugcagccucugcccggccgccaccccgucugggaagugaggagcgucucugcuuggccacccaucgucugggaugugaggagccccucugccuggcugcccagucuggaaagugaggagcgucucugcccggccgccaucccaucuaggaagugaggagcgccucuucccggccgccaucccaucuaggaagugaggagcgucucugcccggccgcccaucgucugagauguggggagcgccucugcccugccgccccgucugggaggugaggagcaucucugcccggccaacccgucugagaagugaggagacccucugccccacaaccaccccgacugagaagugaggagccccuccgcccggcagccaccccgucugggaagugaggagcgucuccgcccggcagccaccccguccgggagggaggugggggucagccccccgccaggccagccgccccguccgggagggaggugggggggucagccccccgaccggccagccgccccguccgggagggaggugggggggucagccccccgcccggccagccgccccaucaaggagggaggugggggggucagccccccgccuggccagccgccccguccgggagggaggugggggcgucagccccccgcccggccagccgccccgcccgggaggugaggggcgccucugccugcccgccccuacugggaagugaggagccccucugcccggccaccaccccgucugggagguguacccaacagcucauugagaacgggccaugaugacaauggcgguuuuguggaauagaaaggggggaaagguggggaaaagauugagaaaucggaugguugccgugucuguguagaaagaaguagacaugggagacuuuucauuuuguucuguacuaagaaaaauucuucugccuugggauccuguugaugggugaccuuacccccaacccugugcucucugaaacaugugcuguguccacucaggguuaaauggauuaagggcgcugcaagaugugcuuuguuaaacagaugcuugaaggcagcaugcucguuaagagucaucaccacucccuaaucucaaguacccagggacacaaacacugcggaaggccgcagaguccucugccuaggaaaaccagagaccuuuguucacuuguuuaucugcugaccuucccuccacuauuguccuaugacccagccaaaucccccucugcgagaaacacccaagaaugaucaauaaaaaaaaaaaaaagaaaagaaaagaacaucacugcuagccuucugguccaagaaggaugagacacccacggagaagaaacaagucagggcuucaugugcacaugguuuauuaaggggugcucuccaguugacaggaaaugaggaggcagggaggacuuuguacccccaccugcccccuccuggcagucagaggccgcaggcuaccagagcagguggaggcagaagcucugggcaaagaagcuuuggcuccucagagggguccaggaacagguggcaagagugagucuugaacccccacagaggcuggggaagaaacacccccuauaggaaaaggagaucccaggaaguaugggcagggaaccaaaagcaucugcuuuaauggcugucuuagaguguguccuaguccauuaggaauccuauaacagaguaacuuagacuggguaauuuauaaacaauacaaauuuauugcucacaauucuggagacugggaaguccaagaucacaccagcaguuucagugucuggugagagccuguuccucacagaaggugccuucuaaguguuuucacaugguggaaggggccaggaggcacccucaagccucuucacuaauccuauucaugaggcguggaacucucaugaccucaucaccuccuaaaggccccaccuucuaauacuaucauacuggguaucaggggacaacccaaauguccaucaugugauaaaugaauuaauaaaaguaguauauccauauaauauuauucaccauuaaaaggagcaauaaauacugcuacauccuacaacauugaugaaccuugaaaacauugugcuaagugaaagccagauacaaaaaagcauguaucauaugauuacuuuuacaugaaauguacagaauaggcaaauccauagaaaccguagauuaauggcugucaggggcugugggaaggaaggaaugaggauugaccacucguggucuggaguuagacaguggcaguaauugcacaacacuguggguaaacuaaaaaaaaaaacaccaaauuaccaagaaaaaaaucaugggggaaauacuuucagauuauacaaauccaucccuugacucuaaaaaccauugcaugccauuagaggaauccaucugcaacauuuaccacugugguaaucaucuaaugggaauuugcuacuucccuccuucuuuacacauuuauuaauugggauuuauuucacuccaagaaaaaauugucacuccucuaauuauuuguaugaguaugaacucauggauauuuuauucuauggguccaacacuauuauuauuuauuuuguuacucaaauuguuucagccuuagcaaucagaagugccuucagguuggcucuuacauuccuuugaaaaacccuuccuccccaccaucauuuucuuuuuaaaaguauuuccuuacuuucugguuccauaagauguuccagguucaucuuguauuuucauuuccccagcccuggaaucagccacuucuaacgagcccuaguuuuuuuucuuuuucuuucuuuuuucuuuuuucaauuggagaacaguguuuagaagccaagaucuggaugcuagguguguucauuaauacuaggguguugguauuucuaagcccucucaguaggcggagcuagaaauguguauguguguguguguguguaacaaaauaccuuagacuggguaauuuauaaacaauacaaauuauauauacacacacaaauguuaauuauauauauguauauguacacacacacauagacauacauacauuuguauauauauauguggugauaagguuuggcugugucuccacuuaaaucucaucuugaauuguagcucccuuaauucccacaugucaugggagccaccugguaggagguaauuaaaucaugggggugggucuuuccugugcuguuccugugauggugaauaagccucaggagaucugaugguuuuauaaagggcaguuccccugcacacgcucucuuuccugcugccauguaaagacaugacuuugcuacucauucaccuuccaccaugauuguaaggccccaccggccauguggaacugugaguccauuaaaccucuuuccuuuauaaauuacccagucucagguaugucuuuauuagcagcauggaaacuaauauauacagcuuagaauauuauauuacauauauucuaaaccacauauacauauaugauuuagaauaacauucaggcccuccauguaaucaucaaucauuaauguuuaagggacacugaguucacuuucucuaauaaucugugccaaaaguaacaaaagaggacaucaacagauguacaauauauauacauacagacaucuauauacaugcacacaccuauauuucuugcuauauuauuguuguguguauauauccacacaucuauauuucuauaucuauuuaucuguauauauuuuuaaaacuacaaguuuauacugauaguucagauuccaaucuaauacacgggcucauuugucuucucacuuuacuuauuuauaacuucuuucucuaacacugagaaaccugcucuuauuaucuacaauauauuuuuguucuaguauacaaauaaacuaguuucaaaacuguuaacccauaucccugugagaaauacauuuaccaaacuagauuacagcauguauguacaguucuguuuuuagcuuuacaguaccuggucaaaauauugcuucacaaagucacuuggguuaguucuucccuguccaauucauuaagguuauguuauuaauuaguaauacuugguucauuuguuaguauuuguauuccauuuuauggcuccugccccuccauauccugauuggcuuaacuguuuauuuggugagccuaugaagaguaugugaacuauuacugugguucuaagagucggagcuauaaaaaagaacaguguucuguucucuuacauacuuuuuuuuuguauaguuacuguuuuuuuaagccaccaggauuugagguguuuauuguggcauucauuccaauggucccgaaacaagaaauuaaaagugcccaauauaaauaacaguuuuuucugaaauuauauaguugcuuuuuuguguuaaaauguccuuuuaaaagaugagauaaugauaguagauaguguguuguuuccauguuaaggcccuuaacucagcaaaauaaaaaguuggccuuaguccuccaauuuuuuuuuuuuuuuuaaguuuuucugguccauaaaacaccauagccuagaaaccaccucuccauucuaccaaucuucccuaggacauuugagaauuauucccauuguacacuuuaaauaggugaauuggauaguauauaaauuauaucucgauaaagugguuguagaaauauauuccuccaccaucucuuuuuaaauccuugaacagcaauuagucuaucagacacaguucaaugugacaguaaauauuucuaggggccaggaaagagaacuaaggcucagggccuagacacagacccaggaaugaaguucuuggaacguuaggaaggggaaaauuagccuaggaagccugaggccaugaagcaccaggacaagaggaacccuggcagaaggacagguaagaaauagugaucaggagguaggagccaugucaaaugcccacaggaggcaggaggcaagagagugaggagguucaucuguaagaaaacaugaauggugagggcugugaaaaaugccccuucuaaaaguauuccaccuuaaauacagaaaaggcaaacaaaacauauggccaguuuguaacugcugaaaugauaguuuuaccuauuaacaaauuauaccuggcucugucuuugccccaacucaucccaguguccagugcuuagaaacuugucccuccuggacucccagugacagggccugcucagguggugcccacagugagguugcuguggagccuggcugcccugcuucaacgaagacaggccaacuggaaugaaugcauggugcucuugggucugccuuggcauuaagagcuuugguaguuaugggacuucaggaggggugaaaaggacaggauguccuccauaggcuccugccuggaaacuuccugcuccagggacuuccagucauacguggacacaauggcagaaagccagaggcugccccggcuggccaugccgcaagcccugggacucugcuccucacuuggcuaucuuuguuggcugggugacucuagccaaauuccuuuauguuucugaaucuucaugcccuuaugugucaacugaaaagaauuuaucgugucuguuuucccuaaugugcuacauuguugugaagaacaaaugaaaaaagaacugugucagugcucagaagaaauaaaaaguacaccagaaaaagcagucccaaaaacaacccaaaaagguaaaugucaacccggaugaagcaaagacagcuuauuugucaaguccuacagguagguguuaagaguaaaaacucccgguuaugcugaguuucugaagggcaggaaccaauuauuggugcccacagcucaagcucagcucaaggcacacaguaggccuccauaaaggucagcuugaaugccagcucccucuuccccagaccaaaaggaauacaaaaauauagaacaggaagcaaugccacucaccucgcuggggccuccaagcuccuaauagggcuggucagagcugaggcuuuacaggcccaguugccaugacuacuaaagcccucuccuccugcuucuuuauucaaaacccccgaacaagucuuggcaagaucccugccuuacacaaaugagcaucuauccugucuccaggacuugaacggaaccaguaacaaauaacgugcacaaaccucucuagggugcugaacccugaaacaacacuuaauguuauuguguuuuuaagggaaccaaaaauggagaccuuuuuuuuaaacagcaaaauacauaaugagccauucuggaucauagucauauuuauguauuuuuuagaaggacuaaacaaugacaaacugagaaaaauaggaauauucuccaaauguauuuuuacucugaaucacagagaaucuagaaucugggccgggucuuagaagaguuacccagcauggcuuccaggcaaggguagaaauccccaagcugcaugaaagccgcucagaaaaaaagacgccaguuucccccagggaacagcuacccugacagcucccaccauacccuugcaccacuaccccacuacccuccaaaaucucauccacagcacccuaacccaugucuccuuuccaguccucaaggaggacaaacuacagcuggugaccaaccauucuacacagaauucacaagaguaacgcuuuccacagacaaggacuaucaaugcuacuuagauuuccuguguucuagugagagagguaccuugaaccaucaucagcacaaggcucaaaguaaccacauuuaggacauggugagccucuuuccauaaguggcuaguccacaagcaucuccugaggacugggcaagagucugcucuuuuccaggcauuccuucugccacagcuuaccaugugcccacaaagggccacugcuguguugggcacugggaaguauacugggaagugaacaagaccaaugccugccauugagaaguaugacauaaauggggagagaaguagcaacacuuagauuuccaaguccagagaacagcuuucaagcaagcaaugaggaacuccauaugaagcaccuggagcucagcauauaaaacaggcagacaagaagcagggaggccacuuggcaggcuguuaucauuguccuaaucagacauaauaaacccugacccagaggaauggguaggaaaugaagauugagacagcaguaaaggaugauaguauuuugaccagaaaaacuaggaaucuuguuguggcccugccagcccuccuacugagaaaagcaucagaccuuuaagcaugugcaguuacucacuccuuccaccagccuagggggccuaccacagcccccaaauuuaauaaauccagggauggaauaaagaaaacuggggcuaaagggggccacuuucauguggagacccauccugggcaucucacaccuguuuccuagcuaguugaugccuccacuccccuuugaucucuacccucaaugucucccauguuccuccaagaaaccaaaggucaggcaguugggaguauaccacagcauggcuauagcucuuccggcucucuaaucccacuuggaaauuacugagucaaaaauacauuuuuuuaaauucucacuauaauugaaguuaacccugagauacugauaaugagcuuuacuucauaauaaggagggaaacaaauuggaagugaaggaguuaaaugugucuguuucccagaggccuuagcaccacuacugcucauuuucuggagaagacucuugaggauuccagagugccugcauuucccacccagguacaauuucauuagcagcucauuagcaggaguggugcaaccauuucugacucuuguuuuucauaauauuuauugguuaauugacacucugaauacagguugacugagacccaaaugaaagugcuaaaaccacucauuagucaaauuuaaaacagagauuguauucuaaacauacccuuuguucucauuuauuuuccucaaacagaagucaugauugaauaaaaggguuaaaaaagcaaagugccaagauauuguacuucaauuuuuaauccuuuuuuccccguacccuaucaguccccaggaauccugucaucauaauuggcucuuauuguucucguuuacagcaccuguuaccuccacagacaaauaugguucuaugaauuauuucagaccaguaucagcuacuacugacuucuacaauuucccuaguggcccugccacaaaagccccucaguuuggauacucccagcaaugaaaaggggaaaaaaauccauagggaugccugcagcaaaauucuuaggguagaauuucucucuagaccagcucuaaaggaugggacuccacaucauucuauuuauuguugugggguggugugugcagggaucagggaggugaaaaugacaaucagagugggagaagaggcagauggagcaacagguacagugcagagacggcagucauauaaacaacugguccuaaguccuuguccaccucccauugggggagcccacccuccuuaaauauaggcaacuuuaacaaaacgagguuauucaccugagccuccuuucaccugucaaaguguaaugacaauccaaauuuucugccuuuuaguuuaaaguuuuggaucguugguauugagagaccuacuaaguaguguugugcuuugcuuucuucacuuguauugcugguuucacuagaaggaauugcagccuuuagcacucggaugaccuaggcaauuguucagcugguggcagagggcacagacucaggaagaucugguuccagguccaguuccaccacuuaauagcucugagaccuugagcaaauaacaccuaugacucaucugcagaaugggcaucagaguacccacuucacagggcucacaggguucacugccaggaauaagagaucaugcauaggagaugcucagagcugacaccagagaguucucaauaauguucucugccuggcucuugccucucugugacuuguucaguuuucccagcuaugagaaaaagaccagggccaugccaugauagaugcucaaacugaguguuaaucggcucucaauacauacuugauugaguucugcagaggaaagaagaguacaugauuuuuuagaauauucaugucaggcugucuuguuaaggcugcaaaaaauucaguaacaaugagggcugcggggcauccaaacugagagggcagcaaaugagcuguuuaaacuuagccuguaccacaucgaaaacacccacuacagcuuuccuuggcucagccaaccugcaggccaccaaacccacuuaagaugggucagucucugucucacuccccaagacaucagaauagaaaucaaagaggccauauccagcagcaaaacugaagcaaauguggggaggauuuaaaggagcacaacugccagcuggcaacaaggaagaagggcuucagguuuccugauaaacuuagcucagucacaaacuuaagccaguuuugcaacaaugcaccaaagagcuuauaaaagcagcuacccugcucuggguuucugcuccucagagggcugugcugacaggugcccacccaagcaugggcaaggaggccuggauguucuaggccaaugcacacaagguuggugcuccagcaaagcugcugcugugcacacuuccaacaagcagccugccucacaccuccaccccaccuucacaacagcugaugcugcccccaacugcacccccauacacccaauccugggcaacuaaugggaacucugugcugucacuugaugagaaacacucuacccacuauacacuccugagucuucuccaaguacccaggcagaaguauauggaaccucuggccuuggugcucccuccuauucauaggcagauucaggcccuacugacuacuuguggucuggaucacuuuugacagaagucgucucccaacaagucaucucucugauauccucuuucaaacuuccauuucagauuuauaaaagagaaggcaaaucccucauaacuucaggaccucagcauucugagcuagaaagaacuucaggagaucaugagacccagcccccacugaaaagauaaauguucccuccuugugccacugcaguuaaguacagcaucccccaggacaggcuuguuggcacucuccuucuuacaagccuucaguggcucccugcugcccuccgaaguaccaauaauacuaucucaugguguucaaggccugccuaaccuaaugaaauccuugcugauauucucugccuuaucgccccucauccacagcuaccccacgcucuggcuaaacucccccuaugcuuuucuuaguccuuaaugccaucucuuuccuugcuuuuugccugucaaauuucaaugcuuuuuuuuuuugagauggagucuugcucugccacccaggcuggaguacaguggugcagucacagcucacugcagccuugaccucccaagcucaagugacaguccauuuuuuaauaggcuagcuugagcaacaacuccaugcaguuuuauacauuaucuuuccauccuuucaaucucuagugccuugcuuauucuuuucuaaugacacuuccucuauucauuuucucuuagucauuuggcuucuuguuaaucauuaaacagacauuuacugaccaucuacuaugugccagguuuuaggaaaauuaaaagugagacauggccucucuacucuuuuuacuuuacuuuuauuuauuauuuuuuugagacagggucucacucuguugcccacgcuggggugcagugguaugaucacggcucacugcagccuugaccucccaggcucgagugaucaucccaccucagccucccugguaccugggacuacaagcaugcacaccacacccagauaauuuuuguauuuuuguacagacaggguuucgccauguugccucucuacucuugaagagaucacuggucuagugagggaaacaaauccauaaaaauuauaauacuugccaaguuuuccccaauagauuguauuauucuugaagucagaacaucuuuauauucccugcauugcugaacagagugcuugguacauagcgaauguccauuguguauauguucuaaaacaaagaugagugagcauuauggaaagaaaaacaauuuccucuuucugaaauguggggcagaaggauguugcaaagauagccuuuaacuugggauaaggggaaaauaaacuucuuauuuuuaaauguauuuuaauuccacagcaucacuccucaacccacaaggaaaauaagagaaagauacaaagacugagaauugcaaagacagaaacaagcaagcaucaaaauagaaugggauagaaguguuguuuaguucuuaacuacuacuaaaccacacacaucagacuuuaucaugggcuucagaguauuaucaccucugauaacaggauuugaugaacuauuggucauagcucuacaacugcucuuuauccuuaaacauucaaguauuuccuaguucaucaagcagaagugguuggugguuaggaaaacaagaauaagaacaauauuacuagagaccagcuggugaagccucugagauuauaugugaaaguuuuaaguacacauuuacauuuuucuaaaaagguccauaggucucaugaguuucuuagagaaaacuguaaaucacucucaaaacacauacauaaacacucauaccuugaagagccucugggccaauaauggcaaggccuugcagcaaccggcauccuaauaacuguagguaaggauaaauuagugcaaggcuuuugggcaucuggcaacaucuaucaaaacuguaacuguucauuccauuugacccagcagaugcuaugucuaggaauuuaucuaauagaaauguucacagaagugcacaaugauauauggauagaguguucacuauagcauucuaauaauuguaaacaaugagaagcaauacaaauguccaucaguaggggauuuguuacacaauacagcauaucccuucaauggaauauauuagucuucaacaaaaaagagggagcuuuguacugacauaaacaagaucacuaaaacuaagcaaaaauaaguugcauauauaugauuucaucuuucuuuuuaaagaacauauguuaauguggcaaaagcaacgucgucuaaucuaccaaauccucacauaaaaacagacugacuagagagcaaaacuaaacccaugagcaacauuucuaucaaaaccaagugcaaagguauugggaagcaacaaguuggcugagagaccuaagaacaagaaaacaccuaaguagcugauaggcauucacuaaaaauuauagugggccaauggguaacagcaagugaaccuaugucuaacaguggacaaggacaagaagucugggguaggacuucaaggggccacagcugucuaguccccugaacucucaaaauuaaccagugcucccuaccaggacagggccccacacugagaaaauacggcuagaagugaaaucaaaacugaguagacuuggacgacagaaauaaaggaaacagaguccagauaaaacuggaggaguaaaacagagccaggaaaccucauaaagcaagcugccauguuuuugaacacuaccugaaaacaagagaagagaaaacuuucucaagcuugacucagaaugaaaaggaaaaaaaaaaaaaaaaaaagaagagaaagcacuauggauuuagaaaagguaauuaaagccaugcuuuuuucuaaaaguucaagaaaccuaauuucacauaaaaaugagcaauagaaaguauuaugguacaauccuauacaauaaaauuauaauaaaaagaagaagaaagaaaagaauaacaucccuacauacaaugaaaguaagccagaaagacauggccacaaacauauaaaaacuguaacuuccuguuucaaaaugcacuaaagacauuuguuaaaugguacaagauacucaauaacaaaaaucagaaaugaggugcuagaggcuguguauggugacucacaccuguaaucccagcacuuugagaagcugaggcagcaggaucacuugaggccaggaguuugagaccagccugggcaaccaggauuucaggaucagcccagguaacacagcaagaccucaucuuuacuaaaaauaaaaaagucagucaggaaugguggcaugcaccugcagucccagcuacuugggaggcugaggugggaggaucacuugagcccaggagcucaagauugcagugagcuaugauagcaccacugcacuccagccuggguaacagagcgagauucugccucuaaaaaaaaauuaaauaaaaagaaaugaggugcuagaacucaaugaagaaucagaaauaaaagaacaaauaaucacaacagaaaaugccuuaagauaaauagaacaugaaaaggaggaaaguuggaaaaaccaaacagaaauggaaaaaguaagguuuguaacaaacuaauaaacaaugaagaaagacaaaagaagacccaacauaaauauaagaaacccuaaacaagcaaacagaauaccaaaaaccauguuucuuuuuaaaagcucaagaaaucuaauuucacauaaaaacgagcaacaaaaaagaauuauaauucaagaaagcuuuccugaaaugaaaaaaauacuuaaaacuauguauugaaauaacacacuguauaccuaagaauacugaccagggauguccaacaguaaggcauauucuaguaaaauaauuggauuuuaaaggcaaaggaaagaucacuugggcauauaagcaaaaaucagcaaguaacuuauaaagaaaauuagauugucaucagcauuuuuaacagcaaagccuacugccagcagaagaugaaguacucaaagaaagaaaaugugagccaaggauuuuauauccuaccaaagugcuuugggauguaaagaacacugacaaaguuaacauacaaaaacacagagauuacuguuucgaugggcucuuccugaagaauuuacuagaaaauacaucccagacaaugaaaauaaguaagaccggcgguaaacauuacauauauaguuauuuguauaaaugccuuaaauaagggcuaaaaaggaaguauauaauggcuacucugagaauauacauacaacacagcugguuaagaacaaugagagcacacacaaaaaaauguuuuaaacuauuuucaguaaucauaucagggauaguauuacugccauucugaaacuguugcauguacaaaaugagacagaucaaaucaguaaaauuauuacauauucuaauuguauaauccccuguguccagaaucaggacucucggugugggaaaaaaagaggcagauguaauaucgaagagauuaaauaaaaacccugccagccggaauaugaauaggcaguacccacuugaauguaugaggauuauaacauauauuuccuaucucuugucaacagaaaaggccuagaaacaaugaccaacacagcaguaaugagcgaccuaauggccagaauguagucuuaaaacuucuuagagaaacagcuaauuccaguccugggaaggaaauguacaagacgagcuuagaauaucuugucaaaccagacagcaagaaaacuaucaaagacuauuagaguaacaugaaaagaacucauuugaaaaccuucaacugaccaaaaaucaaacaauuucaacuucaauaaaaguaauaauuacaaugaauuaaagcccauaaaauaugcuuugaaccugugaguuuguaaagggaaaaaaaacaucuuaauuggucaucuucagaggaucaacucauuaucuugaaaacugguaaauaaggaaaaaagaaccaaacauuuauccugucuuuccuguaugaauuuuaccacugaguaacaaaauaauauauauggggaaauaccucuuuauaaaaguagugcagcuaaaaauaaaaaagaaaugauagauuugaguaucacccucuugcaaucccacaaaaagagaaucaaucagacauuaagcacuuccuaaugaaagagcacaaaacugccuauaguuuucccaaaggaauggaaccuguguccgauugagccccuggauccagcugacaauuugcaagaaauacagagguuggagaaacaugccgaacugcaucauuuaugaaaucagcaaaauuuagccugggaaauggccugagcucuucaacagacaauuuauaagaagaagaagaaaaaaaaaagcaggggguggggguggggaauagauagguaaccuguagauucaaagagacuuaaaggauauaacaacguuucuuaaaugggcaacacuauagucuugggugcaaaacuuagucauaaacuauuugaaaaugcaaaggagcaauuauuguaaaaaucaggagagugguuacauuugguaggagggaaauauuacaguuggagggaccugcugaagugcucggcaaaguucuauuuccugacuugggugugacuucaccugguaauaacucauuaagcuacauauuuuguauaauuuucuauaucuguguuuaacuuuauaauaaaaagagucuuaaaggaguauauguuaucucuggugaagaaacuggacuuagaaggacuuguacuuccuaaauuauacauuucuauaauuaggauuuuuuuauagugagcauucauaccuuuuauuauuagcauuuuuuuuuuuuuuuuuuugagacggagucucacucugucgcccaggcuggagugcaguggugcgaucucagcucacugcaaccuccaccuucccgguucaagcgauucucugccucagccucucaaguagcugggauugcaggcacccaccaucaaaucuggcuaauuuuuguauuuuuaguagagacgggguuucaccaucuuggucaggcuggucuugaacuccugaccucaugguccccccgccucagccucccaaagugcugggauuacagucaugagccaccgcuccuggcaagcaaauuuuuauuuauuuaauuuuucugggauuacaaguugcuaaaaacaugacacauucauggaaaaaauacauaauuccuuuucuaggcacaaaauaaauuacuucaaaacuauuaaaaguauaaaacuguggcauauauuuuaaaaagaaaaaggggagguagcugcaaaaaacaaaccaaucauuugguaucuuuuauuauaggaaggguccauuugggcuucuuuaaaauaugcuguuauaauuggggucuauuauaaauuauauaccuaaaacauauuaauacauucuaaaaugaaaaauaacucagaauaccagucauaaauaacauacacuauucaaacacguacuaacacauccugcgaaauagagaugaauucaacgaaucaaaaguauauugcgaauauaaaaccagaaauaaauccauacaugcauuuacagccaauugauuuuugacaaaggugccacaaagauaaaauggggaaaggacagucucuucaauaaaugguauuggcaaaauggaauauccacauguaaaagaaugaaauuagacccuugguauauuugucauauaccauaugcaaaaucaaaucaaaauagauugaagacuuaaauauaagaccccaaaccaugaaacuacuggaagaaaauacagugggaaagcuccaugacauuagucugagaaugacuuuuuagauuugaccccuaaaagcacaggcaucaaaagcaaaaauagacaaauaggauuacaucaaacuaaaaagcuucugcacagcaaauaaaacaaucaauagagugaagagacaaucuacagaaugggagaaaauacuugcaaacuguacaucugauagugauaaauacccaaaauaaauauggaacucaacucaacagcaaaaaacaaauaaccugauuuuaaaaugggcaaaggaccuaaauaggcaguugccaaaagaagacauacaaauggccaacagguauauaaaaaaaagaucaacaucacuaaucaucagggaaacacaaauuaaaaucacaaugaaguaucaccagacaccugucagaauggcuacuaccaaaaagacaaaagaaaaguguuggcaaggauguacagaaaagagaagcuuuguacacugcugaugggaaugugaauuagaauagucauuaugaaaaauaguauggagguuccuuuaaaaauuaaaaauaaaacuaccauaugauccaguaaugccacuacuggguaaauaaccauaggaaauaaaaucagcaugucauagagacgucugcacucccauguuuacuacguuauucacaauagccaagacauggaaucauccucaaucuccaucaaugcaggaauagaauacagaaaauauggaauacuguuuaaccauaaaaaauaaggaaauccugucauuugcaauaauaugggugagccuagaagaauuaugugaagugaaauaagccaggcacagaaagacaaauacacauuaucucccuuacauguggaaucuaaaaaaguugaucucauagaagcagagagcagaaucauaguuaaccaggacugcgguaguugaggaggugggguagaggcuggggagauguuggucaaaggauacaaaguuucaguuagauaggaggaauaaauucaagagaucuauuguauaacaugguaacuauaguuaauaauauauuguggcugggugcaguugcucacaccuguaaucccagcacuuugggagaccgaggcagguggaucaccugaggucaggaguuugagaccagccuggccaacaugguaaaaauacaaaaaauucgccaggcuugguggugggcaccuauaaucccagcuacuugggaggcuggggcggagguugcagugagccaagaccacaccauugcacuccagccugggcaacaagagcaaaacuccaucucaaaaaaaaaaauacauaaauaauaauaauacauuguauuccugaaaaaugccaagagaaagaauguaaaguguucucaccaaaaauaugauaacuaugugagguaaugcauauguuaauuagcuagauuuagucauuccacaacauagcuauacuuuaguuuguuuuguuguuugagacaaggacucacucugucacccaggcuggaaugcaguagugcaaucacagcucacugcaaccuugaacucuuggacucaagagauccucgcaccccagccuccggaguagcugggacuacaagcaugcaucaccacacccagcuaauguuuuaauuuuuuguagagacaaggucuuacuauguuucccaggcuggucuugaacuccuggguucaagcaauccuccugccuuggccucccaaagugcugggauuauaggcaugagccaucauggcuggucuauuuauacuuuaaaacaucauguuguacauggaaaauacauacaaauuuuccugucaauuuuuaacaaauaauauacauaaauaaaaauauaaacuauauauucacaaugaaauaccugacagauauuuugcuaggguuaggcuuuacaaggaaaugguccagaagucugggaacaggggccuugcacaaaugcaaaucaacgaacaagaugcugaguucaaccucaaugccuuuauuccacaugaccuugaacagagcccucaccugaccagccaaucugacccucaaggaucgcacagugaagccagagugaaagagaauguguacuucaggaggauuugcucccacauuggccguaguuugugaggugggaguggaagggauuaaagaguuuuuuaaaauaggaaucauuucccuucauccccucuugccuucagaacuaagcaucucuuucucucucugucuuuuuuauuuuuauuuuuuuugaggcacagucuugcucugucacccaggcugcagugcaauggcacaaucuuggcucacugcaccuccgccucccggauucaagcgauucuccugccucagccuccugaguagcugggauuacaggcacaugcuaccaugucuagcugauuuuuguauuuuuaguagagaugggguuucaccauguuugccaggcuggucuugaacuucugaccucaugaucugcccgccuuggccucucaaagugcugggauuauaggcgugagccaucgugccuggccagaaucucuuuuuaugagguuauguuuaauacuaaacacccauuaugacugagaagcagaaauuaccaaccagagucugaaagcacuauccacagaaaccucugaaagaagaguguccuaaccaaccuggacaggguucagugcaguucugccuggaggcagauggauggaagcaugacauuuuaaaaacucccauccccuagaacuuuauuuucccucugcagcaggagauaucucaaaacaaggacauuaguccaaacuacucuauagaggaaaagcaauaauccaaggacuuuucugaguauguagcaaccacugagaugcaugaaaaugauacgugugccuaguuuuuaugucuacuccuacuaacuaugcaaaacugaaacuaguuccuuaaaaacaaacugcuccuggacacccuacacagucgcugccgccucccugacucugcagacaucaguaacagagcaugucauagggaauaaaacacaaucauaagguaaugcuacauaaacgcuaguguguuuauggggaauaaaugucaagguaaagcaggaauaucuauuuucuaugugggagauggugauucugugugucaaugccccauuauacugaauugauuuuaguuuugccaaaucacuaaaauauuucacaaucuccuuuuggaggcuguggcugucauaaugacagaaucugcaaugaccuuucacaaggucuacuuuccaggcaucuggacuucacaaucuccuccauucuaagguuccauuuucccaggaaagaggcacaguagggcauggaaagcuggccaguugugauucauucccaauacgaucugccaagcaggcccauccaugcucuugguaucuugaaauuccagagaagcuagacuucaaguccuucccaagacccuaauguccugucauuuagucccuucugaaaguugcuuaaagugacauaagggaagcagcuaauuuacaguccuauucuuuuaaucuuggucagccagauuuucacagacaucaguuuauuucacuuuauaauauauuagacaaaacaacaguaccggaaucaguuccaaggcagcaacucacucucagggguucugcugacauuuauaaacugauccuauuucucucuuguguuuuguuaucagcuaaaccugucaacuuaaauuauugccuuguaacaaaaucagaguuaucuauuacucugguauguguacauuucugaagcuuuguaccuauaucaaguuuugcaaggguagaaaacaagaccauaaauaaacaaauggaaaacagaauauguuaccauuucacuuuaguaacagaagcuaaaagucaaaugcauuacauggaaagccacuaaaacagccaaauauauagaccuugggaauagcaaagcugauacugauacagucauuugcgcuuugccccauccugcaaucaaucucugggcuacaguaccucagaguuccuccauuuccaauuuggaggaguaaaucugauuauuccuagggccuguaacaagugaguagacauaaaaaaacugaggacacaaugucaaaaagcucaaauuuauagccacuucauuauuucaccaguacaguggacuaagaaaccaauuccccuucuauugguauggcuaauggucacucuuacucaaagaccgcagugaccuaaacugagcaacaaaagagucaccagaaagaaagaaaaaagcaauucucggccgggcacaguggcucaugccuauaaucccagcacuuugggaggccaaggcaggcggaucacgaggucaggagaggagauaagaccauccuggccaacaugguaaaacccugucucuacuaaaaauacaaaaaauuagcugcgcauggcagcacacaccuguaaacccagcuauuugggaggcugaggcaggagaauugcuugaacccaggauguggagguugcagugagccgagaccauaccacugcacuccaaccuuggcgacacaguaagacuccaucucaaaaaagaaaaagcaauucuuccccaccaccucugacccugccccagggcuaauucuuauucuuuaacuauucccucccccacauucaaucuaaaaacaaguuguuucccaaauuuuucugggauuucauguggcuuaauacauaauaccuuuaugaacaaaauacaauuccuuuuuuggauacaaaauaaauaaaucacuuccaaacuacaaaaagaauaaaaccgugauauauaucucaauuuccccuacauuucuacuauccaaacccaagccaagauuuucuuguuauuuuacauuuuuagacacuuuacagugacccaaucuacaacaaaacuccaucucccuaaacuguuguuuuacggacugugauuccagucuagcaaccuuuuuaauucucucaggaacugacuguuuaacccccuuagcuuuucccaacagcuacuaccuuaccucuuaagcucagaaacagagaucucaccauacagcaagaacuuucccaaaagccuccucuuugagaaaaccucaaccugaaagggcagaguagagggcacaguuccacacagaggcaccaaaacagucacuggagugaugggaguugagagguaucaaaaagacacuugauaaccccaacacacccaaaauccuacuaaucaaaucucauuguuacagagucagcucuuugauccaaaucuucagauuaugcuaggccaaaucauaugcuuuagugcacccuaggaggaggagauuauaguguugcgggggagugguauacaugauugugcuuccucaucauccucauucucucuaucacacuccagacaaacuauagcacagagcaagaaggcacccauccagaggggaacugagagaugagauauuuaguuuggguccugagccacuugugcaauauggauguauuuuuccaugcaaaaucucacauucacaucucuggguacacaaacaauauuugguuacugcacacuuuucuuugaccaaucucaccuugccuaaaaauaguuacaaagggcuaagccugguggcucacaucuguaaucccagcacuucggguuuccaaggugagaggaucucuuggguccaagaguuugagaccagccugagcaacacagugagaccauaucucuaccaaaaaaaaauuuuuuaaguuacaaagaauuauaaugggcaaaaauuguaauugacaaaaaacuuccuaauucucauuccagguuucaaaggaauuuaaaaaaaaaaggggaggccuuaauuucuggaaucaucucuccugaagcccuccagacuugauuuuuagaauauaggucuugaaagcuaagcauuuucucagcugauccuuuagguuucaccagaccugcuuucuccaccacuuccugcuggggagacgcagaacagcaggagaaggcaaggcaacuugcacaggccagcugcacuaccaguuguggcuucucugcucggccucacaaccugcaugucaacucuucccgaucccaguggauaaaaaaccacuaccacacugcacacaucaaaugccaggcacgaggcagagaccuggcauuauugccaguggcuuuagcuagaaaaaucuagcacuuuucacuugaugacuuucaauuaacaaaacugccaaauaauaaugauagucaccaagcagcuguuuaagagauacagugagagaggggacacuguguuuccacaucagcagucaaugaagcuagaccaguauuggccauucacuuucuagaccagcacuguccaauagaacuuucugcaaugacagaaauguucuauaucuaugcuggcccuuacaguagccccuggucacauguggcuuuugaguacuugaaaugugacuagugauacuaagaaacugaauuuuuaauuuuuaaaauguuaauuuuaauuugaauaaucacaaaugguuagugacuaccauaucagauagcacagaaguagaucuucauuucacaaauagugcaucccuggaauauugugggggcccagugaaacaucagaugaaaaggggcuuugagaggcauggugggcagcacaagcaugaguggaauccuggcgccuugcagcaaaggccccuuugggggacucaaaucugguuuaccacacugaguaccuccugccaguuccaauucaggagacccugagccaaggaguaaaccagagcaguggcucuccagaguagucagcuaggacaccaggggcccauuagcacuacaucucuucugaggacaagaauuauggguaauucgcucucuccauagcuaauuguuauagcagauacccaacucccugaaacaaaaaagcucaagggccaucuccacaauugaaaggaaggcugaguauaauugaaugcaaacauaaauaauggauaaaaacaaguacagaaugugcugcccucccaaacaauucaagagaacucuuucagagauggaggaagacaggauagaaaauaacuuacuaacaaagggcaaagggacaaugaacugcacuguauuuuaguucaaguggcugcaaauagaacaaaauggaaaguuaaacucuacugaauaaugucuuauaagacuaacuaaaaccaaaaguucaaaaaaguaagaaaaucacuucacaaccauuuuauucaaauacagcccuugggguuuuccccauuucugagguuugaaggaaucaucuccauuagcaaauaugcacuggcuacaccaacauuuuacaaugacuuuuuucuuccccacacaaaguccaacuuuagaaaaccaaaagcaaguacuugaaaaccugggauuccuacuuucucucauguagccacagcuaucaucucucagcaagucuccaaaaccuauauuuacacuucugaucuuaaacaaaauaauuucuuacauaacugaaagcuaccaacuuuacugggggugggggguggcacauauuauuguacuuggcaauagaccgugaaugauguauuuuucuccaaauaaaacuaaauauaaacauaaaacuugcuggauacagauuuuaccacccauuggacacacuaaugaaaacaguuaaaucauuagguuuuuuaauuaagaagucaacauacguccauucauuuucacacaaugcauacaguguggacacaaauggaucauuccacagaaaaagcugugggcuaauguuguccugaaagauugaacacuggcuagcuagauuaugccaaguccuggcuagagcuuuuaaucuuaaucugacuacuguucagucucugccaaaaaccaaccugacagagcagauauuugagaaagauagccuaaaggacaggcucuucauguauucuacuaagaggauucuauauugcacucuaguaccagcuuaagacagaagcauacacauuagauuugucccauaaaagacaaacucauacaacaccacuuguauguccucaaauuuuguucagggucuauuacauaaggaacagacugcaaaauccauuccugucuuuucugaaacaagcuugucauuguccaguacaugguuaaucucuaugauaaaaaugcuuuuagaucaauucuuaccagcaccaggaaaaagcugcuuucucagcagacaacugacugcugagaacuauuagcuuuuuaauuaagugacaauuaugugauucaucauauuucccuuuuugucuuggcuaccaggauguucagaaacuauauuuaauauuuggaaccuauaaccaaaguagccaaguugguuaugauauuuguuuuucgccagucccauacccauagaauuuaaauuaguuucaauuuauauuuaagcagucuuccauauauguguauuucacuaaaagcuaauuaaaauccuuuuuauuagcaggcagcccuaaaaaagaguuggacuaccucacuaagcacagcauuaaccacuguuaucgcaauauggcgucaauguugauccacgugauaaauuccuguccuacgacagacauucaagggaagggaagugggugcaggcagggcacugggaagggcagcaugcuacaggacacagagucacucaagaauaaugaaggugagaaaaugcccuuucaaaaacaauuagauguggccugcaauauaaauuuuuuuauuuauuuuucugagacugggucucacucuguagcccaggcuggagugcaguggcacaauuauggcucacugcaacuucugccuucuggacucaagccauccucgugccuuagccucccaaguagcuaggacuacagguacaugccuccauacccagcuaacaauauaaauuuuagacagggcagauauuuucuacaaauaagaaaacaugacaaagagcucaagaaacccucccuaguucuuggcccucuacaguguaccacccugcugugccaugaaccacugucaugaauggagccuccguagacuaugugaauggcuacaagaaccacagaagaccaggcacgguggcucacaccuguaaucccagcacucugggaggccaaggcaggcagaucaccugaggucaggaguuugagaccagccuggccaacauggugaaaccccaucucuacuaaaaauacaaaaauuggccaggcacgguggcacaagccuguaaucccagcuacucaggaggcugaggcaggagaaucgcuugaacccaggaggcagagguugcagugagcugagaucgugccacugcacuccagccugggcaacagagcaagacucugucuuaaaaaaaaaaaacaaaaaaaacaaaaacacacugagaccagcccaagccauucucauugcagccuaguaaauauguacagaggaagugagaagacuucuaaucuuuaacagcauaagggggaagagggcagaauucuaaaagaaaucuagcauuacaaauuaccacuugguacugggcaucagaauagcugcuauacacacaucaucuuguuuaauuuucacaacaaucauauggggcagguauucccauuuuacagaugagaauucuuugguuacacaacuaguacaauucgacaaauguuuaccaaacagaaauuaccaggcauuuuguauccugcaacucacaguggucccugccuagagcagccuucaggcugaugauagaacugagucucuaaccagguuuguauggcuucaaaagcagcucuuccauugcccaacacugccucuucucugugucugagccagugugaggguaugcugagucugacagcaccucaggaacaaccaaauccugacuagcugucaacaccuucccugcccaccccaagaaagcugauugaaacaaaauaggaaagucucuccccaugugcuacaagucauuugauacaaagaccagaaucuauguuccaagauagggccuggaagcccccgcaaagcagacauuauuaaagcucaaaagagaaauugguggagacugguauaauaauggauucccuaagggcugaacagcucagccccuuugguccaaagcccuucuaucauucuuccugucauucuuggaaggcagcaauccacacuucaauuacuuggugucuugaugaacugcugaacugaauuuaucuaaugccagguuagggccaagguugcuaugugggaauggauuccucuagagaucaguaggaacacacgugaaacuuccaaucacguucuuaucaaucauaaucagugagauccuagucaggaagcugaucauggauuaagcccaucagaucagccccaucagucauauagcuccagccauggaaagucagucccucccgaacuagacgaacaggaaggccccaggauacccaggagagagcaggccaacucaaaaagcacugaagcagcagucuuugagcaugggcacugggccaggcccugcaggggcucaaggauucaaaugauaccaacugcuccugauuuaggagcaagaagcagggaauaaagcaaguccauaaauuacuguaaccugaggcuugaugugagcuucaugaaagaggguguggaggggaaggggaauauaaguaagagcaccugccacugggagaaacuagggaggugaaaauucagauguaccuugaagguugaggacaauuuuuuuucuugcuuuauguuuucucaucacuacaaaaauacacaaacauuauuuuuaaaaaaucaaauguguuccuauuucuccacauccucuccagcaccuguuguuuccugacuuuuuaaugauugccauucuaacuggugugagaugauaucucauagugguuuugauuugcauuucucugauggccagugaugaugagcauuucuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcaaaaauuuucucccauguuguagguugccuguucacucugaugguaguuucuuuugcugugcagaagcucuuuaguuuaauuagaucccauuugucaauuuuggcuuuuguugccauugcuuuugguguuuuggacaugaaguccuugcccacgccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagauaugcggcauuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcgaugcgggaacacuuuuacacuguuggugggacuguaaacuaguucaaccauuguggaagucaguguggcgauuccucagggaucuagaacuagaaauaccauuugacccagccaucccauuacuggguauauacccaaagggcuauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaugaugaguucauauccuuuguagggacauggaugaaauuggaaaccaucauucucaguaaacuaucgcaagaacaaaaaaccaaacaccgcauauucucacucauaggugggaauugaacaaugagaucacauggacacaggaaggggaauaucacacucugggaacugugguggggucgggggaggggggagggauagcauugggagauauaccuaaugcuagaugacacauuagugggugcagcgcaccagcauggcacauguauacauauguaacuaaccugcacaaugugcacauguacccuaaaacuuagaguauaauaaaaauaaaaauaaauaaaaaaaaauaaaaaaucaaauguuacaggaauauauucucacacuguaauucccauaaucaucauuucucaaguauaguaauuaacaagggcacaguuuugauuuuuuucucuauauacauuuacacuuaucacuaauaauuuuuucuagaauggaaucauaccauacauacuguugugcaacaugcuucaccaucuagcagcaugccgugaauagcauucuguggcaacaaauguacaucccaacagugccacaguauuccauugcaauggauauaaaagaauaugguuuuaacagguaaaaaugauacaggcuaagggacgggggaguggagaaggagagaagagaaaaagcuacagggugaaaaguagcaugaacaaaaacagggaggaaggaaaguccagggcacaaucaggggaaacagaagcagucccauggcuagaaaaugaagugaguguguacaggaccacaguggaaagaaagggggaggucguggggccucacaguucagguugagaaguuggaucuuaacucuaaacagugggaaaccacuucgguuucuucagggaaaaaucuugugacaauaagaacaguggcuuugaaagacuaauaugguggccagcaauuguaugaugcacugagaggcaaauacaccuggcguugggaaaacuagguagggagcuguuggcauggcuuugaaagaagucauggaguggaaacgagagcagugggaauggaaauaagugaugggacagagcaaugcaagugacuaggcugggagaaaggaaggaaggagaugcccaaguuucaaggugagguaacugggagaaugcugaugucaugauucaacaggaagaacaaguuuggagggaaauuaucauaaggcugguuuagaagacuguggagcaugaaugggacaggcaaauauauaccaggggcugaaaacaugggauggggcacagcaagugaggaugaggcuggaaacacaggcuuggaugucaucugcauggcaaugagggcucgagccagaaaucucugagggagaaagugaagacagaagaaacaauauuuaugacagccuugauaaauggcuacaucuuuccagaugaaagaagaaaaggagucaggaaagagcuaacaauggacuccagugaaacaacagauguagaagcaauuugccggccagcuuggugguucacaucuguaaucccaacacuuugggaggccaaggcaggaggauggcuugagcccaggaguuugagaccaacugcucuccugggcaacauacugaaaccccgacucuaccgaaaaaaaaaaaaaaauuagcugggugugguggugcacaccuguggccccaguuacucaggagguugaggcaggaggaucccuugaaucugggaggucaaggcugcagugagccaugacugcaccacugcacuccagccugagcaacagagugagaccgucuuaaaaaaaaaaaaaaaaaagaagaagaagaagaagcaauuugccaaauuuaacuucuacauaaaugaguuucauuuuuuuauuuuuauuuuauuuuauuauuauuaguuuuugagacggaguuuugcucuuauugcccaggcuggagugcaauggcacuaucucggcucacugcaaccucuaccucccagguucaaacaauucuccugccucagccucccaaguagcugaaauuacaggcaugcacccagcuaauuuuuuuuguuuuuaguagagaugggguuucaccaguuggccaggcuggucucgaaauccuaaccucaagugaucccccugccucggccucccaaagugcugggauuacaggcauaagccaccgcgccuggccauaaaugaauuuuaaaauaaauuauuggccgggcaugguggcucaugccuguaaucccaguucuuugggggcugagguggaucacuugaggucagguguucgagaccagccuggccaaaauggugaaaaccugucucuacuaaaaauacaaaaauuagcugggccugguggcacaugccuguaaucccagcuacuugggaggcugaggcaggggaauaacuugaacucgggaggcggagguugcagugaguugggaucgcgccauugagcuccagccugggcaacagagugagacuccauuugaaaaagauaauaauaauaauuaauuauauuucuuuuuuuaaaaaaauuauauaaauagaaauggggucuugccauguugcccaggcuggacucgaacuccuggacucaagcaauccacccaccacagccuccacaaauaguaggauuacagguaugagccacugcaccuagccaauauauuucuuucuucauccccaacucauacuccacucuucaggccaacaaucagacaucaacaccagcccagaccccaggauccuaacuuccacccucuaggcauuacuucauuccuaauccaacauccugcuacaaucccaucucuuucccauaugacaacaggguaagggaaucaaagggguugguaaguaucuuagaaaugauaggugccaugagguccaugcuguguggggaagagugaggccacaaggacauugaaagacucuaagaaccaagacaggccuauaaucccagcuacuuaggaggcggaggcgggagaacugcuugagcccaggaguuuccaggcugcagugagcuaugaugaugccacugcaccccagcuugggugacagagcgagacccuaucucaaaaaauaaaaauaagaugacugcugaugggcuacaguccuggcucccugaggugaaacaauaggcuuaugggaacugggggagcaaucauacuguuuugagggagcagucauacuguuuuaaguucugggagagaagacaauagaggaggugaggcugacagguuaugagaggaaaaugucaaaaguaggggaaggccacaggagaaguggguauggacccuagaguuucucaggauauaggagcaacugggcuuaagagaaaaccuucucccuuacaccaaguucucaaacaaugggaagaagaaaaagccuccucagggagagguuaccagaccaccccuccacaucccaaguggcuaauguggcuagcauccagccacccacccacagccaggugcucacucccucccuccuccaaaccagccaaggcagcuggcauccauguccaccauaauguagguaccucccuggcccaccauggaacacugccucugcuccagguucuauccuuugcccucucuuuccaugcuaagcaaucauuaggcccguggagcugcugccacuggagcucagacuccucugaaaagaugacagagaaucugacccucugcuuccugcugcuguucugcccacaaugauucuuucauucacuuguucagcaaacaguugcugacugcugacuaagugcccuuuccuuuuugucauuucucugacaaauaacagugaagucaaaaauaucaugauacauuuucaaaauccaaaucauuccuggucaguugacuggcugacaauaaagccuuucuaauaagugggauuucauuccccaugggaacacaugcccuguccucaaaugccagggcugagcucauucuaccugaaaagcagaguguaacuucugaugccaccuccacuaccccacccagcuccuguccaucagcucaguuucuaagaacaauuucuggggcaauaaugggaagaguccuugugaaggaaguccagugcgcacaugccuggacuccaagcuauuccagcuggacucccaacuagacugccuauacuguggcagauaagcccagaauccuccauggcccuuucaagggaagacuuggcuuuggucagcagacagucuacacuuuucagcuccugcagggucugccucaguugcagagagcuacuuugcaugaagucaugauuguuuaggacagccuguaacuagugacugagccaggcauggauauaaaaaccuaaccauuuuagccuaauucaggaucaucugaaggacaauacucacuucagaacuccucacugggaugcacaagacuucaucaggcuuacaucaaaguuugacugcuuccucugcccgauccuacuuccucccccuuccuuuuguaggggucgaucucuaauaaacauacugcauucaaaccucuaucucagcaucggcuucaggagaacccaacccacaacacuuaccaaaaguuuuucaaauuugagaagcugcuacaccuuguggguucuguuuguggcagaacuccaagcucuaguauauacgguuggaacacugucuuagaaaggaggaggcagaaauaguaaauauccccucugugacuauuuaacauuugaaagacuccugagaaggccuuuucugaacugaaacagugggaaaagauuucaacuguccagcaccacccauaaaucauaaccacauucucuaguuagcacauacuacucacuacucaaucacuaguucagauucuuacccuucccuugaacuucugacucuccacucucaguggaggccuggccuucuacaucacagagcaaacagaagcugucagacagggucuccccagcuucccaccagcaaacagauggaguccaccuuuugaagaacuuuacuucuuacccacccucucuccugaagcuuccaccugucccuauguacuagagucucucaucagcauuuauaaauaguuucuuuuuguuaaaaaagacauaaagaguccaucagcagaugaauaaacaaauuuguccauacaaugguaucuccauacaaugauacauuauucagccauaaaaaggcaugaaguauugauacaugcuacaucaugggugaacuucaaaaauuauuaugcucagugaaagaagacagacacaaaaacucauguauguaugacuccauuuacaugaaauauccaaaaugaguagauccauaaagacagaaaggagcuuugugguugucagauguuagaggauagggaaauguggauaaacugcucagcggguaugggauuuccuuuugaggugaugaaaauguuuucggauuaaauagaagcggugauugcacaacauaaugaauguacuaaauaccacugagcuucucacuuuaaaaugauuaauuuuauauuauauaaauuuaaccucaauguaagaaaaagaauaaagaaaaacuucccuagaccucuucuggguagcaucuuuucucaucuccuuucauuuuucuuauacugauaacuucucaaggaaugucuagaccuccuuacccgccauucacuccaaagcccacuccacaccacuccacucucacccagugacaaccacugaugcuucucacuccuccccuccugagauuucuuggcagcacaugacacaggaggccaguuccucaguccuaaaguaaguauucugcccugacuuccuugagacugaauaccugaugaguuccugccacuacagccucuccuuugccagcucacccucuucuaccugacuguuaagaguugaaacuucucaggaugcucuugauucucuucuggggcucaucaguucucaugucuccaacugccaucuagauacacauacacacaaacaggagcgcacagaaauaaaacuagaaugaccuacuggauaauaaaacauauugcaaaaccucuacaauuaaaaugguuugauacuggugcaugaauagacagaauuaccaaugaagcagaaaagaacauucaaaaacagacccaacugcacacagaaauuuaauauacaguaagagcagcaucucaaaucuauagggaaagcacuuucuuuuuuagacagggucucgcucugucggccaggcuggagugcaguaguaugaucacugcaaccucaaacucuugggcccaagcgauucucccaccucagcuucuggaguagcuaggacuacaggcacgcaccacuacaccuggcuaauuuuuuuucuuuuuuguagagacaggaucucucucuguugcccagacuggucucaaauaccuggcuucaauccaucugcccaccucagccucccaaagggccgggauuguaacaggagugagccacugcaccuggccaagucaaacuuuuuaauaagcaguguugggauaacucaacagacauacugaaaaagguaaaaauuaaccccaugucuuaugccuacaugucaagauaaauuccaaacaaauuaaaucuuuaaauauacaaaaugaaaacauauaaguaccaaaagaaagcauaggucaacuacucuauaaucugggaguaguaaauaauaacuuuccuaauuauaaguugguggcaacaacuuguugaaaguaaauaacuuuccuaauuauaauucaaaauccaaaagaaaucacaaaaauauuaauuugauuaugcaaaaauaaaaaguuuuauaaaaaauaaaaaugcauggaaaaauaucauaagcaaaaaagacaaaugucaaacuagguaaaguaucugcaauuuaauaucauagaguguuaauauccccaauauauaaaaaacuuuuaaaaaauaaggagaaaaagaccaaaaacacaauagaaaaaaaagacuacagauauaaacaggcaggucacagaaaaagaaauacaaugcuauuugacucuaugaaaagauguucaacuuugcucaucacaugacaaagauaaaauaaaacuacaguagaaaacugcuuuccaccuauuagguuguaaguacuuugcaggcgagacuagggaaaugaaauuugcauauacagccccuauaaaggggaauuugacaacaucuaauaaaauuauaacugcauuuacccucugacccagaagucugacuucuaggaagugacugcaaagauauguuggcaauaaccuggaugagccuggaaguagauucuuuuccagagccaccagaaagggacacaggcuggccaacacccugguuucaggcugugagacccugaacagaagacucggcuaaccaggaccuagauuucugaccuacaucaacuaugaaauaauaaaugagacgguguuugaagccacuaaguugguggcaauuuguuucacagcuguaauuugcaauacagcccugcagaugggggaaaggguucacaccaaggcuggaaaugggaguaaguggacugugugagaucuuaggccaucuaguuuggcugaaacagcagacaggcagagcuaaggacuuagaauagcugagguucuugaggccagcccuccuugccugaccauccaacgggaguaugggagcaggaggugaagaaaaaggucaaggaggggaaaccccuggcaggcugcaucgcugguacugauaaaaagcauaugaucacuaagacuucagauuuacccuaaagaaucuauaaguacuucuguuucuucuacuuucccuucucccucuaggccuccccucccuucuuucuuggacacucagacuuuaaacuggaugaccuugaaaaagguaggaaaaaaauuuuaacaaaaagggagcccauuauuugguagaaauuucuccuuuguaaguuuuccuuuuauauaagucuauuucuguagauaaauugaacccaacugugauauuuaaaucguuuuaagaaaguacauucuguuuuacuugcaaaaagaggggacccuuggccucuuccuugagacaggcgaaauggaaggggaugcaagauacccugcuuauuuaucuccaaaagaaaucuauagccccaagcccagcccaauuuuugugcccagcaggaacaggccuuuguucagagaacaccacagguaugaugggcaccacaccaaaaacagaaagcagaaccgcuacaucuuugggcucaagacaacgggaacaugaaaacaacaggagauggagagugccaggcacaagggaaauaccuuuuaucuuacauuuuguugcuccuaaugaccuuguucaggccucaaaucaguaugacuucauucuuugggaaguauauucuauggaagcuuuaaaauauauuaugagguugcuaugguuuaaauguggccuccaaaguucauguguuggaaacuuaauccugaaugugacaauguugaaagaggugauuaggucaugagggcuuugcccucaugaaugauuaaugucacuaucacaggaguggguaaguuuucgcaagaguaguuuauuaaaaaagcaaguccagcugggugcaguggugugccccuauaguccuagcuucccaacuacauggaaggcugaaacgcgaggacuugcuugagcccaggaguccagcccaggcaacauagcaacacuccgucucuuuuguucccccccacaaaaggcaaguucagccccauucugcucucucuccagcaccugcucugucaccacaugaugccuuuggccacguaugccacagcaacuaggcccacaacagaugcagcuccucaaacuuggauaucccagucucuagaauuguaagaaauaaaucuaugcucuuuagaaauuacccagucucaauuauucuguuacagcagcauaaaauguacuaagacagagauaaaucaaguucuaacacagggagacagguguuauugaacaggugccguccacaauccuucagagcgcaguuagcuccaucucucuucccacacuaacccaguccgugugugugaaaagguaauaaccugacacaaucuccauacccuggccauugcgcugaggauagaagagauugguucuucuccgugaugguuaauggaggucuucaaaacucuuucaaucccuuacccauuacauuuuucuaagguacuuuuaaauccuuucaacucuguaucuacaacacacugugugagguaaauuuucuuucauuugucccaaauuuaauucccuugggaucacaugaugucaggcucuacugaacaggauuuguugaaccaguccacauucccacuaucuuuacccuauaaauuuucagugcauggcaaagagaagcucaauacauacugugaguagaugaauuuuccuucucuggcuuuacuccacaucaaaaagucccaugcuuucccccacugucuucaaauccacacauacuccacaucugucaugggcugaacuagaaucagaaauaaguguuccuccucucaggaagccaguccuggaucauguuucagguuuaaacaugaaauggggaggguaucaucauaaaccagcccucaccugcagcggaaacaauuucugccaggaaaguaguaaaugaagcuauuuauuugcucuuccugcugauggagugaacacaucguguuucuguacaacccaccuccaaccugacucucauuuccaugcugagcaaaaguggaaaagaaacaauaggaaucauguccccauuggaaugggaaaccacuggaaaucucaaaagagaaacaaaggccuaaacacaaacuccucacacaccuuaagaauaaacaggugauacaacagaauucauucuaucauucauuagccaaucuuuauugaauaccuguuaugagccaagcacagcccugggcucugaagauccagaugugagcaagacagaccaaaaucucuguccacucagggcuuacauucuaguaguggaaacagacaauaaacaacacuaaguaaaaucuauagauuaaauaauaagugcuaaggagcaaaauaaugcagggaaagggauaugaaauguuaagaaaggcuaaaacauuuuugaaaggguagacagagauggccucauagacaagguuaguuuuguuuuugguauuauuuuggacuuacagaaaacucagugauaauacagagaguuccuagaauuucuguacaacauuuacucaguuucaguuccccuaaugcuaucaucuuauauuaccauaguacaguugucaaaacuaagaaaccaacauugguauauuaguguuaacuagacuccagacucuuuauguuucacuaguuuuuccaugaauauccucuuccuguuccagcauccaauucacaauaccacaaugcauuuacaugucauguccucucuggucuaugccaguuucucagucuuuccuuguuuaucaaaaccaugauaguuugcagaguacuggucagguauuuuacagaauguuccaccaucuggguuugucugauguuuuucucauuagacuggggucguugguuuugaggaagaauaccacaaagguaaagugucccuuugucucaucauaccauagggugcaucauauccacaugacaacacuggugauauuacccuggcucacuugauacccuugaucacagguaguacuuaccagauuucuccacuguaaagugacuauuuuuccuuuuccaaaauguguucuuuagaaaugagucaguaagucuagcccaacuggaaagauguaagcuccaccuucuagaggggggaguaucuauauauauauauuauuggaauucuuuuuuuuuuuuuuuuuugagagcaucucacucugucucccaggcuggaguacgguggugcgaucucagcucaaugcaaccuccaccuccuggguucaaacaauucucgugccucaccuccugaguagcugaauuacaggcgugcgccaccauacccagcuaauuuuuguauuuuuagcagagaugggguuucaccauguuggccacgcuggucuugaacuccuggccucaagugauccacuugccuuggccucucaaacugcugggauuacaggcauaagccacaugcccagcccuauuauuggaauucuucugcaagaaagauuuaacuuuuggcugggugcaguggcucacgccuguaauccaagcacuuugagaagugcaaaaaauacaaaauuacaaaaaauacaaaaaugagccauugugguggcacacaccuguagucccagcuacucaggaggcugaggugggaggacugguggagccagggaggucaaggcugcggugagucgugacugugccacugcacuccagcuggagcaacagagcaagacccugugucaaaauuuaaaaaaaaaaaaaauuuaaagaaagaaagauuuaacuuuugagaagacacagaacaagaugguggaauagaaggcuccaucaauugucccuccugcaaggacaccaauuuaacaacuaucugcacaagaaaagcaccuucaugaaaaccaaaaaucaggugagcauucacagugccucuuuuaacucugugucgcugaaagacgcacugaagagauagaaaagauagccuuggauugcuaacgcccacccccccaacaguggcaguaugguaugaagaaugucucugggcacuggcagagggagagcacagcaacugugaggcacugaacuccacacuguccuauuagagcagauagaaaaacuggaccaaacucagcugacgcccacccauggagggagcauuuaaaccagcccacaccaacagggaaucaccgaucccggcaguuuaaaccugaguucccacaaaccuugccgccacaggcuaaagugcucugggucucuaaguaaacuugaaagccugucuagaccgcaaggacuguaacucucaggugaguccaaaugcugaacuggaaccagagacaguagacgguggggcggcagaagagugggaaacacaaucuccuaagacacuagccaaggcgccuaagggaauccuggcaucaucccuccucuaacccuaggcugcacaacucacagcuccaaaagaggccccuuccuucugcuugagaagaagagagaaaagaguggggaggacuucaucuugcaucuugaauaccggcucagccacagcagaacagggcaccagucagaguugugaggcaccuguucuaggcccuagcucccagaugacauuucuagacacacccuggccaaaagggaacuugcugccuuaaagggaaggacccaguccuggcagcauucgucaucugcuaacugaaaagcccuuagacccugaauaaccagcaaugaugcccagguaccaugcugagggccuuggguaagccucugagacagcucagccacagguggguagagcaccaagcagggcccuggggucccagauuccaggaucugacucuuggaugacauuucuggaccuacccugggccagaagggagcccacugcgcugaagggugagucccaggccaggcagcauuuaccacaagcugacuuaagagcccuugggccuuaagggaacaucggugguagucuggcaguacuccccaugggccuguaguggugguggccacacuuuccaaagguggccuuuggaaaggggagggaagacugugucuugugguuuaagugccaccucagcugcaauaccacagaauaccagguagaugucuaagguuuuuuacucuagucccugacucccaggcggcaccucuagagcgaggugccgucugggaaugaugucccacauagcaccugggggagcuggcugcccugaagggaaggauaugggccuggcuggcuuugcuaccugcucauuguagaaccccagggccuugagugaacauaggcaauagccagggaaugguuacagcauuggaauaacuuaaagacucccccaaaaaacuauuagaauuaacaaacaaauucaguaaagauacaaaaucaacauacaaaaaucaguagcauuucucuuuuuuuuuuuuuuuaagacuucucaccgucacccaggcuggagugcaguggcuugaucucagcucacugcaaccuccaccuccccaguucaagcaauucuccugccucagccucccaagcagcugggacuacaggaacacgccacuacgccuggcuaauuuuuguauuuuuaguagagacacgguuucaccauauuggccaggcuggucuuggacuccugaucucaugaucugcccaccucggccucccaaagugcugggauuacaggagagagccaccgugcccagcccuaaaaaucaguagcauuucuauaugccaacagugaacaaucugaaaaagaaauuuaaaaaguaaucucauuuacacacuaaaauuaaauaucuaggaauuaacuuaaccaaagaagugaaagaucucuacaaugaaaacuauaaaacacugaugaaugaaauggaaaaggacaccaaaaaauggaaagagauuccauguccauggauuggaagaaucaauguuguuaaaauguccauaguacccaaagcaaucuacagauucaugcaaucccuauuaaaauaccaaugacauucuucauagaaauagaaaaaccaauccuaaaauuuauauggaaccacagaagaaccagaauagccaaagcuauucuuagcaaaaagaacaaaacuggaggaaucacauuaccugacuucaaauuauacuacagcgcuaugguaacccaaacagcaugguacuggcauaaaaacagacacauaugccaauggaaagaagagagaacccagaaacaaaugcacauaccuacaguaaacucauuuuugacaaaggugccaagaacauacacuggggaauagauggucucuucaauaaauggugcugggaaaacuggauauccauaugcagaagaauaaaauuagaccccuaucucucaccauauacaaaaaucaaaucaaaauggauuaaauguuuaaaucuaagaucccaaacuaugaaacuacuacaagaaaacauuggggaaaaucuccaggacacuggucugggcaaagauuucuugagcaguaccacacaagcacaaauaaccaaagcaaaaaugaacaaaugggaucauaucaaauuaaaaagcuucugcacagcaaaggaaacaaucgacaaggugaagagacaacccacagaauuggagaaaauaucugcaaacuacccaucugacaagacacuaauaaccagaauaucuaagaagcucaaacaacuauaggaaaaacaaacuuaauaauuccaucaaaaaaaugugcaaaagauuugaauagacuuuucuuacucuuuuuuuuuuuuuuuuuuuuuuuuugagagggagucucgcucugucacucaggcuggagugcaguggugugaucucagcucaccacaaccucugccucccagguucaagugauucuccugucucagccuccugaguagcugggauuacaggcacccaccaccaggccuggcuaauuuuuguauuuuuuguagagaugggguuucaccauguuggccagguuguucucaaacucccaaccucaagugaucucccccucucagccucccaaagugcugggauuacaggugugagccaccacaccuggccugaauagacauuucuuaaaagaagacauacaaauggcaaacggguauaugaaaagguacuuaacaucacugaucgucagagaaaugugcaucaaaacuacaaugagauaucaucucaucucaccccaguuaaaauggcuuauauccaaaaaacaggcaauagcaaaugcuggagaggauguggaaaaaagggaacccucauacacuguuggugggaauguaaauuacuacaccacuauggagaauaauuggaaguuccucaaaaaacuaaaaauagagcuaccauaugauccagcaauuccacugccggauauauacccaaaagaaaagaaaucaguauaucaaagagauaucuguacuccauguuuguagcagcacuguucacaauagccaacauuggaagcaacuuaaguguccaucaacagaugaauggauuuuuaaaaaugugguacauauacacaauggaauacuauucagucauuaaaaaaaaagaaugagauccuaucauuugcaacaacauggaugaaacuagagaucauuauguuaaauaagccaggcacagaaagacaaacaucauauguucuuacuuauuugugggaucuaaaaaucaaaacaauugaacucauggauacagcagguagaaggaugguuaccauaggcuaggaaagggaguggggaaggggaacaaggagauagggaugguuaauggauauuaaaaaaauagaaagaauaaguaagaccuacuuuugauagcacaacacggugacuguagucaauaauaaucuaauuguacauuuaaauaacuaaaagaguauaacuggacuguucauaacacaaaggauaaaugcuugaggggaaggauaccccauucuccauaaugugauuauuacccauugcaugccuguaucaaaacaucucauguaccucauaaauauauacaccuauaauguaugcacaaaaaguaacaugaaauuuuuuuaaaaagauuuaacuucuucuccccuagucauuuauuuaaaugaguuuagacucauguacauuuauuuuauaauuugaguuauaauccaauauuaccuuacuuauuuuguugcuucauaucaauccagcuuuggacacuggaaaagaagaaagucacuucugaggaaagacuaagggaagugagggagcuagccacaaagccauccaguagaagaacauucuaggucccaaggugugacagccugauguguuuagggaacaagagcaagaccagagugacuagaggagaggaaauauaagggagaguagcagcaaaugaaaugacagagguaauggugagccgcaucacagagcugugcaggccaaagaaggagcuaacccuuacuuuaugugagaaggaacaccagaggauauuucuaagcacaggaaggcaugguagaaggaucacuggcugcuguguugagaaauaacugcagguaauuaggacagaaugagggaggcuaauuagaugucuauucaauaauccaggugagagaucauggugaucacacgggugaugagaaguggucaaauucuggauauauuuuuugaagacagagcuguugggaucggcugucagacagaauguggggucuuagagaaagaaaggggucgagaaugacugugaggauuuugaccugaaaaauuaaagggauagaauagccauuaacugaaguggggaaagcugcaggagcucaguuuuagacauguuaaauuuaagaugccuauccaaguaaaggugucuaguaggcagauggaucugaaguucagagaagccuagguuggagauaaaaaaaaaaccuagcagucaucagcauacagaugaaacaugaagccaucagacuagaugagucaccaacgccuuaaguguagacagagaagagcagagguccaaggacugagccuggggcguucuggcacugagaaaaaucaagacuuucuuaccuucccuuuaaucagauacaaauguagcaaguuuuuuuucucauccacuguguaccuaguacugcucuggauucccuaacucucagaauauaaccuuaacucucccucaccucucuguaauucuccauccucuguucugugcugccguacaccuggucaccaucauaagacagucauuacugccacuaccucuuugcaagcugcuccucccaccuggaaaacccuuuauacuccaccucaucaaauaccagcuuuuccaagccccaauuaaucuccuaucuuuucucugaaauuuaccuaauuacucucauagugaaugagcuucuccaccaaagcaacccuaacacuucaaugacuaccaacguugaacuuaaugucuguacaaucagauauuuaucaguuauugaccuguguggcuaacuguauauaaacuguguauaaaugcuguagcuuccuuuaagaagaaaagcacaucuaccuuuucucuuccccccaaaauagccuagaacaaauaccuaccacauagcaagugcucaauaaauugugugugaauucuuucauguuaauucuguuauucaaucagucaccaugcucccugagaguagagaccuguuuuguaucuccuccauuugauucuggguuagacacagguagguaggcauucaauaacugcuugcuaucaaaggggaugaugacaaugugaggucucuggggaccuuacgaucuuggcacaaaacaaugagaauguguauucuguucuugcuacccaucucaccugaacccagcuauuuccuggacaaagaagaagaauccagggaccacauagagaagaaauuccagggcaucugauguuagugcagagagauacucaaaaucaugguauuaucuaaaacgccuggaaaagaguuugcccucgcugaaaugcugggugaaaagaaucagaaaagacacgcacuugggugugaauccuaagaacacagagaauacaucaaaauaaauacaaguauauucacuaaugaauuauuuacaacagugaaaaacuggaaaccaucuaaaugcccaaccguaagaauuaaguauaauuugguauauucauacacuugaauauauuaaagaacagcaccuggaaaauguucacuuuaugccuaaggcucacuuuauaccuauaugcuggaggcucuaacuuucagucuccauuucuaaagggaaaguaucugucucaaaauagucuguacaguaugacugcacuuuugugcaaacaacuggaagaacacaagccauaauguuaauuuuacaucugcacagugggauuugggugauuuuguuguuguuguuguugucucccuuuguguuuuucuauguuuuccaaguauucugcuuugaaaacauauuacuuugucagcaggcaaaaaaaaaaaaaaaaagagagagagagagagagaaagucauuuuaaaaacaaacauauaagagccaaauucucaacucucuaggcaucugacugcugaaaguauccuacuuccaauauaauaugcaagaauccuaagguccagcccccuccucccauuccuuccccucccauagcacccaagacagaaaacagaugaaacuaagaucaagggcugcuuuuuucuuuuuuuuuuuuuuuguuuuuugagacggaguuuuugcucuuguugcccaggcuggagugcaauggugcaaucucagcucaccgcaaccuccgccucccagguucaagcaguucuccugccucagccuccugaguagcugggauuacaggcaugcaccaccacgccuggcuaauuuuguauuuuuaguagagaugggguuucuccauguuggucaggcuggucucaaacucccaaccucaggugauccaccugccucagccucccaaagugcugggauuacaggugugagccaccaugcccagccuaucaagagcuucuuaagggaaagauccuguccuuuugaucuuuggucucccaccucaaaauucucagcacccugugaggcauuaggcgcucaguaaacaagaaagggaaggaagaagauguagugaacuuacaaggcauagauaccacuaccgcaaugacauccccacccaagguaccgcuccacccuauucuaggucugaucccuuucucuccuaucucugagcauugcacaggccugucaagcagcucuuagaauaagaguucugauucuuugcaccacagcaaguauuccucuuuugccuuucccccugccccuuuccuuccucccucuuuuuaaaaggugaucuugccuuucggcuaguacaaugugcugcacugaaccagcgugccagucagucuguggagaaucagagagaaugaauuugaauaauaaaagccagaacaaggcgauaccuuggagagagacuugguguaguaccuucaauuuagaaccucauuucaguggcuaaugcaguuguuggagacauuagccuaauuuuugccaggagaguccagcaacacagcaguacuaaacaugggcacaguggacccugcucaucucagagacaaaguguggagaaugaaauuagcagcacugcacuucuggugcagaggaaagcaaauucucacuccccucccccaauucauuaccaaucaucuuuaaaaugaaaaacacagacaugugugugggagucagcauaagcaugaaguucaagggaagccaggacccugaagaaacucccaggaggcacuuauggaccaugggaaaguuaauuucaaaggacauccaauaaaugcugcccuaccacagaucuugucauugccaagcccuauuugcugcaggccugggaaggcuccagaaccugcuggcaggucaguuuguugaggccagaaaugggaaggagagcccacaaaggccaaacuggaagaaagaggcucagcucuagacacaucuacacagacuggggugaggguuccuacaacaagugcuuccuauuggcuagguuaaaaagaagccacaccuggucugguccagauuuguccuaagucucucccugugugucagccuccaugcugcaggagccaagcagcucaggaccuuucacucugcuguagcugugagccuuuaaagacggcagcacguggcucagagguagcaacaauaauuguagguaacagacugggcaggggccuccuggcuccuccuagaccacgccaacaaugggucgagcaugggugucccuggcuagccaggcugaagaagggacuccuuucucuuguucuaacaggcugguaggccagaaguccucucucuguuccugcuggucucucacugccucugauuccccaaagucccacucugcucccuacucuguuauucaggguccuuuugucuuguccagagauggguaaaaggaagacaaaguuuaaccaaagucuucacagacaaggauuuucuagaaccuaaugccccuuuuccucuccucuccccuagcagagggcaaaggaaaacccaacguuaccaguaacucacuuucaacaguaucacagcaucaccagcacuagccuggaggccucaacgacccugacauaucaacauaaugacagacacaaggacaccuguauauccagauccuugaguggguuaguaagacugccaaucuuuuuguuugaauugauucccagguaggcugugguuaaggauuaagacuuaaggcccaggcacucugcuaugaccucacuguauuuaaugcagcaguaggcacauggcaaguacccaaacaccucaggacuugaacucuuccuaagggucucucugugaagucccaggaacgugagagacuguccucuuuuccugacagauacugaaggccaauccuagagaagaaggaagggcugcuuagaggaaaagcggaagaaaugagaggcuaggcaacccagacuccacccaagaagcacacgcaaugaggggagcagggcagggauagggcggcaggacucgcucuccguacacacagccugccugccaaaauuuacuggauggcaggaauccuagauccgugggugaggauugagucauguuaugaaucuccuuuuucuaagcagcaugugaaaaaacuccuccaucucaggaagagaagguggggaagaggggggcgauauguggggaaggugguggucggcaacuggaagcccagauuucauucuaaugccagaacagccuccucaaauuacaagggguccauuccagaagaagcuaggcaggccaaggaggcuggacuguggcuuuggauagucaaaauaccacugacaugaaacuguaucaucgcaguguugauaauuucccuggaagaagcaaauccucccauaacuauaaaucaaucccucacugcaauugcagaaaucuaucaaaaaaaaaauucagcuguuaccagaaauucuaaaugcuuggcacuagaagcauaauuaggggagauucugaaagguguccugaggcaggccauacaagaacagaguagaaaggaguuauauacccuuagaaagcucauuuagggaaugggcugugcauaaugcaugcaggcccgggagugcagacauucccucccggcggccugcucagaggcaggcugugagccgcgacacuggcagauggcugccccgguagcaaucgugcacgcuccaacggccgccuccuccaguccacccuugagcacaggcuuauguucccaaaagggguggagagcaccagcaaacauuacccccaaagaauaguggcuuucccuagggaagguaaacauuuccaucagaaggcagaagccggcacaaggcaauuucucucugugcagggaaaaggagccgcaaacauaaaguugcucagucaaaagagacagaugaucucugcaagcgaagccgugccaaacugucuguaaaggauuugcacauccaucagcauaaguggcuguguaggggagggggacgcaggaguggggaaggcccacucauggugcaggauucucaggacucagaagccccaggagaggagaagccaguuauuuuucugcuagugcucuagccugagcaaagguauagcaaaaggcuugauuuccagcagauucucucugcucucucaauccucccaauccauacucaaggucuguccacuucaagccucugcauucacaagguuuuggggccacuggcuauucaaucuugagccagccacuucuccuucccacuggcauccuccaccuuuuuaaagucacgugugacuaaaagagaaauggcaguucacuagucuuaugccuaaaauaaccuacagaaaaauaugguuuaugaacuauccuguaauauaauacacaauucggagccuagccauuugucacagcauugaguaauccacauacaucccaagggucugacaauaagauguguaaaucaacagcaaaaagcagcauagcuuagccauugaguuaaaauacaaagaauguuuuuuagcauugauuuuuuuuaacuuagaaaauaugggcuucugaggguaaaugcuuguaagggaguugugugcuagaaugaaagacucuauacuuuccagaacccccgauaccugacuucaaagcaaaaauaaaaacuccaagacucacauucuuccaaugaugauaauggcuuucuucuacaaacccugcuauuagcaugacagggauggccacaucagucauaagaaaagcacauguaccuuuuacacuuaagaaaagcaagcaaaauaccugcuuugugcaaaagcaagccacuuggcaggaaagaaaauaauaaauuacugcaaaggcuugaaauuauuuuucuuucucuggaugaucaaacaaugagcguagggguaggcaucacaauccacaaacauacugccauagugauuggugcuuagguaggauaaaacaggcagaauuucauuuauauuccaaagaacagagacaagugcccugaucacucagcccugcagagaguccuaaugccacaugaguggccuccuccccaguugcuguauggccccgcugcaggaucugaucuggggugugugucugcauugcuaucugaccaauuaucugccuagaacagaccuugccugaggaugcagcaggugugcaggugcuuaagaggcagguguugggaucccugaguaagagcccuccuucugacaugggaggcaagacugacucagguguuaccuguuaugcugggggcacagcuauacccuggugaguuucuccuuuacuuaaaaagaucacuuagacauuauucuauuuuagcuuuuuauuuugaaacaauuuuagacuuacagaaaaguugcaaaaaaaagaaaaaaaaauacagaguuucccauauacucuucauccagauuuuccugcuauuaacgucuuacaaaacuauaggacaauuaucaaaacuaagaaauuauacaacaguaguaacuaaacuauagacucuacuuggauuucaccaguuuuuccacuaauguuuuucucucuugcacagucuaauccaggauaucacacuguauuuggucgucaggucuccuuugucuccuccaaucugugacaguuccucagucuuugucuuucaucaccuggacauacuugaaaagugcugguaguuauucugcagacuguaccucaauuuggguucaucugauguccacugauuuuuaauacaacagaaaaaacaacagcuaacauuuacugagcuauuacuaugcaccuggcaucacaguaaacauuucauguuuaccuuauuuacuauuuaaaauaacccucugaaguaggcauuauuacuaccccuauuuuacagagagggauaguucauuaaucuuuacuguaauuaaguaacuugcccagcuacuagcuauaaaagacagagcagaggugugaacccagguagacugacucuaaaacacuauacuacaugcuauauucaaggcacggcagcaacaaucaaaugccaaaauacaaucugggcucagcucuuggccauucccucuccgaagaaugugucucauugaagaaagggcauuauaggcuuuaucuuucuuccaaagacgacgaaauacuccacuugaauuucugcccauagaaccagaagauuuuuuuucucuugacaagaagcaccuuccuggauuaaggguaaagaaaaggccauuguucuccugagaccucacucuggacuggugccagauggagggaaaaauagaugagcauguaggugugcucaauucaagagaguucuauuccgaagccuuuucaagccuauggaaacacggaggucacaaaaaggggaaaaagcuccugggauugcuuuuuuucccauguuaugcccagaaauauccaaugaugggcaacacaaacggacaccuugucguuaguauuaggaucuuugggaaaguugagguacaaacuauucauguggcacauggugugugugucaagggacagggcugugggaggcaggcugggaagaauuccagcugcacuccaggauuuguuuuuaaugcuuaugacuuuagaucacucaguuccacagacuugauuuuucccaaauccccucucuggcaacgcuaauguguuuuuccucuaguucugacugaucagcgaaauacguggcuggaagaauaggcugggaaaucauuucuuugaugcuagcagaauugagaaaauauucccccagcuacagaccucuccaucuauucaucccugccaccugccagucagcugcagguagaggcagcuaggaagguaagguggcagggagggcaggaugugaaggaggggaaaagggaaaagaacugagagcaugaaaacaaggaaaagaaaaaaaaaaaagaguauuguguucaaacggccacuuuagaaccaagacuuucauugauaugcaucagcagugucagaugaagccagcaaauaggugaaaaaugcucagccuuccuuagaacuuuucuucugcucuucaccccacaaaguacaucccuuaacuucaaaacuaagauggacuccuguaaaugaaacacuuuaucugggugccuccauuacugccagcuuuguaaaagagcccucuccuuugaaaucuacuguucuauaccuaacuccaaaguauccucagcuagauacuuugaucaaauacuggaagcuaaaaugcuaaccaucuuuagggaacaauuccuccagccucuacaucuacaauuuaacccagugggaaucuaaagccagcuaacagcccucaaaucacacugcacacagggcugcuuacucugcuguguuuagggacauaagaauuaaucccuaagauccaacuuagaaacccaaacagggcagcuugauaauucugugucugcuugaauaauuucccccucucagugucaaaggccuucaaaauucacauuauuuuguucccauguagacgucaaauaaaacugcuuucagaucaugaccccgcagauuccaucuucagaagaaaggaaaucugggaaaagcaaugagaucugaagccccuuuaccaauggaccaugggcuccaaaagagaccaagagaaaacauaacuacucccuuaugggguaucuugaggacuuaauauacacaaagcaccuagcacaaggggauguuaaaaaaaaaaaaaaaaaaagcaguuuucuuccuuuccccauccaacugcuagacuggaauuccuggguccuauuuccccucugucuuuuuuuuuuuuuuuugguaaaccccuuccauucuaggauccucucagucauuucuuggucaugagauacuagacaaccuccucauccucuaagagccugaaugacuuggccaggcacggaggcucacgucuauaaucucagcacuuugggaggacaaggcuggcagaucacgaggucaggaguucaagacuagccuggccagcauggugaaaccccgucucuacuaaaaaugcaaaaauuagccaggcaugguggcacgcgccuguaguccuagcuacucaggaggcugaggcaggagaauugcuugaacccggcagauggagguugcagugagccgagaucacgccauugcacuccagccugggugacagagcaagacucugucucgaaaaaaaaaaaaaagaagagccugaaugacuugaccaaacugggagaugauggaauagagauuaaaaagaugauguuuauauaacauuuagagggcuacugggguggggagcaggggucguuucuuuuuuccccuaaggaaaaagaacuuuacaaauauaccauauuacuauuccuuaaaaacucaccccugcccagauaaacucauuauggccauagguaaucaaaucugaagacuuuuaauccaaagaaaugguucucuucuuccaaacagcugcauuacacaaaccauaaacagacuguucugggaauuaaauaaauuaaacuaaaacucaaucuuuguuugcccaaauccacauauuaugggaaauaaggaaaaaccaacaacuuaugaguuuaugaauaauaacaaaacaaaacccccacaugaacagaaauauaaucagcuugauuagcacccaggcaacaaaaggcucacagagccccugcacacaaggcugugcuucaugugggcucuugacaggcugccaaaagaucaguggcuaguggggugccacccccacccugcccugugcacugccagggccucaaagaguucccuugauguucccugucuucagaagagggaagguuggagcagguucagaggagcuuccaaaaagcucuccagagcuugccagaaaccuggcuucacaaagccccaugggccagauggacaaaagucucccuuaccauacccagagacaacccaagaguccccagaaugaucugccuaucauuccucagacuccagccaucucacuguccaccuauguaugcacugcccagggcucagauuacucaaggaagucaacaaaccucacccaccacagugucagguugucagauguuaacuggacuuuuccuaauacugggugaugcucaguucugaccucuugguuguccaagcaccuuccccacaguaguucuucccaaccuuccauuucucaagcacccaaauggguacuucucuuucauugcucaaagcagaagaccacccucagcuuggcucagaaaacugaagacaucuaauaggagcuucuucaauuucugucuauaucccuaccaccuuucugugucccuuucuagccucugcuucuaauuucucagucucaucacauuuaugaagccaagacuguccaucugcuaccuaaauaacuuugccccaucaaugaucuccucuaugggauuauaaaucugucaacacugauuccuuuccccucugccuuccaacauacagaaaaccucucuccauccagcuccaaugaccccaccucagggaagccuuuccuucaguguccucugcauucucacugagccaccuuccuguaggggguccuccaucacuauaagcccaagugagcaaccucugucaugcccaccaugguaucccuggcaucaagcacuauacuuccaggaguucaacaaauggaauaugaaaugaacaaguuuuuugauauggcuaucgcuaacugaaauugcccuuucaguucuccucuucuacuaucaaacuccucaaacccaggaguuuacaucaucuuucuucaucuccucaucucccagcacagcuccugguuggauucuaugacagacuaaucuguuacacuuaaguuucacaccucuccccucuccccacuccccacggucucccucucccucucuuuccacggucucccucugaugccgagccaaagcuggacuguacugcugccaucucggcucacugcaaccucccugccugauucuccugccucagccugccgagcgccugcgauugcaggugcgcgccgccacgccugacugguuuucguauuuuuuugcuggagacgggguuucgcuguguuggccgggcuggucuccagcuccuaaccgcgagugauccgccagccucggccucccgaggugccgggauugcagacggagucuaguucacucagugcucaauguugcccaggcuggagugcaguggcgugaucucagcuagcuacaaccuccaccucccagcagccugccuuggccucccaaagugccgagauugcagccucugcccggccgccaccccguccgagaagugaggagcgucucugccuggccgcccaucaucugggaugugaggagccccucugcccggcugcccagucugggaagugaggagcgccucuucccggcugccaucccgucuaggaagugaggagcgucucugcccggcugcccaucgucugagauguagggagcgccucugccccgccacccagucugggaugugaggagcgccucugcccggccgcgaccccgucugggaggugaggagcgccucugcccggccgccccgucugagaagugaggagccccuccgcccggcagccgccccgucugggaagugaggagugucuccgcccggcagccaaccccuccgggagggaggugggggccagcccccgcccggccagccgccccauccgggagggagguggcgggcgccuccgcccggccgccgccccgugcgggagguggggggcgccucugcccggccgccccuucugggaagugaggagccccucugcccggccaccaccccgucugggaggugcacccaacagcucauugagaacgggccaugaugacaauggcaguuuuguggaacagaaaagggggaaauguggggaaaagauagagaaaucagauuguugcugugucuguguagaaagaaguagacauaggagacuccauuuuguucuguacuaagaaagauucuucugccuugggaugcuguucaucuaugaccuugcccccaacccugugcucucugaaacaugugcuguguccacucaggguuaaauggauuaaggguggugcaagaugugcuuuguuaaacagaugcuugaaggcagcaugcucguuaagagucaucaccacucccuaaucucaaguacccagggacacaaacacugcggaaggccgcaggguccucugccuaggaaaaccagaaaccuuuguucacuuguuuaucugcugaccuucccuccacuauuguccuaugacccugccaaaucccccucugcgagaaacacccaagaaugaucaauaaaaaauaaaauaaaaaauaaauaaauaaauaaauuuaaaaaaaaaaguuucacaccuuuaaaucuacuggcuugucaguucuccuccugaucuccucccucucccucacuggcccccaccucugacagaguggaugcugcccacccccaccaccucauuuuucccuuacacacaccugccacuccagacaagcagauauacucucacuucaggucucuguucauauuauccccaccaacaccacuacucauacuuuguucucuucucuaucuagugaaguacugucucuaaguuauagaucaauuccuaccuccaaggcucugacaaaacuaagaaugcaacagguucugggaaagggccucucauucaagcucuaggccagcccuugagaacuacuccuagcccugguuagucuuaaccguggagaugcccugggcugucuuggccaguggggugaggccaauauuagaaaaggaagcaaagucagagcuacaaagguucucugaacuaaaacaaagucuguggcaugagggcugggacuauuuuggcagcuaguuuuccaucaucccuacuuggucuaaguuuuccaucucagacauuugggugucccaaccuuugagaguugaggcuaugccacucugcucagcacuccugauuaaaccucagagagaacagguggauagaagcagaggaaggggaggauaagggcuucagggugcauguuaagcauacaaaugcuuguuagaaagaggauggccaacagcugcucuccaucaccacccaaaugcacagauugcaaacuggacccuggccugucccauccggguaaugaaggccaaagccagggcagacaugcuuuggugucagagcagaacucagccagccggcugcaaaguggccucagucuuggcaguggcugccauggagguugcaguccuuccuggccuggccuccaccugcucucccagggggcugugggauuuagcugcugaggggcagugaucagccauccugagaggcuagugaagagaccucccuacaugagaaaugaggucucucugcaaugaagagaucuaaaugauccucauggagccuccuggggccuuccuguauuccagcccaccaucuuuuuuucucucccaguacaggauaauuugaagccucagaaacugcuccuauaggccucaagagaccuggcauccuuccaucccccaagugguucucccuaacaagcuuguauuaccaaggagcaaaggagaugcucagagucgagaaugcuuagcaaaggcugggaagguggaaguuauagagggagggaccagaaguauagguagaagaggaacaaaugaaguucuaaggaaauccccagaagacuagaaagcccucaaaguaagaaggguggcacugugcagaaagaaguagcaccaaaaguaagcucuguugaauacuucauccugaaaaguugccagagauagcaacuuauguccaagaagacagaccaccccaacagaaucaggcuguuucuucuauuuagccccugccccacauuuccagcacugugcuugagccagggugaaacaucauccaacaaagaccccuggcuaucccccucccuuaagucauuacuuccuuaacagcagcuaagaagucccacugucacacuuugaugagccgcaggggcuuaggcaugaaguguccugaaccaacaaccuugcucccacccaauuucuugggccucacaugugugugcaugucuauguauaaaggaugggacagaagagauuauacucuuggggaccauggggaaugagaagacccguaaggaagauccuuccaggaucagggagggagggagggucaccugccucccaaccacagaccuggggagggggcagaacacacugggagcuuugccccccuuagucucacuuuuauugcaacugugguauaauaaaaaauauguguagucuuugacccugguuccuggcucauuguuucuaaaacucuuggaauuuuuugagccauaagaguguacuuuguuauuccuaccaaaccccuuucaacuauggggcuuuuauacugauuaggugacucuugguuggagguucuaaauagcuucaggauggaggcugguugccagaaagaccaacccaggauuagagggcuggaacuuucagccccagccccacucugaccucaggggagggaaggaggacuggagauugagcuaaauuaucaauggccaaugcuuuaaucaauuaugccuacauaauaaaaccuccauaaaagcccugaaacaacaggauucagagagcuuccugaacuccacuugagcaugaggguuggcggacacacugaagugcuagaaggcucugcacaccacucccuacccccacuccaauaucuugccgcaucuaaacucuuccguuuggcugucacugaguugcauuuucauaacaaaccaauaaacauaaaguguuuuccugagagccauucuagcaaauuauuaaugucaaaccugagaaggagauugugagaauccccaacuuauaccuggucagucagaaauacagguggcccaggacuugcaacugccauaugaaauggaagcagucuuauggacuuagcccuuuaacuugagggaucugagacuaauuccacauagacauuggcagauuugaauugaauuguugcacacccacuuggugucagaggaguggagaaccacgccgccccuccaaagcugcaaagagccagaggcccaacagaaacagugucacagagucacccagaccagagucaggugcuccuucagacagauguccagggccugcaggaaaucagacuccucucuuaaauacuugaaaccagaguaguuggucuacuauaaaugagguuuuuaaaauucaauucccucuuauugcucgugcagaucugaaaugaucugaccagauggcuggugcucuauaauucuuggauugcucucaucaguuguugaugauuuggaauuuuuuucuuuuucuuuuuuuucccccucacaugaacguguuccugcacaggcuuccugcgugcucacauugagugggcucuuugugcuaaugccaauauuucagagacucucacagccgccuggagucagaucaggucaauaaggagccccaggucugcuccuggcuggcuacgcuucccugagcccacauggggccaacaugcagcacuggguaaugagcagaacaaggggcccucugccagggcugccuccuuaccuccacuuccccuucagguccccaaggaaagggagguagcaaagguguauauacauagauauauauuuuuaaaaagacuauguugccaaggcuggagugcaguagcuauucacagacaccaaguuaccaaugaugcaaacuccuaggcucaagcaauccucccaccucagccuccugaguagcugggacuacauucgcacgccacugugcccagaacaaagguauauauuuuuaaaugacaacuauagccacuuauugaauauggccuaugugccaggcccuguguugaacauuuuacauauguuaaccuuguuucauucuuacaucaucucugcgaaguagguauuauauuuucaucccuaucaucagaugaggaaacuaagguucugagauucuaagcaaccugagcaaggccacacagcucaaagagagagcugcagauggaguuggagauucagcaucauaaaauuugaugaacugccccacacagaucucaggguuaaagagaaaaggcccuggccuugccauaccaucuuuaugcccucacugagcacaaaauacuuccaccaagacauccaaaacacuuugguggcuguuuuugucuuuguucucuguauccuuuguaagauuaugagcuggauagagggcaggggucacguccuuuuugcuacacaagaagauaguauggcacagugguuaggagcuggggcuuagagccagacaaaucuagguuugagucccaacucuaccacuuuuugguuguuuggcugaguccuuccuucugagacucaguuguaucuguaaaaaugaggauaguuauagcaccugcccucaaaggaugccuggcagagucagugcucaguaaaugugagcuguuaccuauaucucuggcuauagaugaugcccagggugcaggagcccauugaaguggcugugaccagcauucuguaauaccaacugcacagguccaaaguccuaguguucagccucagguccucagccucaggacaaauuccugaguucccugcccagaacccccaggaccugccagcaaacagcuuuccucugcuugcuugugaacagcuaaugcuguauccacccucaaaugcuugcugugccuccguaaggugaggcagaucccaaaauaaaccagaagaaagagacaggaaaaucacuucuaggaacaagcagcucccagugaggaugcugacaguaauaacaggggcagauagacuucaggagauucaccugcagcuguuccaggacugagugacuggggcccaauuccuaccuggacugcagggaaggcccacgaagucaugaguuuguccccugguguuccaggcagcaggcagucuggaaaucugccuucaaaugagcacagccaaaacagcccacgaaaccuaguuccccucuugggagccuaaggacaacacagcugugguccucccuuaagagcccugaggggacagaagguacugaacuggggacaauaacuguccauauaaacuugcaauuuucuuaaaguccaccgucuuccugugccaugccacugacucucagacaggaaacacucugcuaaccccuuuugcucgugcuuacccuugcuccuugaucaaagucucuguugagggagagaggacauuucaugaacaugcaagucucuucuucacaucguaaguucccuuucccauguaaagccauagggacagaagccuacaugcucauguacccucaccggcauccagugauuccacaaugggauugaagggauggccaaguggagaauuuaccacugaaaaucagaacagcuguguacugagugauuucuccauguuaggaaguaggcagagggcuuugcaucuaccaucucacuccauacaacagccuccgcagcaggcagggcaggacacuucccccaugccaccccaugcaaaaccaaggaacagaaauauucugugacuugcccaagauccccuaaguaucaaggcuaggguuugaaccccaaacuggcugaaucuagucuguccucuuuaccacuaaauuauaccaccuccccauuuaccuacccauccaguucccaggacuggcuacauuccuuuuaaucuuuagguagauguguugggaagcucccaggcagaauucagaaugugguaaauuaaguaccauaaucugguugaaggcaagugccagcuauccacacacacccuugagaggucaguuuccuaacaguauacauagaaaacaugucaauucuuuacuggggccuccacuggucugacaccaugacaccagauucugaaucaccccacaucagauacugaggccagaacaagccucccaccuaaccuccccucaccaguccugcuuuugagauguaguguaggcaaaaaaugcuccugggauggggcaggcaugaccggaaccagaguugcuuugcccucugagcuacagggccucugcgucugggugcaacugcaacacaccagccuuugggacaacuccaagggaauuuugugcagaagaguuuaccagggacucuugagaaacuccaaggcagagggugaugccaaugaaacaucaaguuaacuguaaaaaucagugcucuacuccaauucuccaggagucucucagaguccacaguccacucuugucacacaggcucuggcugucccuccccaaggauacagagaggggcucuuuuuagccauuaauagcagccccacugcccagaggguugggcaaggggccagggucagaaccaucaacaucguucagucugcaacaugaaccaggaugcuacuggaugaagggagcuacugacucaaccacagaaacagauagaguaggagucgaggccacaggacacugacuuccaucugcuccaggaacuugccugguuaaaagugguacaagaaagccaggugcgguggcucacgucuguaauccuaggacuuuggcaggcugaggcagguggauugcucgagcccaggaguucgagauuagccugggcaacagggcaaaaccuagucucuacaaaaaauacaaaaauuagcugggugugguggcuugcaccuauagucccagcuacucuggaggcugagaugggaggauuacuugagcccaggaggcagagguugcagugagccaagaucgcaacauggcacuccagccugggugacagagcaagacccugucucaaaaaagugaaagugauacaagcaacacuauauacauaaaaucagcggauauaguccguaucuuccacgcccuaccccugacagccucugguuuuaguccuuaaggaccagugggacuaaguucucaagugaagccagguuggcaaggggugggugguggcaggcagagguuggaucugcugaacccaguaccucuauuccuaaaaguucccucugcucaaugccauuagcucccaccuggcuuccucggugcuucaucacucuucuguggcagcaacuacccaugugcaaacacagcaggagcaauauugcuaccagaaagcuggcuggcacagcaaaugcugcccugccagcacagcagcagugggggcagugaggacauggugaugaauaucagcaagaagcuggugaaacuacacuguggcagcugcuggggcuugccauccaccuugccacuccugagaacagucccaagugucagaguaguaggcuccagccaaggacagcuaggacugggaagaagugggaagagaguaggcccaggcucuggggucaauggcauagggcaaguuagcuggaugacauaggacaaguugcuuaaccucacugagccucagugcuuucaucugaacauaaggauaauaauaguuccuauuauugugaaaauucaacaagauuaugcauacgaagcaccuaguacaguaccugaauauggugaagacucugcaauuguugacuauucucauuauuuuaagccuugggcccaggcucaugaaaggguuagaaaauuguuccuucugaggaugcacuauuuaaaaaccaggccaggaccagccuguuucuuggcacagguuccuuuaacaacagaauacuccugccccacaccagugcucaggacucucccaagaacaauauuucagcagcacugagccgagcagcagagcccaaaauagcauuugcagagcaaggcacaugucacugccucucuggugcuucagaagugcagggaaagaaaguuuucaaucacuugcucagaaaccacggccacccaccaccugccuuccuuccagggcacuaagaugcugcaaucucuguucugcuggaaaacgaaggucccugagcccugcagcagcagcuaccacucugacggaccaugcuguuucccucccgcaggccagagaagagcagccugaaggagcagcccucuggggacaaaggacauaugcaguuugaauucaaaguguguuuuguggggacagggcugggccugauaccuggcugaagggccugccacucaugcgucggguggaacaccuccaggacuucggcauccagcuccuccucggcuuugguuucuuuucucucuguuucuuuggugcugcucuucucuggguuggucagggcaaacuccuucugagaaaagaaaacacagggcaugacccacugcaacuaggcgccagguaagcagaaaaaaaauggccuaggguggcacguucuuuuccuccaugccccucucccccacagccugauaugucuggacacucgcaauuccuuucccaaggucagccucagaaccagcacaugugaggugauauggcuaaaugaaugcagcauguuguccugugcguaugugguacuuuugaaaaugcacagggaaugacucuagaagaucccauguaucuugagcagguuaagggaacacauuagggacaggggcuggcaaaacgaaacaauaagagccuuuuacuuuuugacaugcuauuauacuguuugauguuuaaaacucgcacauauuauuuuuacaauaaaaauaaacauauuuagaaaagaaaaaaacacauacaugaaugggagaguaaggccucaaauggccacuacagauguacaaaagcuggcagcuaaggcccaacugauucccaagcagcccagcagggcacaauuccccagugugccuaugagccauugcaaaccauggaggaagcgugcaagugggaaggagagaauccagcugggcugagggaggaagaugcucagguuggaaaccacuuccuaaaaccuguugccuuccacccuguguagaacauagaggauuaaugagauggugucucuggagcauucucagcucaggagacagcgaugcaagauaaauacaaaguauuauucauuuugcucuuuccuggacucucauccuuccuaucccauuuuuaaacccguucuugcaaaaaaaguaauaaggccucaggaaauucgaaccagaggguuccggagcucugggaaauuacauuugggaaaacaaggaggaacccacauuagcacauggggagguauuucagccugcccaccuccccugucaucgcuuuuucucugcuucccaaucccuccccuaguaauaaaaaguauauuucuuggaaucuuccuaugagcccagacccgugcuggguacuuuacauagaucucauuuuggucucccaacaauucuaaccacaacugggagauguuauaugcauacaucuguaaaguuauuuaacuuucaacuaacaccucauucucagccaggcaugguggcucacaccuauaaucccagcacuuugagaggccaaggcagguggauugcuugaacccaagaguucaagaccagccugggcaacaccacaaaaccccaccucuacaaaaaauacaaaaaaauuagccagguguggugguguaugucuguagucccagcuacuugggcggcugaggcaacaggaucguuagagcccaggaggcagaggcugcagugaccugagauggcaccaccacacuucagccugugugacagagcaagacccugucucaaaaaaaaaaaaaagugccuggcuccagauaaggacucccuccugccugggucccucaaugucugaucuuuaguugucgaggaaaaguuaaaauguuaaggugcuggugaugccaauguagagccccuccaagaauuuuuacauuuuaacaagaaauaaaggcaugaaauuuagauggcagaauuucaggccuuacuaaggaccaauaaggaaaauaucuuggcaagaagaagcucucaaaucuaaccacaccugggagauguaauaugcauaguuaugagaggcacugacuccagcauagugcuuaagaugcuggaauaacucaaaucccaguuucuugugucucgggaaaguuauuuaaccuccuaagcuucaguuuccacauuuucaacaugaaaauaauaacaacaucuagcucauaguuagaugagguacuacauuguaaaccacuggcuuuggguacaugguggcugcuacuauuacuuaugaaggcagucauagauuccaggcuguguugugacauccaggagugacuauacaauauggcaucauucaagcaggucaccugcgcagccuggugccucaaaccccuccuaucccuucaacuuaaaguuugcacaaaucugagcucaaaagaaaacuaggaauagaagaauaggugugcuuaugagacuacagagaagacugacuggcaggaggcauccuccauucugaggacauggacaucaagaacuuccaacagcugaguuuccagagggcaggcaccaugucagucuccuucaucacccccaugccuagcacagggcuuaguuugaagcugcugaaaaaacagaugaaugaaugccccuucccauaggcaggugugucuucugggugccuuagacugaggaaagcccaaagcaccugagucugcuccagguacuugccucacauuccagaacaaagaccacccugucugcuaaguacccagagccuacauacacuaggaucagcccuggucagaagcauuagacugcaggaccaggagaaaguuaauaaaauuuaccuuggaggugugucaaugaaaugccccaggggccaggcagggaugcagggaaaucaguggaccagguguaaacaauagggaguggugggacugcagaaacuggagcccucuugccuugacuaagggaagcagcugcuacuccgcuggucuaccacugucacgcaggcauucaacuugaaaacagaaauccagauuuuuaugugaaauguucuuauuuuuagaacacuaagaaggccaaacuaaaauaucuaagcaucaauuugcaaccuucuuuuuuucuuuuaauuuuuaguagagacaaggucucccuguguuucccaggcuggucuugaacuccuggacuuaagcaauccucccuccucugccucccaaagugcugggauuacaggcaugagccaccacacccagccucaauccuuguuucaguuuaccuauuagccggguaauuucuggcaggcuguaagcaagcagcaaaauucucaucaagagaagcagaaagggguaagggagauggugauaagaagguagcacaggaaauccuccaaaauccagguaggcugauguucauuuuaacuacuaaggguucggaaagccucuuuuucuagauuucauuaacaagauuaauagaguggauucaagaaggaggguuagaacgagacugaugaaccaccgagcuacaugcuucaaguccuaaggaggccagacucuuuugcaacaauccugucacuguucaaaauguuuuuugcaccuccuuuugguaucaucuuugaaucagauuuuaagacacaaacacaaaaccuguacauuuaaaaguauauuuuaaaguacaccucaguuuuuaguggagauugacacaaaauugguucuccccuaucuaugcuuacccuguuuacgagcccuggcuauaaaagucuuuagaugcuuugcccaaaacacaccuagcuauccucaaaggccaagggcucagaagccuugagagagguucaaugauaugaacaaaccacaggcuggacagugaguucaaaagcagaguuccagaaaagguuuugagaaaaagcagcaucaagaggaugagguuguaaugauaacagcagcuaccauuuauuaagcccugaucauaugucaggcacuggggcaaggugccuuccauuccucaauucauccaagugucaucugugaagcacaucauauuagucccauaggaggacagauauggggcuuuucaaaaucacacugcucagaaaagcagagcagagauugaaguccagaccugccuggcuccaaagcccauacacaaguuuugacucacugcuaugauucuuucuuggucagauguccuaauaaguugugcccugagagcugagggaaugacgcgggauacugagaucaccuuagcauaucuaccagcacaugcccuuccucggcaaagacuuccaugggccagguaagaaaccauagucccaguaaaagaacaagcacaacuagccucacucugccuaggcaguguccugaacaggagagagagagaggcaggccagcccuuggucagcugugaaguaaaccccgugcucuggugccuucccagcuggcuucucagggcugccuuccacgcuggaucaucagugcucucuucucccuaucaccaucauuccaaauaccaauuuccucucaagugacuggcaagaaauccuagcuaagguguuagcugacaacagcuuaccaugucacacuuccuugcgcuuguauccgaauaagagauucuuaaaaaccaaagccuucaagauccaagagaauaaaugaaucucuaaugguggguugacagacacuguaacagagacagacugccagggcaacguuuugggacagaagccugcuugacacagcccaaauuaaaccauagaagcagcauccccauacuaaaaaacaacagcugacauucauuaaccauuuauuggccauauugugccaguuucaaugccaggugcuuuauauauaaucauauuuaaucuacacuaaaaccuuaagagggagguaccaacccuguuuuacagauuaggaaacaaagcucagaaagggucaaauugccaaagugggaggcaaaagggaucuuacgaagggccugugcgccuuccacaaggcuccacuacuguacccgccucauuguuuaccaccuuuuucaaggccaguaacacacaaccacagcccuucagcaucuacacgccuccugagauguggcaucccggggaaguaccacagcaggagccaggaaggaaagcuggcuccagaucauacugugauacacacagccggccuuuccugggugggcauuaaccugccccaaugccuuuggggaggacaauucuaggucaucaggagcacuuaccuggacuccaggcucugaagaaaggaucauaaccaccuccaccccauuuucacuguugugaagguggcuggcugcauaauuuagauuuuaaaugacaucagggcagcaauuuuuaugguaugagagaaaagaugcuucaacuccuacuugugcuuagcacaugaugaaagauuaugacaaauggauacagcuuaggaacagacauaaggauaaaagcagcuucuguugaugaaagucaguauuaacauuuuucugagacuagacucaauagagcuaauauaaaugggccagaauaauuaugcucugaaagcucaucuauuugguuggacuauuauccaaaagggacuuccuaacucgguccuuaaguaaauucaucagcaugccuuuguuaauugugcaucugcuaaagcucacgauggggagcauggcauccucaugagguacaaguuggggaggggacacagcccugggcccugaagguucuuuucugggccauuccaccgccaacccaugccagagacagccccaaccucacgcuguagccagucccauucucaggggccccugggaucccauucuuacuguccuugaagaagaggcaaauaaacagcaccaacaggaucucagagggcauuaaaaacucaaaaggacucgugacuccuaacuguauguuuuccccugcuccacgaaguggggggaaaggcagagaggaaacaaaugauuucagagagaagguggaagcuugccaugagccagaggugaaccacagcuaagcuggauuguuauuaaauucaucacaauugucauuugcacuucaaggaccucccgcuccagagcuuccagcgcuuuauccaacauuuagugggagcccuggggguuggggaagguggccaggggagggugaaacugucaaauaacugacagugggagcuuaucaagggagaggagagggagggcauuaggagcuggucaagggcaggcuguugcugggacaagccaaguaaacagggccaggaaccguagugugcugcagccaggccaagcucagggccuuucugggcauucuccuccugccaguggcaauggcagaagcccugagcaguaagcucuagguuaaugaaguguggcccagaaagaacagggagcuacagacaaaaggaaggaggauacagagauggagaugaacugagaaaguacaagggagagaggaguagaggaagaaaaagagucuuacuuggaacugaugcccaccacacaggcacucagcuuuugggaagaauccugacauucacagcucucacaaacuggcugugugauuuuggccaaguuacuuaaugucucugagucuuagucuucuccucaaaaggagaauaaaaacuguagcugccuacuucauaguguuguugggaggauuaaaugagaauacauauaaagcacucacuacaagguuugguaaauggaagauuauaauuaugaauuuaucaucaucaucauauuuuccccaaagggaaacugugucauaagcuuuaaacagaggccagaagacacagggauggggaggaagaagucuaccuacuccaugauccacugccagccacacucacauaagaaagaaacauagaagcccacacccuacucccacaacagcccuggugacagggaggccuucucaagaccucaucaagggucccucccauuuacaauaaagauauuuaccagguucugaugacugaggcagaaggugaagcaggcggccaucagcagcccaagcagcaugcccagaggagccauccuagaugaaggcaggcucuggggagccauagucagggaccugcaggugcaagcauagacaacagaaggucaaugaaaagcuaaugcuugguucccccgcacugugauucccaugucgucacuugcucacaugucagacauuuccugcauagagguauaacgagucuucuaccacuucuagauaauucugaagccuccaucuaccaugguggguccagccauccaacaagagauaugcccuggguagaaccauacagucgaucaggacuccugcauaagcuauuacagcccuagucccuuccuucuucauuagaacuuguuaucagguuguggcggguggucuugacuauaaggagagagggaaacuaaccaacugaucugcaugugaacaaacaugggcacaaauccacauaagccuuuauaaccacccacuucuaaaacacacccauuauccuaccugaagacagauggcaucaauauccucuaagacagcaaaguucgauauucccaagucacaaaaccucucacaucagcuuucaaacagucaaacaaauaaaaguacaagccccaguagcuauuaaaaggacaggcaaaggugggaggaucacuugaggccagaaguucacgaccagccugaacaacacagugagacccugucuccacaaaaaauuaaaaaaacaaaaaaauuagcuaggcaugguggugugagccuguagucccaacuauguggaaggcugaggcaggaagaccacuuaagccccagaggaugaggcuguagugauccaugacugcacuacuacaguccagccugggugacagaaugagaccccaucccuccaaaaaaaaaaaaaaaauuaaaagaauauaaggauggaaggacaucccauguucaugaauuagagacuucauacuguuaacaacaguacuacccaaagcaacauacagauucagagcaaucucuguuaaaaucccaauggagaaacucaucccuaaaacucauaugacauuucgggggacccagaauagccaaaacaaucuuaaaaaugaagaaagggucgggucugguggcucacaccuauaguuccagcacuuugcaaggccaauggguggagugccugagcucaggaguucaagaccagccuggucaacauggcacaaccccaucucuaccaaaaauacaaaaauuugcugggugugguggcacaugccuguagucccagcuaccuaggaggcugaggugggaggaucgcguaagccugggaggcaaagguugcggugagcugagaucgcaccacugcacuacaaccugggcaacagagugaguacccaucuaagaaaguaaaagaagaaaguuagaggacucacucuuccugauuucaaaacuuacuacaaagcuacaguaaucaaagggugauacuggcauaaggauggacagacagaccaauggaauaaaauugagaguccagaaauaaucucauauauggccaauuuuugacaaugguaccaagaccauucaaugagaaaggacagucucuuuaacaaaugguacugggacaacuggauauccacaaguguaagagugaaguuggggccaggugugguggcucacgccuguaaucccagccaaggcgggcagaucacaaggucaggagaucaagaucauccuggcuaacacagugaaaccccaucucuacuaaaaacacaaaaaauuagcugagcaugguggcgggugccuguagucccagcuacucaggagacugaagccggaguauggcgugcacccaggaggcagagcuugcagugagccgagaucacgccacugcauuccagccugggcaacagagcgagacuccgucucaaaaauaauaauaagaguacaguuggacccuuaccuuauaucauuuauaaaaacuaacuagaaaugaaucaaagaccuacauuuaagagcuaaaagcauaaaacuuagaaggaaacauagauguaaucuuaacgaccuuggauuuagcacugguuucuuaaauaugacaccaaaagcauaggcaacaaaagaaaaauagauauauuggacuucaucaaaauuaaaaagcuuuugggucucaaaggauauuaucaaauagugaaaagacagaaugggagaaaauauuuguaaaucacaucucuguuauggguauauuguccagaauguguugagaauuccuaaaucucaacaauaaaaagacaaguaucccaauuuaaaaaugggcaaaggcaggaguucaagaacagccugagcaacauggcuagaccucuucucuaaaaaaacaaauuaaaaauuuuuuaaauuagccaggugugguggugugcaccuacagucccagcuacuuaggaggcucgggugagaagaucucuugagcccaggaguuugagaccucagugagcuaugauaaugccacugugcuccggccugggcaacagagugagauucugccacuaaaaaaaauaaaaaaaauuaaaaugggcaaaggacuugaauaaacauuucuccaaagaagauauacaaauggccaauagggacacgaaaagguucucaacaucauuaaccaugagggaaaugcaaaucaaaaccacaaugauacaccacuucacacccacaaugauggcuguaauuuuuuuuuuaaguaaaauaacaaguguuggugaagauguggauuaacuggaacccucguacauugcugguguagauauaaaacagugcagccacuugggaauagcuugguggcuccucagaaagcuaaauauagaauuaacauaugucccggcaauuccacuccuaggcauaucccccaaagaauugaaaacagggacucaaacagauauauguacaucaauguucauugcagcauuauucacgauacccaaaagguggaaacaauccaagugccaucaaaagauggauuuucaaaaugugguauauacauacaauggaauauuauucagccauaaaaggaaugaaauucugauacaugcugcaacauggaagcuugaaaacauuaucccaagugaaauaagucagacacaaaagcucagauauuguaugauucuaauuauaugaaauauuuagaacagacaaauucauuuagauagaaaguagaaaagcaguuaccggguuaaggaaaaggggaaauggagaguuacuccuuaauagguaaagaguuucuauuuggaauagugaaaauauucuaguaaacuaggauagacgucaagaaaacuuaauccaaauuagcaaaugaucuaggaaagaaaaacaaaauaaaacaagcaaaacaaacaagaaaaccuuaugaaaauucaggaugugucaguauuagcccagacccuuauaagagguuuuaauauuuaucccucagccccaguauaccucauuaggcaguuuacucaauugaggcuuaagugaguuaauuacagggcagcaccucugaagaaugcgguguuuacuuuuucucuaucccacuccugccacauuccucccugcuucaccuuaacaaauuggaccuguggcaugauugcagugggacccaaagcgugccugaacccacucucagaagucauuaccccucugcccugcccacaucuucucaggggucggaagaaacuuucccuaaggacaucugcagccaugaaggaaaacagcccugcuggaccgccacugugcaaaaaagcacagccaaauggaaaagcaaaggcucggguacuaaaaauagcugcuacacucacccagcagcaaaagccuuagcuuucugccagcucccccccucuuuuuuugccgacaaaauggaacggcugagugccacgagagcuucccccagcaaccuggcucccuggggcaccaaucacacugaaagacagggauugaguucacagcaccacaccaggcucuggauaggugacuggccaucccugggugugagcaggagaggggccaggcugggugaggaugaacaagggcaaggcgucaccacaacaggagggagaaggcuagggaggccuagggagaugguuccugagagggcacaacccuagagcugccuauacugcucuauacuucuguuaacgcugcagccuuggcuguggggagaaaaagaauaaagaauagaagugggggacucacagcauuaucaggacaacauacaacaaaacaaagauuaacccaaagccacagauaucccuccccuuccaugagauacucauguguauacacacacacacacagacacacacauacagacacacaguuaugagcuuccuucuuacagcuagggaucaacaacgaaacuggugcuggggaaaaagaagaggaggaagagcuaaaugagaaggaaauagucaagggcaaagaagacaaaugagcagaagggggaggcccagaagggacugaggaagaagaggucaggggcagcugaugcacacacagcagcuucccccacuccuuggagugggaagaggaguggagggugagagaaaugguagcucccacagggcucccagccaucucugucuccugcacacacgcuaacacugucagaaacauuuucugccaauacuaaggaugagagguggauucacaaguggauccuucaucuucccucaauaauuccacauggacugcacagcugacccaguuauugccucuauauauuuuuccacaaaacagggagagagaaugagagagagaaagagaggacaagaacauggagcugaggugggcagugggagagggauggggagauugagaggacugaggagagaccuaggugaggcugggagaaaggugugagauaguuucucaggcuucacaggggcauccagagagcaagagcaaguacaaacuacagcaugcaggcacggaaaacaguguucuccguccuuuuaaggccuggccugcagccacgucaccuggucuugguccuuacucaagaaguggcaggcauaguuugcccugggcuuuaugcuaaagcugagggagaagggaaagggggaaagggaaguggcacacagcuaugcuuugccaggauggcccaccaucacaagcagggacagaggcagcagcaguggcaaaagccagcugcggucccuggcauaaguaaagccaaagucauggcaucccauugaggcacaguuuggcacaccuggccugaugauagugccauucccaaaccacuugccacccauaaacucuggguucaccugaucaauggccccugcauacccugcaaaaaaaaaaaaauccuucucaucauccuuggcuuucaauggaggacagaccuacaucuuuacauuuauggcccucuucugacauaaaauaccaucacucuguccaggaaaggggaaacuauuucagugucucaccgguaacucuuuccuuaaguauccuugggcuuugggacagaagagacaauaagguacuugagaugcccauuuuucuaucaaaaguguccauuuguaggcuguaccucugcuuaaauagagguuggaugcacucaccaaucuguauugccagcuuacugcagcccagagcagauguuuggggagcaggugggaggaggccacucggcccccaccucucucagugccucaugucuuccacacaauucagacaagacuggggguggggauugggcccuguguaaacaagacgucucuucuuaaugucuuuucuccagaauggaaaacaaaagaaugggaugaggauggcaagaagccaauaaagggagagggagcaguauugcugggucucuggcagcuucugacacaccuggcaggacccaugggcaguagcugaguuucaggaccagagcacagaaagaacuggaaaagguucuaaguguccuggacaagcaaagccaacucaguagccugccauggagcccuuggaauuccaucuuauaaaaugcucauguuauuaaccuacacuguauguucauguauuuguuuuccugaaucuccugggaaaagugaaagggcaagaauuccuacuuccauuuuauaaggaagaaacugaagcaaagagacaaaagaaacaaaaacacuggguaguauaacacauggacuugaagucagacagaccuaaggccaauucuuggcucugccacuuccuagcuaugugaucuuggacacaacuucacuaggccucaguuucuucaccuauaaaauagguacauuaagaauuucuacuucaaagguugguagcgaggauuaaauaaagcaaugaauaggaaguacuggguacagcaccuagcaucuaaucaucacuccauuuuuuuauuaguuguuuuguuuguuuucugagacagggccucacucugucacccaggcuggagugcaaugacacaaucucagcucacugcaaccucugcuucccaagcucaagcaauccucccaucucagccuccugaguagcugggacuacuaccgaguagcagauauggugugccaccauaccuggcuuuuuaaaauuuauuauuuuuguagagaugggguuucaccauguugcccaggcuggucucgaacuccugggcucaacugauccacccaugucagccucccaaaguguugggauuacaguccugagccucggugcccggcccacuccaucauuggaauggaaaugaugacugcugcccuggacccgcagcccaucagagccaggccaggcaacuacucuccaaagcuccugcucccuguuagauccacacacuguccagcugacccaugccucaaaugaggaccaaagccuuuuguuggguagcuacucccaggagguaaaggaaauaaauguuaaaggaugacccuccuggcugaaaauggagaaacccgaggcaguuuucugcugagccccaaggcagacccagcccacucagugcuuuuccuagcauauuggcauccagagagccaagccaccaacaugcagaacugccagcugcaggaacagcuguaagacaaucaccugcuuuacaaacugaagguuagaggaugagcucuuccacagacacacauucauuacuauuuaugggcugcacaaacucauaugcacacauacagucacucaccucuacacaaacagaagugcacuaccuaauuuaagcagacaaauaugaagcuggagaaacaacgcaaagaggacacugaaaggacgccccugacaagggagaacaacgugcaaaggcuuaagaaaagaaauggaauuuuaaagaauaauuugaaggacaagaaaaacaaguuuguaauagucaggcaaacaagcuuuucccgccugagacaauacuaaacagaaagucaagaggcagacagcaauuaaauggaaagucuuugaacagcaaaacaaauguggcuucuaacuaguccagcccccagcuggcaagguggcuggacuggaacaucccugagccaguggccauuuguacaauggggauaauaucuccccuauguuuugaagucaugccuagggccaagcaaagagggacugcucucaacaaacccaaggcacccaagaaaaaagguuauuagaggaggcuguuggaggguagaggguucacaauggauccaagccucugccuaaccagagagcuacaaagagcuacagagagcuacaaaauccaccgugcagccugcaagggagaacaguggcaguacagauguuagcccugccagagggcacagggagccaagaagggcuccacaggcccagcugggaauaggcaccuggaaggaagacaacaugggaugggaugaaaugggaagggcagugaggagcauuccuagcccuuucucuguacucccagagguggaacacgaccuacuccauucccacuccaguagagaagaauacagaucuucaagaagggagcuaaacaaacuagcaaaaaaaaaaaaaaaaaacugcaaucacagcgacaaaaguuagugcauccaaugaaaagaaaucacaugacacaaucgggcaugguggcucacaccuguaaucccaguacuuugggaggccaaggcaggcagaucacuugaggucaggagcucgagaccagccuggccaacauggcaaaaccccaucucuacuaaaaauacaaaaaaauuagccgggugucauggugcacgccuguaaucccagcuacucgggaggcugagacaggagaaucucuugaaccuaggaagcagagguugcagugagccgagaucaugccucugcacucuagccugggugacagagugaggcucugucucaaaauuagaaaaaaaagaaaucacaugacaagcagagugacugaauaaaaagccuagccuggcccucuccagaucucuccuacuuggccacagcuugcaaagaaucugaaugcuagaagugagcuuaaggcucaaucuuuauuuggacugcuaaagacccagaagacauggcaggcacucaauaccuacauagagaacaauuggaauucaaugccauuaggcguggaacuuaucaauggauccaggaaggcuguggcaaccucauaccuguugaagacgaagagguagacagggcuaaggcagggcaagaguuucagugcuaucaacacagaggugaucaucaaagcaacaggagcagagcgacuaucuuucuagggagaaaccuuagagagaaaaggacagcggaccaagcauagucuucaacucauggcugcacguuaggaaaagggagcaagcaaggaaaccagaggagcagccacaugauuagugcagaccuacacaggucaaaagaguggagaauccugagaaaauccaguuguaggcaacaaugucaggagaucagucacuggauuuggcaaugaggcagucagagggcccuucaaaagaguguccacagaugaagacauagaggcacaaggguaggccacuccaaaaggcucaauggguccacuaaauuuugaagauuugaggccacauuucuaaaugugauuuuucaacauuucacuaaagucuuaaugagaaaagagaaaaaaaaauuccuccaugggugcaacagagggauucuucaauaccauacauaaguuccuaugauugaugaagagcuaccccacaacacacaugaccucaggacaaugaugggcaucagucacuccagcagaaggagggggcagggagguaaaauuucuaagaagaaacucccaucagacacaauucuaccuucucugggcucucagccaugccucagacugcccggaggcuuuaguccuuccacuuuguggaaauguaauaauaacuccgccauggcggagacagagaaauacccuagugccaccccuucccccagcauucaaauauacuaucugggcaucccagaggaaaauuaauucugucaaauaauaauuauagucaacauuuauagagaacuuuccauguugcaagcaaaguauuaguucauuuacucuucacgacaacccucugaggugguuccaauaugcugcucauuuuacccaugaggggaccaaaauucagagagguuaaguaacgugccagaguucaugcagccacagagcaguagagucagaauucaaagccaguuuggccccaaagccaugcucuuuccauagccgugcugucucucgaggggucugugaaaucagccacagaaacuggacucaucauuuuauuuguucugcaacaguauaaauaaaaaggcacauuuugugucaggacagaaauuuuuuuuuuaauuuuauuauuauuauacuuuaaguuuuaggguacaugugcacaaugugcagguuuguuacauauguaugcaugugcaauguuggugugcugcacccauuaacucgucauuuagcauuagguauaucuccuaaugcuaucccuccccccucccccaaccccacaacaguccccggugugugauguuccccuuccuguguccauguguucucauuguucaauucccaccucugaaugggugcugggaaaacuggcuagccauauguagaaaggacagaaauuuuuaaaugagccuacuggggcccucuuguggaaagacccaccucuaccauguucuaguuucugcaccacacacaaacacacaccacacacacgcgcacacacacacauaccacacacaggcaccuugauuacuaaaugcccuuggcacagaccagccaaggcauaggcacaggcauucaggaagaagaaaucccuugacucagauugcagccaggcuuccuuugugacuugaucccuuaaacuccuaucacucaagcuuccuagcuauacacgaagcaaaagcaucccugcuccccuucauggagcccagugccaggcacacacacacauauacacacacacacacacacaaaccacaaccacacacaccacguauauacacacacccaacugucuggcaagaacuugacaccucgccccuccaugcagaaaauacacaagacagaaguauuucuacauggcagacaaagacggagucuucuuuggugaauggggcuugccuaagcauaccagcaguugaccagaugaaucagaggaauacucagguccuagucuguacuuuccaguagguccuagacuguaagcuccuagcaagauacagacaaggggaccuacuccuuauaccugauccuugacccugccugagguaccgggagugaucagcccaugucugauaacaaccaagguuacaagaagcuccauucccuuccaacccacuacaguguaauaggaagaaugcaggcucuggauuuugagccaagucuccccuacuagcugugugacuuugggccagaugcuuaaccucuacaaguuucaaccccuucaucuauaagaggacuugauaguaacuauuuaguaugacugucuauauuaaaugagaugacauagagcauauagcacagugccugacacaaaaugagggcucauaaagcuuauagcucucacuacuauuauuagagaaaauucugagcaaagaauaggauaagcaaaagcagcgagggcuucacccccauacagaacugucuucuguucugacaaccaagccccucuuuggagacuagcuucccugagccacaagucagcccacacaccuggacuauacucugggugguuacagacacauuuccauugaaaccuuuaagcgaugcuggcuggcucugcaucagugccagcugacugacaucaaacacuucagagucccgcuuccugaugacucaggccugucuccaaauuccugcugccacucuccuaccucuaagggggagucagggagaguaggaacagccggggcaaaugcagcugaccuagacugcugggaccacuguagacagaugcagcuagcauccagggacuaagggucccagggcuuuucuucccuccccuuuuaaaauaguaacuggaucuccugacaguaugugcgaugggcuuucucuauagccugcucccaaagaacaccagggacuuucacaccacagucauccagauaccacggucaggguucgaggggaggagagaucagaauucaucuuuccuuuccccugaugucucuaagcuuccagaaaacaucagggccucuuaaaggggcuaaaauagggaagaagguaugauuuccaguccauaguucuaaaggaacuaucugcuaacugguaaguacaauuuguuugccauuucuauugcaagcauucagcacucacacucuaaaagcaaauaccacacaaagauaauuucagcauuaaugucaguuccuugagcacacugggcaccauacuauggaacagaauauacaaaagauauugucacuugccucagguggaugauguccuguucacauucaguggauaauguggccuuccacaucuuagucucagacagcauaauuauuaaaaagaaaaggacaggcgcaguggcucacaccuguaauccuagcauuuugggaggcugaggcagguggaucacaugaggucaggaguucaagaccagccuggccaacauggugaaaccucaucucuacuaaaaaauacaaaaacuaguuggggccgggcaugguggcuuacaccuguaaucccaaaacuuugggaggcugaggcagguggaucacccgaggucaggaguucaagaccagccuggccaacauggugaaaccucaucucuacuaaaaaauacaaaaauuaguugaggcugggugcaguggcucaugccuguaaucccagaacuuugggaggccgaggcagguggaucacuugaggcagaaguucaagacuagccuggccaacacggugaaaccccgucucuacuaaaaauacaaaaauuagccagguguggugaugggugccuguaaucccagcuacucgggagccugaggcaagagaauugcuugagccugggaggcggagguugcagugagccgagaucgagccacugcccuccagccugggcgacagagcaagacucugucucaaaaaaaaaaaaaagacacuaauuacaacuuuguaauaaugagcuaggcaauaauuaggguacuccuuaaacuaauuggggagccccaagaaaauagcauuuacuuacagaaacacuuagcaacaauacgaggaugggucaccaagcacaggacuugcuacuaccauguugguaucaacuaugucuuccagguaagucagcaacugcaacauuuuauuuuuaacaugccugagagcccaagacuauuuauaauaccagauccuuaaaaacuugaaagggagaugaauuuuaaaauguacacauuuacauaugugggcagaaacacaaaaaucagaugccucucaacacagcucagggagccauaacucacggcuuucacaaucccaccgaaugcccagagaaaauccgggcaccuucuacaagggaugguaggaagcuggguagguagccaagaaacaaagaaaccuaaacucaguacuuggcaggacaauuaaggagcagaggauuuuaaaugcauuguuucugacucuaaauauggcuacauuuauuaccaauuugggaucagaaaccacauuuaguucugucaugaccacaugcuaaaaauauuaagcagaguauugccuaggaaacagcaguucucccugcugcggcagcuccacuucagagccaucucugccauggucacaggguuuccauccugugcuuugcugagagcacaguuacaagcagaacugacacuguccugccaagacguccccccgcauuuuagaaggcagcaauaggaaccagagcuagggacugcacaaacuccucauccucuccagggcuguuuuaggugucagugaagcucuauuucauaggccuauaacuagaauccaucugacugggagcuccacagcgggagggacaauugucuguguaacauaccacugucuccucauugcccagcacuuuuccuggcacucaaaaaauagccauugauuuaauaaaaucaauaaucuaaaaagaaccauuuggaagaguacaauggaaaauaacacugccauuaaaauagguaaaaauauggacugugguaauacauaaaaacaggugcuggccaggcacaaugguucacaccuguaaucccagcacuuugggaggccuagguaggaggaugacuugaagcuaggaguucaagaucagccugggcagcaaaguaagacucugucucuacaaaaaaaaaaaaaaaauuuuuuuuucauuagcagggcauggugaugcaacuauggucucaacuacucaggaggcugaggugggaggauggcuugagcccaggaguucagggcugcagugagcuaugaucacaccacugcacuccagguugggcaauagcgagaccccuaucuuuaaaagcagaugcauaaaaaauuguugaguggaagugaaagcagcagaaccuaauggcauacauauguaaauuacuacuuuggaaagaaguguguguggccaccucuaugaucacaugugaacuuagaauuauggaaaacugugcucaauggaaucuuucacccugaaauguuaaauaucugagaaaacacuuuaaaauacauuauuuucagcacagaaccuacucccuuaucagcugacuuguucugaucuccugaauggcucagaggccuuguucuuguucagcaaacccaagaucagaccauacacucaucagccaaaggaaacagagaacacauggaaaaagccgcagucuuaaaguccaacuuagcaacuugacccuguaagggcaguuuccaggcugcauaaucagaauggcuggcugcccagacaggcggccaagauggaagugucaaaacaaaaaaguauggaaaaguucaccuggcccaacuucaaagccaaagcuccaaaaagguaggaguuuaacaggcacuuacuggccagcaaggugccuguuaagaaggguagcaguacacuaauccuucucaaacucuucacaaaaaccaaagagaagggaaacacuuccuaauucauucuaugaagucagcauuacccugaaaccaaagcaagacaaagacacuauaagaagacuccagaccaauaucucuuauaauauacaugcaaaaaauccugaacaaaauacuagcaagccaaaauucagcagcauauuaagagaauuauacaacaugaucaagugguguuuuaucccaggaauacaagaguggcucaacauaugaaaugcaaucaauguaauacaccacauuaauagaaugaaggaaaaaaaccacaugaucauuucaauggauacugaaaaagcaacugacaaaauccaauauccuuucauaauaaaaaauacccaauaaacccggaauagaaaagaacauccucaacauaauaaaaggcauauaugaaaaacccacagcuagcaucauauuuaauggugaaagacugaaagcuuuuccccaaagaccaagaacacgacaaagauacccacuuucaccaccucuuuuacuuauuuauuuauuuuuuuuugagauagagucucgcucuguugcccaggcuggagugcaguggcgcgaucucgguucacugcaagcucugccuuccggguucacgccauucuccugcaucagccuccugaguagcugggacuacaggugcccgccaccacgccuggcuaauuuuuuuuguauuuuuaguagacaggguuucacuguguuagccaggauggucucaaucuccugaccucgugauccgcccaccuuggccuuccaaagugcugggauuacaagcgugagccaccgcgcccggccacccacuuucaccacuucuauucaacauaauacuauaaguucuagccagagcaauuaggcaagaaaagaauaaaaggcauccauauuggaaaggaagauguaaaacuauucuaugugcagaugauauauacauauauauguguauauacacauauaaauguauauacauauauguauauauacauauauaaacacauauauacacacauauguauauacacauguguauauacauauauacacacacacacacacacacacacacacacacacacacauauauauauauauauauauaugguuuuuuguuuuguuuuguuaagauggaguuucgcucuuguugcccagguuagaguagcggggcguaaucuaggcucacugcaaccucugccuccuggguucaagcgauucucaugccucagccucccaaguagcugggauuacaggcauguaccaccacacauggcuaaguuuuuguauuuuuaguagagaugggguuucaccuuguuggccaggcuggucucgaacuccugaccucaggcaauccgcccaccuuagccucccaaagcucugggauuacgggcauaagccaccacgcccagccaaugauaugaucuuaugcauagaaaaccuucacaaauaaaaccuguuagagcuaauaaauucaguaaaguugcaggacauaaaaccaacacacaaaaaucaguuguauuucuauaucccagagaugaacgauccaaaaaggaaacuaagaaagcaauuccauuuaaaacaguaucaaaaagaacacuuaggaauaaauuuugccaaugaagcaaaagacuuuacacugaaaacuacaaaacgcugcugaagaaauaaaagaagaucuccauuucaauuuuucuguacaacacauaaauaaauaaaaagucauuuuagguucaugauucaaagauaugauauugcuaaaaugauaguauuacccaaagcaauacgcagaugcaacgcaaucccuuucaaaauuccaguggauuuuuugcagaaauggaaaaacccauccuaaaauucacauggaguuucaagggacccugaauauccaaaacaaucuugaagcaggagaacaaaacugcugggcacagugauucaugccuguaaucccagcuacuugggaggcugaggcaggaggauugcuugaggcuaggaacucaaggcugcagugggcuaugacagugccauugcacuuuagucugagugacagagcaagaucccaucucuuaaaaaaacaaaaacaaaaaacagcaaaguugaggggaaaaaaagaacaaagcuggagaauuccacaaguccaauuucaaaacuuaccauaaggcuagaguaaucaaaagugugguaaugauguaaggauaaacauauagaccaauggaauagaauugugagaccagaauuaaacccucacaucucuauagucaacugauuuuuacaaaaguguuauugaguaaaaagggauuuuuaaaggacgaaauuuaaaaggcuaaaacuggcagggugcgguggcucacaccuguaaucccagcacuuugggaggcugaggcaggcagaucaccugaugucaggaguucgaaaccagccuggccaacauggcaaaaccccgucucuacuaaaaauacaaaaauuagccgggcgugguggcgggcaccuuuagucccagcuacucgggaggcugaagcacaagaaucacuugaacccgggagguggagguugcagugagcugagacugagccacugcacuccagcaugggcaacaaagcaagccucccaucuaaaaaaaaaaaguuaaaacuauacaguucuuagaagaaaacaugggcaaaaccuucaugaccuuggauucggcaaugauuucuuaaauauuacacuaaaaucacaggugguaaaagaaaaauaaauugaacuucauuaaaauauuuuuaaaauuuuugugcaaaggacgcgaucaagagaaugaaaagacaagggaaugaaacaaaauauuugcaaaucacacaucugauaaggguuuaauauccagaauacagaaacaacuccuacaacagaaagacaaacaaccuaauuuuaaaaugggcaauaaucuugaauagacaucucuccauuguacaaauggccuggaggcacaugaaaagaugcucaguaucauuagucaucauuagagaaaugccaaucaaagccacuucacaccuacuagguaugguuauaauuauugaagaaaaggaaaauaacaaguguuggugaagaugugaagaaacuggaacccucauacaucacuggugggaguauaaaauguugcagcugcuauggaaaaguuuggugguucuucaaaaagcuaaacauaaaauuaccauaugacccagcaauucuuugcuuaaguagauacccaaaagaugugaaaacagugacucaaacagaugcuugcaugugaauguucacagcagcauuauucacuauauccaaaagaugaaaaugacucaaacagccaucacagauaaguggauuuuuauaaaaugugggugugggugugggggcguguguguguguguguguguguguguguguguguguguguguguguguguguauuuccaauggaauauuauucagccucaaaaaggaaugaaguucugauacaugcuacaauaugaaugaaaccuuaaaacacuauucuaagugaaauaagccagacacauaaaggacaaauauugcugggugugguggcccacuaaagugggaggauagcuugagcccagggguuugaggccagccugggcaacacagagagaccucuaucucuuaaaaaauaaauaaaaaaaaaaauaaagaggcaucauaaugacaaauuuuaugcuuuguguguguguauauauaaguaugugaguguguguguguauguauauguauaugagauuguguuguguguuuugguagagauggggucucacuauauugcccagggcagucucaaacuucuggggucaagugauugccccaccuuggccucccaaagugcugcgauuacagccaugagcugcugugcccagccuucugcuguauauauuuuaucauacuaaaaaauuaaaaaacaauguaagauugcccaugaguuagaaauuguuaaaaccggacauuggguacaugaauacauuauauugcucucuucuaaaaauuuaagaaggccaggaaugguggcucacaccuauaaucccaacacuuuaggaggccaaggugagacaaucacuugagcccaggaguucaagaucagccugggcaacaaagugagacccugucucuacaaaaaauuuaaaaacucagccaggcauggaagcacaugccuguggucccagguauucaggaggcugaggugggagaaucauuugagcccuggagguggaggcugcaguuagucaugauggcaccacuguacucuagccugggugacagggugagacucuguuucaaaaaauguuuaauaaaauaaaaauaauaaaaauaaacuuaagaaagaaaaaaauaucuuuucuguaguuuuuugguagauauucuuugucaagguaaagaaauccccuucuuugccuaaacugcuaagagguuuuaucaugaauguguguuaaauuuuaucaaguguguuuucuaccucuaagaugaucauauaguuuuaccuuuaaccuauuaauguggcuaauuuuauguauagauuuucuaauaugaaaccacccgugaauucuuggguaagcucaauuuggucagauaaucacuuuuauuuucuguuggauuuuauuugccauauuuuguugauucuccauguacucccauaauucucugugcaacuaucauaagauccacaaaacuguacuguaaauaugaauugccugaguacaugggacuccuuccucauccacuguuuaaucucuaguuagaucuaacacacagcaagcacucaguaaagguauagcugaugaacaaauaggugaauaaaugggugaguggacagacgaacagauaagcaaauaaacaccuuaauccagaagagugucacuugcccuggcaggaguauagagcagcucuuuucaggcaagggguuucccuugccuuuucagcucuuuucagcucuuuucccaagggguuuccaaccacuccaaagagguaucuaaucugucuguggacaacucaguuugucugcagaucuguaagcugaacccuacccugagacacucaucucaccacuuacccucaucagcaacacucuacagaucagugccugccuucaccaacaggauacagcccugguaucacagcacaccacacagcuuagauccuaugcugggguugaggggaaauguggcuucaaacucaguguuccucucaauuucagaguuuauucccaacaaucaaaauggccucaucccaacccugauuggcauagcaagagcccaucccauuaacaauucacugccucagcacuccagaggaggagagcaaucagcaagagaaacagcugaauuauuucagcagcuguaaauuauguguucucucuuccccuccuccaaguccauguucaacugugccccacaccuccacacugaacuugggucugucaaguaucuaugucaacugcaguaaccaaacuuaaguucaagaagcaauauuaaaaagcacuaauuagcugauauuuaaauaacuguguuuaaugucaacaaaaucacacuuuaaauauccccuagucuauuaguugcuuaauuaaauuccuuaagauccuuggacacuggcacagagcacgcugcccuggggagccguucccaggcccuggcuuuggcaggauguggaaggggaggagcccauaucccuggggaagugccaggagagcccugguuuucuucuagagucuccuaaugagguggcuucucuucacagcucugcuggucuccacagggcagcaagaacaugacaaauaaauacauucugagcauggagaagugccaaaccagacuacaauuuauuuuuuaaagugcauuaaaaaaaaaaaaagcacacauaaacccaagagaguuacuuuucccaucugguaucuguucucuuuaagagugguauaucacaaaacauucaggcauguguacaggggguacacaauaggauuugugacagcagguagggucagggggcccugcaagaugccaccaaccaaaucccagccugccaagagucaucagccugcaacugacagggguacagcucagccaacagcaguguccuaggcuggaacuugcaaagggacucuggguuccagugggugagcuugugauagggauaccagugggaccccaggaagucucuccugccacaguaggcuccauggggauggcuugccagccagccuucucaccaaaccagauuugcuguaaggggaugacaugccagcuaccugcccagguaaacauauccuggaaacagucugucucacuaacugccuccaggcagagcacauucagccaaggaucaguaagcauuaggagucuacauuuugggcagcagacgcucugaacccaaucccaccgggucaugaauaagaaaacaucauuuuaagagcaacaagggugugagagaggccaaguggccguccuuugccucacucuuacaacaagggccccaguucuuucuaguuuccuuacagaacuaccaacucaccucucaguaagucuuacuuuuuugucucuaucacucagccccuuccuacaccuucuauuuugccuaaagggcuugcccuccugcaaaguaggaggcaauucuuuccaauuauuccauccugagucucacugcucagggaucccucuuauggcagcucuccuuaaaacagccacugcagccccugguaaugccagcggaaaacacuggguagaagaagcuugguuaauaucacagacucucacccugaaaugcaaccacucccguuaacaacuaggcacaaacccuggcuucggagaagccaggugcuuggguuguagcucacaaaaaugugaagagcacccaggaaaaaaaaaaagaaacugugcugcccaggcacauuguucacuuacuaccugugguuacacacccacgccaaagccauuucaaccccaggugagcaguuaacagucacgccaaucuggaaaaauauauuuuugcaaaaacauuuuucauucucccauacaggacagcuaccaaaagagcaaauauuugugcucuacgaaaagaugaauaaacccauacugccuacuagggaccauacaacaaguugccaccccaaacacauccaaacagaagauuauucauccuuccacacauauuuguuugagaccugcugcaauccagacaugugccaggugcugcagauacaaauagggguccuguccuccaggagcuuccacacaggcaauggagauagauuggcaauacacacucuuaaggagaacagauaccagaugggaaaaucggcaauuacagcaaacacugaguugaaaagagcccugacagagaugacucugaggcagaagacaacagacgucucauucaggagauggggucagggaggacuuccuagaagaggugagcuuugaugauuaaaagaggaaaaggaauuacagaaacaaagacaauaagaaaggcauccuaggcaggacaagagugguuuuuuaaaggccuggaggcaugaaacuaggaacaugcauuaauuucaacaauauaugcuggagcaaagggcuuauggagaguagcaugaugauauacaagaccuccuugccagacagguuagauagaguucaaacacauagcucacugcacugucuuagcaaaucucuccuuuuuagaacuuccccauggugaaugagagauaagagaagggagaaggaagccugcuauaagccugcaacuugcauaacacagucaccacaguuugugaccucugauuaugaauucauuccuggcagcucagugguuuguuagcucuugcaaacucucaacuucuacuucacuuaauagaaggagccaguaaacagaauuugauuuggacuguauuaucuacccauaguggccuaaaccccagcggauaacuucaacagaaaagcagccugagauuuuagguagucuuccugccaucucuucugggugauaugccugcuguacucuccucuuguauguuccacacuuaagaaguccaaagcucagcuccugcucuucccuccacacgucucauccuccuccaggacugccuaguucuacugcacacgcuggaaacccaagagcucucaaucccuccucucccuucccugucuucuauccccuacucagccaucaucaacuauugucaauuuuaucuacuaaauaugucccucccccuaugcuccuguucucaugcccaaauuauuauagccacuccccacuucucagguaggagcaaccgucgcaagcugucaaucaagccagacccaagcagagcagcaaaaugaggaagccaaaggcacauggcuuugacgaaucucucauuugcucaacucaggguuucuggaauacccaauauccagucuccugaaccccuccuaaaggcucucaauaaaagccacuuucuucuucgguugaagagaggcacucagggagccuauucaauagcaguaacaagcuagaacgugggcugcggggaaggucuggugcuggcgugaguccuccggaaaugucaacacuuugggagccuagcccaaagccaagccuucaauuaugggaauuauaucccaggcaaggcaagcuuggcuccccacagccccaccacucacagugcacggagacauaccuacacagccccugaguugaagaggcuucaucccuacucccucugccacccucccuuggcauaaggaaaaccauuuggugaaagcagguagaaggcagcaauuuucaggaggaggaugcugguauugauaauaccuugaacauuuuccaaaauaaaggacaaaauagguauugaagaagaaggagagaucugacuaugccucccagccucaacucaauggaaaccuucccuuuaccccauucccaaccauuggcccccacaccagccuagaaagaaaaaauauauguugaaugaaugaagaaaugaacaaauagacugaggacagaggaagggggcaacaggagaaaaagaagacccugcucaaaacucuccuuuucauucauucagauaucuccaagcaccuaccguguacuagugcaaggugcugggaacacacaggcaugcaucaacugugaaagagaagaacgacuggggagaaaaacacacuaucugucuggaaugcugucuuuccaaaugcuacuuuaacaacaccuccuguuuuucugacauuaaagccaugccaaacagcauacaugcaaacaaaaacuucacauuuuauuguauccaguacuguggggccuugugguuucuuuucuaaggaaaaacucaucauucaucuccuugauuaaaaauuuaucuaauuuggcuuucauuagguagguacaaggggaaaacacagauucacagggagaacuugcccagcaacaggacugugaugagcucccgcaacugcacaguugggucccaacccaccaccaaggaaagaaaauuaaaaagcucacaauguggaguauaagcucuagccaaaaggaauuaucuucccacaagcauuucugucggauauuugguuaauggaaaaaaaaacuuucaaaagagaaggaaaggaaaccccaaggauauuuaacauguaacuuagaauuucuauauuuuucaaauucccuugcagggagaaaaggcaaagaagucuuuauuucucaauccuacuuuccaaaacuuuuccaauugauacaacauugucauaaaaaauuucaauuuguagagagcauggagcagaagaaggugcaguggcugaggaauuuuaagcugcugcaaagaggcucugaggugagagcaggcagagcugcagcagaggugggagcagcagcccugaacaccgcaggcucggcaauggugccuugggccgugcgucuaagaucaaacaccagggacucaggccugcggcaggccacgcucuccacacaauucuucagguuccuaugcucagacagugauuuggaguaaauggucaggcuuuaaugcaacgucaaaguauccugggguaaaagaucagcaaauuacaaguauacaucuugauuaaauguuuauuuagaauguagagggauuggccaggcacaguggcucacaccuguaaucccagcacuuuaggaggccgaggcagguggacugccugaggucaggaguucgagaccagccuggccaacauggugaaaccccaccucuacuaaaaauacaaaaauuagccgggcaugguggagggugccuguaaucccagcuacucggcaggcugaggcaggagaaucccuugaacccaggaggcagagguugcagugagccgagaucaugccacuacacuccagccugggugauagagugagacaacaucuugggaaaaaaaaaaagaaaagaaaaaaaaaaagaauguagagggauuacucuauagccagaccaugaaucugacccuauccuucccugcuugaaaccauucaaugguuuuccaggacccucagaauaaaggccaaauuccauacucgcaaccugccaccauccagcccugaucaacaucagcagcuucaucucuuuccucucccugccuauugagauggaguuuugcucuuguugcccaggcuagagugagugcaauggcgcgaucucagcucaccgcaaccucugcaucccagguucaagggauucuccugccucggcuucccaaguagcugggauuacaggcauaugccaccacgcccggcuaauuuuguauuuuuaguagagacgggguuucuccauguuggucaggcuggucuugaacuccugaccuuaggugauccgccccccuuggccucccaaagugcugggauuacaggcgugagccaccgcaccuggccuagaguuggucuuauacaacauuucuuacaaugcugaagacaucucgucucccaccuccaggcuuuugcacaugucauucccucugcuuggaaugccauuuccccuccucuuuaucugacaaauuccuacucauccuaaaggcuacagcuuaaaagacacuuccgcuuugaggccuuccccaacccuccccacuacagcaaauucagugcugccagagcaccuguacuucucugaucauagcauuauuauacuuucuuauauaguuguccuucuccccuuccagaccuuaaccauugcaaggacagagaccauguucauucugccuaacuagcucaagacuugagacaaaagagauguuuaauaaauuacugagaugauuuagagucucuguuagacucacuucucaguucuauccugguucacccccuaagccaguuacacgcuugccaccacaacacccacuugccuccacagaccccucacauuucuguccuuaguggauggcucacugaggccuugaccuuaagcacguucaucagcuaucuguugcagcauuugcuaucugauggacacaguguuaaguaacugagauacaaaggugacuaugcucccccuccugccuucuaagagaaaaaaaggggcauauaaacaaauaaucaccacauaguaugauaagugucauaacggugagguaucggaauguagguguuguuaaaccauuuuucccagugcuccucuuuccacaguaccccaagcuaacuacacacuguccuuccucauucuuacagacagaaauccuuccagugcucuuuccccgaguguccagcccagacccaacuucuucaagcugggcucccauucuguuccagguuaauugaaauucuuucuggcuucugcuuucucgccuucuucaguucuuuucucaggcaucucacauacaucccugccucuuuucuuauccugagccaacuuguccaaacuaguauuucuccaucuccucucucaacugucuuggaugauaacuuggcauuuauaagacaucugcauuuacacaaaauguaaauaacagucucugucuauaaugaagaagggacugagccaaaauaucagguaaaaaaaaaggcaaaauaaaccuucaucaacaaaguuuucucccucuacugcuuccucuuacagauccaagugcuagggcaucauggcccucagaagauguucccaauucuguuacauuuccagggacauuacagugcccuuuacucacuaaugcccaggcagugacccucuggccugcccuuucagucucucugaaugcuaaggccacucuauccagccaugugcucauuuaaucaacaugugcugagcaccccugugagccaagagccaugucuuccacaaugcugugcacgcucuguacauaacacaugcuugauuaaugucugugauugaaucacugauaagaaggaaaccaggugagccucuccugccccuugcccaggaauaccccgguguaaaaaauauuuugcaauauagcugaggucagaacccccaccccgaaagccucuuauucaucuaagccuagaccagggagaccuuuacuccagcuaaggagaugcugacacagcccucacaucaccaagccaagugagccagagaaacuaguguuguaaaacaccuuuuuaaucaagugacuugucuccuguuaguguagauuuaggggaaauuuuucucaaggaaccagaaauaaauggagaggaagaaaagaacagaaacuaaugaacauaguaauuaucccccaaaguugcaaaucagaacaauucuucaccugaagacaaguaugaaaaacaagauugaaaugcuucagggauguguuugugaaacagcagguaaaagaacagauaaaauguauuuacaguaccucacuggggauacguaccuuuuggcugauagcuaacagauacuaaauaccgcuguaaaaauaauauuauucuauccuucauuauggaguuauaguuauccacaggaaagcaggaacauaaacuauuuugaaugcuaauuaggaauaauuucagaguucaaguuuauucugagauuucugggcacaaguggguaugagcuggguuaggcccacuguauuagccugcucaggcugcucuaacaaaauaccacagacugauggcuucaacaacggaaaauuuucucacaauucugaaggccagaaguccaagaucaagguuccagcugaagacucucaucuuagcuugcagauggcugcccucuugccaugucuucacauggccuuuccucaguauacacacacacguacacagagugagagagagagagagagagagagagagagaacgagcucucgagcucucuuuaaucucuucuuauggagacacuaauccugugggaucacggcccaaaccugaugacuucauuuagccucacguacuucuuuacaccaaauacagccacacuugggauuaggacuucaacauaugaauuuugggagacacaagcauucagucauuaauacccccuaaagggagagaccuguucccccaaagaccagcccaagcacugauaaaagaaaacagaagacuggguaagaggguggccuuggggauaucugcagaccauagcaggugacagccaaggaccccagggcacaggaggccaaggcaggcaugagggggaacugucccaggucaaauaaacucuuuuuuuuuuuaagacagucuugcucuguugcccaggcuggagugcaguggcgugaucugggcucacugcaaccucugccucccagguucaagcgauuuucccaccucagccucccaaauagcugggauuacaggaacacaccaccaugcccggcuaacuuuuguauuuucaguagagacgggguuucuccauguuggccaggcuggucuugaacuacugccaggucaaacucuuaaggaacuauccucucccuuucacagaagaugacuaaauaauaguaauauaaaauauauguuuacguaauaauaaugcuuucuggauaccaggcaucaacuacauaccuggcccauuuccaagugcuuagcaggcaagauuucauuuaaaucucauggcaauuuaguacagaauauuugauaaucauuuuuauuuuacagauaagaaaauaaguucacacugaugaaagucacuugcccaagguaacccaguaugguaggcagaaaaauaacaucccaaagauaucagguccuaaucccuagaaccuauaaauguuaccuuauuaaaaaaaaaagaagccaggugugaucacucacaccuguaaucccagcuacuuggaaggcuggggcagaaggaucccuugagcccaggaguugagucuggcugagggagggaauaagaaaaaaaaaggaucuuugcagauguuuuuacauuaaggaacuuaaaaugauuauccuggauuaucagcauaggcccuaaaucacaagaagcugagggagauuugacagagacacagaaaagaaggugauugagauuuguagacauuggccuugaagacaggaguaauguguccacaagccaaggaaugcuguuagccaccagaagcuagaagcagcaaggaagaacagauuuugcccuacaagguauagagggagcacagcccugccaauaccuuaacuucagcccagugacacugauuucagacuucuggccuccaaaaccaugaaaggauaaaucucuuguuuuaagccaccaaguuuguguucaucuguuacagcagccacgugaaacuaacacacccagcuagccagacucuaaccuggguccuaugacuccaggccagcacucuugagcccugugccuugcuccuuuucuauacacagccuccccaagccagacuuguccacuaucugaugggugacccugccaagaauugaagcaaucagcacugacagcuccucugcugcaaagccuucucaugagccucuccuuucucccaccaacaucacugcaaaagcuuaucagagacugaauuaucuucuugauguucuaauuaucagguguggagagaaauaguccagaaucuaucauccacaagaggaaguaaaucaaacugucuaacaaagguuuucaucuaauuuuuuguuuguacuuguuuuuccaaucacugagaagcuccuaaccuuuguuggucugcuccauccugcccacaauuucuccuuucccacagagacauguuuggaagguaucagaccacgaguaauucaguuuccucucugcccccugagaaggacugcuauucaccacuuugacuucccaggaacaccaagagaaggagugagccaccugaguccuucucuggaaguuuucaggaugaguguuggugugagcaggcuggcccagagguaccucaaguuaaccaauucuggaauuaacaagcaagcuaauaaacacauugucaggacaaagguaaagcaacccaaaaugcacuuuuugaaccuauucugacaagugugcuucagcuuuaucuguuuaugacacuucaaaaugcagguggagaaacacagcaguauguuuuguaaaaauaaugaugucuugguaacagaggacacuguggcugcuguggcuaugaaaucuuugcagaggagccaguagaaccaguuugggguuccugggagaaaaaucaguuugguggaauagcaaaggggaagacuuggaauuuacuaauguaguacaauaauaguuaauucauuaaaguacccagaguucuacuuuucuuuuugcuagaugcuuuuccucucccucaaccccaugucuuccuucaauccuucaagguuauucuagcaacucucuaccuucuuuugucaagaagguucaaucugauuuuucgucaguaucccaaaacaauuauagcuaacauuuagagaguugcaaaacuggguucacaacaauccuucgucauaggaaccaucauuauuccccuauuacugaugaggcagcugagaucaaagagguuaggccaccuucccaaagucagagagcuaaucaauggcagagccagaauuagaaagcaggucugacuccaaagcccaagaucuuaacuacaauaucaaacugccugccuccaaaugacaccaaaugaaugggggaaaguuaauaguguaagcuagagaagaacuaaaagagacaaauuacacaucuuugggugagccucugaagugcucagaaagacucacaaaaauguucuuagaauucugucuagaaaauuucuuccauuccugcauccucagagagaaucaucuugaaaaugcaguuagucccuaagaauccuugugggaggcaaaugaaucuagaaaugacagcaagcuuaccccuuccccagaugaaccaaaccccucggauuuagcaguaccugaagggagcccaccccugcucccuccaccugccugaucucagcaggcugucaccagcaagauccucauucaucgcaccaugagggaaauaauggagaguccccaagugugggggagaaaaccaaaaaguaauguaaaaagauaaggaguaagaagagaacaaagccuuucaguuaauggcagaugagaaaaaaagguaaaauaauuuuuuaaaaaaagaaaagaacaaagcucaagcuccuauuuauuauguauccgcagguucuaauuuuuuaagcuucuuaagauauucuggcuccaaauuagcuuucuuugcuuaguccuaguuauugcuuuagcucucuucaaaugggccccuaaagauguugaaaaaauguaacugaaaggucaacugguuccaugggaacugcagggagacucucugacaucuugcucugaaaugcuauuuuguaacuuuauaggauaauacccuagaacuaaucaugguaaagaauuucccauucccccuggcaacagggcuaauggaggcuacaggggacaaggggaaagaaagaugguacuaaaagagagagagggaaaaaaaaaaaggccccaucuccucauuuagcagcacaugcgcaaaacaguuucccaaauucuacccaaaucacuaggcuaacacugaugccauccaauuccaaagcaacaugucacacaugacacuguccuuucugauggaagaaaggccagcaggaugugaggagguaaagaacuggggcagcaaagaggggauggagaagaaauauaaaccauaaauuagggccggaagcccugcugcuuguccugccaggagcuggcaaggaaggacugaaucaaguuucugaaacguaagaccaugaaaggggauguuaaaauaaauugagagaaaacggaaaaagaucagaggagagaagagucuuauugcaccagguuugcaauuugucugcuuucugagcugaagcucugaguaccagauuuuuuaagauuuauuuuaagagcuuugaggcuucuuggggaaaaaaaaaaucacuaauuguaccucuuucaaaguuuccagaauuuugcugcaauggaggguauuugcaugaagcaggacaaguuccucuuagagaagugccuauucuuuauaacacaguugugcuugugugugugugcauguguaagagaagagagaccuuuggaagcuguuucccccacagcaguauauuaguccaucaggugcacaggugaagaauacagaggcugauccacucaauucuugugaacacaaagguuggcaacugauuuugaaguucuuacucaggauuuaagaaagaagaggaaaucaaugcaagucaaaauaaaaagagaugcaaguauguuuacuuucuaaacaaaacaaaaacccucaaccuaaaaaaaaauuuccuuuuaaaggcagccucauuaggcaucacagaagugcaggccauuaccaucccugaaggucaagagcaucucaaguuuggggacccuggcugagguaccauuacaugacacagauucacaaaugacagucacaguggggugggagagccuaacugugcauuuuacccaucccaaucacauuuccacaaucacacacacacacacacacacacacacacacacacacacacacaaaaguuauagccuggaggaguagaagagauggagccuaacauauuaccuacaacccuagccagaagacagcugugaaaacuuccgaaagaaaacacuccuuugaagaacugcagaaacaacacaggggccaggaaacagagcaagugaaaaaagauuaaaggaaugaggaucaucauuuagcacugaaaaggggcaguaaaagaagugagcagagccuuaauaaugauuuuugagcccaaaguugguugagagagccacucuaccaaaaagcuguucuaccaaaaaacuaccuucugguaacuacuagaaccuucaaaucccugucuugcugguguauagcugaaauucuugcauaaaaaagggagcgaggccaggugucguggcucaugccuauaaucccagcaguuugggaggccgaggcaggcagaccaccugagguuaggaguuggagaccagccuaacauggugaaaacccgucucaaaaugcaaaaauuagcugggugugguggcacacaccuguagucccagcuacucaggaggcugagacaggagaauugcuugaaccugggagguggagguugcggugagccaagaucaugccacagcacuccagccugggaaacagagcaagacuccaucacaaauaaaaaaggguggggguagcaagaguuucacuaaaaggggacuucuacauaaguuuaaacauaaagacuauuccagaaggauaggggauagucaguaacuaaagcaaguuaauaguaacaagaauaacaggcugggcgcgguggcucaugccuguaaucccagcaauuugggaggcugaggcggguggaucaccugaggucaggaguuugagaccagccugaccaacauggugaaaccucgucucuacuaaaaacacaaaauuagcugggcaugguggcgcaugccuguaauuccagcuacucaggaggcugaggcaggagaaucgcuugaaccugggaggcagagguugcgaugaacugagaucgcgccauugcacuccagccugggcaacaagagugaaacucugacucaaaaaaaagaauaaccaaauacccucagucagccacaaggccaaaucuuuaaauaagggaaaugaaggagaaagcuaacaagcaggcuguccaauauccuucauuugagagccguauagugaagaguagacaacaucuaagucagguuaaagguaaccaugugcuuugagaaaaggaaaaggagaagccagcuucaggugggaaaaaggagcccuagacaugaguagagaccaguaucugcagggcuacaguucucaacacacaaagaauuguuuuugggaaagcuaaugaacaucugucggcuaacccuguucuagacacucucucuuucucauauccaucccugggauuuuauuaucuuaagaaccaggucuuugagcaccaauaacauuuaggacucaaacguuuucaaaagugaccagagucccacaucuuccuuacucccaggagcuuggagcacuucccuagaaaagcaaagaauuagaauugcuggccaggugcgguggcucaugccuguaaucccaccacuuugggaggcugaggugggcagauugaguccaggaguuugagaccagacugggcaacauggcaaaaccccaucucuacuaaaaacacaaaaauuagcugggcaugguagcacgcucccguaguccccacuacuugggaggcugaggugggaggaucaucugaggcugggaaguggucguugcagugagccaagaucaugccacugcacuccagccugggcaacagagagagacucugucucaaaaaaaaaaaaaaauuaggauugccuaggccuuaccaggugggcacaccagcacugagcagucccccuacagucucuacagcucccaaacauacaggcccuacgaaaggagaacaguuacacuggccaauauuugccaugaaaaaccaggccacuaccagaaagagaagcacuauccccucugaccucuccaugucucacccugccacccacucacauucugugaauuuguuucuaucuggccauugucaauuccugucuaaugaccuuaucuaagaacuuagggaguacuacaaaaaaugucaguaaaaaaucagagugagauaaauuugcuauuccuggugagcuuuuguguuuguuuuauuccaaaccaauucacuaaagcuugcuuccuuaugacagaaauccuaaaaaucaaugcucaaagccuagcaaccacaaacucccccuuccaguaacaaaaugcuaggaagaaagagagccacauaaaacgaaggaaggggaaaauggccucuccacagacuguuccaauuaaugggaguggaggagcacaauaguuaaugaauaagaaagaaaaucaucuugauuacauuuauuuaaggaacaaagcaguaggaaugugaaugugaacaccuguguacccagguucagcguaauaaaagaacacauucucauucacagcucauucauucaacaaauguuguuugaucaucuacuauaugccagguaccuuuccuaggacugggaauacagcugugaaugugacaaacagaucucgucccuacucucaugaaacuuacguucuaguggagggaaaacagagucaacaagaagcagaaaagcaagaaaaauaucaagugguuaaguuauggugacuuaaguagucacuuuauaccagauaaaaggaagagccuuucuuguaaauaacagcagaacugagcugagaaugacaaagagcucauccaaugaagacgagagaaaaauauucuaggcagaggguacagguggagcaaaggcccucuguuuaagaagcagaaaguaaguuacuguguccagaacacagaaggcaagcagaagggaguaggggagguuaggagauaaagcugccaaggaaggcaggcagggaucggaauaugaaaggccuuauaaccaggcuaaggaguuuggaguugauucuaaguaugauggugagcccaaagggcgucaggcagcaaggugacgugcuccuuaagaaauugagggaaacugauaacugauuccaagauggaaacugacuuuucagaaaaguuaucuaaccacagaaauuuaaaacagcuuaauuuccccaaaagaaaugcuucacuguuuuguuuuuuuuucgguuuuuucuuuuguggagacaagguaucgcucugucacccaggcuggagucaaguggcaccaucucgucucauugcaaccuccaccucccagguucaagcgauucuccugccuccgccuccugaguagcugggauuacaggugcccaccaccacgccuggcuauuuuuuguguuuuugguagagaugggguuucaccauauuggucaugcugguguugaacuccugggcucaagugauccgcccgucucggccucccaaagugcugggauuacaggcaugagccaacaugcccagcugcuucacuauuuuuuaauuuaucaguuauuaaauaugcacuaagugaagggcacuguacuaaauguauuaaauauuggguuggugcaaaaguaauugugguuuuugccauuuaaaauugcaauuauuucauccucauccagcacuguaaguagauauuaucaucucaccuauaauuccuauaauucacgccuauaauuccagcacuuugggaggcugggcgggcagaucacuugaggccaagaguucaagacuagccuggccaacagggugaaaccccgucucuacuaaaaauacaaacauuagcuggguaugguggcguaagccuguaaucccagcuacucgggaggcuaaggcacaagaauagcuugagcccaggagacagagguugcaguaagacaagaucgugccacugcacuccagccugggcaacaacaagagaaugucucaaaaaaaaaaaaaaaaagauauuaucaucuccauuuuacagauaaaguaaccaaaguucagacaggaggggaaaugacuugccaaaggccacgcaacauguacauggcacaaagccaggaagggacuccaagucucucugacucaaaagagccagugcaccagcuacuuucucuaaugacuccaucccuucccucacaagagggaagagaaaaaacaguucuuucugguuacuacucaaagcuucugcccauugccuucucucuacuugaaggagccgcucaccuuccccaguaagggacacagauugaggccugacuccaaauaccuucuccaagaaccuucccuaacaaggcaaacccaaccccacuguccccaugucguuagucagccucucucagccccuagggucgggcccauggguucugucccuaaugaaacuugagcucuuuaaaggcauuacaaucuucaccauucauugagcaccuaccaugugccaagcacaugaccuccauuauuucauuucauccuaacugcccuaggagguggguaucaguacacacuuauucagaugaagaaacuaagucacagaaguaauaagaacaaaguccaaaagcuaguaaggaagaggugggaagaugguagaguagaaagcaaugaggacuaaacucugauuuuaucuggcccaaauuccuaucuaaaaggucuggggagucauguccuacaaacaguaaauucucaucagauggguuuuauuuaaccauguauauugagacuuacuuuccaaucugacucuggcauaacaaggaagaaaauaaaaauauuuuaccccaaaacauguuucucugccauaucuugaauggcccugcaaagugaucccuugugggaaaaauccacauauucuauagagaauccccuacccccuuguuuuccuuucuuccuuccuuccuuuccagauccaggagauaaucaacuaagagucacgcauucuuuuagguccgauaagaaacauuuuacaaccugcucucucugaagugugcuaccugagagcuuccucugcacaauaaaacuuggucuccacaauccuuuauguuaaccuaaacauuuccuuucuauugaucccagaucuucagauaaacucaaccgucagccagaaaauguuuaaauuuaccuauagccuggaagcccccacuuugaguugucccaccuuucugaaccaaaccaauguauuucuuguuuguuuguuuuuuugagauggaguuucauucuuguugcccaagcuggagcacaaaugugugaucucggcucacugcaaccuccaccucccagguucaagcaauucucaugccucagccucccgacuagcugggauuacaggcacaugccaccacaccuggcuaauuuuuuguauuuuuaguagaaacaggguuucaccauguuagccaggcuggucuugaacuccugaccucaggugauccgcccaccuuagccucccaaauugcugggauuacaggccaaaccaaugucugucuuuuuuauuauuuuuauuauuauuauuuuuugagacggggucucacccugucaccaggcuggaauacagugacacgaucucgguuuacugcaaccuccgcuuccuguguucaagugauucuccugccucagacuccugaguagcuggggcuacagguacaugcccaccaugcccggcuaauuuuuuuuuauuauuuuuuaguagagauggaguuucaccguguuagccaggauggucucgaucuccugaccucaagauccgcccaccuaggccucccaaagugcugggauuacaggccugagccaccacgccuggccuguauuucuuaaauguauuugauugaugucuugugccucccugaaauauauaaaaccaagcuguaccccgaacaccuugggcacauguucucaggaccuccugagggcuaugucaugggccauggucacucagguuuggcucagaauaagucucuaaaaaauauuuuacagagucuaacucuucgucaacagcacagaaaucugucucccuaacuagacaacaacugcacugacagaauuugucugauauaaaucagagucaugugcugcacauuucagucaacaacagaccacuuauacgacaguggucucauaagaugacaauggagcugaaacauuccuaucaccuaguauuuaccauuaaauacuucuuauugcuauuuuagaggguacucauucuacuuauuuuuuaagaggggccaggcauaguggcucaugccugcaaucccagagcuuuagaaggucaagacaggaggaucccuugaggccacaaguucaagaucagccugagcaauauagcaagauccuguccuuacaaaaaauacaaaaauaggcguggugaugaguaccuguagucccagcuacuuggaaggcugaggcaggaggacugcuugagccaaggaauuugggguugcagugggcuaucaucaugccauugcauuacagccugggcaaggagugacuuuuuuucuuuuuccugagacaggaucucauucccauagcccaggcuggagugcgguggcaugauagcagcucacuggagccucaacuuuccaggcucaggugauuuucccaccucauccuccuaaguaacgggcacuacaggcacacaccagcacaccuggcaauguuuuuguuuuuuuugagacagagucucacucugucgcccaggcuggagugcaguggcacaaucucagcucacugcaagcucugccucccaagugcauaccauucuccugccucagccucccaaguagcugggaauacaggcacccaccaccacgcccggcuaauuauuuuuuuguauuuuuaguagagacgggguuucaccguguuagccaggauggucucgaucuccugaccuugugauccacccgccucagccucccaaagugcugagauuacaggcgugagccaccgcgcccagccuuugucuuguauuuuuaguagagacuacuaacacgguuucgccauguugcccaggcugauccugaacuccugggcucaaguaacccccaccccccgccucagccucccaaagugcugaaauuacaggcgugagccacaguacccagccaaggaguggcuuuaaaagaaaaacaaaguuaacuguaaaccagccucaagcaggucuuuccagaaggcacuauuaucacaggaaaugacaguuccaagugugugauugccccugaagaccuuccagugggacuaaaugugaagauagaagacagugauguuaaugauccugacccuguguagaccuaggcuaauguauuuuugucuuuauuuuuaacaaaaaaaguuuaaaaaguaaaauuaaaaacugcuaauagaaaaaugcuuacagaauaauguauaaauauuuuugugccguuguacaauaugcauuuguuuaagcuguuauuaugagucaacaguuuuaaauuuuaaaguauauaaaguaaaaauauuacaguaagcuacagcuacauuuauuauugaagaaaaaauuuuuuauaaauguagcguagccuaaguguacaguguuuauaaagucuacaguaguauacaguaacauccuaggcuuucauauucacugaccacuuacucacugacucaccuagagcaacuuccaguccugcaagcuccauucauguuaagugcacuguacagggguacuacuuuuuauuuuuucucuuuuaauagguuggggucuccuucuguugcccaggcugaucuugaacuccugggcucaagcaauccuccuaccucagccucccaaguagcugggacuccaggcaugugacacccgugugcagcuaccauuuuuuaucuuuuauacuacauuuuuacuguaccuuuucuauguuuagaaauguuuagguacauaaaugcuuaccauuguguuacaauugucuauaauauugaguacaguagcaagcuguacagguuuuagccuaggagcaagaggcuauacaauaaagcuuagaugugugguaggcuauaccaucuagguuuauguaaguacacuuuaugagguuugcacaaggacaaaaaucacuuaacacauuuuucagaacuaucccuguuguuaagugaaguauggcuguauuuuggaacucuggaaacaacugaagccuugcaacuuccagggaaaggccuugauggcaaauugcaguuaaugucuaucaauuucaacucuuagcagaguagcagcuacguuucccccaacuucacggcagguaguuguguauguguuccuggagcagcuugcacacagcuugcacaaaaagaacacugucuuccaaauacuggggaucugugcugauucugauugcugcuucugauuacagaggugcagacaaaguaguagcagagauuguuguugcuccucccagcccgguugcaagccccuuucccucaggcugaagugacuuccuggagauuuaaagggccaaugcuuuuuuuuuuccuccccugaucauuuaucuuuuucaccuuuugggagucagacauuaaagaacauucaagcaaggcgcagugacugacaccuguaaucccaguauaggaggccaaaacaggcagaucgcuugaacccaggaguuuaagaccauccugggcaacauggcaaaaccccaucucuacaaaaaauuaagugggccugacggcacgugucuguagucccaguuacucuggaggcugaggugggagaaucaccugagcccaggaaguuaaggcuguagugacuugugaucacaccacuucacuccagccugggcaaugaagacccugucucaaaaaaaaaaaaaaaaacugaauuuuuaaaggcaacuacauaagccuguccagucaugcaugcuuguagucccagcuacucaaaaggcugggaugggaggauugcaugagcccaggaguuggaugguauagugcauuauaaucaugucuaugaauagucccaguacuccugauuggacaacauagcaagauccugccucuaaacaaaaauguuuuuaaggcaucuacauguguaaggaaaaucagaaagucacugcacaugcccaggggaaagugcaggcucaaaagagaccugagaagaccuuaaguuuacaccugaggcugauccucagcacacaaagccuaugacaauaaaaacaaaaacgaaaaccacaaacacugggaaaggcaaaagaucugcuuuccaggguuaccacauuauuauauucaaauguccaguuuugaacccaaaacacaaggcauacaaugaaacagaaaaguaugguguguguguguguauguguguguguauauagauagauuuuuuuuuuuuuuuuuugagacagagucuugcucuauugcccaggcuggacuggagugcaauggcacaaucuccacucacugcaaccuccgccuccuggguuuaagcgauucuccugccucagccucccgaguagcugggacuacaggugcacaccaccacaccuggcuaauuuuuugaauuuuuaguagagaugggguuucaccauauuggccagucuggucucaaacuccugaccucaugauccacccaccuuggccucccaaagugcugggauuacaggcgugagccaccacgcccggcccaaguaugguauauuuaagaaaaaaaaaagcucuacucccucuccccucuccccucucccucuccccacggucucccucucccucuuuccacggucucccucucccucucucuccacagucucccucugaugccgagccgaagcuggacuguacugcugccaucucggcucacugcagccucccugccugauucuccugccucagccugccaagugccugcgauuacaggcgcgugcugccacgccugacugguuuucguacuuuuuugguggagacgggguuucgcuguguuggccgggcuggucuccagcuccuaaccgcgagugauccgccagccucggccucccgaggugcugggauugcagacggagucugguucacucagugcucaauggugcccaggcuggagugcaguggcgugaucucggcucgcuacaaccuccaccucccagcagccugccuuggccucccaaagugccgagauugcagcuucugcccggccgccaccccgucugggaagugaggagcgucucugcuuggccgcccaucgugugggacgugaggagccccucugccuggcugcccagucuggaaagugaggagcgucucugcccggccgccaucccaucuaggaagugaggagugccucuucccagccgccaucccaucuaggaagugaggagcgucucugcccggccgcccaucgucugagauguggggagcgccucugccccaccaccccaucugggaugugagaagcaccucugcccggccgcgaccccgucugggaggugaggagcgucucugcccggccgcccccaucugagaagugaggagacccucugccuggcaaccgccccaucugagaagugaggagccccuccgcccagcagccaccccgucugagaagugaggagccccuccgcccggcagccaccccgucugggaagugaggagcgucuccgcccggcagccaccccguccggaagggaggugggggucagcccuggccaggccagccgccccguccgggagggaggugggggggucagccccccgcccggccagccgccccguccgggaggugaggggcgccucugcccagccgccccuacugggaagugaggagccccucugcccagccagccgccccguccgggagggaggugggggggucagucccccgcccggccagccgccccguccgggaggugaggggcgccucugcccagccgccccuacugggaagugaggagccccucugcccggccagcugccccguccgggagggaggugggggggucagcccccugcccggccagccgccccguccgggaggugaggggcgccucugccccgccgccccuacugggaugugaggagccccucugcccggccaccaccccaucugggagguguacccaacagcucauugagaacgggccgggaugacaauggcgguuuuguggaauagaaaggggggaaagguggggaaaagauugagaaaucggaugguugccguaucuguguagaaagaaguagacaugggagacuuuucauuuuguucuguacuaagaaaaauucuucugccuugggauccuguugaugggugaccuuacccccaacccugugcucucugaaacaugugcuguguccacucaggguuaaauggauuaaggguggugcaagaugugcuuuguuaaacagaugcuugaaggcagcgugcucguuaagaaucaucaccacucccuaaucucaaguacccagggacacaaacacugcggaaggccacaggguccucugccuaggaaaaccagagaccuuuguucacuuguuuaucugcugaccuucccuccacuauuguccuaugacccugccaacucccccucugcgagaaacacccaagaaugaucaauaaaaaaaaauaaaaagaaaaaaaauaaaaaagaaaaaaaaagaaaaaaaauaaaccaaaagaaacuauccccgaaaagaccuaauggcagaucuacuagacaaagacuuuaaagcaacagccuuaaaguugcuuaaagaacuaaaggaaggcauggagaaaaaucaagaaaacaauguuuggaaaaagauuaaaauaucaauaaagauacagacaucuuaaaaagaaaccaaaaauucuagagcuggaaaguacaauaacugaaauaaaaaauucacuagaggaauucaaaggcagauuugagcaagcaaaagaaauaaucugagaacacuuggagacuggacaauggaaauuaucaagucugaggaaaagaagcacaaagacugaagagaagugaauagagacuaagggaccuaggggacacaaucaagcagaccaacauacacauugugaaagucccagaaagaaaagauaaguagcagagagaacauuugaaaauauaaugguacaaaauuucccaaauuugaugaaagacacgaacauaaacaucugaaaagcucaacaaacuccaaacaggaugaauacaaagagacucacaccaagacacauuauaaucaaacuguugaaagacaaagggccagguaugguggcuuagagccaggcaugauggcugaugccuggaaucccagcacuuugggaggcugaggcaggcaaaucaugaggucaggaguucgagaccagccuagccaacauggcaaaacccugucucuacuaaaaauacaaaaaauuagcugggcaugguggcaggugccuguaaucccaguuacuugggaggcugaggcaggagaacugcuugaacccgggagguggagguugcagugaggcaagaucacgccacugcacuccggccggggaauagcgugagacuccgucucaaaaaaaaaaaaaaaagacagacaaagacaaaaucuugaaggggagaaaagcaacucauuacacacaaggauccucaauaagauaaggagaucucucaucagaaacuuuggagggacccacucccaagauggcagccgcaauggcugccagcuguugcggccacagugaagacaggcagcaaaacaccagcuggucccagauucacugcuaagugcugaggggaguuuuucucuauccucugugacauuuccaauuuuagauaaugccucacaucucugcccccacuccagaacccgcugaugcccccaugaucccaaagaagacagccuacccuagaauucacccccaggauguugcaacaccacauuuuguuuuuacauaauuuaagagacuaaugcauuaaaaaaauagauauagguuauguuuuuagacacacaacguguaagaugcaauaucaugacaucaacaacugaaaggggugagaaauggagcuguugaagaagccgaguuuucuaugcuauugaaguuaagcuauuauaaauucaaauuacaguguuauaacuucaggauguuaaauguaaugcccauggcaaccacacagaaaauagcuaaagaauauacaccaaaaaaaaugagggccggguguaguggcucaagccuguaauaccagcacuuuggagaccaaggcaggcagaucacuugaggucaggaguuugagaccagccuggccaacauggugaaaccccaucucuacuaaaaauacaaaaauuaguugggggugaugacaggagccuauaaucccagcuacucaggaggcugaggcaagagaauugcuugaacccaggaggcagagauuucagugagccaagaucaugcuacugcacuccagccugggaaacagagugagacgcugucuuaaaaauaaacaaaaauaaauaaauaaauaccuaaaacuuacacgggacacagcaaaagcaauacuaaaggagaaauuuauaacuauaauguguacauuaaaaaacaggaaagaucagccaggcacgguggcucaugccuguaaucccagcaccuugggaggccaaggcaggcagaucacgaggucaggagaucgagaccauccuggcuaacauggugaaaccccgucucuacuaaaaauacaaaaaaaaaaaaaaaaaaauuagccgggcgugguggcaggugccuguagucccagcuacucaggaggcugaggcaggagaaugacgugaacccaggaggcggagcuugcagugagcugagauugcaccacuguacuccagccugggugacagagugagacucugucucaaaaaauaaaagaaaaaaaaaaaaacaggaaagaucacagacaacaaccuaacuuuacaauuuaaggaacugaaaaaagaaaugcaaacuaaacccaaagcuagcagaagaaagaaaauaauaauaaagaucagagcuaagaucaaugagauagagaauagaaaaauaauagaaaaaaaucaacaaaccuaaaaggugguuaugcaaaaaagaucaccaaaauugacaaaccuuuaccuagauggacuuuuuuaaaacaggccaggcacagugguucacaccuauaauccuagcacuuugggaggccaagauaggauugcuuaagcacaagaguucaagacccgucugggcaauaugucaagaucccaucucuacaaaaaauuuuaaaauuagccaggcaugguggcaggugccuguggucccaacuacuugggaggcugaggcagaaggaucacuugagcccaggaggucaugacuacgccaccaaacuccagccugggcaacagggugagacccugucucaaaaaggaaaaagagagagaggacucaaauuacuaaaaucagaaaucaaaguugggccagguaugguggcacaugccugugguaccagguacucaggaggauccuuugagcccaggaguuugagaccagccugggcaguacagcaagaccccauuucaaaaaaaaacaaaaaagacugcagggugaaguggcucagccuguaaucccagcacuuugggaggccaaggcaggcagaucaccugaggucaggaguucaagaccagccuggccaacaugccaaaacccugucucuacuaaaaauacaaaaauuagccgggcaucauguuaugugccuguaaucccagcuacucaggaggcugagccaggagaaucacuugaacaugggaagcagagguugcagugaagcgacaucaugucacugcacuccagccuggaugacagaguaagacugugucucaaaaaaaaaaaaaaaaaaaaaaagaauaaaagaaaaaaauaaugaaaguggagauauuaccacugauucuacagaaaugaaaaggauuauaagaguguacuaggccaggcgcaguggcucacaccuguaaucccagaacuuugggaggccaaggcagguggaucaccugaggucaggaguuggagaccagccuggccaagauggcaaaaccccgucucuacuaaaaaauacaaaaauuagcuggcaugguggcacgcgccuguagucccaguuacucagaaggcugaggcaggagaauugcuugaagccgggaggcggagguugcagugagcaagaucgcaccacugcacuccagccugggcaacaagagcgaagcuccaucucaaaacaaacaaacaaaaaaaaagaguguacuaugagcagguguacaccaacaagcuugauaaccuagauauggacaaauucauagaaccaaaaucuaccaagacugaaucacaaacaaauagaaauucugaacagacagaccuguaacuagcaagccaacugaaccaguaaucaaaaaucucccaacaaagcaaagcccuagaccugauggcuucaccaaacauuuaaagaacuaacaucaauccuucucaaacuuuuccaaaacauugaagaggaaggaauauucccuacuuuauucucugaggccagcguuacucugauaccaaagccagacaaacacuacaagaaaacuacagacuggccaggcgcgguggcucacgccuguaaucccagcacuucgggaggccgaggcaggcagaucaccugaggucaggacuucaagaccagccugggcaacauggugaaaacccgucucuacuaaaaauacaaaaaucaacugagcgugguggcgcaugccugugaucccagcuacucaggaggcugaggcaugagaaucauuugaacccgggagguggagguugcagugagccacgaucuugccauugcaugaucugggcaacagagugagacucagucucaaaaagaaaaaaaaaagaaaacuacagaccuguuucucuuaugaccuuuuuugugagacagugucucacucuguggcccaggcuagagugcagugccacaaucacagcucacugcagucucaaaacccuggucucaagcaauccucccacaucggccucccaaagugcugggauuacaagcaugagccacugcacccugacucuuugccacuucauaagaagguggccuuuccuucaguuuccaauaacauguuccuaauuuccaucugaggcaccauuagaagggccuuuaccauccagauuucuaucuacauucugaucaagaccacuuagauaaucucuaagaaaacggaggcuuucucuacagcucucuucugaaccuucgucggaauuacccuuaaggcuccuuucauggcaaugcaccucaaaacuccucuagccuucuacccauuacccaguuccaaagcugcuuccacauuuuagguaucuguuauagcaacacccuacuucucagaaccaauuucuaucuuaguccacucaggcugcuauaaaauaaaaauauuuuagacuggauaauuuauauauaacagaaauuuauugcuaacaauucuaaaggcuuggaaguccaagaacaagaugccaacagauucaacgucaggugagggaucucugcuucauagauggcaccuucuuacuggguccucacaugcagaagaggcaaggaagcuccucgggccucuuuuauaagggcacuaauccuauucaugaggguggagcccucaugaccuaaucaccucccagaggaaccaccucgaggguuagguuucaacauaugaauuuggaggggacacacauucagaccauggcacuaucauuauucccuauuuagagcugagaaaauuaaugggcaggaaagcaaaguaaauaguccaaggucacauagcuuccaaguggagaagcugagauucuuuuuuuuuuuuuuuuuuuuuuugagacagagucucacucugucgcccaggcuggagugcagugacgcaagcuucgcucacugcaagcuccgcuuucuggguucaugccauucuccugccucagccucccgaguagcuggaacuacaggcgcccgccaccacagccggcuaauuuuuuguauuuuuaguagagaugggguuucaccauguuagccgggauggucucgaucuccugaccuugugauccaccugccuuggccucccaaagugcugggauuauaggcgugagccaccacgccuggccuuuauuuuauuuauuuauuuauuuauuuauuugagacuggcucugucacccaggcuggagugcaguggcaccaucucggcucacugcaaccuccgccuccugcuuucaagcgauucugcuaucucagccuccugaguagcugggauuacaggcacacaccaccgugccuggcuaauuuuuguauuuuuaguagagaugagguuucaucauguuggucaggcugguuucgaauuccugaucucgugauccaccugccuuggccucccaaaaugcugggauuacaggcaugagccaccgcgcccagccgagaagcugagauucuaacuaaagucagccccaguccaagggccaagcuccuaaccacuaugcagcauggccuuccagaugaauaagugaaaggaguagugggcaaggccacaguaucacuaaagagucuggucuagggucuauacccgcccaccaugcacuuaacacuuggucuggcagcacguaacucugacccaguuuucuuuauaccacaggcaacuccuaaaccucaguuuuccuggacacacagugggaggaacaacuccagcccauuucuggcccuccagacauugguugcugccaagagagaacaugugcacaucuacaucaaccagaacugaauguuacacaaaccacaggugcuggcuuugcuaacuuggcacaucacaucucugggaguugccagugucaguggcuuaaguggucuaaggugaaggggguagcccuuacccaguagugacagccaagagagggauggugacacagcagguuacaaaggacucuguagcugucagccguuaacaugugacaagccugaaaccuccaggccuuuuucugugcagauggaaagaugccaagugcuggcacccugggccaccaugucugcugaguggccaggugccccaacaacacacugacuacuggcacugagagagcacaugaaucaggaggaacaaggccacacuaaaggagauuagucucaagauugccauuuagcugacugaaggaaaacaaccuauuacaguaauguuccuuuucugaucuucauuuucacucccucaacaaaauccauccaguguccaaaagggugcugcucauuugcaaauccaaaaccaccaaaaccaccaccaacucuccaaaggcuuccccuguucuccagguaaauaugaaaugccaugccacagcugacaaggccugcccucaccaaccccuccaaccucagcuggcuccucucacucucugugcuccaaccauacuuucaguuccucauaaaacuccccacccacugccugcuuccagagccuuugcaaauccaggcccucagccugaaauuuuccucaacguccugucacucugcuugguaaauacuuguuuggucuucacaauauuuacucgaacaucacuuccucaaagaagccuucuaugauacccucuuagcccuaggaccaagucaaaucccucucagauguucuuaacucuuucuuucaauacacuuauuccaaguguaauuuuacuaacuuugacauauucaucaguacacucuaagcuggaacccuaucugacacuguaucucagggccuaacagucucuggaauguaacagauguuuuauauacauuuguugacugaaaaaauaaaauuucagagagaaggaaaacgaagcuguauccaaaucaaagaguucuacuuagagcuguucuccucccuacaugaccuuaagccaaacaauucucuccccuucccccuuucucucccaaauuucuuacagaaguuacuuucuguccugacauucuuuaagcuggugguagccauagugauaagcuggccuacagccagaaacagucuaaaaagauaucaccuugucugagugcuccaggcuuccaaaauaaaaguucccagcacaggcccaggcaggcacaaacacaaaagccuuuccccaguaaagacacugaaccaaacaaccaggacccccugaaagaaaugaguaauccccagggcagacagugccccccgagugacccacccaaagaaagaagggaggggaggcaaggcuacaggggcagaagcaggcauucugugcccugaugagauuuuaaacccucuuuuacuccuuggaugaagcagagaugugcccaaacacuaaauaucaaagucgcuccugaugaggcagcuucagaggagguccacagauuguggcucagaaaagcaauaucagcaacuaaagaaguucacauaaagcucuaauuaaggccauuuucccucuacagaagcaggaggaucuucuccuuacccuucucuuauguaggguaggcagguaggggguggcaggaagggaggcagaaguauuuuuugagcaccacuuagugccaggcauagugacagguacuuuauagacagggcuauuaauaaaaaacaaaugggaaaugaauaagcacauacacagauagguagcugaugcucagcgagguuaagcaacuuguccaacuauugaaugguaaggucaagggucacacccacagccagaugugguggcucauaccuauaaucccaacacuucagaaggcagaggagggaggaucacuugaaaccaggaguucaaaaccagccugagcaacacagcaagaucccaucucuacaaaaaauuaaaagauuagccaggugugguggcacaugacuguagucccacuacuagggaggcugaggugggaggaucucuugaccucaggaagucgaggcugcagugagccaagacugugccacugcauuccagccagggcaacagagcaagacccugucucuuuaaaaaaaaaaaaaaaaaaaaguuggccaggcacgguggcucaugcuuguaaucccagcacuuugggagaccgagguggguggaucacuugaggccaggcguucgagacccaggaguucaagaccagccugaccaacauggggaaaccucaucucuacuaaaaacacaaaaaaauuagccaggcauaguggugugcaccuguaaucccagcuacuugggacgcugaagcaggagaaucacaugaaaccaggaggugaagauugcagugagccgagaucacgccauugcaauccagccugggcaacaagagcaaaacuccaucucaaaaaaaaaaaaaaaaaaaaaaaaaucauacccagcuuugccugaaucagacuuuuuucuccuaccccaaugcugccuuugugggucaucuauuagccccacucugcuccucaccccuuuaccaccaccuuccuaaccagaauugggaauguagcuccugguaagcucucuggcaaagaaaagucugucuuccaugagcacaacccaccacaauugauacauacaaaacugagaugcaccaccacuuccuagguuuggagcacaguuuguuguagggagcaaaauucaucaucugcaacuaugggcaugaggcuggauuuucugaaaacccaaaaugagaccacagugaugaagucucugcauuucccagaacccacagcucugggcacuaguaugguauuccugcaguguagcaugccuuaaaccaaaggauggugugcuccaucacaccaucagaaagacaguaccugcaggguagacaaucccagcugaagucuccauagcuccucuagcuaggcagagaggguagcaacuccauaccugagucaccugccucuacacagcaucuucugcaagguuaagcagccauucauugugcuguaguucaagguuaacccuucccccugcacucauuucaggaucugccucuuaucaaaaccuaugccagcugauuauuauaaugauaacuauuaugccauuauaauaacauuauugugcuuuuuuucugcacuugacaucuguuggcugauagguuuaaacaguacauaagcaauaauuaugcagugcucucuccuuuccaaccaagccucuagugugacucuuaauguuacauccaacugcaauaaaugcccagcccgagcagcagugggaaacauggcucaucuggguucacccaccaugccucuagucacagugccagaaacagaggcucaacuaggucccuaauuguuaacaugcuccccugcucucccagggauuugggggaaauacuacccagcaagcaauuuauuguugaaaacccccgcagggcuggaggaguuauauacaagucucaguacugcagagggacaagcaguaccaaaucacaacagcacacaccaucacaagagaagaagcacaggaaaaugcauuccuccacugggaguucucaaacaaaugauuuccagagagucauucugccugguuccccacacacaguucuuggcaauugcugguaaaauuggcagaagggagaggagggguaggacuaucuccaggcuucuauuuugaaguugagaaaucacuaaacuggcugcucagccuucuuuauaggacccgccagaguccaggauagagucuggaggccaaagcagagaagucccaccuccugucagccaaagcccuugcaucuaccuuucacacuguugaugacaaucaagguagaaaaaagaugugagauucuuuaacugcagacuaucaauaugccugaauuacacauuagcccuauuaaaguaaaggcaacccauagcaaggcuucacuaaaaaaugauguuaaaacaaaccucgccaggggaccagggcuggccuguuuuguuuucuacacuguaauacacaguuuuuguuuuuuugguuuuuuuuaaggcagagaaggggguggaagguuauuugaauuuaaacgagcaguaaacacuauaaucugugugcaaggagaaaaggaacauucagaagugccaagugcagccucuugggacauguguggccagggcaguaguagcccggggggcuuucuccuucagccucaacacgcugcucucauugcuugggagcaggcaagccagcaggcaagguccacgcagcacaaaaaggcacuguucccuaggucuaaggagaagauugcccucucagaaggaaauuaauaugacgcaacacggaaugagcagggcgagucauccacagaagucaccuaucuaaggaggggguuugaagagguguuacucaaggcauggaccacaucugucucauucaucacuguauuuccagggcuaagcagguccuggcacacaauggguacucagcaaauaaugguggacugaaugguaaccagaaagaacccuuagguuggaagccacugacaagagcuagaaucuaacuguuccuauuguaaccugugguaacaaaagagccguggacggcaaagaauauauaaagggagccaagagaauaaaaaugagucuaucuccaguaccuggugccuuaauagacugacaaguguauucuggucagauuacaauauagcccuagaaggacaaagugggaaggagaaaaggggaagagggaagagugagaaacaagugagacaaaacauuuauugagugcuuaccauguauauaucugaaaaacccaggggguuucacagcugaggacacaggagcagggggguugaguagcuccucugaagucucacagcuguuacaugguuuaaaucuggguguaucugaugcuaugacccaaaagcuugccaccauaauuugccuugguuuccuccagaggggagcuggcuucccagcuaaucucuccuacagaggagagaugcucuuacauguccacauaaaucaacuuagucgucauguuuauuggaguuaguuaacuggaacugugacuugauggucucuuaugaauuucacaugccugaggcaggcccccaggaacugaaaccuggaugaacuaacuaaguuuacaggccugcaaagcugcacaccaguaagguccuaagucaucagcuuucuagggcaaaccucucuggcccggcacaggucaggucuggguaaggaaagaaccuaagcaugaccucuacaugcccccaaguucuccucagaaauuacaaagaagccuucccuacuccaugcuaugucagccauacacagaauucuauuugaaggcuuuaaauucugauuuaaguaggacuaacagaaguaaaaagccaaggauuucugcaugguccuuagaagcaaaugagccuucccuccauguccauggugcuccugccuccccggaguuuccagagaccuuccacacccaugaugucaggugcagcagaguagaaagggcaaggugauuuuccauauucuauucagaagagaccagaggugagaaucagccagugcuccuaauggaggugaauacccuggacaaacucagaggcagcuuagguuguacuaaaaaacauuuucaagguugucuguuuauugcaccuccuguaugagggcuuucaucaguuaaaauggguuuuuucaaagcacagggaagcggaugauucacccaggugcacaacagcugcugggaagaccugugggaagaggccacccggcaaaggcaggcuguguaugguaagaagggucuccaaggaaugcccuacaugccaagccacaugcugucaggauauuaauccaaacccaucuugcacacuuuacaauguuuacucucucugggauguggagcauuaaauuauauccaaggacuacacaaguccuuccaauucuauuccacacucacuucuuugcuaaaaagauuuguaaccuggaaacaaagcccucugccuaauagcagcaauaacucuccgcaaagaauaggaagccagacugucaguucaaacucuccuaaaagguauugccccauugaagcuuuaguuuagguuucuccaaaaaguggagaaaccuacuacugauccccuuuuuccagagaggacaggccuguguaacuaagcauccugaaaggaggguucaaaccaaaagaggaaagaggaaucaccaccacuccauuccugcccuaacugcaaugguccuggaaaugguaaagaauuccaaagaggacugccucauugcuacaagaacuaagaacaagguacauuaauaggagacaaagcuaccuggauuagucacagcccuacucuggcuagcaguaugacccuaaaugggucauuuagacucuccgagccucaauauuuuaccaccauaaaauggggguguuguguggccaggcacaguggcucauucuuauaaucccagcacuuugggaggucaagguggaaggaucgcuugaggccaggaguucaagaccagccucggaaacauagcaaaaccccaucucuacaaaaaaauuuuaaaaaauuagccaggcaugguggcacaugccuauagucccagcucaggaggcugaggugggaggauaucuugagcccaagauuuugagguugcagugagcuacgaucacaccacuguuacuccagccugggugugagugagauguugucucuaaaaaaacuacaacuaaaaaauaaauaaauggggaugucauaagaaucagacugaaaacaguaaaauuugaaaacaguaaaauauugcacauacuuuacaccugauuguuauuccaaagaccccugcaugagaaacccuaggacauuucuagggagcagagaggccaagcugucacaucugagaggcagucuacagcgacuggguccaguuguuuacagagaaauccauaugucaggaauaaagugaggacagaguaaaauuugaagagaagaccacacaugggucugcucagcuacauuuaaaaaauaacaauacagcaggucuccaaauaacauugcuucgaucaacauuauuuccuuauaacaccgacgagaaaaaaauaauuguuucccagccagggccacugcuuguguggagucugcuuauucuccccaugucuguguggguuuucuccaaguccucagucaccuuccacaucccgaagacgugccuguuagguucacuguugcguguaagggguccagucugcaugagugucagggugugugaguguaccuugaaaugggauggcauccuguccaaggcugguuccugccuggugcccugagcugccgggaugggcucuggccacccaagacccugaacuaauaggguaguaauuaucucacuuguuuuuguuaauccuucuuaaaggaauguauagcucacauuuaucucaguuuuuaauauuagaaguguuuuggucuuuauuuagaaguuuggucauguuucuguaacaagaaauauucuguaggaacuuaacucuuguuuauaccaaugagccauaguaaaauugguuuuguauacauuucacuuaaagucacaguuuccaagaacuuaugaccgaugucaagugaggacuuacuguauaugcauauguuucaaauuugaaaaggcacacaaagacauauagugaaaaguaagucucccuccuucccaauucucuaguuacccagggccucucacuagagacaaacugcacugcuuucaguuucucauguagucugcccgagauaucccaggcagcuaauuucuacuggagauggggauaucauuuguggcaacacucucagaccuagaaggugaugccaggcaaguaagcacugcuggggcacuuagggacuaugaaaaaaaugagacagccagaggauaagauaucaccuugcaaaagguuccauggagaugcagacuuccuucuggcuauuauacuguuuugccccuuggcugaccacauuuaagcagugauucuguacaauguauuucccuuuuaguuguauuuguucacccagagcucuuucucagagaugucauuaacagaaguggccucugggaccuuaugcugcaccagccugaccaccaggcccuucaaaguagccagaagcaggaacaacuaucaaaccugccucaguggaagcugagcaaaagggcaaaaagugcaaaaguucuugagucaccaccuuucuagggacaaaaguugcuuuucauagcccagugaaaucagaauauaagggaggauaaagcccagaccauagauguucuacagggccgaacccaagagauuaagucacuacccacagaaaaucauaggacacuuuuaucuaaagauaggcuuucaccaaacgcccucaaaaguuuucaagcuauguccuccccucccccaccuuuauuauuuuacaaggaauuuaaaugugugaaacuccagccucuaccuaaaggauacagauggguagccuauaggucaaaucuagaccacaaauaugcuuugguagucccuagagauuaugaauaucuggccucccauaugacaugaggaggccauacucacccaugacgauaggcugaguagcagccaccccucaugaagcacauaagcacuccgguuugacacaggccuaccauucucuguugccucucuguucccaacuuggcccuaaaaacaucugaguuggagacuccuagccagugaguaacacaggaggcuaaacuggcaaguacaucagcugaccaaauagcaggacucuugaauucauaaacauuuauugaacacucucuaugugccaggacugugcuggggauuggaugcaugaagaggaaugacagaugcagugucugcccucuaggaaguucuaauccaauugaguguauaaggcuuacucuaaggaauccaaugcuucaaaaacaaagggcucugggaauggagcaugugaacucacuguggcugggaaucaagaaaugcuucagggaaguaggauuucaacaggauuguuaucauuucuuaaguuuucauguaaacauccauucaacaaccauuuaugguauccauauuacacucagcauuaugcuaagagacacauuaaaucacaacccauauccuugagaagcucauauaaaaagagacaaacaucauaccauaauaaaagugugcugaauucuauaauaaagguguugcaauggggauacagaugaggacacaucagguaaggcucacugaaggcggcagcucugcagcauaaaguagggaaccggcugggugcaguggcucacgucuguaaucccagcacuuugggaugccgaggcggguggaucacaaggucaggagcucgaggccagccuggccaacacggugaaaccccgucucuacuaaaauuacaaaaauuagccgggugugguggcacaugccuguggucccagcuacuugggaggcugaggcaggaguaucacuggaacccgggaggcagagguugcaaugagccgagauugugccacuccacuccagccuggggcaacagagcaagacuccaucuuaaaaaaaaaaaaaaaaguaggaaacuaaggagagaguacucugggcaaaagaacuggcagagacaccaacaugaagcauacucagaggaccacguggaucaguucaucaggagcaagggguacacgugggugaugguacggacauauuaauuaaaaugguaggauggguauacacugcaauaggcuuggaacaccaacaaccugauacauuuggaauuuauucaggagcuagugggugccauugaaggcuucugauaugguuugaauuuguguccccacccaaaucucauaucaaauuguaaucccuaauauuggaggaggggccuagugggaggugacuaagucauaggggcggauuucccccuugcuguuuucacaaaagugaguucucacaggaucuggccauuuaaaaaugugcagcaugucccccuugcucucuuucuccugcuccagacauguaagacgugccagcuuccccuucgccuuccgccaugaugguaaguuuccugaggccuucccagaagcagaagucuguacagccugcagaaccaugagcuaauuaaaccucuuuucuuuauaaauuacccauucucagguauuuguuuauaacuguaugagaacagacuaauacagcuuccaagcauaaguauucucugauaagcacaauauauaggaagacccaaaguggcagugguauauaguguccuggaggaagcaaaagcaagaaauaagagggcgcuucuguaauaauucuggagcacagucacaggaaacaggggaagcaacaaaacuagguaaaaaagauacugcagaggcucgcuaaaaagaaaaagacaauggcauuuucuugaauguacuaauuccuauuguuuaccaauucagauuggccuucccuccaaauagugaguuuuuuuuaccuuauuuguuucauacagagaagugaggcauggucuauagucauagugcuuggauuuuuuuaaaaacucaacuugagaucaaaauaaugggauuggcuccaggggcuuuuuccucacucccuugcuacauggaaccaguuguacaucucaaagagagagacagucaacuugagcacaaaaucugggucaguguaugugacugugccuccgugacuuugcacaaggaccagaaaugagcauacaaaucagaggaaagcagugacaaaagucaacauucccuugaugagcuaauugcuucaugucuggcugaagagcagaaagcaagagauaaggagaacauacuaucugagggaccaggcaggcucuggacuagccagcccuaccccaauaaaauccccucaucagacacugcccccgaaacaaggccugcuggcuugagcaccugacaagagagaaccugagaaagauaagcacuaagcugaguaaggaaggagauggcagagaagcagcaaaguuccuugcuacucacaacuuuuaguuauucagcaugaaauaccuauaacuauugguauaaauaauauguaauacaaaccaacuaagacaacaaugaggugaugguuaagauaaaacuugcuuggucagcauaaccuauccugaaacuacgacguggcucagaaacuggaaacuauuguugucaauaaugaugacaacacagagcauuuacaucaggggucccaaacccccgauacuggucuguagccuaucagaaacccauccaaggaggugagcagcaagugagugagcaaagcuucaucuguauuuacagcugcuccccaacgcuugcauuaacgccugagcaccgccuccugucagaucaguggcagcauuagauucucauaggagcacaaacucuauugugaacugugcaugcaagggaucuagguugaacacuccuuaugagaaucuaaugccugaugaucugucacugucucccaucacccccagaugggaccgucuaguugcaggaaaacaagcucagggcucccacuaagucuacauuauggugaguuguauauuucauuacauacuauaauguaauaauaauagaaauagguugggcaugaugcccauaaucccagcauuuugggagguccaggcggguggaucaccugaggucaggaguucaagaccagccuggucaacauggugaaaccucaucucuacuaaaaauacaaaaauuagcggguguggugguacacaucuguaaucucagcuacucaggaagcugaggcaggagaauugcuugaaccugggaagcagagguugcagugagccaagacugugccacugaacuccagccugggugauggagugagacucugucucaaaaauaauaauaacagaaauaaaguacacaauaaauauaaugugcuugaaucauccccaaaccaucccccacaucccccaguccauggaaaaauagucuuccaugaaacuagucccuagugccaaaaagguuggggacugcuguuuuacauugugccagaggaagcaccauaucuauucucugaauucuuaagauagcuauaaaaauacauauuacuauucccauucaacagaucauaaaacuaaggcuuagagaaaauaaguaacuuacaaucugacaacuaguaaguagauaucagaacguaaauacaagugagucugacuccaaaguguguuuaaaccacucugaaauacacucauuccuucucucuuucucuuagagaugucuugaagguuugcuuggaucaccagauaagguccacuguuacaucuggccucauucuuuacagaaacacacaagucuggccugagcacuauuuguuucuaacacggaggaaggcuucaaauucauuuccucugagguaagagcaagagaaacacauuucgacaugaguaggaggaaaaacagcacgacagcaaaaaucuucaaccaugaggguauaagaucauguacaaggcaguaaguggagacagggccuccuccuucccaggagacuuuuaacugcaaaagcauccugcaucuuuacaaugcuuuaaacaauucuaacaacuucuauggccacccuuuguaagaccccuagccugugucccagcucuaacacuagagucccacuauuauguggguggccuaaaaaagauccuaccauuacguggcccacuucacuucucuggggcucaguuuuugucgucagaaaaauaaaaaccuaucaaaugcaaaauggaggcauugggcaguaacagaacuagaaguguaucuccugacucuucacucauccacaguaccacaaacagccagcccugauguuugcaaggaaauaaagaucucuauaauaucuuccagcccaaaacacaaucauuuuagacuuuagcagcuggguccaaggauggagacuuaacuucaagaauacagucaaacccaacuccccaugaguaugagaugggguguggggaaaaacaagaagcaaccuuaggccagagacaguggcucacaccuguaaucccagcacuuugggagaccggggugagcagauuaccugaugucaggaguucaagaccagccuggccaacaugguaaaaccccaucucuacugcaaauacaaaaauuagccggccaugguggcaagcaccuguaaucccagcugcuuaggaggcugaggcacaagaaucacuugaaccugggaggcagagguugcagugagccaagaucacacucacaccugggugacagugagacucugucucaaaaaaaaaaaaaaaaaaaaaaaagcauccuuaaauacuuacuuacaacuuacuuaugagcuggccccuuaagcuuccaauacacacuauccacagcacucaaagcauggccaaucaauguugucuguaucgauuguccuacuuuauguuauuccacugggcugaagccugcuaguuuucuaguuuggucagauggcugcuuuccccuugggagccucacaaaaaugagacuauccccagagguaaagaaauguccauuuaaaagcccacugguauagcugggcaugguggcucacacuuguaaucccagugcucuagaaggccaagguagggcaucacuugaggccaggaauuuaagaucagccugggcaauguugcaagcaagacccugucucuuuaaaaaaaaaaaaaaaaauuaaauuagccaggcaugguggugcacacccaugguccuagcuacuugggaggcugaggugggaggaucacuugagcccaggaguuggagguugcaaugagcuaugaucacaccacuauacuccagcgugggcaacagagugagacccucuuaaaaagggccaggcacaguggcucacgccuguaaucccagcacuuuggaaggccgaggccggcagaucucgaggccaggaguuugagaccagccuggccaauauggugaaaucccaucucuacuaaaaauacaaaaauuagccaggcgugguggcaggcgccuguagucccagcuacucggaaggcugaggcagaagaaucacuugaaccugggaggcagagguugcagugagccgagauugugccacugcacuccagccugggcaacagagcaagaugcugucucaaaaaaaaaaaaaaaaaaaaaaauccacuggcgagugaggcauggugguacaugcauguaaucccagcuacucaggagguugagguggaaggauugcuugaucccaggaguucaagacuagccugggcaacauagcaagaccccaucucaaaaaaaaaaaaaaaaguccauuggcauuagcuuuccucaccagaacuuuaggauguaucucagauuauucuuccaguuucuagaucucuuucccaucacaagacugaagaagcaaacuacuugcagagauggaaguagccagauguggagaugaguucacugaccacuuugauguuuuucugccagugaugauaagugguaaccaaaagggaugaucaagaacuuccucagucacaacauagccuaugagcagaccucagaaacauacccuuccccauuucucuguagaugugaaaugugaaaugugacaagggccaaacaucagacucuucccaaagguuccgauguccagucuggggacaccugggccaacacagcagccccagcugugaagauggaagguccaagaggcaccagagaagcagaugauaaauggaccaccucaaaauccaaagacuggaagaaaauuaaaacaauaaagaauaaacuuggcuggguguggugguucacacuuaauaaucccaguacuuugggagaccgaggcaggagaaaugcuugagcccagaaguucaagaccagccugagcaacacagugagacugucucuaccaaaaaaaaaaaaaauuagccagaugugguggcacaugccuguaguaccagcuacucaggaggcugaggcaggagaaucacuugaacccaggaggcagagguugcagugagccaagaucacgccauugcacuccagccugggcaacaagagcgaaacucagucucaaaaaaaaaaaaaaaaaaaaaaaaaaaacaggaaaggaaacgaaaaagcuugugguacuagcuguuucuucuggauaaaaaacuggccuugaugacuacauuaaagaaagaauaucagauaagaccaugcauucucagugagugcaguaacagcccagaaggggugaaaauugauucuugggggaaaaaaaguuagauauuacaaugguuuguggccauccaaagggccacaauacaaaaacagauacacaguacaucugugguauuaaaauuccauuggggguagcugggcacgauggcucaugccuguaaucccagcacuuugggagacugaggugggcagaucacuuaaggccaggaguucaagaccagccuggccaacauggcaaaacacaaaaacuacuacuaaauaacacaaaaauuaguugggcaugguggugggcgccuauaaucccaguuacucaggaggcugaagcacaagaaucacuugaacccaggaggcagaggccacagugagcagagaucacaccacugcacuccagccugggcgacagagugagacucccucucaaaaaaacauuccacuggggaguagacaauuaagggaaaaaaagucucaaaauaugauaaugaacaaaagguugaaaaauaauuagaugaacccaaaggguugagucuuagaugaacccuaagggcacaguguucauuaacuuguauaauggucauggguaggguaacuaacuuguccugguuugccccggacuuuccugcuuuuggcacuaaaagucccacauacggauaucccucuguccugggaaaacuggcauggugguccacucuucucaagagagagaucaaugaaggcauucccauuucacaaaugaggugacaccaagaaacacagugguugucacggauucacagcacuuuagcagcauuccugaggcaaggcuggcucuuuccauuugucuaguccuaugcucacaacucucugccccugauuuccacuuuggcagagaauguuacucaugaauugauuaugccacuuccuucucaauaccaaagccaagggcaguauuaggaggaugaaggcaaacauggccagccagcauaaucacagccaugucuuacagcugccugguggaaccugaaggaacuacaagucugggcugaauauaguuuuguugcuacuggauucuggguacaaauuugcaaaaguaagaaugccagguguaaacuccucacaagcuaggaaaauuccuagcuugagguucuccacaugugucugagcagcccgaaucuuuuacaagguuuuugucccaaagaugaacucaguuauugcuuaugcuaggaaucagggguuacccaaggccucacucugaauggcaacaggcuauucuccuacuccccuacucagcagugaaauccuuggugaaaguaaaggaagaaaagaaaagggcaugcuauuccgucuuuagucuacguauaauuaaaauacaagacucucugcuguagaagacuaagguuugcaguuuaaggccgacucagaaaaggauaaaguauucauccuugcucagaaagagagaagauuagcuccacaggaugggucuccaaauugacaccaaauccaggaguuagagauggcugugcuacagagcgugauccaagcaccaucuggagcccccagaaaaaaaucccuaggaauagcgacuaagggacuagcauuguaagagaguucagauuagcucuccugaaaagaggcuuacuacaagagacuggcagacagccucugcagcaaaacuucacuuaggaaaggacagaaaaugaaugaagaaagacagggggaggcugagcaggucagaguaugaauccacaaguaugugaaaaagagaauccaccuauuucgaaaaagguacaacuuccuuucagagccuuuuuuuuuuuuuuugagacagaaucucucgcucuaucacccaggcuggagugcaauggcacaaugaucucggcucauugcaaccuccgccucccgaguucaagugauucuccugccucagccucccgaguagcugggauuacaggcaugcgccaccacgcccggcuaauuuugcauuuuuaguagagacgggguuucuccauguuggucaggcuggucuugaacucccgaccucaggugauccacccaccucagccucccaaagugcugggauuacaggugugagccaccgcacccggccagagacucucauguucuuuugaauauucucauuaacggcaaaucuucauucuuugagggugaaaacauuuauugcauuccuaugucccaagagcuuucauguguaauacgucauuuaaccacccuucaaaguaaauauuauucccaguuuuuuuuguuuuguuuuguuuuguuuugagacggagucucgcucugucgcccaggcuggagugaauggcgugaucuccgcucacugcaagcuccgcuucccagguucacgccauucuccugccucagccuccugaguagcugggacuacaggcacccaccaccucgcccggguaauuuuuuguauuuuuaguagagacgggguuucaccguguuagccaggauggucucgaucuccugaccucgugauccgcccaccuuggccucccaaagugcugggauuacaggcgugagccaccaugcccggcccuauucccacuguuauguagugguacauugagccccagaggugaaguaacuuauccaagguuauguggcuaauaagugguagacucagaauuaaaacucauguucaccacccuccaaaaaucuguuauuuccacuucaaaagaacuguuaacucaucugaagacaaggcaggugacaagguugcuuacccaugccauucgggguuaaauauauauaggcugugugcaguggcucacgccuguaaucucaacauuuuaggaggccaagacagaagaaucgcuugaggccaggaauucaaaaacagccugggcaacacagcgagacccugucucuacaaaaauuaaaauuacaaaauuagcugggccugguggugcgccccuguagucccaacuacucaggaggcuuuagugagaguauuacuuaagcccaggaguucaagguugcagugagcuaugauuaugccacugcacuccggccugaaccacagugugagaccccaucugaaaaauaauaauaauaauaauacaguaugguuuaauauauuaaagaaacugaucucucgcaugguucaaaaaggucucugaaaacaauuccagagguggauuuucaaaacugccuuggacaacagccaaaucacuuaggcacgccauccucaacucccaccaccuacaccugcacacaucacucuaaaggagaacauucauugguggaucaaguucccacaugucaguuauuuuaaaauccauuuuguuaccuuucaguuucacuuaauuagccucuucuccugccaaugaaacacaccagggcucacaguuggccucaguagagaaguaauagcuggccuucagaaaacagcagggaaggggaaguaagugggaaucaaaguacuaggcaacuuuucauuccuggacugccgcaucccuacuaacauuuccaucaccuguaaaaugggagcagaacgucucuucuauugccaauuucauuaaaacagcacauguauucaugagcagauuaaauucacuaaacaaaugaaagaaaggggaaauaaauguggugugguaacaccaucuuaaaaacccgagagccauguucucaaaaccacagaccaaguucugacccauguuauacaaauaucaaucccaauaucguuacacucuggcucccaucaaaauccuacccaauccccaaaucuggcuauacuuuuaucagaaaagaaaaaaacuuggguggggugagagcagaaaagacacacacacacaacaaaauaucuuucacaaugucaaaaaaaaaccuguuuauaugccaggcgagguggcucaugccuguaaucccagcacuuugggaggccgagguagacagaucaccugaggucaggaguucgagaccagccugaucaacauggagaaacccugucucuauuaaaaauagaaaauuagccgggcacgauggcgcaugccuguaaucccugcuaaucgggaaggugaggcaggagaaucgcuugaaccugggaggcggagguugcugugagucgagauggcaccauugcacuccagccugagaaacaagagcgaaacuccgccucaaaaaaaaaaaaaaaaaaaaaaaacuguuuauaaacacaucacuuucuucucuuagcaaauauguaaguuucauucuccuccugucuacuuaguuuggguuaacuuaacccccgccccaucucucagaucauguuuuuauuuagguuuauugaggugggaaagccaacugaacuuuaaacgaagccaggcauuuaagaauauuagaaaacugaucuuacauauauagguagucaaauauuuuuaaaagacaucaaauggcauucuaauuccuccggugcaaagaaagccccagccucacacguguuagcauuuccugauuccuggcuuuucccacucagagccccauuccaggggcucauaugucaagucauucucuccugacuucugaagcagggauuuucaaagccaggauuccgggaccaccugaaugagaacccccugggguacagcugcccacgcaccaucuuaucggaaaucccagggaauggagcccaaggcuuaugcacaaagccccuagacgauccgagagauaacacuaaccagucuguaaccucuaaaggcaaauuuuccaggacaaagaaaaacaagcaauaagagagugacaauaauuccacaugggaagagacacacgggucucggagaucaacaccaaaccaccccuucuucggacagauacggaaacuuaggcugggagaaugaaacaggcaagggcacuaaaaacaggugcggagccaaagccaaucucaaauuuccacggccccaucuccugccaauaaagaggugaauggagacauucugagugggaaagauaagaaagguaggccuucggcagggagccccgggcccacuuggacgucccgcuuuggagacacuagugaggauguguggguccccagaacacugcugggaaggcgccgaggccgccggcaggaggaggcccaggaagcgcccugagccccccgcccagcuccagggccgggcggcccucaccgccccuaccuucggccuccggcagccgaguggcagacacaacucccacaauuccaggcggccgcggcggcgaccagcucccccugcgcaaacgcggcggcgaccgucugagccggu

SEQ ID NO: 192753 - RNA, 76318 nt, Homo sapiens
gggcgccuccgggccucugcggagcccugggcagcucugagcucgcggaggcguggccggugcgcggggcccgcggcgcgcggggaugggggucucgguggaugugcaccagguguacaaguaccccuucgagcagguggucgccagcuuucuccgaaagguaccgccccgcuuccaccuuccguaucccgcgcugccuccgcugcuugccccucucuccucuccuucauccacgcggaagcuggcaccgccagugucucuuuccagcugcgggcuuugcuucagggaugugugggucgagagggauuuccucgaagacucccuuuacagggagcgggaaaaggggccgugcuuggcaucacguucacaccugccccagcugaaagaagaggcuuuccuuuuaggaagagccuccgggaaucccagcucgugagcuccguggaguugcagaugaccgacguguggagcuuuccgguucaucacugaccccuuaaaagcgaggggaggccauugggcagucauccugguuuacucagcaugaugguucugcugccccauccgcugcuccuuauuaaacagcugugggacaucgugcagguugcuuacucucuuugugccuuaguuugcuaaucuguaaaauggggaaaauaauaguaccgacucauagaguuguugugaggauccaaaugagguaacuuguguaaagugcuuagcacaguugugaccuaaaugaagaaacugaggcaaaaucaauauaaaaagagaguucauucgagccaaguuugagggcugcauccugggagugaaggugcccugaguauacauucugaugagcagaagucgaaaguggguuuuuaaaggagaauaagaagcacuuccuaaguuguuuaccaagaauuuauauuaaaauaacauaaacuauugauugucuguacauuguucuuuguaucacaaauuccaggaacuugaagauaauggguaaggcagcuggucaggaacaaaaugccuuuaaccaguugcucccaggaauggguugggugaggaggggaccacuaaaguccuauacucuugucucucugggcuugauugauuuugcauauuucacuguaacucacacaaucugcucugagcuauuuuucuuuuucucacugcuacugauguuuaguuagggcucuaaaauguuauuguuguuuguauuacuacaaccgauuucaauacagauaaugaacucuuccucaauacugaggagcccugaaucccaaagacuguuucuaggauuguggguccugauaauaggaaaaugggaaaugucuuugaaaaaucgaaagcgcccaggccugggaggcaggacuccuggacucugaucugguucuaugcgugguuaguucucugggugaccuuggcugagggucuuuucucuaggccuuaguuuccacaucuauaagaugaagggguuguaccagaugaucuuugaagguccccuucgguuuucauaagcaaaauuugcaacaguugcaauuugccuugguuagcagccacgggacauugaacuccauaugcaacccggaagccaaacuaagggagaugcugggaagaugaaggucauuuguuaaacgauaagguguagccuccguuagaggaggugacacgguggcccuggucacagaggagugaggaggacacugguuaacacuuuguugcuauagggggccucuuuagaaggaaugucagcuugcugauauguucguugauuuucaguaucuagacuagugccuagcaccuacuagguauuuaauaaaaaccugagcaaugaauaaaugaaugaaagaaugauuuacagaccuguuguagacuuugccuuaggccaggcuucugggcccaaaaaguaacagccaacacccaauuuuuuuguuagaacuggcacuuuggagucuggguacccuuaagccacugcuccuuuguaaagucuuuuuggauugucaucaucaagagucaguugaucuccaccuucucagaacucacagggcacucugucuaggcguugcugaccgucugcagugucagauggugacuucuguauguguuguguuucccguuagacucuaagguuuuuaaaggugagacucacuccugcagaagcacauaacacaaugccaaacucuuauuuacggagguccuggcgcauugucagcuuuugguaaaugcuuuucuuuuguugaauacuuaucuucugugugccaagcuuuguguuaagugcuagaaaaaugugggaggucaccgcagacccuguucucauggaacugaugguguguaguggggagauuaacauaaauaaaugaugcgcaaaugaacacaaaauucaaauugaugauguguacuuaugaaaggaaaauacauggugcuugaauauagcagggaggccugcugaagucagagagggugaucuuuaggaaaggcuuuccugaagaaguggcacuggugaaaugauggcugaagcaugaauagaaguuuccuaggaaggcuggguguguggugugugguguggugugugugguguggugugguguguguaugugcgcucaugugugcuuuccauacuuuaucauguuuacugcugccagcacccucaggaaguaguuaugauuaauuuccauuuuacaauauagagaaacugaggaccagagaaguccaagugccuuccucaaguucccacagcuagcagguaggacagccaggauuuuaacacauggauccgaaacucacagccuuagccacccggcugugcugcauugcauauaauaggcacuucaacgauuauugagguaauacaggguuucagaaucaacuuugccggcugggcacggcagcucacuccuguaaucccagcacuuugggaggccgaggcgggcggaucacuugaggucaggaguucaagaccagccuggcuaacauggugaaauaccaucucuaccaaaaauacaaaaaauuagccagguguggugcccuaugccuguaaucccagcuacucgggaggcuaagaugagaaucacuugaacccaagagauggagguugcagugagcugagaucaugccauugcacuccagccugggugacagagcaagacuucaucucaaaaacaaaaacaaacaaaaaaacccaaaaaacuuggcugugcucaauguguuuucuuuuguucacagucuucucucaggguuugcucagcuaaguggaccuguugacccugauauaaagauauaacuuugauguguguuagggugagaacacagaauguuuaaguuaucuauugguauguaacaaaccacuccaaaacguagcgacuuaaaccaaugacaggcuuuuaauuuucacaauucugugaguugacuaaacucaugugguugauuuuugugugcugugugguauagcugaggucacuuauguagcuguauucaguuagaaccuguuguaauucuuauaaaauauuuagcaaaguaccugguacauagugaauaaguacuaugaaaaggcagaacugggaagggcagaacugggaaacagaacuggggaugucagaacugggaaauggaaggcagaacuggggaaaugagagacaaacauuuggagacuaaaggucuagugaugggacaguguuaacaucaugcaugucacuguacuuccuuucuuucuauucauucauaaaggaauccuucagagauuccuugggaggaacuaugugacuauuucuaagaugucaguaaacccauuugcugggugaauuuuccccuuauguuauucaaagccaugaacugguagucaguagaccuggaucuugaucauuaugcuuucacuguuagguuggguggccaugggaaacaauuuucaccauccuauacuguguccuugugcaaauuagaaaaggcaucuuuuagggguccacuccauaagcucacaguucauagggcuaggggaaagcaaaugagacuauuuaugcaaauuagaaaaaguuacuccuuccuuuagguggaugcaguccugugcccacaggcccacuugaccaggagcccuugugcagucagcagcaucacaacuguguaagcccuaguuucuccucugugaaaaugguaaugccaccuaccccaccuaccuuccaggguuguugugaggaugucacauguguuaacaguuugaaaagcauaagcuuuuuuauaagccuaagguaguaagaauuaucuuuuuggcaaaauacacuuuuauuuuucuuucagucuuuaugauuuuuuuuucaaaggaaagcacuuggcagaagcgacaaucauaugaggaucacugggaagcauuuaaucugauuuugcacaaugguauguuugaagcugcuuuagcacugaggaaguucuauuuuaaaucagaucuacugaucuauggcuuuugguuuguuaggaguugccuuccaaguuauaauauacuacgguuuuuaaaaccugaagaauguuugcucuucuuacaucugccuguugaauaccacaggcaaaauauuagcugcaugcuuucaaagcuaagugacacugugaaaacaaacaauaugauacucuuuguuccuaaaauacaauauuucucaauaaacucuucauggaggaauguuaugaaacccaaaauaguuuauucauuggaugcugaacuguauguacuuuccaagaacuauagugucaaugcacuugacaguguauuuugguuucuuucuuugugugauucuuagcuuucuagcucuuaucacuuaccacuguuuccuuccuuuuacuuaaaaucaucuacaaagagaacacaaaguugcauagaugaauguagcaguguagaaagugggucuucucuggaaucucacuuagaccuuuuuaaugggcuugccuuucaugagcuggauucagagaacuucuuaaauuucaucugccugaaauuuaaacucauuaaaaaggauccagagagcuauuauauugacuggauuuucuuguuuauaucuaaaugaggccagagaaguaaagauuuuucuuaccuucagaagguugacuuucuuuuuaugcuguggucaaaggagucauagugaauagaauaucaccuucauagguggugauuuuugucauuuguuucugauguaucccaauuacccaaagagauccuggaacauaguagguacucagcaaauccuugcugaaugaaugaaugaacugacucuuuuggggauuagcccugugcaauuuuagauugaagucaguaugggauucagaaacauguccuuacuuuggauacuguaauaaaauggacagauuaaaauauugauaauuucuuugcuuugacagaaugacccuggguguuauuuauuuuggcugggagccuggugugcugaacaaaaugguuugaauguuuacucuuaagcucauaaaggggauuuaugaagggcuauuuccauuuagaguagaaaguugauuggguaauuaauaauguuuccauuucugauccuaucuuuucucccuugcaaaucugacacuuacauguuaucuuuugucacaugcuguacuagucuuucuucacuuuugucuuccuguccucaguuccacuagaagauuaggcaugauguaaaggagaauggugcagaugugcagaaugugggcucugacauuggaugggguggggaagacagggauggagcgcuguuagcccugugagcuuggacaggucaguucauuuuucugugccucgauuuccucaucugcaaaaugagaauaauaaucacugucuucuggaguuguuggagaaauuaaauuggauaaugcuuacaguuauauguaauauaccuagcuuaauuucagcacacagcaggcuccuuuaaaguacuuguugaauaaugauaacaacaacaauaauuuguugcauuuauuucaugaaccugaaaauaaaaagcugagagaaguggccucagaaaucauuacuaacuuagaguaauaaaggagagagugagcaugaauaaagguacacauuugaauuaggaauauuuucuaaaugccauuugaacaauuguaaaguauacuuagaaacuuaucuaauggagauuguggcuuaaucaguguauaaaagacagaagauauuggccaggcaugguggcucaugccuauaauccaagcacuuugcaaggccuaguuggguugaucacuugagccuaggaguucaagaccagccugggcaacagggcaaaaaccccaucucuaccaccaccaccaccaccaccaccaacaacaacaaaaccccaaaccacacagacacaaaaacaaaaaacccccaaaauuagccggggcaugguggcacacaccuguagucccagguacucgggaggcugaguuaggaggaucgcuugagccgggaggcagagguugcagugagcuguaauugcaucacugcacuccagcguggaugacaaagugagacccagucucaaaaaaaaaaaaaaaaaaaaaaaagauuuuuuucacuaucuaaguacauggaccugucuucaaggaguucacugucaaaagggacagaggaggauauauuaauuuucaugauaaaggcuuucuugggggcauauggcagacauuacauuguaguauggggcaagauuuauauuuuaauuauaaauccaugaaagcauuuaaacuauuuagaaacaguugucuuuuuaaaaacaaguaaauauucucuccagcacucuuacuucucuggugcagcccuuucccuaaugcuaguguggagugaagugucagggaggccuuguaucuuacacaaauuccgaacugguaaagcacgagcuucugaguuuuuuauuagucuaggaaaaucagauauauuaucuucuaaucauuuuaaaaucauuguguaaguauuuuuggauugcagauagaugccagcaauguauuuaaugccacaccacaguaaauugcaagauaaaaaccaaaaucuugaaacuuuuuaagucuucaaaaguguugauucauuuguuaguagcaaaaccagcuacauuuauuuucuacuugcacagugcuagguauuauacuguaauuaaauuguuuccuuuaauucuuauaacaacucuuugagguaaguauuuauucucauuuuacagaugaagaaacuagggcagauuaaagugauuuguccaagcuucucacagauaggauuccaauucagaucucuugggcucuaaaauucacuguuuucuaacaucgugucuuuaauuuuguuuuuuauuucuuuucauuuauaaauaauuugacuuauaaaacauuucaaaaacaauauugcagaaacaaagaauucccacauacuuuuuuccagcuuccccaaaccacaguauacuuuuuaaaaccaggaaauuaacacugauacaaugcuauuaacuaaccuauagacccuauuuagauuuugucaauuguccacuaguaucguuuuuccagucuagcauccaauucaggaccccacauugcauuuagcugccaguguccugcaguguaggacgguuccucagucuuuccuugcauuuccggaccauggugauuuugaagagugcugggcaguuauuuguaguguaucuuuagcugcacuggguuuaugcauacauuugauguugugauaagaggauuuuccucuguguuacaaugaaaaacugucuuuucaaaaccuucacuaugccguugcugauuauugggucauuuuugaaagaaagaggcugaugugcuguugguuggccuuuguuuggaaccauagcuuuuccuggccagaaggaucuuggaugaucaccuggugguucaucaccccgaccucacagauggcagcguuguagucugcaugucuuggcucguugcccuuuguucuuucuauuucaucauccuauugaaagaccaaugaacagccauuccaaauacuuuucaacuuaaguacguuuuguccuugaucauugaaauuuugauuaauuuauaacucguuucgucuugguauaaaaucaacuuugcuuuucuucugagauagacuaugguguggagcucauaaaaggaauuuggcauagcucauggugauuucuuucugcugcuaaacaccaaaucucuuuucagcagccccaucucuuugcauguacauguuuggcagcagccuagauaacagauucccuuaaugcuuauaacacggguauguuaauauaccagacuuacuguaggucuucuuugccuucuuugaaggacucuucagacagaucugucagucaccugcuuccuuguacucucucugguaaccucauuuguaaauugguagacagugacuccuuuggaugucacugacuguuucugagaggggaagcaaauguuauuaaaaaaaggcauuggcuuuugagcuuuuuggaaaguucauauuuuaauaacucuuuuaagaguaggcuuucugaaagcuuauggguuuuuuuuucccucggcaaauaugaaugcaaaauguuauaucuucaugaagcuucucccagaaacauauugaauauucuguaauuagauggauucaguuucuugccucuaacuuuuuauauauauguguuugcuuuaaugcauauucccccccaauauuauggaguucuuggcuuaucuuuuaauauguaaaaacuaaagcaagcagauacaacagcuuuaggcacgucuacauuuuacccuuguuagacuguuacauacauaugauauauacagugguauuuguaguaguuucaugucuucgggaaaggaaaaggaguuaguuuacacguucugugaagaaauuaaaaauuauaaggaaaugcaaaaugaagucaaauauaccuuuaaaaaucccuuaaaucauccauaaaguaguauagcauacauggcauauguaugcagccugugggaucguucucuugcacacugcaguuugugaucagcuaagccaggaucaagaaagacaagggcuuuuggcagauaucugggucuucagaucacauugcuuucaugagagucucuaguaugaaauggggauugaagaaucccaugugaaccugcuugucugcgggcuuuacacuauuauauuuauagcagaaauacucuguauauuaauacuugauagguuuccacgcuuugagaaggacugaaugagaucaugcgcauggcagcuucucuaggauagcacccugcgugaacacaguagcugcucaguuaagucuuugaugggugugauccugauucagcuugaucaauucugcagucauacuggauuguguuugaaaagguguccagaaaaaccuggccaucugccuccugucuucccagguaaguguuccugguauugaccucugagaagccuucccucuuucaacuuuuucucaugggaguuuugguaaauuuucaugaauuaaaacaugaauauucagguuaccacaagauggcgucagaucauuucaaguaaugccagguagggggagccucaguucaauaaaucuuuaaagagguugaaauaugugccuuucauaguaugguaguuagcuauugcaaauaaaccccuacuuucuucuacuguucuucuauggaaacuugaggcucuuggcuguucaacuccaaaaauuauguaagugugaaguauuugaguuuauaauguuuaagaauuucucugauagcuuagugaaguaaucagaacuugaaaaauuugaucaucaugucucccugguguuuacauuuucaacgucuuuuauaguuuaguuaucuuucuacaacuuauguugaauuuguaauauucagucaauauauauuuauggguauguaaugaacaaacuagaacuguaguaaacgagauaagcacauuuuacuuuaguguacaaguuauaauuuauacacauauaaucacaauucagaggaccugugugagucucaaauaucucccuugcuuuagggguacuguguaagcgaaagucuccuuuccugaggagcagaguaucuaaaccugacccucugucaugggcauguaacucggaagggcugaacuucaagaaagcaaucacuguaguuccaaguuuuuuuuuuuuuuuuuuuuuuuuuuuuuuuuuuugagacagagucucacucuaucaccgaggcuggagugcaguggcaugaucucggcucacugcaaccuccgccucccagguucaagcaauucuccugccucagcauccugaguagcugggacuacaggcaugcaccaccacaucuggcuaauuuuuguauuuuuaguagagacaggguuucacuauuuugggcaggcuggucucaaacuccuaaccucaagugauccacccgccucagccucccaaagugcugggauuacaggcaugaaccuccaugcccagccaagcauuuuuuuuucuagggcuaaaaugagugaaugaaugaauauauaaauaaauagauuuuuaaaaaccaaguuuuucaucaguuaucaagauuucaguuuccaggauggaagugugaaugacagaguuuaccaacaugaaacaugaagagauauugagguugcugaaagcugagccacugcucucuucauagauugguuucugacugaaggcaggcucauuuuccaaauugaucccugaggucauugagguuuauauucccaauuuuuuauuuauccagaaaauauugacugagugcuuuuuaugugccaggcauuacgcuggcuguuggagauacaggaguaacugaaauagacaguauuccugcccucagagagccuguguucuaaucuagugucuuuuugggucacagauaucuuuaagaauguguuaaaaugaugaaccccuuucccugaaaaauccauuaauaaaucaauaucacacacacacacacacacacacacacacacacacacacgccugcuguggguggagacccacagucagaguuuuguauuucacuuccuaggguucggaaaacuuaaagcucaaguuugcaaagugaggggccuuucuucuuucuccccucagccugccugcugcuuuugccuucugcucagcacuuugugaugucauggauaagacuuccugccaauuuucuuuucagauuugaucacaugauacgucgguaaaccucagggaagagaguccaagggggcucaguaggcuuuggucagcagcuaccuuguccuguggcuucuaggaggucacuucugcucccagugucucucuuuucacaucugaguaguggaaaggauuguguuaauuuaacucuuaggugauuuggugguagguuaggugggcaggcuuugcaggcuggcagaaaguaucggggguaaauuauguuaccccccagauacacuauucauuagcuggacaauuugagcaaauuaucuaauuugucuaagccuuauuuuucauauaugaaguggaaaaaauaacacauaccuuauagaaugguuuugugaauuaacugagcuaauguaucuaaaguauuuaaauugccuacgacaaaagcaguggcuauuaucaaccuugucacagccaaauugcuuuucaggggaauuaaauuaacauguuaaauauuuauugaguauuuacuaugugccuagcaaagcauacuucuaugacuaugcuacugugaugcuaacccagccaccagacaaugauauuagaccacagugaagagguccacucuguauuaaacaggccugguuuaauucccuggcuccaccaggagccagcugggugacccuaagcaauccagucuucauucaguuuccguaucugaaagauggggauggugguaucacauaaaucaguuauaacagagaggcuguuggauuuagacaagauugugcaaggaaagcauuuaguacagugccuagcacaaagaacacucuugauuuauguuaggcugguucaauauuaauaguauuauuauuuacugauuagcuuaaccucaucccccucagggcuaguuggaucuaaagaagguuuuccccagauuucauguaagucaagaugaugauagcaucucacuuaucuaggcccaaguuauaaaauuaagauccaugauucaaaacugggcuuuguuuagaaguuucuuggaaaauauuuacuaguccugcagacagcugugguuacuucuaaauaguucaccuugguagaagauuaaugguaauucuuuuuuauauauuuuuguuuaguaccccaaccccauggauaaaaaugucaucucaguaaaaaucauggaggaaaaaagagguaaguucucuguacaguuuuuucaguaaugaucauuaaaugauagugauuuuuguaaagauguguguacguguguguguggccuauuagguuuuuuuuaaaaaauuguucaccugcaguuucuuccauuauuaguuuuuaaacagguauauuucuguacuugaggugacuuagaaagguguggcagguagagcaccaggauuugugauaguaaaaggccugcugaugcuuuuugucacuuucuaacuaauaauugaugacaacacugagcuauauauaauuguaacugcuaacauuuuugagcacuuaauauguggcagguacucuuauuaauucauuuaauauucagaacaauguuuggaauagguguuagacuacucauuuaaugaauggagaaacugggauacagagaaguuaagugacuugcucaaggucacauggcuguagccuauuauaucauuuuguagauggcaaaaugcauaugauuaaauacgagauaugacuauaaagugauggcuuauggaaucacaacuacuaggcagugugguuuagcauugacuaaaucaggaguugacaagcuauggcuugugcugccuguuuuaguaaauaaaguuugacuggaacauagucacauuuguuuacaugucaucuacgacugcuuccucacuacaacagcagaguugaccaguugccacagagacuuuauugcccacaaaacuuaaauuauuuagcaccugauucuuugcagaaaauguuuacugauuccuggucuagagcauaggaaucucuucuguucuguguuauccccaucuccagcaaaaaccauuauuagugucaguguuuaaacuugagaacugggcaaugcaggaagcugugacaaugcacauagucaauguacaaagcuuuggggacacuggggccuagguccagcaugcucuuuacccuucuuaggaaucaugagaugcuacuguucauugugugugacucugaagcccucucugugcuugguaaacauaacugccuuuugcuuguauaugcauuuucuguaauucuauaaccauauagauauauuaaaaauauuuucucauguaccugcagugugagagaaacuuauuauuugucaucagacaaacuggauuucaaaucuugauuucauuacuaccuuggugacccaacuuuuuggagccucaguuucuucaucugucaaacgggaaaauaaucuuguuuuuagguuguuaggaagaucaaaugagagaacacugugcauauucuaaauugaaauguuaauuauaauuucugucaucgucaggggcaucuuugccuuugggaguggcuaauccauuucgaguaugugugcagcaaacacuggaugagauggccaaagggagggccaaugggcagagggguuugcacccuaucaacagcuucugggcagucaggguuuuugcaucaaggguugggacuacuauagccagagcuuugagaaaaccuguaacagcauggcuaagucacagugauucacaaagcagaagacugcacuucagaauuuauucuuuucucugccucugccuuucuuuuucuuaacuaacauuguuuuuuacaucccuggcuuaauucuggaaacuucaccgcagaacaaaaugguugcaguccuaguguuacaguagguagcuagucagguaugagcaggacagaagagggcuuacacacacacacacaaacacgagggcuuacacacacauacacagaagagggcuuacacacauacacacacacagaagagagcuuaaacacacagaagagggcuuacacacacauacacacagaagagggcuuacacacacauacacacacacagaagaggacuuacacacacacacacagaagaggacuuacacacacacacacacacacacacacacacccaggagaguuggaugaccaucaggugacggucaggcgguuguuaacugucucucuaaaguaauaauuggucacagcuggcaccaggcaaaggcacgcuucuaauagauagaaaauaccugaaacugaugaucagcagcuuccugauaagaucucaggaguugggagaagugauguaagaccccggauauaugccaacgugcguaaaaccccaagucgaaaggucagaccacacgccugccuuucagguugcccgcuuggcugucuucuaacugguacuuuccuuccuuucauucccauucuaaaggaagcggaauagcuuuuuccuguuuaggaaaguuuauaaaaagaacaggaauagccauuuccuauucuuuuuaaauaaacuuucacuccugcucuaaaacuugucuuggucccuccuucugccuuaugccccucagucgaauuccuucuucuucugaggagaccauaauugagguugcugcagaaccguacagguuugcugccgguaacaauaggaagucuacucccuuaugagagagaaauguggcuaauauaauuaauuauggguuuaaauuuugcagccagaaaucugugcuugaaaguuugguacaaaagguagcagcaucagguucucccucuuuuuguugaaacauucucuuuggaguugagcaggagucccacuggucaucgucauuggaguacugacacggauaguccagagcagcgaacgguugugauucuuucauccuugacauuggagugugcauucugaguuacuguuguacccuuauuccuucaucccagauaaggaauaccugauucggcccugaaaagugucagggaaacugaauuuugaguuaaacauuuucuguaggaaucuugcaaauagaaaauugauacugacuuuaaaagauucauugcgggaggcugaggcaggagaaucccuugaacccaggagguagaaguugcagugagccgagaccgugccauugcacuccagccugggugucucaaaaaaaaaaaacaaaaaacaaaaaacaaaaaaaccccacccccgcaagauuuauugacacuaagaaaagaacacauuucuuuaauuuuuuuuuguguaaaaaaauuucuuuuuuagaugaaucaacaggggucaucuacagaaagaggauugcaaucugucagaacgugguuccagaaauuuuaaggaagguaaguucauuuuaaaauguaaucacaguuguaacauugaguaauuuuuaauagucaugaaaaggaacagcauuuucugauguaaaggagcguuagaaacuuccuacuccuuuuaccucagaaccuucugaggaagaaagcucuuucuuauccaaccucacuuuuagcagaugccacuggagauacuuugucucucugucuugugaagaacucuuaauggacauagagauauugugcaguuacuuuaaagauacuuuuggcauuuugcaugaagugacuaucuaaucuguucaugauuagaaauuacucuuaggugagaaugaucagaaaugggaagaauguaaauauuuagucucaucuuuaauaagaaagagaaaaacuucaguuucuaauucacuaucagagauaacaguuauuucccagaguauaagguucuccacacccucuguaagucuuuauguguauuucucuaaaguaauaucauugaugaugaaaucuucaugauagcaaauuguuuucucucuuugaaguccuuaagcacucuggugauucuuuguuggaaaaaggugaguggaaauuuuuaaucacauugcuugacccauagagggauuuucagugggaguccuuuuagagcuaugaggaagucagaggaaagcaucuggauaugcccuuuaaacaggucucagaggguaguuucaacccaagagagauucugugugugauguuguguuacuccauucucaggcuacugauaaagacauaccugagacugaguaauuuauaaauaaaaagaguuuuaauggacucacaguuccacauggcuggggaggccucauaaucaugguggaaggugaaggaggagcccagauacauguuacauggcagcaggcaagagagcgugugcaggggaacugcccuuuauaaaaccaucagaucuggugagacuuauucacuaucaugggaacagcacaggaaaacccgcccccgugauucaguuaccucccacugagucucucccaugacauguggggauuaugggagcuacaauucaagaugagauuugggaggggacacagccaaaccauaucagauguggaacccagcuuggcuccugccgauuagcuugcaaauuaaauugcugugcuguauguggaacaaauggcagcuuccgucacuuccuuaucaugaauuaaaagacugucacauucuucaguguaauaaagcugauaugacaaugaaaaugaacuuucuuuuauuuuccagaugguaaaacuuguugcaguguagcagcaaauuauuacuggcuuuuuccagaguguguacccugccuuugcccuauauacucacucugaaucuauuauuuaaaaaggcauucaacuuugucuugugucucaauucuuaaauaauuuaaggacaccucugacuuguacaauucugccuuuguaguuuuccaugucuucaccuaggaaaccauacauuucuagguauuggacagaguuuaaaaugaagaaaauauuuuaccugauauuguucugcaugugagcuuguaagugggcucgauuagaauccaucaauuuaagaaggccauaaccagccuuagaggagacgcgaaggaggcugauaauuugcuuaguguuuagcaguuagguaaauuaggccagagacuguauagccuacauaaauccugggucauuugcauguccucaccagcacuuaguaaggucauaguauguuugauuaucaaaaacguacagccacuggugagccaucauccauguaucaggauuacuuguccucuugguuauccaagacugagaguaacucuggaugcagucauuauguugccugcucuuccuaaauugaaaaagccauuuucuuucuguuggacaggugagcauuuugaaaguaccuaauauccaauuagaagaggagucauggcucaauccucgggaaagaaacauggccauacggagucacugccuuacguggacacaguaugcauccaugaaggaagagucugucuuccgggaaaguauggaaaacccaaauugguaagacucguguguauauguguguguguuuugguugcagggauggacacaugaguacauacauuaaaaaucuaugguucuauacuuaugaccacuguuuauaacucauacaaauuccacauuauuaauuuuuuaaucacaguaauuaaugaauuuuuugcaagggaggucaggaaaugauagaguucaccuucugucucaccaucucccccaauccuguugucuuuuucacccucuugagaaguagugaguguuaucaguuugcugaauauucuuccagaccuuaaagagauaccuuuagauccuuauauauauacucauagagccuguauaguaugguuuuguauauauuuuaaaacauguauuguaaguuauaaauuaguuuguaaauugugcacuucuuuuuuuuuuacuuaauggaauguuucugagcuuaaaccaugugauauauauauauauauauauauauauaaaacuagcuuauuccuuuauugcauauaauucaauccugugacuauaugacauuuuauguagcuacuacuuuuuugauagacagaugguaucuaaguucuuuuuuacaaacaauauuacaacauuugugaagcauaucuuccuuguauaugauccuuuauguuauaugaguuguuuaucuaaaguauauauauauauauauuuuuuuuuauuuauuuauuuauuuuuuuuugaaaugcagucuugcucugucaccuaggcuggagugcagugguguaaucauggcucggugcagccucaaccuccugggcucaagugauccucccaccucagccuccugagaagcagggacuacaggcaugugccucaggagaugaagguuucaggcaugugucaccaugccuuguuaauuaaaaaauuuguuucguagauacggggucucacuauguugcccaggcuggucucaaacuccuggcucaagugauucuccuacaucagccucccaaagugcuaggauuccaggcgugauccacugugccuggccuagaguagaauuuuuuaauaucagguuuauugagauauuauuugcauacaauaaaacuuacuuuucuuaguguauaguucuuugaguuuugacaaauauauaguugugccaccacugccacaauuaaacuauagaacauuuuagauagauuuaaaacaguuaauauuacaagaccaaucaauggggaaagaauauuucuuucaacaaauggugcugagauaacuggauauccacauacgaaagaaugaauuuagaucccuaccucauguagaauacaaaauuaacucaaaauagaucaaauaccuaaaugaaagaguuaaaacuauaagacacuuagaaauaaacauggguauaaaucuuugucaucuuggguuagguaguaauuucuuagauaugauagcaaaaauuuaagcagcaaaauuaaaaauagauaaaauugaugucaucaauuagaaacuuuuguguuucaagggacacugucaagaaggugaaaaacaggcugggcguggugacucaugccuguaauccuagcacuuugggaggccaaggcggggugaucacuugaguccaggaguuugagaccacccuagucacauggcaaaaucccgucucuacuaaaaauacaacaauuagccgggugugguggugcaugccuaugguuucaacuauauggguggcugaggcacgagaauagcuugaacccaggagacgaagguuucagugagccgagaucgcaccauggcacucuagccugggcaacagagcgagacugucucaaaaaaaaaaaaaaaaaaaaaaaaaagacacacaauaacaaggauugguuguggauauguggauaaauuagaacccuuacauguuucuuaugggaauauaaaauggugcagcugcuuuggagaacaguuuuucagauccucaaaaaguuaaacguagaauuaccacuugacccagcaauuucacuccuagauacuacaagaaaaaugagaaaauauauguccacacaaaaacuuguacaaaacuuucauagcauuauaauagccagaauguagaaacaagccaauguccaucaacugauaaauauguagcccaauguaauguauccacaaaauggaauauuauuuagcuacaaaaaggaauggagugcugauucaugguuaaacauggacaaauuuugaaaauaugcuaaaugaaagaaggcaguuacaaaaggccacauauuguauggguccauuuauuugaaaaguccagaauguguaaauccauagugacagaauguagauuauugguuuccauggguuacggggagaggggagugaugagugacugccaguugguacggaguuucuuuuuuggggugaugaaaauguccuggaauuaguguugaugguugcagaacucugcgaauauacuaaaccucacugaauuguguaccuuaaaagggugaauuuuaugguaagugaauuauaucucaauacagaaaacgauauagcugauucucaggacaugcauacuuuuauuaguuuauauaguguuuuaguuugccugcuauaacaagaauaccauagacugugugguuuacacaguaaacauuaauuucucacagaccuggaggcugggaaauccaccaucuaggcacuggccuuuccagugucuggugaaggccauauuuuugguuugcagaugcugccuccucaucauugccucacaugguggauagagugaguucuagucuugguuucuuuuuauaaggacaccaaucccaaaaugcagucucuaacucaugaccucaugaaaaccuaauuaccucccaaagucucagucuccuaguaccaucccauuguagguuaaaguuucagcacaugaauuggggguggcaggggagggcaccgacaugcagucguaacauacagauucugucacuuugccuuccaauguguuaauaugcacauuuuacacugaucaacagcgcaugagcguguucauucccuuacaacagcgucagcacuuauucacaugcuuuuuaacuuuugccaguauaaugggugaaaaaugauuaauuuuuuugagauacauuuaaaaacaaguaaaauauaagcacuaaauguuaauagugauuauugcugugaacugugguugcugugaacuggauaauuaucuguuuuuuuuuguuauuauucugugugguuugaauuuuuuauuauauacuuaucauuuuauggaaauaguaaagcccucaagcccaaacaacuauaaaccgaaaauuuaaaauccauucuuaagcccaaacccuuguccagaucauuacugcucuccauaacuuugguccuguagugauaauuuuaggaugcugcagcagcccgcugagugggugugaagccaugucuuauuggcaucagaggugggcuugcucugaaccacccgcuaguuuuucuuucuuagucucucucaugauaagaguuucacauagggcauagauguuugggauuaaguguaaaggcuguggccagagaauagagcuccuuucuuuguauguagaaauagcaaaaggauggaauuggcugauuuugugcaaaaaaaucauuucaucuacuucguguuagccuuaauuuuugcacauauuugagcuauuagcuagucuuaaaaggugaacuaaacuuucaucugugauauauaaaaugacaauuagcucugaaaauccagggaggacauccuuuaggaacaauuuuccuuugaguguuuuucaaaaauuauuuuaaaauagucauucugauucuagaaacaauaaugcaugugucuuguaaaaaaaccaguucugagaaaaaaaggaaaauuaaucauaccuggagauauuguuuguuuacaugauuuucuuggucuguuccucauugaaacuuagguuguuuguuuuugcucuuacaaacaguguuguggugaaagucucuaugauuacauauuuucccacuuauucuguuaccauuuaagguagauugagcaaagugagauuucauggucaaagguuguaugcauuuuauauuuugguacauaugaccagacuucuguauaagaagguuugaccaguuaaauuuuuuuuuuucuuccuuugguuuguuauguuccaguccucuccaaaacacugccuuuucuaucauugacacagcaggcuaacauuuauugaugccuacuaugucaaggucaaagcuauauccuucauguguauucuuuggaggcuuagguuaaauaacuugcccaaggugauacagucaguagauugcuaagccaagauacgaaugcagauauuguagacuccaccuugagcacaguggugaggcaggaauaugaacauuuacaaaggauggguuuaucuuguucuguagagugcuuuggaucccagguaugaagaauggguuuugucccuucagcaacaagcagccacaaaaagguuucugauuagggguugauaugcugaaagcugggauccacauuccagagaacuuauguuuccuuagcucuugacauggauuuagaaaggcauuuaggcagacauucuaaaugaauggguaaugggauggggugggggcauccaagaaagauucauuauuacuuuaauuucuucccuuugcuaaggaaaucugagaguaauggcuagccacugcacccagaauagggacaaguuuuuuuaaagggaauaaaaaagcugucagggcuacuaaguguaaaauuagacuuucaagcuguguguugguuagcaggugugggugugugacuagaaaccagaugucacucugucccugugcauggccuguuggcucaauucagagaugggcucagaauaaguuuccuuuagaaacuaagccuugcucuauguccucuuuacauagaucugauuuuggcuucccacugacaucucuacagucguggcaucuucuugggugagagaacuacauugggcuuucccccaucuguacugucacacaacuggauagcucuaauaugcuuucuuccuucacugauuuuauccgacauugucuuccuguaguuuuuuauggaauggaauuucuauucucuccauaauagguaugggaagauagggugauguccuguuucucacucaucugacucucccagaacccagauuggcacuccaugccucagggaagcccuccuguacuuacuuuaucccuccuccuguaucaguuaggcugccuugugcugcaaguagcagaaaccugacucagacaauaccagccaucccuuacauguguuuacuaugugcaggcucugcucuaagugcuugauguauguauguauauguguguguguaaaugugugucuauauuuaauccucauaauaaccaugugagguuggaacuauuaucuuuguuuuacagacugaggcuagagaugucaagugacuuguaugaaguaagauggccaguaaguggcagcaccagauucaaacaugggcugauuagcuuuagaaucugagcgguuggcagugacacugcccuuccucucacuaaggaacugcauuaucucauagccaagugggcaguauuuccauagcucuuauucuuuuggcucuaccuuucucuguauguccacuuuuuuuuuuucaaguuuggauuccucaugacugucaacaucaucuaggaucagcguacuaauuuguccacauuuaaugagagaaagagcuauguagaggagggaaccugucuccuagccaugaggaaaaaagcccuucaccugauggugauugagucaacuuagaacaccugcucccccagaccaaucagcguguucagaggaaugauauagguguauuggcagauccagucaagaucugcccuuggagcuggggaugaggucaucucccucugaagcacaugggcugcaugggggauggguaggcaccugaacagaaauaauugggacauaguagaaggggacucagcacaccuuuuuuccucuucauguuuucuuggcacuauguugcccauugucuuuauuuugcuuuggaaguaauggaaacucacuacugcagaugauuacagggauauuucuguaccagugaucaggccuccuaagggauaggaaccaggaauuggaaagccagcaaggccuaaggcagccucauagucucuuauuuuucugugucuggcuauuuugucuaguaauuuacagaucugcuuuauuuacacagccaaccugacucccuccaggccugcacagggucucuccucucauguccuaugccacaguaacugaguaggcaucugcguuuagaauccuaccucugcuccaggcauggcucaauaccuaugauccccguacuuugggaggccaaagugggaguaucuuguggccaggaguucgagaccagccuggugacauaccaagacuuugucucuacaaauaauaaaauaauuagccgagcauggugccacaugcccguaguccagcuacucaggaggcugagguagggggaucgcuugagccuggguggucaagguuacggugagcugugauccugccauugaauuccaaccugggcaacagagcaagaccccugauaugguuuugcuguguccccacccaaaucucaucuugaguuguagcucacacaauucccauaugucaugggaaggacccagugggaggcaauuaaaucgugggggcaggucuuucccaugcuguucuugugauagugaauaaguuucacgagaucugaugguuuuauaaagggggguucccuggcacaauuuuuuuuuuuuuuuuuuuuuuuuuuuuuuuuuuuuugccugcugccauguaagacgugccuuuugccuuccaccaugauugugaggccuccucagccauguggaacugugaguccauuaaaccgcuuuccuuuauaaauuacccagucucagguaugucuuuaucagcagcaugaaaauggacuaauacaaccucugucucaaacaaaaaaagaggaaaaagaagaauucugccucugaaacuguaacuaugugcccuuguacaauuugugucacuucucuacuccucgguuucuucaucuguaugaugggagugauaacccuuucccagagggugguuguaugaauuaaaugaagucguacauagagaaagcuuaaaauagugccagcccauaguggucagcagauauuaguguuuuguauuauuacuuuuacaguuguuauuuucauaauaaaaauucugauaacuuuugauucuaauucucagaauguauuuaauauagaaacaguguuuguaaugauuuacuguuacacugcagaaauauguucauuuuggaguuuugcauucccucaguacacaucuuuggggcuaugagugccucaauuugagaggcaugggacugggaaacuuguauuuuaguuucggaaugaaauuuaagcucuggaaagaauaguauucagggucaaugcaagcaauuggcauggacugaaucugcucacauuucugguuuucuucuagguucaugcagugaucuuggcaguuguagauucaggggcaucacauaggguccucugaugcacugcuugaauguguagaaugagagaugccaugcucaugcucuauuuugccuuaagacacuugggccaaaucagaaaaaagaaaagugaaucuuaaucugaaaagaggaaaaaauuaaagucagcuuuugugggaauaugcuuuauuauguagagcaggacacacacauuuacuuuggaaaauggagacugaaguguauuguuuuagacuuuucagaaggaagaaaaaagucaugguuuuuacccuccaaaaccuuauguucugagauagguuuguuaauuucuuguguuugugucuggucuuuaaaauauauguauuugugaguuucugguucuuauuuauuacccuuuuccucuuaauagguauuuguuaugccaugugggaauauaauugacaugcauuugauuugguuuuaguaauugacauuugcuuuauccgaguacugcaauguaauucuggaagauaaucaccuaguaaaagcauuuucuucagcuuuacucuuccagcauauguguuuuuaugcuaaguaaaaacuuucugguaucuucaaguuacuaccaucaauggagaccuauucacgauguugucaaaccggguuuuuccugcauuugaguaacaagauuauucuucuacacucagcacagcaucucaauggccaugucuucagcuuucuaugucuaaaagcuucugcuuauccucugcugcuuauuuuugacauuaaaaaugcucagccaggcugggcacaguggcucaugccuguaaucccagcacuacgggaggccgggaaagguggaaaagcaaaagcucucccagggcccugcauaggcccauggccagguuggaggcuggcucuuugucuccaggugcuuauagccucauuacaugaaaaccauuuuagggccccauuuggcccacccucuccugggcagaguggucgggcauagcugggccauggcagugugucaagacuugaugaaggggccgggcacgguggcucaugccuguaaucccggcacuuugggaggcuaaggcaggcagauugcuugagcccaggaguuccagaccagccugggcaacauggagaaacccugucucuacuaaaaauacaaaaauuagcugggugugguggugugugccuguggucguaacuacuugguggggcugacugagguggaagaauugcuugagccugggaggcggagauuacagugaacccagaucgcaccacugcauacuccagccugggugacagagaccaugucucaaaaaaaaaaaaaaaaaaaagcaaaaaaaaagcucagccuagugaaguguguguuaauaauuugaauauaucccucguggaauauaguaaaaaacaagucaaaaucaaacuuaaacacagauuacauuaaugagaugagaaacuguucuuuuuuuuuucuuuuccuuuuuuuuguaagacagggucccucuguugcccaggcuggagugcaguaacacaaucacagcuuacugcagccuugaacuucggggcucaagcaauucugccaccucagccucugaguagcugagauauaggugugugcuaccaugccuggcuaauuuuuuuuucuuuuuuguagagacagggugucacuguguuguccagccggucuugaacuccuggccucaagugacccucuugccuugaccucccaaagugcugggauuccuggcgugagucucugcgccugaccgccacuauuguugggucaauacauuuucauuacuacugaaauuacucaugaauauucuucacucucuaauagauauggauacaacuuuuuaaauguuuuauuuuugaauuucuggauuaaaacauccuaagucucaaguguucaucugaaaaaucacaaauaguauaauuugcaugugcugagggcuaauugggcauauuuuuuggugugucccauuuuuucacccugcucuagagucuuuuugguuuuuuuuccaugaguaaauucgguagucuggugacuucuguguguuuuuaagauuggcacuggcauuuuugauugaccuccauaccugcuuuuacugaaguauuaaaacacucuggcucugcugacuuaggaauuauuucuaagcccaguccuggagcuaaagggcuugaggguguaguuaacuaauagccuaaauaaauacuacuguauucgucccaaaacaugacucccucugcucauauuaaccuugauuuccagugcaccaguggauaaucaaacaauuagcagaaagcaccaccaauuaugaagagccaagcagugaggccuuuucuauacaaauauaaugaucugggcuggagcuuuauuuuuggcuuaauaagacugcccuccaaaagauacucauuugccauuugauguuuguguucauauaaucagagucuccucuguuuuuguauccuguacuaauuguuuugugguggcugugcacugaggucacaguuuaccacuguauccccuguauguagcacagugcuuggcucccagaagaugcuucaucaccaucugucuaaugaaugaugaaugaaaaucugcuaaaggggaugcagacaguacuuguggggugaaaugggaauggcagggucgggggguuguggguaggaaaggaaaagagaaggaauuugcugcaggguaagugcaggggaagcccaguaggauuugguaggaaaugccauguagagagaaucucuacauugagccaguaauaugggagcuucucuucuuguuucugcuuggucauuuuaugugcucuuugacucugggaaaagggauaaagcuggccugagcucccucacagagugaugugaagacuuaauaagauaaaaaauagacaugcucugcgcauuuaugaagcaccgaauaaauguaaguuguuagaacuaaugggauuaaauguuguuuucaaaguguggugacuguuuaaaguuacuaauuuugaaaaguagaguaagcuguuuuguugaaaagggaaaugauaauugagcuagaaacaaucauguuuagcuaagagagcauucgaugacauaaguaggagcuuuugagauacaguccaacacugccuacaacauuucagucuauggcagaccgcauauauuaaggugguaccauaagauuguauuggagcugaaaaaguccuguuggcuaguaacgucauagucaucuuaauaucauagcgugaugcauuacucauguguuuguggugauggcaguguaaacaaaccuacugugcugccaguuguguaaacguguaguguauacaauacauaauacuugauaaugauguauuaguacauaauacuugauaaugguguauuaguccauuuucauacuguuaucaagaaauaacugagacaggguaauuuauaaaggaaagagguuuaguugacucacaguuccacauggcuggggaggccucaggaaacuuacaauuaugguggaaggugaagaagaagcaagcaccuucuucacaagguggcgggagagagauagagugcaggggaaacugccacuuuuaaaaccaucagaucucaugagaacucucucacugucaggagagcagcauggaggaaaccacucccaugauccaaucagcucccaccaggucccucccuugacacaugggaauuacaauuugagaugagauuugguggggacacagagccaaaccauauaaaugguaauaaaugacuguguuacugguuuauguaauuacaauaccauuuauuguuguuuuaaaguguacuccuaacuuauaaaauauuuuaaaaaguuaacuguuaaacagccuuaggcagguacuuuaagugguauucuggaaagcauuguuaucauaggagauggcagcuucauguguguuauugccccugaagacuuuccagugggauaagauauggaggugggagacagugauauugaugaucaugacccuguguaguccuaggcuaauguguguguuuuuguguuuuuaacaaaaauauuuaaaaaguaaaaaauuaaaaauugaaaaaaguuaauagaauaagaauuuaaaagacaauauuuuuguacaguuaugcaauguguuuguguuuuaagcuaagugugauugcaaaagagugaaaaaguuaaaaaugaaaacguuuauaaaguagaaaaguuacaauaaucuaaguuuaauuuauuauugaaaaaagaaaaauuuuaaaaauaaauuuaguguagccuagguguacaguauuuauaaagucuacagcaguguacaguaauauccuagaccuuugcauugacucaccacucacucacugacuuaugcagagugaccucgguacugcaggcuccaucauucaugguaaguguguuucauuuuguauaaacgguauauacaugguauauaucuuuuauacugcacuuuuacuguuccuuuucuaugucuagauauguuuagauacacaaauaccacuguguugcaguugcauacaguaugcgguauaguaacaugaugugcagcuuuguagucuaggaacaauaggcuauaccaucuagccuauguguguaguaagcuauaccaucuagguuuaugcaaguacacucuaugauguuugcacaacgaugaaguugucuaauaaugcauuucucagaacauaucuucauuguuaggugauacacaauuguaucuuaguggaugccuguugacauuguuuuucauccuccuuuuccuuugaguuguuuugaguuguauauuggcccaagauucaggggcggaguuaaaaauguagauucaccuugguaauucuaguuuuguaucccugggcuggcucaugaaaaaucgacauuuuuaaaguucuccugaugaaucuguugaguagcuagauuuggaaucccugauaaauaguaaguaucccauggucccagugguaagcauacauacagcuggcagcccuuuuggaacuucauuuuuugcaaaauucuuguuaaucuuauaaagcaugaucaguuaauauucuggcuaucuagcaaacgcuaaacacuuuucaguggaaacaccugcugaaaagucaaaauucauaugaaggcucuacugaauuuaugcaagaagaaugaucaauggaaauaagggaugaggaggggagacuucaguaaguaugauuagugucaaaacuauauugcauuuucugcucuuaggaaacacagaugccaguuaaauuuuuuucuuuuguuugguuagcuuuuguagcuauaggaaauaaagaauuuugguauuaaaaauuaugauacuuuauuaaccaggcauugagauaaugcagaauaaccuaaagaucucgagacaauagagaggaaccuggugacaaucuagacucagggucuaccuccuccacugggcagacaaucaacaccagcugugagugggaugcaugcacuguugggccugauaucccaagacaagccuccaccuaagcuaguuuacaaaccauuguguaauuugaagcuucgccaucaacucaggaugcccguaagcuuucacuaaauagacacuuuucuagguaauaggguugugggaagggacaugggaucugagguuaacuguguuaauaguggcccugucacuuauuuuuauaugaccauaaguaaguuugccucuuggaaccucaguuuuuuuaaucuguaaaaucggguuaauauuauauaccuuauaaggcuguugugagaauuaacugaaaggcauguauauaaaaaacuuaauacaaugcuuuaccacaauaggcuaugaaaauauguuaacuguuauuauuaauaaucaauucuuuucuuuuuugaggcagagucuagcucugcugcccagacuggagugcaauggcgugaucucggcucaccacaaccuccgccuccuggguucaagcaauucuccugccucagccucccgaguagcuggguuuacagguguaugccaccacacccagcuaauuuuuuauauuuuugguagacaugggguuucaucauguuggccaggcuggucucaaacuccugaccucaugauaugccugccucagccucccaaaaugcugggauuucaggcgugagguauauuaauaaucaauucuuaaauaccauguuuuaagggacagagccagacuguccugaaauguauacuuguacuaaccugcugagccucugagauucuaucauuuaauuuauuucuuaauguuauggcauacccuguugaugcucauuguuaauaauuuagguaacaaccuguugguuucugggauggguuagaagaacagcucagagggaaagcgcuuaggagaggaggucagagaaggaugguagaauguuugguuucacagugcagagugugugguagcagggugggacaggagucugggaaguugggaggcuucuguuccaagagcuuugaauguuaaaacugggguggggaagggguucauucccuucauugccaagugguuuauggugauugaguuccaccuagaaguuaaugaauuacagagucuuggaguugccucgggcuggauuuucacagugguuauuugacuucucagccacugugcuuuuuuuuuuuuuuuuuacuuuaaauuggaauaauaauggugguuguaguagaacagcauaauuauuacuaauguuaguacuguuuacucacauuuguugggugcuuacacauaguacuuugagugcuuuccgcauauugccuuauucaaccuugugagaacucaugaaauagguauuauuaaccccauuuuagagaagagcgaacuucacagagcuucaggaacuuacuacguggguggguaggcaagcuaaaacaagaugugaauguaaauggucuaauuccaggagccgcgccuucguucccugucuuaaaggcauguauauguauauauagugugugugugugugauuuuacacguauaaauacacauguucauguuaaggcugaaacuacauagcauguauugagagcucugcaaauugcauugguuuucuguggaggcaguuauguaaauggguucagacagacagcaugggagagacuacauagucugccauccuggagcagcagugagucaagaagucucugcagcagcagcagagccagggaguuggucaggagugagugggcagucugacuugaagaccccguguuuccuuugggacccuuauuucugugugcuuacaggagaaugcuaaaaacaugauuagaacugaggucaucacaacaagaguaucuguggaagcuuuuuuugccccucaaagacacuuuaauuagauucccaucaugaaaacaauuaggcaagauuugccauaccuaaccagucaauaauucaaggacaggaucucauuaagagcuuuugcuuucccggaaacugccguuuugaggauucagcacuggugacugcgugcucuggggauuaauuccugauccauauuuccccugaacuuuuuuauuuucucaaauccagaagaaaacaaauuuuuaaaugacuguauaagcugcccuucauuuucacaaagguguucugggauuugaguugugcuuucucugucacaguuccauuggguuuuguuuugaaucacacccacuaaguggacaaagcaagagacgagacucagauacaggcacugcuugagugggugagccucacucucagauuuuuuagguggcucaucccacaaucaggugaagguugucuucuguugaccugagccaguggaacuccugugauaucugguucauuuuccaugacacaaguauugagauguauuauauauuucuugccuucuuuugcuucuucacuuucucuucccuauacucccuccaucucuucauucuuuccuuccuaagugcauuauugauuuccuaccgugcgcuagucuuugcaauugaaauugaggauucaaugaagaaaaaauagauacaaccauuuagaaaaacauuuggccugaucuguuaaaguugaaacugugcaugugcuauggcccagguacuugacugcuggauacuccagagauacuugugcacauauauaucugguuacauuauaagcauuuucauaacagcacuguugauaacagccauaaacugaguccauucuaaauaucuucuguagagugguuaauuuggaguguuuucaaucaguagaacacuauguagcaaugaaaaugaacaaacaacaacuacaugcaacauuguggaugagucuuauacacauaagacugagcacaugggcauuauucacccugccuuaauaggcagugacaugaucagugugugcuuaggaaguugacuuuugucaguacggaguuuagggaauucaugcuggagacagggaccccauugggaggcacuuugcaaugguccuggagagagaaaauucuaugccaagcccaggcaguagcaguagcaaggaagagaguaacauggauuguugagggacauuacaagcgaaauaagcacaaucaggugacuuacuggauguuuagauugauucuagagaggggaccaucuaacauguugcuaagauuucuaaucucgugcacuagaagaacaguugugucauucacuaagaacagaggaagacuaggauuuugaggugauagcuaaugaauccucaugacauuaagauaugugaccuugggcaaguuauuuaacaucucuuugccauaguuucuucuuguauaaaagagagaaaauaauuuucaaagcauagcaaccucagaagguaauacaaugucugauauagaauguacauuguuacgauacuggguuucgaggaguaaguaugacccugaauuuguaauaucauaaaugugauggagaguccucucuguaggcuucucagagaugaaagacaggugaaggaaaacuugagucauccuuauaugucuugaggaugaugaaacacuauguacuucaaguacaggguggggagaaagucuuaagacacaagcuacaaagaaacgagauuacauaacgugggaaaaggaaagccaagaggugauuuaacaagacuuuaaaugaagagcaagccagaaguuagcagguacuguugcugaaaaugguuuaaaaggcacagccauuuauaaaaugcuuuauuuauuuacauaaaagugauacucagggucuuauuacucaauagacuuuuuggugauggccaaaggaauacauauuguuuaaauagaaaauuuauaaacuacuaaaaagaagaccaaagcaaguaaauaacauauauaauucuaaugcccuaauguuaacauuuuagcucuguucacuuacucaucuguccaucuguccaucuguucauccguccgucuguccauccauccauccauccaucuugucuuuuuuuuuaaaugaagcugaaauuaaaccauguguuguguaaacugcuguguuuugcacagaacuuaaauggagauuaauucuagugugagggauuuagguuagcuauuuguaguaagaagagugucugaugugcuuuaucaaugaguuauugagggaaagugcaauauuuucuucucuggcagucuuaaaauauaguaggauaaacucucaucucguugauggcaagggcaugacccugcuuuacugcucuguuauucucugauauguggacaaaacccaagagugcuuuucugaggacuuacuucucccaaaaguggcagaaagaaauauugguuagaauaugauguaagagacucuuauuaaucccucaccuacauuugccuucaggacugaggacugaagaguucaucucucccaagagugugagacugcucaacuuuucauuucucaauauuaaaaucacuguaaaauucuauucugacuaauccagaauaaagacaggaaagauuagugucaccaggauauaguuuuacaugagcaaaucauuuuaaauaggcuuaaaucuaaggggugaaaacugcuuagacggaagguauuuaugucagaguggaugggauaacucguguguguguguguguguguguguguguguguguaagagaaggggaggaaagggaagggggagagggagagaggaauucugaaggcuuccuuuuauuguaugcaugaucuaaauguagaggcuacugcuauuagugaggucuaauuaagagguuuuaauaaccauuuugaccaaaaugacaguuuguuggauccaguauuuucucagauuuuuuuugauuguuucagugcaugugcucacauaugcaugcauauaaacacaugccaacuauacauacaggagacguggcucucauuuccuuuccacagagauguaagguugagaaaauguuuucuguuuugaauauuuuuuauuacaaagaaauugaauuaauucauuuaacaaaugcucauugaacucauucaguguaagcacuauggugaaaauggggaauaggagauugccuaaaagcauuaaggaauggcaaggagcguuuuagucaguggcgcagaugugacuauuaaucuauaccgaguacuugguguccucagaagacaagccaccguuaccuucaggguaaagccuaaacuucucagccugaggccauuugcaaucuugucuucaauuauccuuucagccucauacccuaacaucucccacacccaccuuaugcuccagucauuccugugggaagaauuuaucaagccccauaccauguacugggcauuuuuagauaacuuguggcuccucagacaucucucuuccuucacgccuccuuaccuggguccuugugguuuuccucugauggaaugcuucaccuccaauugcugacacacucccacuugccugugugccuuuuccacuagccagugagauccuggaggagagagaccaucuccuucucugugggccucuagcagucaguauggcacuuagcauauaguagccaugcagucaguguguugaacaaaugaaugaaugaggcaaaguuaaguguaauccaaaucuguaguggugaugagcugccuuagcuuuuguuuauuuaggaacaucuuaauuucucuuucauuuuugaaggauaguuuugcuggauguaguauuuuugucuuguagguuuuuuuuuuuuuuuaauuucaguauuuugaacaugucauuccauucacuucuugccugcaaaguuucugccaaguaaucuacugaaaaucuuauaggagcuuaaugugaugaguugcuuuucucuuacugcuuucaagauucucccuuuuucugugacuuuugacaguuugacuauaaugugucuuggugugagucuuuuauauauauauauauauuuuauuauacuuuaaguucuaggguacaugugcacaacgugcagguuugaugcauagguauacaugugccauguugguuugcugcacccaucaacucaucauuuacauuagguauuucuccuaaugcuaucccuccccuaggcccccacccacugacaggcccuggugugugauguuccccacucuguggccaagugaucucauuguucaauucccaucuaugagugagaacaugugguguuugguuuucugucuuuaugauaguuugcugagaaugaugguuuccagcuucauccaugucccugcaaaggacaugaacuaauccuuuguuauggcugcauacuauuccaugguguauaugugccacauuuucugaauccagucuaucauugauggacauuuggguugguuccaggucuuugcuauugugaauagugcugcaauaagcauaugugugcacaugucuuuauaguagcaugauuuauaauccuuuggguauauacccaguaaugggauggcugggucaaaugguaauucuaguucuagguccuugaggaaucaccacacugucuuccacaaugguugaacuaauuugcacagaugugagucuuuuuguauuuauccuaguugaaguucauugagcuuucucaauuuguaugccaauuuccucccucaaauuuggggaauuuucagccauuauuucuucaaauaggcacucacucugcuucuuucucacucucuucucauucugagauucccguaauguggauaaugaucuguuugaugaugucuuauaagucccuuaggcucucuugacuuuucuuuauucuuuuuauuuguuuuuugguuccugacucaauaauuucaaauaaccuaucuuuaaguuugcugauucuucugcuugaucaaguuugcuauugaaugagccacucuagugaauuguguuuuaguuccauuauuguauucuucaacucuggaauuucugcuugguucucauuuuucucauaguuucuuuuuguugauagucucauuuuauucuugcgcuuuauuuuuccugauccauuuaguugucuauuuuaguucauggagcauuuuaagaugguuauuucaaguucuuugugagguaauucauagaucucuguuucuucaguguugguuucuagagauuuauuuuguuucuuugauugggccauguuuccuuguuucuuugcaugcauugugaucuuuuguugagguuuggguauauaaaaaaacagccacuucucccagucuuauggacuggcuucauacagggaagaccuucacuagucagccuagcuugagauucugggggccucucaaaccuuuuugagggaugcaucuucucuggacuuguguguaauuucccagucacagaggacugccccuguucucaagagcccaugaucuuuuguuacccuuguugucugucugagguacugcaggcucucuaguguaacaagccaccaugcuugcuuuugaaaguauauugccauuuccuuuagcacucugagucaugccccucuuaaagacaggauguuggaugcacaguuagcacuuuucuaucccuacugagggagaagccagaagcugggaguuuuuucuugauugcguuacacuaugcugggugggagggagcuaucauagguaaaagcaacaaaguuucuuaucugcuuugauguggcucuucuuggcuuugcaccuaccugggugcugcuaauucuugagggaguucucauaaaggcaauuugguuuguauauuguucuuaagucauugucucucaggguaaugaaggcuugggacuuccuauucagccaucuuacuucuaucacucuuaaguguaaucuagaucucuguuuuaugacaugaagauaauuaauauugauauaauuuugguaaugaaaauugguagagauggugacauaucucuucugucucaccccuucuccaaucgaggauugaaaaagucauuccaggugucuggcuuuccaaucuugucucuaucugacucucuuuaguaauaguagcuaacauuuaguaaaugcuuauguguuaggaacucuucauauuccugugaugugugauaacucauuuacuugccacaguaguuguaaaagaaagauacuauggucguucccauuuuacaugugaggaaaccgaguuauagagagucuaaauaauuuaccuaaggucauaucauugauaauuaccucagacucaauuuuaaaaagagauuuugcagcaugaaaugaauauucuuuaauuugaauaagacuguuaauauuauauaaacuauaaguuacuuuuaacaaaaucuucuuauaauagguaguuauugaauuauuaaggauauuauuuuuuauugauuauaagugguaauuaugcagcuagaaaugucugucguuuacauauccaagcauagaaugacaucaaagauguguuuuuuguuuuuuuugcaggacagaguucauucaaagaggcaggauuucaaucacagggguuggauuucucaacuguguuuuagaaacuuuugccagcacauucuuacgacagggagcccagaagguaaccauauuucugcuuugaaccaacauuaauuuuaaaaaacaauaggaguuccaauaggguuauugaauaagacucaugagcagacauaaugagaaaaacauauaguuaauaaacaaauauaugcaaaaauaaucaaccucaaaauuauuacauaaauucaaaucaaaguaaaacuaaaguggcauuuauggcucauuaaauuaaaaauaugccaaugaagaguaugugaaaauuuggagcauacuuauaaucuaauuaaaagaaauaaucagaaugaauaauaauguauaguaugaugacaacuauuuaauaaagauaaugauaguuaauauuuauugagcacuuacuauguacuacugacugcuaaaagaauuuguauuauuaacucauugaauccucacaaaccuuugcaggagcuguuauuguuguccuaauauuauggaugaggaaaauacagagaccccaauuguccacucuuauaguuuucaaacucuauucucaagggagcuuaggcuuccaugaaagugauucagaagccauguuggaguucuaagguccugugugcucuauuuuaaguagagcuuuuccauuuuaaucuguccucuaugguauuccauauaacauuuauaucuucuauuuucuuuccuuaauagcauuauuuuuaaaacuucaugucaaaacccauugcuuaugcauuuuuaugugcuuauugcagugcucaguauaaagcaguugcuccuaaguguuuuauuauuguuauuaauuacgaugauaauuauacucauuuauuuccagauuuuacucaggacuuuuuguauaaguuuaccucauuuuguuuugugggauagaauuaaccgcugguguaaagaaccauuguuaugacccucagagacuuccuggcaauggacccuuguuuucauuuuugcaugucuagguucaaggaugaaccuguacuaggagguguucaucugggaggcugagggcggugaaugaauauucaguaccguucuguacaccauagacauacuguugugauugaugauguguucuugcuccaguugaggugguuccuggcacauauucagacugguccagccucuuuaaaccuggacuugaagggaguaguugaacuuccggaagaucuuaugucaccuuuacucacucagacauuauugcaaauuuuucugcuauauugcaauuuaugcguuuguaaaaacucccauguucugcagcauugcauucuaaaaauaguggaacugaugagaaaaguaauuucauugccauguuucuuacugaguugacuuuuugugcauccuuuaaacucuguaugaugauaauaguaauaauaaauugaauuuuuuuauaauacagcuauauucacuagaagaaugggauuuuuuugagggggagggauaacauuuaggugaagcagcguucaaaauucguguuccuuauuaucaaauugauugcaaauguucauuuauaaaaaccauucuugcaggccauauaaauacagguggugggcuggauuuggcuuguaggguauagcuaaccccuauuucagauaaauauuauuucauuaacugagguuggucuguauuugaugcaucaauuaaucugaugaaccuaauaaugacuuuuaauugcacagugguuauguacauucugauccugugagacacauaaagugaaauuuuuauucccauuuuauuaaugagaaugagaauucccauuucauuaaugagaaaugacuugacuuaaaagauaagcauacccgauacgugguaacugcuuucccugcuuccuuccucuuacagauauauauugaguaccugcuuugcacuaggcacugugcuaagugugggcuaaauguguuucuucaaggucacagaacuagcaaaggguggagucuggacuuaaaucccuaucuuuugucaauaagaguucccucuugccacuuuacugugcagcccucagaugaaugaagugaaauccuugccuaccuagcaucacgaacuucacuaauacuuguguuuguuagaugaauuuguguuguggucuuacucccuuuggauuuauuaggacuauuugguugcaaguaacagaaaccacuucaggcuagcucauucuaaguguacaaggguggugaggcuggcagccuucagaaaggucuucacugggaacugaacacugccagcaaccaagugguauuccuucuucagcucuugucuguaagacuaugugucuauuuuauuccacucuuucuguguagucugguuuucucugcuccccaggcuauauaaugggacaugggccuccauugucaagcauacauauuauauauuaauagaauucucacuaauaauaaaauagcuuauuucuuuucuuuauuaauucuuugggagggacucucguuggccuccuauaggucaggcaccaccaggaagguggaagucaaguuguccaguuauggcucauucucugccaugaccacauggaccaggguuaggggccacuucucaggggaagggguuguggggcggauauauacuccccaaaguuucuagcaugaucccacuuugauuuuauguuccuugauggcagaagugguuucauucaccuuaauucuuauucccuucucccaaccuauaguaccuuggacaguguuccauccauucgugugggaaugaguagaaaggaaaugcccagggagguucacaguugguuucugaugaauauuaccuggaaauaauuaggugacuucaacuucuuaaagugauuccuuuuuauucucauuuauuaugcuuagaaguaagaauauauuuuuccugcuagcuuuugccuuuucugacuuacuuuuucuuuucgaagaggccacguuuaauuagcuuuuugauuuuaggagccauuuaugccugagugucuuuuuuguuuuauccaaguggucauuuuuucugguaucagccugacuuccugauaaaccuucacagcugagccugcauaaaugguuucuguggaagucaccauaagaguguuuuaggugacuuuauuuucacuuuaggacuuauugcugagucuguuuaguagugguaaugaugggaucugauaucuauuuuuuuccagaaaaaucaaaacuagguacucacaaacuuuauauuuuuauguuuguaaauuaaaagcuggcuuuagccauggauccccaagcugaggucauacguauucugugccucuggggacuggcucaauugcuuuuuucuccuuccuucaucacucuuaaagggagguaacuuggaauuugggagccuuugugucacaaaugcugacuuuucacacaccagucagaccccuccuuccuccuggaguggaaaucugugggcaggagaacugggauuuccguuuggcagccaaguugacagauguauccuugaaacggagugguucugaacuuacaguccucuggacuugcucuccucaccuuugugacccagcacaaaucacuuuggcccucccuauucucaguuuaauugucugcaaaauggggauuuuaauguguucccacagguacaugugaaaacuaaguuugauaacuuucuguaacuuaguaaacacaggucaaauauacaaaauauguuuuaguuuucaagaauuaagaaaaaucacugccacauacuucuuuaacauauuuucuuuuuaugguuauauguuuuuuuuucucucccucaaauucauguaaacacauacagucuagacaacuagauuuuaaguucaauuccaccagcacuuuuugggugucaccuaugugccaggcauuggguagaaugcuggagacacaaguaagaauuaagacauaauucacaagauagagacugugccuuaaguagcuuuacuucugggacaucuagcucaggguggaaagcaggacagacaaugaaugaacaucugcugaugcagaaaauuuauugagccuuguuugguguucagugccagcacuaugaucagugcugagaagcauauuaaaauaacagcuagugcuugcaagagcuuaguagaugccaagcacuguccuuggcacgcauuaccuuaucugauuuucuggacaacauaaugaaauaggaaauguuauuuucauuuuaugcauagggaaacugaggucccaaguggcaaaguaguuuucucaaggucacagaauuaguaaauggugaaccggggauuugaacccaagcuugucugaccccagagugcucuugauuucugcaucacagugcugcauccaugaucugugcacuuaagccacuugcguggggcaagcuggguguucuugauauaaccagagugaggcgaugugauacacgguaaugauggaggaaugcaaacguagggagcucaguuacaagagaggagcuuggaaugggccagaggaaugcggccaugcuacuugaaacggccuaugaggggcaagugaauaucuucccuucuguucagaggccucagcaucugucgucuacacuacagcugaccuaaacuccacagugccuugcagguugacaguguguuagcuaacguuucacccauuuuuacuguaaugacguauccucuuuucugcuuuucuguguacugcagauguauuguuauuugcuuugaaaauaccuuuguauuaaaaauaauauuaaaaguuuguuuuuuauuguggcaaaauauacguagcauaaaauuuaccauuuuaaccauuuuuaaguguacaguucaguggcauuaaguacacucacauuguugugcagccgucaccaucauccaucuccagaacuuuguuucucuucccaaacaggaacuccuuagccauuaaacaauaacuuccuaucccauucaccuccuagccccuggcaaccaccauucuacuuuuugucucuaugaacuuggcuaguuugguuaugucauauaaguggacucauacaguauuugucuuuuugugacuggcauuauuuuacugagcauauguuuucaguguucaucugcauuguagcaugugucagacuuaccuuucuuuuuauggcuaauauuuccuuguuuguauauaucacauuuuguuugucuagucaccugauaugguuuggcuauguucccacccaaaucuuacgugaauuguaauaauccccacgugucaagguggggccagguggagauaauugaaucaugggggcuguuuccuccauccuguucucuugguagugaugggaguuccccugcacaagcuuucuugccugccaccauguaagacgugacuugcuccucauucgccuucugccaugauugugaggccucccuagccauguggaacugugagucaauuaaaacucuuuccuuuauaaauuacucaguggcugguaugucuuuauuagcagugugaaaacagacaucauccauugguggauuguuggguugcuucugccuuuuggcuauugugaauaauacugcuauaaacauggguauauaaauaucuguuugagucccugcuuccaauucuuuuugguauauauauauauauauauacccagaagugaaauugcuggauuaauuauauguuuaauauuuugaggacucauuuaaaagguuuuuuaaauuuuuaaguuaauuuuuuauuuuuaauugacaaauuauaauuguauauauuuacgggauacaauguggcauuuugauauauauauauauauauauauauacacacacacacacacacacaauguggaauuauuaauucaagcuuauuaaaauaucuaucaccucacauauuuaacauuuuuuguggugagaucauuuggaguuuacucuuagcaauuuugaaauuuacaauauauucucauuaacuauagucaacaugcuauacaauagaucuaaaaacuuauuccuccugucuaaccgaaacuuuuugccuuuuggccaacaucuccuuauucucucgcaccucccccagccucagauaaccaccauucuacucucuacuucuaugaguuuaacuuuuuuagauuuuacauaugagguauuuguccuucugugccuuauuucacuuaacauaauguucuccagguuuauccauguugucacaaaugacagaacuugcuucuuuuuaaggcugacuaguacuccacuguguacuauaccacauuuucuuuguccauucauccauuguugaacacuuagguugauuccauaucuuggcuacugugaauaaugcugcagugaacaugagaguucagcugucucuuugacauacugauucccaauucuucggauaaauacccagaagugggauugcuggaucauaugguaguucuauuuuguguuuuuugaggaacuuucauauaguuuuccauaauggguauaccaauuuacauuuccaccaacaguguacaagggcauccuuuucuccucauucuugccaacacuuuuuaucuuucaucuuuuugauaucagccauuguaacaaguaugaggugauaucucauugugguuuuaauuuacauuucucuaaugauuggugcuguugaaccuucuuuuuuucauauaccuguuggccauuuguauauuuucuugugggaaauagcugucugguucuuugcccauuucuuaauuggguuauuuguuuucuugcaauugaguuguuugaaucccuuguauauuuuggauauuaaccccauaucagaugugugauuuguagauauuuucuuccaacuugcagguugucucuucacuccauuaauuguuuccuuugcugugcauaagcuguuuaguuugaugcaaucuuauuugucuguuuuuguucccugugcuuuugaggccaaauccaaaaaaucauugcccagaccaaugucauggauuuuuucccuuguauuuccuucuaguaauuuuauagcuucaguucuuauguuuaagucuuuaguucauuuugaguugauuuuuguauauggugugagauacagguccaauuuuauuauucuauguggauauucaguuuucccagcaccauuuauugaagagacugguuuuuuucccauuguguguucuuggcaucuuccgugaaaaucaauugacuguaaaugcgcagguucauuucuggucucucuauucuauuccauuauucaaugugucuguuuuuugccaguauugugccauuuugauuacuauagguuuguaauguauuuugaaaagagagagugugaugcuuccaguuuuguucuuuuuacucaagauuacugugguuauuugaggucuuuugugguuccaugugaauuuuagaauugcuuauucuauuuuuguggaaaauguuguuggaauauugauagagauugcauugaaucuguagauugcuuuggguauuauggauaaguuagcaauauuaauucuuucaagcuaugaucaugggaugucuuuccauuuauuugugucuucaguuuuguccauguuuuauacuuuucaguguagagaucuuuuacugcguugguuaaauuuauuccuaaguauuucuuugguaacuacuauaaaugagauugauuucuuaauuuuuucggauagucuguuguuagcauauagaaaugauacugauuuuuguauguugauuuuuguauccugcaacuuaacugaauucauuuaucaguuccauuuuuugguggagucuuuaggguuuuauauauauauauaagaucauguugccagcaaacauagaugauuuuacuucuuucuuuucuacaugggugccuuuuauuucuuucucuugccuaauugcucuagcaaaacucccaguauuauauugaauagaaguggcgagagugggccacuucuuuugagauaguugucuaucugugugcaugacagcaaugggguauaccauuucugugaauuuuucucaauucuauacagaagaaugaauauauaccaucagccaaugagcacuggugggugugccauacaguguguuccucaaccugggaggcauucacucaucucuugaccgugccauagucucucucagccuagauuucaugugcugguggacacuuuugacccgugguggccaauagaagauaguauguuggaagugccaaaaacaugcugaagacaaguauuugcuuaucucaagucaugcuaaaauauguaguuagcuuuuaauaggccuugagauaaguaaguacauucagaaagcagaucaaaaagauaaagaucugaaggaaaauagugguugguggaaaucugggacacaugaaaggcuucauauacauuucuacagccuuggaagauggcccaaccacugugugaagcagagcuggaagacacccaggccagagucaagucaugaucucagaccucagggacccaaagaggaggaaacagagacaucacugaugcucugcaggugcucaccaguuugggagggcuuuccuuaggucaguguuucucaacccuuuuuucauuauuacucccuucaggagccuuuuuagacaauuuuccccuaauugcucuuuucaccaugaaauuuuaagaccauagauagacugauuauuuguucauauacuauauuauguucaauuuauacauaaaaagugaagauagcagggugugguggcucaugccuggaaucccagcacuuugggacgcugaagugggaggaucacuugagcucaggaguuugagaccagcauaggcaacauagggagaucucgucucuacagaaaaccaaaacaauuaucugggcauguuguugcaugccuauaaucccagcugcuccgggggcugaggugggaggauugcuugagcugggagguaaaggcugcagugaacugugauggcaccacugcacccuagccugggugacagugagacccuaugucaaaaaaaaaaaaauuguugccucuuuucaauauugcccuguugagacagcaugccauuuacuauuuugggcauacuauuuagggagcuuuugucucuacuccuccaaauugacaucuuccgugugaagugaaaaaauugcuagcuucccacuccccaaaaaucucaaaccaaaaauuuccaaacgcaaagcaaaagaacguuuuggugaacccccacauaguugcuuacaaauuccacauuuugcuucucuggggaggcuuaggagauaacaugggugauaacagucuuguuaugcaagcauucuuuuuuuagccuaguuugucugaaucuuuagagaguacuacaaaugcuguggaaaugcagagcucucauuaugcaaucgcauagacguguuuuuuguuuuguuuuguuuuguuuuuuguuuuugaguuugugaaauacauuuucaaugugugaugaaauaauuuguuauuucagccacucuccuggcaaggccccauuauuaguuccaucauuauucuuauugugaucaggaggcugaagcagagaacgauugaauucaacagugugugaaauauuugucacugaaacaaugcgggcaagucaaacaauuugaacaucgcuuuuaagaaggucuggccuagacaugcuacagcuaaagaaaucagaauaugcaguuuccuugggguguaugcuuguuauuuuagccuuauagaaauccauuuuaguagugggagauaauuuccugggacucaagaaaaaaguggagauacuacaaauguaguucaaguaggcauuugaaaaaccuugagacauuugguggcauuauuuuuguaaaguaacuguauuaguuauuuauugcuguguaacaaauugccccaacuuugcagcuugaaacaacacauauguauuaccucuguuucuguagauuaggagucuaggcacagcuuaguuggaucuguuucaagguuucacagggauguaaucaagguuuuagcuggggcugcaaacucaucugaaggcucaguggggaagcuucaucuccaaacucacaugguugcugguaggauucagcgggccucccuugguuccuugccacaugggccucuguauagaugaucucagaauguggcagugagcgugagagcaagagagugcuaccaaggugaaauaucacaguuuuuuauaaacuaauugaagugacauccuuuuauuuucuguauucuuuucauuagaagaaagucacagcccacacuaaaaaggagauuacacaggggcauaaauaccaggaggcacaggucacuaggagccacaucagaagcugccugccacacugaccuuauccaaccuguaugcugaguuguaggcauaaguauuaaguucuuuuugauauauacuggguauugauuauaaugagagguugcugagggucagcugcaucccagaaaccucauuaacaguuuauggaaauuucugugacacauauauugugacauuuauuaguuauuuauuuauaaguaggcacaaaauaguugaccuguucuguaaguuuaagucuucauccuuuugggugcucaggccaugaauugcaugaacagcucacugaaggcacagcagacaauauuccaaaggcaggauucagcuauuuuauagagagcaucagguaaccagaaucuucugauauaguagcuggcccugggaccauuuaggcauaaacuguggaugccaucccuaaaguuggagggugaaggucuugcuagauagagacuuacacccugauggcacaaggaugggugcuuguuuagaauuuugagcuaauccacguaucuuaaguuccauucauugaguuaaugacaguccauuucuaauauccauuaugcuaguuaacaagccauuauuuuuaccagugaaaauuugcaauuuuaacauuccuugugcuaauaaucaaagccuuuggugucugacugaaguuucuggagagcgagguugcugauuagaaugcucacagacagccucuggcaugugaggccugcauuagggcaucuagcuguaucuaguguauaacuugaacuaacacucauacuaucguaguauacaucaugugcugaaguauuuuaaagcaaauuauagacaucuuaacaaucguauaccaaauaucaacuucugaacuaaaagcauaguaugcugugccuuuagaaagauuguucagugugaaacaaaguuuugucuguauguuuaacauagggauuguguaugaagcuuuagagaaaagcuucuuggcccuugauuaggcuuucucacuucccacaagucacacuuuucucucucagacccuaaacuuucucucucuagaaugaagugaucauaaaccccauuuuauaggauuuuuaaaggauuaagugagguuacauaugugaaauaugccuggcacauaguaaaaccucaaucauugucagcuuuaagagacauucucugcuaagaaguauauuuuuauagguaauagccuuuuaaauacaaacauuuuagauauaccgugguacagggcaaguuugugguauuucuuuuaaaaaugauauauuuuuaucauuuucuugaauuauaaaauuacuaaauauucauuuucaauuuuuaauuaaagugcaaguaagauaaaaucauucauaauucuaauacucaguguauucacauuuaacauuuugacguagaucuuuuuauaugucuguucauguuugcaaauguauguauauguauguuuuuuuaaaaaaaaaaaaaacaaaguugggauuauuuagcccaacuauuucauuuguggacauauuuauaaacauuuuuuucugugucauuacauauuccuuggaaacaugauuuuugaugccugcauaauauuccaucggcauaauagcuguuauuguugguuucuauuuuucuucacuauuaugaauaauauuggaauaaauuuuugaauauaaaugccauauaaauauuuguguacauuucuuguugcuuucugagcuaagaccuuucaugcuuauugccaaauuuucucccaagagaauuccgcaaauuuggcacuggauaucauccauauucuggcuguauaacuugaaugaaagacuuaacuucuuaaaacuuccauuuaucauuaauaaauuaggcuaaucucacuucauaaaauuguugagaagaaaacaaaauuguuaggucuugucuucugauaucuacuuugaagacuacugaaaguuaaugauucugccauuaacuaguuguuugacuuuaguccaccuccaugaauuuuuuuucuuuucuuuucuuuuuuuuuuuuuuuuaagcucaccacaaccucugccuuucagauucaaacaauucuugugccucaaccucccaaguagcugagacuacaggugugcaccaccaugcccggcuaauuuuuuuguauuuuuaguaaagaccagguuuugccauguuggccaggcugguaucggaccuguggccucaagugaucugcccaccucagccucccaaaaugcugggauuacaggugugaaccaccaugccccagccccccuccaagccuuucauauauccuaccuuggaccaguugcucugaggugcucaauucuuuaucugugaacuuacuguucaggaaacacacauacacggguagucacaauucuaaaaaacaguggauauuucaaaauucaguaauuccaagacagaggaaaagagcauaaaaccgucguucaaaagaauaaggagaagucacaagugugauauaagaacagggugugauaguauacugacuauauaucggagacuugcauuuccugcuuguucaugugaacccuuucaagauucuuuguuacuugaaccacaugaaaaaacugaugaaauauuuuuucccuauuccagaggguuuauuucccaguucaaauuuaccucuguugauaauacuuuuuaaucccacccuugagugcucagauagauugauuuaguugauauuuauucauuagcuguccugagaauauuaccaagaauucugauuuuuaacagcuuauuucuagaccagguauaucauaguagcugcuguauucuuacacaucuccuuccccaucagcccugcuacuacuauuaccucuagaguuuucgucugaugaaacauagcuuuugcagggaaaacagcuuuguggaaaugaguauucuguaagugauacauuuuuuuguuccuucuacugaguuuaaaucaaugccuuuaccuugacugugaaaccugggaauccacaaucccuugauggcucauuugaauucauccugguuguaacagacuuugcuaagugguaaagcuuuugggaauucuugguugguuuaccagcugaaauucugggacguugccuucuaugaaacuagaugaaaucucggaagucaagcucuugccugaaaugaaguaagugguuuucugagcuccagauguguuagagcacagugaugggagaaagggccucuccacacagugcggugagaugccugucaacccagccaggagucaggagaccugggcucuggcccugucuuggccgcucucugagggcuguguugcuugagcuaguugcucugagcuucacuaacaucuucuguaaaaucagacuuaacuggguaggucauuuucaauuaggcaauuguaugacuuuuuaaaaaaaauucucucucccuuccuucagugucuaaccaagauuuuucugucugacaaauagucuuuaagcccugcaucaaaaugcaguaguuuaagcuaacuagggauuuaagagcaucagagguaauucaaacaaguuuguagucaaggguugagauggcaauaaaauauuuaaaaauaagaaacauaauuuuauaaaaugcuaauuagcagaagccaugguaagcaugugguaggguuguuaaaauuucauuuuauaauucuauuaacauaaauauguuggcuuauuuuuaaucuaugccuucuauaaacacagccuuuggaaacuuuggggaagaccagauauaauauaauaguagcuguaauuuauugaguguuuaccaugagccaagugcuacacuguuguaugaacauuuaguuuucccaguuaccuucuggaacagagacugugguuacucccaccuuucuguuuuacagaugaggaaauagaagcacacaaagguccaauuccuugcacaaagucaucagccaguaaguggcagagcuggaauuugaauccagguggucugaccucagagcccauccucucaaccgccauucacuuugauucccugacaagggaggucagagucccagagaguucagaugaaggagacaagacaaaugcauggcuugucucuaucagcacuggguguacauaugacuuugaaguagauacuuguuagacuauagggaaaaauguccucaucuucaaaacacuuaauaugagacuugcuuucuuaguguuccucuacucucacacccacuaguuccucuaaucucuccaaagagauuugggagcuguguucucuccgcugugcuggauggaaauuccaaccaaucuauuaguuuucugaaccucuucucucacucuuuugugcuaaauucaaagacaaagacaaugagaaaauaggaauuuguggccacuauaaaucuucauguaccucguauaaaccuauggcaggcauagaauugaaagcugcuacagcucuggccaggcugcauugaaauaccaaaaacaaauuguguauuuguauguguguauauagauauaguauauauauauauauaguguauauauauagauauaguauauauauaguauauauauauaguguguguguauauauauauaguauauauaguguauauauauaaguguauauauauaguguguauauauaguauauauauaguguguauauauauaguauauauauaguguguauauagauauacuauauaucuauauacacacacauacauauauaaaaauauaaauauaggggcugcaucugcacauuguguggacuaagugccuuuaggaacacaucuguuguaaaucaaaaaaaggcaucauuacuuacaggauugggcuuggauuuuccuaggcucuuuguguugaauuaagucuuuuaguuugaccaaaaagaccaggaaaaugucauucagacauaucagcugagggacuaauacagaauucuggguagagcuacuugaauuguaaauguaauuucauuuaaggaugcaucuacuaguuuagcaacagcuguguccuucagcccugcagcaugcuacuucagugcuccuugagcugucugagguguccagcuguuccccuggagcauucuuccucccuuugucuauugugauuucucauccuggcuccccacucuaagauagaauuucauccuuccugaaagaccccuuugguuguagccaccccuaaugggcagcaggcagugacccaggaaggcgguggggaggaggcugcagugucugccuguuguuaggagaaaaggaagcauugugucuagugaagcgggauuuguuggagugacauuucuuugucacuuucaguuuuuuugaauuccauuugcugucugagauuugacuccuuuuuccuuggcuagcuucuuuccuuagauuccagcucaccaucucugaauuuccaaaggaaaaugguggcuuuuugagaguuaaguaacuccuuucuuauugagucccaauuuaaguagaauuuaaaggcuauaauuaaaauuuccucaaucaggggcuuuuaguagaguguagcuuuuguuauuuuuagacauuaacauuuguuaauaccuauugguuuuucuauuauucucugaacuuccugauacauuugaaauaguucaaaauuuaaaaacuuaucauacuccuccuaaaaagacuuuuaaaaucuuuaaacaaaauuaaaaaaacuuauuuaacaauguuuuaaauagguacuaccugcauguaaauauuuuaaauuauauuuccaguagagccauuuauguucuuuuuccucagcucccuuugaagccagcagaauacucugcccugaccagcuguaugaccuuggcugagcuauuuaauuuucugugucucauguuccucaucuauaaaaggaggacaauauuggaaccuacuuuguagaguauugugaggaguaaaugagcuauguacaugaagcucuuaggauaggauguggcaacaacaaaugaucaguuguuauuguugucguuuugaggcggagucucacuuuguugcccagcuggaucuuggcucacugcaaccuccaccuccuggguucaagugauucuccugccucagccuccugaguggcugagauuacaggcaccugccaccacaccuggcuaauuuuuauauuuuuaguagagaugggguuuugccauguuggccagucuggucuugaacuccugaccucaggugauccaccugccucggccucccaaagugcugggauuaugggcgagagccaccaugcccggccccuguuguuauuuuaagagacgaggucucaccauguugcccaggcuggucucgaacuccugggcucaagcuaguuguuguuauuaacauuacuuaaaaaguaaaaugcaagauaguuaaaaacaauaacuuauuuuucccauuaugacauuauaaauaauuguuuagugguuaugaugagccugucuuuggaaucaacccaauguggauuuaaaucagagugcccucccucauagaguauggaugaacuuaaccucucucugggugaaauaugaauaauacuauauaucuuaugaguaugagagugaaggagauaguauaaggaaguacuuaaaauaccuuggcacacaauaaauacuucauaaaugauaacuguuuucuuuucauuauuacccaaauuggcguauuuccuucuagucucauacgcaaauuuuaaacacagucauaaugaaacaguguuaguacaauuucauuucuugcuuuuuucaaguaauauuuuauaaucccuuucacaguaacuacauaaacuucaaauucaucauuuuaaugauuauauaauauuucauuaaauaguuauauaauaauuuauauugcccuuuaguauugaacauucagguuauuuccacuuuuaccauuauaaaugacaccaugugaaacaacuuuauacauauaaccuuucauauuuuuguaccauugccuuagaaaagauucccugaagcacucuuaacuguaugugacuacuuucaugauccuuugaauauguuuuuuaucucugucacugaaagauaggcuucuguuuaaggcuuaccacuuuauccuuaguaccuagcacaucaucaaugcucaauaaauauuuauugaauuaaugaacaaaugaacauauuauaauauuauuuuccaaaaggguuagacuuuauguuuucauucuauuaucuuuuaacaaaacucuuaaaaacagaggcgcuuucuauaugacacaggaguaaucagaaagguaacaguaacaggucauauuuuuugaguacuuucuaugccccagacaucaaucauccugaguauguugcauguauuaccucauccaauuugcuuagcauccaccauacaauucacuauggugaguacuauuguuacaggaucuuugggguaucauuuuucuggcuggaaaccuguggcuggugacaccuuugccugaguuuuacuugggccugcugggcucauuccacccagucggccuggcaggcugugcuuaguucacacuaccgcccuggcuuccacgccuccaagggagacugugagucaggcguggagcagcgaggggugugugagcaagcguggaguacagccacuaagcaguuggacacaccagcugcugccgugggacaggcagcucuaggugcuggcaugggugccaguucucugcaaagcuguggcugggccaggcgcacuacaagcagcuuccccaguugguacuguuuguguuguaacuguuucagcuuggcggguacugaguucuuguucugugaucaggaagauugagaugcauggacaaauggaggaugaguaagacaaaaaggagcuuuacugagugauagaacagcucagagggaacucacaguguguagccccuuuccacauccagggugucccguagagugugcagccccuagcagagaggagacccuggagugagaagcuccucucugcaggcaggucguccagucgucccuguaucucucagcagagaggaggcucuggaguggguugcuccccucugcagcugauaauccuauuucuagagcugucagcagagaggaggcccuggaguggguagcucuucucuguggcugguugucccaacaucugcucagcucugauugagccugggucuuuuaugggccucagaggggagaaagugugcaccaguuggguggccauaggcaggccaagaaaaggcacacaaauucccacucuggugggacuggcagccccgcccccagccuucaggcccucccuggccugaagauggggcuucaucgaggaccugcucccuuccguccaggaaccugucugccuccugcugccauucaugguguccagauucggcccugauguugcucugaguuuggagcaguuccugacagcugagagaagccaggcagcagggacaggcacuuccaagccugugagugcacaggggcccuucccacccccuggcccccaagaguguagggaagccuugguuugcagugugcuuugggcgguugcagcugugcccaugggggcaggguuucuaccugcuccguggagcaggaggccugggucugcagcugcaguuuggguggcuguagcugcgcgcaggcaggcggggcucccaccugccccugggcuccugccagcuucauggagugugcagcccuggccgugccucccuguugcagccagcagugauggcaguggcaggccauuuggagcagcugcugccaucauuaucauuaccauuuuauaguugaggaggcauagagaagugaguugacuugcccaagaucaagaucgcacagguggugagugguagaauccagauuuaaacuagacagugggacucagacugagcacauaauuacuaggcugccuggcuuuaagguacugaaaauuuccucucaugcuaggugcaguggcucaugcaugccuguaaucccaccuacucaagaggcuaaggugggaggauugccugagcccaggaguucaaggccucagugagcuacaauugaacugcugcacuccagccugggcaacagagugugagaccccgucucuaaaacaaaaaaggaaauucccccucauuuuacuuuuccagcagcucacuucuuuacuucagccacuguaacaaacuauuuucuagagaaccugaauuuguuggccaaauuccauauaagacgugaaucagagcugucccucagucuugggaauuuugcaucagucuccaaacaagagccagaauugcuuacagcacuuggucuuuuaaaacaaucccacccuugcaguucaccaagugaaggauuugugaauuuuuuaaaaauacaagccuuaauuuuuuuauugaaaggaauaauuuuauuaaacuguuuaacauuaaagacagaugguagauuuggaacaucauccaugugggagauaauaauacaugcagggauaucucaaccaaaucauacaacgaauauccuagggauuaaccaagaacacuccccacuuaguuagcaacugaaauaguagaacaacuuuuaagaaguaucaacauuauuacaucuauuucuucagugucuccuuccccuuaccaguuuauuacaggguuuaggagcuugaaagagcauuuguauauacaguagucccccuuaucuuugguggauauguuccaagacccccagugggugccugaaacgguggauaguauggaacucuacauacacuauguacaaauuucuuuuuccuucuucacaguuucauggauagaagacuuguucuuaccauagaucuuagcaaccucagcauaugauuuuuuuuucuuucuuucuucauuugagaacuuucaccuuuucacuuacaggaaacacauuguggcuucucuucaacauaucugaauugucagcaucacuacuuuugcacuuuggugcccuuaugaaguaaaauaagaguuacuugaacacaggcacagugauacugcaacgguugaucugagagcucagagggcuacagagugacuaauaggccagcagugucuacaguguggauauccuggacaaagagaugauucaugugccaggacagaagauuucaucacacgucucagaaugucaugcacuaaaaacuuaugaauuuuuuauuucuggaauuuuccacuuaauauuuuuggaccacaguugacuguggguaacugaaacuguggaaaacaaaacuacagauaagagguaacuauaaacacugcaggcauuuuuuuucuuugcaaauaguugacuuaaaaacagcccaugguuuauuuuuaggcuauuaucugcauauagagauuuuauuuuuuaaucauuuaguagcuuuccuguauguagcuuuuuuuuucugauuacucuuuuuaauuuguaauguuaaguguguggaauuaaaacacaaacgucacuuccuaaacuugccauggacuuacuguuccuucacuccacagguagugcaaaggaugaggagugaagucaagcuaucauauuuauguugcuuuuguuaaugacagcacucuggcuaaccuuguacuucauucacccacuguggguuuuguccccaagaaaugaugacuuuguucaguacugaaaggcuuuuagugggaagugaagggcccuccauguuggcauuacacaauggaauucugauaggcagauauuguguuaaagcagaaaugcuucccuguggaauguuucucuucuggcuucuccagagugcacaagggagcuucacuuagugucagcucaaaacaaaauucauuugcauacauggggaggugcuuuuuuucuuauggcaauuucaagaacuacauguucccugccucuucuaaauuaauaaaauuaaaaccacgcagauguagauggaaauuauuuuuugauuguaggaaggaaugugccgaagcugacaugucauuuuuugguaauuugagaaaacccuauaaacacaucuuuucgaggagauaguauacggaaggcucagagucacaaaaaucagggugugaagcuggauuaugcuacuguuucuuuuuuuuuuugagauggagucucauucuguuccucaggcuggagugcaguggcuugauuucggcucacugcaaccuccaccucccagguucaagugauucuccaaccucagccuccugacuagcuggggccacaggcguacaucaccaugccuggcuacguuuuguauuuuuuguggagaugggguuucaccauguuggccaggcuggucucaaacuccugacuucaagugauccacccaccucagccucccaaagugcuggguuuauaggugucagccauugugccuggccugauuuugccauuuauuaauugagugucuuuggucaccuuuuuuaaccgagcugaacuucauuuuucuuauguaauugacuuauagguaggaugugagagggugaaggcauguaaugugcucagcacagacuaguagauagaggccuuagcuugcuugcuaauuaguucuuucccuggaacuggauccuaguucugucuuugaugacuacuaugaccugaggaaaccugguuuacccugcugggccuaauagugugaaacagaaguguuagugacucuuagaggugaugugaagggugaggaaaaugugagcaagcaugaggugagccccugcugguauuuccuauaggucaucagccucuagcugaauguggggaggugccucacugcgggagucccauuaugaggggccccuagucagauagaguccauauauaaaucaguagcuacuuuuuaggacaugggaagaaugggagguaaugguuaacaaaagucuguugugugccaguagcuuuauauguugccucauuuaaucuucaggagugauccugcagugaaguguacuuauucucuucccucuacacauuuucaggcacagaaacacauucagugagguaaguaagcacucguuguggaaugagguggagaaauccagauuuaaauccuaggucugccacuugcuagcuacaugacuuugaacaagucauuuaccucuccgaggcugaguuuucuuaccuggaaauggugagagcagaacugucuuaccucacgggacuauugagaggguuaaaugagauaauguaaguaaagugucagcauacaguaaccccauaauaaauuaucauuagauucaauauugagguuuggugagauugguuuuugacugaaauauggcuuugaaaaauucuauuuuguugaaaggaaacaccugacuugaagacacaguagacugaccuuuuauguaaagaagaucauugacuuauagaauugcaugaaccuguggggaaggagaaggguagagauacaagauaaaagcagaauuaucugggcagcuguuagauuuauuuauuauuugagcaucaauuggauucauuuauucuguuaaagacaauuuguugauaaaauguacaagcaugcugcuaaccacuuuaucucagaauagggaagaaaaaagggaaaauuaugacugagcuuaagucugaugaauagugaaaaaauggcugauaaaggggaaauaauaggaaccuuguugcuuuucacuugggcacaguugagaguacaggaguugguacugggauggucuggugccagccacuaaaacaguuccuuacucuucaaugugaggaagcacugucucguaauuaagcacagauggacuaaggaacaguaugcuucccaugaauggagguuuccagcaggcaacagaugaucaaauguuauaaaugucauggauggacauggcacugggggagaggccauauuuugcaugaagugcaagugaggaaaaauaaaauuauaugcaggucaaauuuuuuaaaauucaaaaugaaaauagauuaauugagucacauuggaagguggcggaaguaacuuuguaaaauagaaaaacaccagcgacuuaaaucuucauguuagguuaggguuuauuugaaaaucagcaacaugauuuauuaauugaucuuucauucuguuauuugauugcaggaaaucucuuuaaaucagauggaccauuuuugauucuuugcuuagaguuuccuauccggacuagaaaauauaagguccuuuccaguuuuuagacuuuauuauuugaggauauauucuuuuccauuauaaauugugaaaauuaaauauucucuuuaaggagagagaaagcuuuauaaugugaagcaaagacaucugaauuauuguaucaguuuaauguucugcaguuacaccuaaagauuuuggguuacuuauaaaaauaaaaaugaaucuuacucaaaaguuuauuagcuacuaugggaaaauuauauugaagccauacauucuaucaggcuauuucuaauugaaaaaacauugucuuuaaaacaguuuguagaugggauuagauauugauucauauauuaagauucauguuauuuuguuugggagcaggacuaaaauaccugacuuauuuauuaggcucuuugaauacagccaauaaagaaaggaagaaaagcucuugcuauguaccugcuaugguuugaauguguccccccaaggcacauguuggaaacuuaauccuuggugcaacaguguuggaagugaccuaaugagaaguguucagauagugagggcuccaccccuuugaauggauucaugccaauuauaaaagggcuugaaacugugaguucaaucucuugguuucuuguacauacccucuugccaaguggugccuucugccauguuauaacacagcaagaaggcccucaccagaugcacucccucaaucuuagacuucccagccuccagcacuguaaaccaaauaaacuuuuuuuuuguuuacaaaucacucagccuauaguauucuguuacagcagcacaacacagacuaguuccaacagugugucggggguuuucacuuuugcauucucauuuaaacuucccauccccacaguguaguaagauucaggguccuggauucuugagccugauugccuccugucaaauugagguuuaguuacugugugauuuugaacagguuguuuaauuucucugagccuuggucucauccaaaaaaaaaaaggggagaugggaggguaaaauaagugauugcaggcaaagugcuuggcacacuguaugugccaaugaauuuuaacuguuuauuuuagauuauuauuagguguuauuccacuuucuagauaaaguucugcaucuaaaaggauuagacagcaucagauuaaaaguugcauaaaaguugcuuuauugugguagaagaucucuucauggagaagugucaugcaguauucucuuaccuuuugaugagaaaacuggauguagaucccuucgcccuuuccucccuucaucucuuccuuccucccaugcaguucccacucccauccauuuucuuucuugcuuuuuuuuugagauggagucuugcucuuauugcccaggcuggagugcaguggugcgaucucggcucaccgcaaucuucgccucccacguucaagcaauucuccugccucagccucccaaguagcagggauuacaggcaugcgucaccacacccagcuaauuuuguaguuuuaguagagauggcguuucuccauguugguuaggcuggucuugaacuccugaccucaggugauccaccugccucagccuccccaaagugcugggauuacaggcgugagccacugugcccagccacuuccauccauuuucuuaagccuccuucuccuuggucuuucccuuuaucucugugugucacacuuacgacuggacuuugggucuuacucaaaucccucuucuucaaguggcuucugcaaguccuuccuuccugcaacauuaauuucuacuuccuuucuuccauuauacagucacuuagcaaaagggauacauucugagaaauauauuauuagacgauuuugucauuguacaaaccucauagagugcacguccacaaaccuagaugguagagccuacaacauacccaggcuauaugguacagccaguuguuccuaggcuauaaaucuguacucauguacuguacugaauacuguaggcaauuguaacacaaugauaacuauuuguguauccaaacauagcuaaauauaggaaacaguagaguaaacauaugguauaaaagauuaaaaaaaggguauaccuguauaggacacuuacugugaaugaaacuugcgggacuggaaguugcucugggugggcgagucaguaaguggugaguaggaaggcaugggacuuuacuggacauuacugugcauuacuacagauuuauaaacccuuugcacuuaggcuacacuacauuuauaaacaaauacuuuuguuuauucaauaacaaaauaaccuuagguugcuuuaacauuuuuuacucuauaaaauugugaauuuuaacuuuuugacuauuuuguuauaaccguuagcuuaaaacgcaaacacauugcacagguaugcaaaaguauuuugcuuuauauccuuauucuagaaacuuuuuucuauuuuugaaauuuuuaauuuuaauuuuuacuuuuugaacuuuuuuguuaaaagcaaaggcauauacauucacacauuagccuaggccuacacagaaucaggaucaucaaucucauugucuuucaccuucacaucuugucccauuggaaagucuucaggggcaguaacauggagcugucaucugcugugauaacaaugccuucuucugguauaccuccugaaggaccugccugaggcuguuuuacaguuaaccuuuuuuucagagacagggucucucacuuuguugcccaggcuguagugcaguggcauaaucauaguucacugcagccucaaacuccugaacucaagugauccuaaguagguaagacuacaggcucaugucacugcaacuggcuaauuaaauuuuuuuuuuuuaauagagaaggggucuuacuauguugccaaagcuggucucgaacuccuggccuuaagcaauccucccaccucagccucucccaaagugccaccaugccuggcccuauaguuaauuuuuuucauaaguagaaguacauucuaaaaugauaaaaaguacaacauaauaaauauauaaaccaguaguguagucauuuaccaucguuaucaaguauuaugauguuauaauuauaugugcuauacuuuuauacaacuggcagugcaguaguuuuguucacaccaaugucaccacaaacacaugaggaauguauugggcuaugacagcuacaacgucaccaggugauaggauuuuuucagcuccuauacaguccugugggaccaccaucauauauaucaucugucauugacugaaaugucaucaagcagcacauuacuguacuuuuuucuuuuaaaagucauaguguuuuucagaggcuguguugccuuucaguuauuuuuaauuccucuauuuccucugaagaggccaaugguccauugagugcaggcuucuugucuuaucugcaucccuguuccacguagcuucccugcccuuccuuacacacagugggugcaucaguucaugguguuuacuccaaagccaugacccacaagaaagcguuauuuccagugggggucuuuaacaccaaucuuuuaucacugauaauugaaugagcaauucuguuuuguuaagagcucccuguggaugcaccuuuugagaacugcuuuagaaaauuuuuguuuggucuaauauuacucucuuccaagccuccuacauaaaucagagcuucucaaggaaggauuaguuuuauagcaaaguaaauauacuguuugaauuuagccaccuuuaguuucaacuuauuccugcuccucuuaagacaaguuuguguuuuuaguaauaaucagcuauuucugagacucuuagaguggagaauuugugaaguguuuagaaucugacucugagacuccuuuguggggauacauuuggucagcacagcucugguauuagggaaaugaaccugcgagauagcucacuuaucuguacauuggcaaauagagaaagauagucuuguaauagagaaaaaaaaaucucagaggggaaagaaauaauaaaaucaagcugguuuaugguuugucaguccaaaaagcuuuuaagccuuaucuauaaagguagauccacuuaauguuuguucugcauuucaggcaucauugugugauaagugguguaaauuuagccccuuuaagccugaucuccuggggguugagauuuaagcguuggaacuuuauuugaaaggacucuauugacugggcuuugauuugguccuucuuuaccgaagagagguacuaaaucauggcuuagcuucccuguuagguguuuuuuuuucuuuuuuguuuauuuuauaggccucucucucccugccgccauucuccauguuccauuucuaacuguucugcuuagacugaagugguaugagagggggggaaaaagggaaagaaaaaucaacugucacccugugaacuuaauugauucaauaaauaacgucuuucaauucccaaggaaaaccucagucuucacuuaugucaauuaguguucaguucaauaagugguggaggucuuaauuuagauggaugggaaaguuugcagguccucaccuccuagggaaggagugugcuuuucuuauuuuaaagucauaccgucuggauuuaugcucuacucuguaaauagaagcuugaaagagaauuaaugugauaguuuuuauucuuccugaaaauagaaagaagacauuuaauuauuguccagagauuuguuagaauaaaaaagugaagugagggaaugaaaauuuucuggaaucuacuagacuguaaacuccaugggggcaggaacuaucuuguucauucaccauuuaauccccagugcacguaguaggugcauaguacauauuuguuaacugggucuguuguuaagggaauaagaacgaaaaggggcacaaugcagguuuucuguuaagaauuuaguuaaauuucauuucacugguuguuucgucccuuguccccaauccccuuuccccuaauucuuuuuuuuuuuuuuuuuuuuuugagacagagucucgcucugucaccaggcuggaaugcaguggcgugcucuuggcucacugcaaccuuugccucccugguucaagcaauucuccugucuuagccuccugaguagcugggacuacaggcacccaccaccacgcccagcuaacuuuuguauuuuuaguagagacgggguuucaccauguuggccaggauggucuccaucucuugaccucgugauccaccugccucggccucccaaaguacugggauuacaggcaugagccacugugccuggccuccccuaauucuuuaaauggaagguaccucuuaagaguguaguauauacuauaucuucagaaaugauuaaggauaaccuguuucaucaauuccaagacugucagaguuggaagagaugguguaaagcugcuauuuacaaauucuaguaaaugaacugguuguguuucagaaucacauugaaaugggauaguucucugaccccuuuccaugacuuaugaagggguugccucauuuacucagcacgcagcucucaaccccuugcaaaagggggagcacacaggugagcagaugcagaugccaggaugagugcuuuuggacaaccaguaggagcagaacucugugcgggccuauggaagcaucuagagguugccuuugacccucagaaccccagggagugcguguuauagugugcucuuuuagcuuugucauucauagauggcuuaaguguuaagcagcucaguggagggucagugugacagccucuugcacuugcacccggcuccuuguccugcauccaggaagaaucagguggcgugaacgaauugaaggguggugaauguggaggauuuuacugagcaguggaaguggcucucagcgggauggggagcuggaaaggggauggaguagaaaggugauuguccccuggaguuuggcuguccuuggcugaauuccucucugagguccugccaucaagccaucccucugaagucaagcugcuucucuccaauguccagcugcuucuucuccucucuccucugcugcucugccacuccaccaguggggccugggguuuuuauggguacagggugggggguggggugggccagggugguuuuggaaaaggcaacauucauaugggaaaacgggaauguauauucugacuuugggccacagguccaggcuugaggguguggcccucaccagggacugcccuuuucuacccaguauuuuccugccaccuguccuuaucaacaugaaguauguuacacacauacagacucaggccugagacuugaaauuucugacugagucaaauacacucuuggguagacucuugggagucuguuuucuuuugugacuccccuuaguaaugcuagagugcaacuggguauagaaagcacuaaucccaucuagcucucagugcccugaccucuguggucuauguuacuccuuaguaaaagugaucagccuaaggugccuagcagaaugauugguggagcugugacuagaacucaggucuccuaccucugacaguggugcuccugguccugugguuugcugcuuugguuuagcaaacacuccuuacuacucagcauucucucaagauccaguaauacuucuuccuuccaagauaacgguaguauuuguggugauggccaggcagaaucugaaggaccuucugaauccucaaggaaauacuaacuuuaguuuagucuacuuugguguuaaauauauuuuauugucuucucuagcgaugccuuugauuacccuccguccccaucccugggcuuagaucccaaguaggaagucccugccuuuuuccugcaggcccacgugguguucacagcccugccuaaucauaagaggaucauaugggugccucuuaagggcauagagcucuggugccugcuugagucccauuaaaucagaauuuuccugggaggggccuggggaucuguauuuuaaguuccccuuaucauuauucuucucugcaagaauucucaggcucagaucucugaaaauagcagcucccuuucccauggauccaacuuugauguccuggagaccucaguuuauaauugcaucauaacccugucuucccacuugaagguuuauccucuggucuguaaaacuuguccuuuaaggaggaaaggaauucaugcuuucuucuuucuuccaagguagaauuuuucuggacaggaugcugaguagauagguggguauggacaguagaaaaaugaacauugcaagaagguucauggaggccuuugaaaaggaagagggugccugugcuguuucccuggcuuuauuauuuaauaguuguguaacuucggggaaauuauuuaaaccucuuugaguuucuguuuccucgucaguaaaauguggguaaggauaguacuuauuuggagguuuuauguguauuaagguguccuaggucagcucuuggggcacagacuuaguuugagauuugccugcaggcgguauuguagugcgcacucaggaacaacucuugucaugggguacgggaagggauuuuugaacugcaaugcacuuguaacaaaggucuuagcugaucccuuggggagcuuugaggguuggaugcuccucagaguugucccaaauuaagggaagggggccaggucuuuauaccgcuguacauaccagucauccaaugauguaugcugccccuggagggacaugacuucagguaaggcagcucccuuuggcagaggguggcugugugccagcagcagccuacagucuugguggaaagggaaggagugcuuuaguucugggaggggucucagugauacaccauagcacucgcuacccccagguaaugcacauaaaaccccagcagugaaucuagcauauuuguaaauguucaaugaauauuaacuacugccauuaucauucuagcucuggcagggccacuuucaagaaguuauuuaacuacucuuggguuguuuucuuauguuuaaaauggcgaucauaagcuccguucugcccaugucccugaguaguucugagcacaugcggagauaauguaugugaaauugcugaguaaaauauuaaaaaaaugucagguauggcuaugagccuacuuuguugaaaugaauauauggccaugaccuggauucuuugaagggaaaagguugugauaaauguaaaaguacuugucugugaaauagggcauuuuaauuuuuuuuccuucuuucuauagggaauuagaaucauggagaugcugcuaaaggaacaguguggugcccccuuagcugaauaaagaaucaucagugaguaccaaaagcaaagucagaauuauuuacacaagccauauuuucaugcuuaucagccugguauucuacagcagccucccugggcuauucacgcugcacauuucccaguuauaugcacagaauacuauuucacagguguuuuaucucuucaguacuuuuauuuacuugguucuuugauuuucagagcaguuuuguauuacaugcuggguuacaacucuauucaaauuguuaaaacuguugcacaaucuaccaugauugagagccucaagguguuauagauuuguaaagacugcagcucagauuaacugaggcuuaauguuuuuguucugaaaauaaucaaaggaagccuuuaaaaguguaauuggagcaggaagagaaacaaggaaggggcauguugauuggccagugaaacaaauaucucuuauuagucauauguauuuccacugaugguggguaacugccugaaaugcuauugaaagggauucugaagucuugagaguaauucccaggcucuggguaagagugccuuggugguuaacagugucugccaugggcacaggauggaaggaggacagcacucaugcugaagcacgugccacaucuaguuuagggcaaaugguauaggguuaacagauagugggggauugcagaacuacucaacucccuacccccaccuccuaaauuucuauugucuggaucagggagaauggucuuuguaguggaaagggcagggcagaguuauuuaagaaagaaucaaagcccaaaauaaaugaguaugauagguuuacaucuuacagaauuuauaggccuuagguuuuuuuguuuuuguuuguuugagauggagucuugcucuauugcccaggcuggagugcaguggugugaucucggcucacugcagccuccaccucucugcaaccuccaucucccggguucaagccauucuccugcuucagucucccgagaggcaggaacuacaggugugcaccaucaugcccggcuaauuuuuguauuuuuaguagagaugggguuucaccaugcuggccaggcuggucuugaacuccugacuucgugauccaccugccucagccucccaaagugcuaggauuacaggcgugagccacugugccuggucaggccuuagguuuuuaacaucugagaguugaaaccuuugaauaaaacaaacuuugccuuggguaauguagaauuaccucagguuuucuuguguugguuuaaaaguugagacacauagucuuguguaagcaaccugguauucuaauugugauaaacaguaaagagugagagcaguuaaccaaaaagaagcaaaaggaacaucauauacaagcaccuuggcguguaaagcaugcuguccagaccugugaaugaacaucauucggagaauuguaaagucuuucugcuuauuugcagguuggacuccauuuugauuaauaugaaaccucuguauacuuaauacauauuaauagacuccuuuauuacuggaaaagcuaaauaagauaauuucauuuagcauaggcauacacauagcaggugcucauaaauguuggaauugaaucuaaauaugguuuacuccuacacccacccuguuccuuaaaaaauuauagagaacaacuuggccacaucucccugguuuucucggcuagcauauuugugaggcucacuaagcaccucuuguacuugcaugcuuaggcacagaucccaucuuacucuggagggugggaucucgagucagcuccaagguaaaugagggaaugaggggucuccauuuccaugggaaagguauacaccuauuggucuucaaacuucaaauuaguguuuuugaaacuuucuugagcaucagagucaucuggaggauuuguuaacacagauuggugggccccacuccccaaguucugauucaguaggucugagauggggccugagcauuuguguuucuaacagauuuccaggugauggugauccugguccuggggccacacuuugagaauggcaguuuuaaaugaguucacuucuuuggguggagacagaugaaaugccaggucacugagaaagcuaauagcuaggaguuagauauuguugucauguauucggucaacuuuugauuaauaggaagaaugauauucuuuguauggcuuuucccugauuuuagcaucucagcuucuuguuugcccccuuuuuuguugcuuaaauguggccaggcucuacccuggagcaaaugcaguugaaaagaggggaggugagauucacaucaacucguacuuuaaaucaguuuggauuuaaauuguugguagugaauaugaguaaauuaaacaaguuuacagcauuaccuauugucuuguuacccauguucuguguuuuguuuuguuuuauuuugagacauggucucacuguucuguugcccaggcuggggugcaguagcgcaaucacggcucaccauagccuugaccucugggguucaagcaauccucacaccucagcccccuuaguagcugggaccauaggcgugcaccaccacaccuggcuaauuuuuuccuuuuuuauagaggugaagucucccuauguugcccaggcugguguguuuuuuauguuuguuuguuuguguuuuuguccugugguugagggcuaagccaugaacucagggcaucguauuguuugugaaaagcaacuuacucuccucucuuaagugaaauggucgaggucugaauauaaccaggaguuuaguacaggacaguugcauuuaaugcauucaaugcaaugaaauuuccugaaagauuuauauaauuccaacucucaaaauucaugaccaguuuucucagaggaguaacuguaaaguaggggauauauguauauguauguauguacucuuaccacauaaaucuacaauuugauguugcaucgaaugcugccagcuuauuccuuuccuuuucucccauuuucuugacuguuuuuacaaaguuugucaaguuugaaauaugccuauguuaauggaacuuuuuaauuucucagaauuaacuguauggaaaauggagggggugguuguagguggggguacuacuguuuucauguguuguaaaaugcuacauuaaaagaagugggggaaauuagcucuauagcuauaauaaaguagaggucaggaaacuacagccuguaaaccaaauuuagccggcugccugcuuuuauacacaaaguuuuauuggaacacaacuaugcuucuaacuauguucaaagcuacaacugcagaguugaauaguuauaacagugaccuuauagcuacaaagccuauaauauuuacugucugguccuugaagaaaauuuuugccuacugauugaguguccuaaauuaacaucaaggaguguuguggugauuguuuggccuuucaaaauauaguguuugaucacgucuuaccccuaaaguuuauaguuugacaguuuguuuuucuugcauuagcucuaacgucaacacuuugugaagacuuggcugauuuuauauuaagacauaaaaagguauuaaaaugauaauaacaggaaguuaaaauaccagcaacaguggucacuaaaauugcucauaaaguuccaaugcgcguacacaauggaguagacauauaggcauuuaguuuggcacauaaaguggcacugugaugaggcuagaggguaggugcuauuuauaauuuacucaauuuuuucagcuuuggaauuuugcaauuuuuaauacuuaaaagacguuuugugggauuugcagaaaucugcauaaggagacaguauuuaauauuuuuauaucauaccacauuuuaaauuugcauaauuuaaauucacauagaaagugacuacguucuacacuguaccuaacauuaaagauacuucacagaacucucugaccuguauguccaagugggcauuugaaaaugagaaagcuuagaaggugauuuuugucaugagccaaaauggagacacauaaaucucacuaaccaauaugcuuguggcauugcuguugacacaucccuuugauagauuuuugauuuccugucauuuuugaauaaaacaaauaacccugacagcugucuguucuugccacuggcaguugggagaucaggcuuggugagauuugacaacauagcagaguucuaucacacuggaaugauuaagaccucaauuuuagcuauaucuuaacucuucucugaaccagcuccuuuggguaguuggacuuaauaaaaugaggugcuugccuuguucgaagaucauuaggagggagaaaugcaauuucaagaauuauccguagugauagaauucaaguggacucugaagaguugcuucagaaaagagggcaaauaaguauugauuggugagacauguuuaugaggugauaaagccuguuugcuuucucuugcaggagagcuguauccaugucuacuuauuuauuuauuuauuuuuuuuuugagaaucacuucuuggccacagcacaucacagacacaguuucuggaauacagguuugaggauacaguguuggcagcuucaagaagagaagaccuucuugccaggacauaaaaugauacccuccucugggagccugcuucgaauagugggacucagggagauaagaccuucuugcuggauuuuuaugacacaaucucuuuauaauuuuacaaauaaaggaaaaaagaaccauguaagauaugugugcccuuccucaggguguucugcugguugucugaugauggugucagggcagcuaaggacaggauaaaggccuggagagggugcuugugcccuuauguuaucagcaccguuguuccuaggauucgugaggggauucuggaaccaauaagggaguugaacugguaccugauucacggguggacuggaacaaacaggaauguaccagaccuauguugaagcuaagccguauuuauaacaauguuuaagauucucagaaaucaggagauuuuuauccuauccauaaguaauauguaacugccauaaguauagcuuuuagaauguaauauguaaacugugauuugguccucuggaaaaaaaaaaaugaaaugaagagugggaaggcaguuucuuuucugcuaauucguucugugauggugagcaagcaaaucauuaaccucucuguuuuuuauugggcaaauggggauaaucaggcacaggucuuuccgccaaugcguuaugaugauuaaagaagguaauuuugugcaggguuuuaagucaacagacagaccuggguuugaauccaagugcuggcaccuacuugcucagugaucaugaacacaauuuuaaaucuuucugaaucucauuuaaaaaaauuugugaaacaagaugauagaauuaauuuugugagauuguuggacugauuugagaucaugccuaugaaguaccuagcacacugccuaguacauaguagaaguccaggaaauggaagccauuauuauguaaaacauuuugcaaagguacuuuuuaacuguaacguaaagugguacuacuguuugaaacuuagauggcaguaguuugcauuucucgugaucagaagccaaaauauaaauacauacuaccuaaaaaaucuugaagagagguaauaauuugaaauucaucuucuuaagauaaaaaucagggcagggugugguggcuuaugccuguaaucccaguacuuugggaggccgaggcggguggaucacaaggucaggaguucgagaccagccuggccaauauggugaaaccccgucucuacuaaaaauacaaaaaaauuagcugggcgugguggcgcaugccuguaauccuagcuacuugggagucugaggcaggagaauugcuugaacucaggaggugaagguugcaguaagcugagauugugccacugcaccccagccugggugacagagcaagacuccaucac

SEQ ID NO: 192754 - RNA, 55053 nt, Homo sapiens
gugacggguccgcgaggcccagcucgcgcagucguucgggugagcgaagauggcggccgagagggaaccuccuccgcugggggacgggaagcccaccgacuuugaggaucuggaggacggagaggaccuguucaccagcacugucuccacccuagaggugagaccgcgucgcugcgggugcugcgcugcguagcugccgcgcgucucaccuuuccccugccccgacuugucccuccccaucccccguguuugcaaggaccgucuuggggugacaccugugacgcgagccccaccuccggugccugucagagggaugugcuugggcugagcgcagggccuccucaggagagcagccugcggcccgcgggugccgaccuaauccucagaggggccagaaccgaaccgagcauugcagcggcgcuuucccagcucagcuggccuuccucggugucucuugcacguccuccucuucaagccggagaagggcuugcucugcaucccaguaaaccuccaccgagcucuuuugaaggggugcucgcuuuuccuuuccagagggagggugugccgcugccaggggagcgcaaugaagugagcgcugaggggccgagggucuguggggaacgaaugggugcacuuucccaggaauggcccuucacggacugcugguuccucuugagggagcugcuucugauuuggacuguuaaauagguaaaugcauuugccucuuuuuguuugucuuuaguuccuagacuuuuaaaaggucauaguauuuauaaaauguaaagcugaaggcaggauuaguccaggaaacugcuguuguguguguguguguuuucgaaguuaccaagggagaaauagaaacagaucuccacuccuuuuuccucuuuucucgcuugaucagcgaucucugaagcuguguguuccuguuuuugucaaaggaagcacccucuauaaacuuaacuguauugggcccuccuuauauccaguuccauuugaauugcuuugcguuugaugagagcacccacaccucacagccuaauuuuaaguguguguaugugaauuaaaauguaugaaauuucccagaggauuguuuacugugggcuauacuugcuuuuaaaguauuuucaauaagcuuucuuggcuuguuuaacucugcaccaaaucaauuggaaauuacuguaaaauauccauuaucugaaauucaguuaccugaaacuggaaacccggaaacaguuuucagcacugaucacauucugcuaauuguauaugcagugucccacccaaaccccaccuccccucagguuauagguuuucugcagcuuaguguuaauuuccugaucaucuuugugucucucacaaaaucuugaacauguguauuuauuagguuggugcaaaaguaauugugguuuuugccaucccuuuuaauagccaaaagccgcaauuacuuuugcacaaaccuaauaguaaauguuugccugaguuaaaaccagcaccuccuaaaauuaauaaaaauuaucuugcagaauauauuuucggggauuaguauccuuuuagcccuuucuacuuacuauacagcuacuuuaacauguacauguguugaaagugucugcaggauccuaagaccuguauuccuuuuggaggauacaguuuuucuaccagcgagaaucagaacaaacuugauugacccuagugugaacuagaauacugugaaggcuaagcauucuguugggggucguuuagaguugaguagaaagaacuauaaucuguauuucccaugugaauaaaacuuuaaaaaacagaguguuacaaccuuuuuucaguaagucugcaaaguuugaucaugaauaauuuaucuugguuaacgcacuguaaaaguuguaaacacauuuguuuuugauuauucaucucagcaccuuauuuaauguacucauuuagguuacuaauuuucagaaggugguguggcuaugagauuuguaaagucagauuuuuuuuuucuuuuuaaauuugggaaggauauauagcaguauuuccuaguauaccaaaacugcuuuaaaggaauguucuuucaguacuucacuuuucuuuuaaacagugcuucucaaacuguggugugcuggaguauccacaguauucaucuuuaaaaugcagaugccugugccucacuggaaacuucauguuuaauaaguguucuagauccguguuuugcaaucuuuguaaauagggaucuuguugaagugcaaauucggauucuguaggacuggguagaacccaguauucugcauuuuuaacacgcuuuccugauaucagugcuucugguccauagacaacauugaguugcaaggcccuacgugauucugauauagaucaucaggcuugaauaguuauuaccuaagaaaauauauacuacuuaaaccauaaaaucaaaagucagucauauaaauuaaugucuuuuaacuuaaaguaagucagaguuuauuauauuauucauauaggaacuuuuucauuuaagagcauuuaauuugcagggggaucaauugaaauuuaagugaaaaucaaauuauagaaagcuucaauggcauaauuguuaagcuuguaaugccuaugcauuacuauaucuguacacuuauguguauauuuuuacuuuuauuauuuuuaauugacacauaauguacauacuuauggaguacagugugauguuucaguaccuguguacaauguguaaugaucaaaucaggauaauuagcuuauccauuaccucaaacguuuaucaguucuuuguguuggaacauucaaaaucugcucaucuagcccuuugaaaauauacaauaaauuguuaauuuuagucaauguaugguguucuagaacacuagaauuuauuccuccuauuuggcuguaauauuguauguuaacccauuuuugacuauuggccucuucccagacucuuguaaucacuagucuacuuucuacuucuguuagaugaacuuuuuuaacuuuuacauaugaguaggaacaugcaguauuugucuuucugugccuggcuuauuuuacuuaacauaauguccuccaagcucauccauguuguugcaaaugacaggauuucauuccuuuuuauaguugaauaguauuccaucaugcauauauaccacaugcucuugauucauucaucuguugguggauaucuagauugcuuccaaaucuugucuauugugaauagugcugcaguaaacaugggggcacagauaucgccaacauauuuauuuccuuuccuuuggauauuuacccaguagugggauugcugaaucauccgguaguuguauuuucaguuuucugaguaaacuccauacuguuuuccauaauggcuauacuaauuacguucccaucagcagcaguguauaagauaacuccuuucuccacaucuuugcuagcauuuguuauuuuuugacuuuuuauuuauuuuuguuuuuauuuuuuugagacagagucucgcucugucacccaggguggagugcagugguuugaucuuggcucacugcagucuccaccucccagguucaagcaguucuccugccucagccuccugaguagcugggacuacaggcgugcaccaccaugcccuauuuuuugacuuuuuaauagcuauucugacugcagucagauaauaucuuauugugguuuugauuugcauuuccuugaugauuagugauguugagaauuuuuuucuuauguguauauuuuuuaacccaauauuaaacuccuccccuuucaaaauuaauaacagccacauaaagcuauaucaguaaauaaaacauuucaaacuccuacuguauguuucuuuugugacugugaaacaaaaaagggauggagacagagaagggaaugagaagggaaaaaaaucuggcaaaagccuguucuucuaugguaccugagaggcaaggcuuuaacuuguuuaugaauacuguuuuauuccuuaaauggugcaacccuaagcuuaauggugcuugaccuuuaaauacaguuuugcauggaguaguagauaguacguuuuaaaaaaaaggucaggaauuuauauuaacuaccugguucuuuuuuaaaaacaucuguguugagauaugauuuauauaucauauaauuuacccauuuaguauguacaauuuaaugguuucuaguguauucacagauaugcccaacaucaccucaguuuuagagcguuuucaucaccucagaaagauacccuguacccuuuagcuaucaucccacgccuuaauucccucauccccucugcccucaacuguaagcaaccacuaaucuacuuucugucucuagauuucccuauucuagacuuuauaugaauggaucguauaauacauggucuuuugugacgggcuuuuuuccuuuaguacaaugguuucuaggucuguagcacguaucaauacuucauuccuuuuuaugaccaaauaauauucuauaguauggcuguaccacaguuuguuuaaccauuuguugauggacauuuaggugguuaugaauaugaccaugaguauucagcuauugugaauaaugccguuaacauucguguacaaguggaauugcuggguuaugugguaacuccauguuuaaucauuugaagaguugccagacugguuucccaaaaugggaugaguuggaggcacuuuuuuaaaaaauuauuuuauuuuuucaaguucugggguacauguggaggauucgcagguuuguuaauagguaaaugugugccauggugguuugcugcuccuaucaacccaucaccuagguauuaagcccagcaugcauuaggucuuuucccuaaugcucuccuguccuccccuuacaggccccaguuuguguuguuucaaguuggaggcacuuuaaacagucugagguuaaaggccuaaagaaagaaagugcaaauaauaaaggagaaaagagaacuuauguaauaacagauuaaaagauaauauucagaagucuuauaaugccucccuucagaugauucuuaggggagggaauaauaaguuuauuucacuugagguuauguuauaucagugaagauagcauuaggcagcuaggacugcuggaugggcuagagauguagcuuugggagucuaucuuaaacuuauugaaaacacuaaaccgggaucuuuguggaaaucuagucuuccucuaguggaguguaugaaccaacagaagucaauauaauaaauacaaucgugugaauaaauaccugccauaccaggugauauauguguaauuaaaaaucugcacaagguacagaaacaggugauauauguguaauuaaaauagaaauaguauagaagacuggggugacuugauugcauagagaugaucuuugaggcccugaaagugguugagaauuaucaagagaaaguagaauaagacaggagacacuuuugauaaagaggaacugcgagcaaguuuaguaucugcuguucuaacauaacagguaauaaaaguauauauaacuuguuuucuuuucuuuucuuuucuuuuuuuuuuuuugagacagagucuugcgcugucccaggcuggagugcaguggcgcaaccucagcucacugcagccucugccucccagguucaagcgauucuccugccucagccuuccacguagcugggauuacaggugcacgccaccaugcccggcuaauuuuuguauuuuuaguggagacgagguuucaccauguugaccaagcaggucucgaacuccugaccuugugaucuguccaccucggcccccuagagugcugggauuacaggccugagccaccacgcacagccuuguuuucuuaauucuguuuucuaauccuugggccuccaacuuuaaaugugugaauuuuuugaaaauuucauuacgaauuaucuauguuucagagggaaaaauuugugaacagguauuuaaaugcauuaagcauggaaaauuaguagaaagagauuuaugaagaagcgugauucaaguugaccacuuucucuugaaaccauuaaauuuaaggaguuuugaaugaauuauuuuuagauccuauaaaaauaaguuauuuuaugaaguugcuugcgacagggaugcucagcuuuucuugaagagauuuucuuagccucuucccagccucuggcaaccacugaucuguuuucugccuaaaguuuugucuuuucuagaaugucauauagguggaaucauagauuaugaaacuuuuagaguuugacuuucuuuaacuuaacauaaagcauuugagagucauuaaguuuguucuauguaucaauuguuaaugacuuguuuauuauugauuuaguauuccauuguuuguauguaacaguuuguugaucagcugaaggacauuucaguuguuuccaguuugggguauuuaugaauaaagcaauauaaacauguauuuacaggcuuuugugugagcaugaguuuucaguuuugcagcguacauaccuacaaaguaggguggcuggguugugugguaaauauaagcuuaauuuuaaauaaacugccaaacuauuuucaaaaguggcuguaccauuuugcauugcaucaauaaugacuaagaaugacaguuuuuccauauccuugucagcacuuguuauuaucaauuuuaauuuuaggcaguggugagcugaaggcuggucuugcuagcaagaacuguauguuacauuuuuaggaauuuuaugaacuaguuaauaaacagccauuauuaaaaauuaaaugcaaugaauuuaaaauuaaauauauaccuauguaaagauuauacauaauuuuauaaaauuuuuauuaauguuauaaauauguaaaaauaauaaauauauaaagcuccuugcuuucuaauuccuuuacuacauuucacuauuaccuaugcucuugagauuaauuaugucuguugugucuguaugguggaagguacgugucuucgcaacucuaccacagaaaucagcaaaagcuaaaaaucuggaucuucuccucugcagaucugauugcuaaacauuuaccagcacaacacugauuuuuagccauucuaagagguguuuaguguuaccucaucccuuuaauauauauucacuaaugccuaauguugcugaguaucuuuuuauguacauaccaucugaauauuaucuuuuuugguuauguguccuuuuacaucuuuugcuuauuuuuuuauuuuauuuuauuugagacagagucuugcucuguugcccaggcuuggagugcgguggugugaucucgguucacugcaaccuccaccucccggguucaaaagauucuccugccucggccuccugaauagcugggauuacaggcaccuacccccacgcccagcuaauuuuuguauuuuuaguagagacaagguuucaccauguuauccagguuguucucgaacuccuaaccucaggcaguucgcccuucucagccucccaaagugcugagauuacaggcgugagccaucacgcccggccuauuuuauuuuauuugagauggagucucacucugcugcccaggcuagagagcaguuggcacaaucucugcucacugcaaccuccaccuccccaguucaagcgauucuccugccucagccucccuaguagcugggauuacaggugcccaccaccaugcccagcuaauuuuuguauuuuuaguagagauaggguuucgccauguuagccaggcuggucuugaacuccugaccugaagugaucugccugccuuggccucccaaaguguugggauuacaggcgugagcuauugcaccugaccuguuuugcucauuuaaaauauugaauuuugagaauuauuuauguugugaauauuuuuuuucccagucggugacuuguguuuuuuguuuuguuucuuuguuuuuguuuuuuguuuuuguugagauggagucucgcucugucacuagguuggagugcaguggcgugaucucggcucacugcaaccuccaccuccccaguucaagcgauucuccugccucaaccuccugaauagcugggacuacacacacgugccaccaugcccagcuaauuuuuuuuuuuuuuuguauuuuuagcagagacaagguuucauaauguuagccaggauggucucgaucucuugaccucgugauccacccaucucggccucccagacugcugggauuauaggcgugagccaccgcgccugcccagugacuuguuuuuuuguuugauuaaccguaucuuucucagagcagauguuuaacauuaacauuuaaaggaaagcuaucuuuucuuuuuuuauugauaguauuuuagaugucacauauaugaaauccuuugcuaacuuuaacccauggucacaaagauuuugcuuauaguuucuuccaaaagaauuuggaauuuuacauuguacauuuaggauucauguugaguuaauuuuugugugagauauggguugacauucuuuuuuuaaaauacagauacuuaguuauuccagcaccauuuguugaaagucuagccuuucuuuauugggcugucuuuuucagaaaugaacugaccauauauauguggguugaccuauuucuguuuuguuucauugaucuauugagaauccuuucccagucuacacugucuugauuauuuaaucugaaucuugaaaucaagucgaaugacuccucuaacuuuguuauuuuaaaaauugccuuggcuauucuaguucuuuugcuuuuucuuauaauuuuagaaucaauuuguugauuucuacugaaaaauccugcugagauuuuaauugggauuguguugaauucagaaauuaguuucaggagaauuaacccauuaacaauauugagccuucaagcuauaagcauaaucucucuauuuauuuaguuagaucuugauuuucuuucacuaauguuuguagcuuucagcauacagaucuagcacauauuuuguuaugugcuagaucuguaugcugaguauuucauaguuuuuagugcuuuuauuucuuuuauuacuuuuuauauuuccccuuugguugcauguugacccuguaugauagcaacuguucuaaacacuuacuagguuuaguagguuuuuguagaguccgaugauuuucuguguagauaaucauauuguuugugauuggaguuuuauuuccuucucucagucuuuauaccuuuuuuuuuuuucucuuguccuaauggcuggguaggaccaccaguauaauauugaauaaaaguggugauagugaauauucuuuccuuuuucaugaucucaggauauaagauguuaucuguaagguuuuuuguuuuuuuuaaugagcuuaaucaaaugaaguucuccucuguuucuaguuuucugaguuuuuauccaugaacggauguuaauuuugacaaaugcuuuuucugcauucauuaugauaaucauauaguuuucuucuuuaguuuauugauaaguuagauuauauugauuuuuuuuucuuuuuuuuuaagccccacccucagaaugauuuucaaacugauucaaaaaaguugaaucagcguugcauucuugggauaaaccccacacaaucauaauguauuuauccuuuuuauauauugcuggaugcaauuugcuagauuuuguuuaggcuuuugugucuguguucacgacagauauuuguguuuucuuuuucauguaucuuugguuuucauaugagaaaugcuagcuucguuaagugauuuggcgaguguuuccucuuauuucauauucuugaagagguuguguggaauuagucuuacgucuucccuaaauguugauagaauuuacuaaugaagucaucugaauuguaguuuuguuuguuggaaggcuuuuaacgacaaauucaauuuuuuaaauacaggacugcuucauggugaacuuuggaaguauguaucuuuuaaggaauuuauccauucagucucaguugugaaauuuaugggcauacuguuuuuuguaguacuuaucauccuguuaacauguuuguggagucuguggaugguaaacuuuucuuuuuuuuccugauacugguaauuuacaucuucuguuuauuuauguauuuugauuugguagagguuugauauccucuuaggaucuucucaaacaauuaccuuuugcuuucauugauuuuuuuccuccuguuguuucuguugugaauuucauugauuucugcucuguuuucuuucuucugcuugcuuuguguuuaauuugcucuucuaguuuuuuuuuguuguuguuguuaauuuuaguuuuuauuuuuauuuuuauuuuuuuuguagagacagggagucacacuauguugcccaggcugcucuugaacuccuggccccaagugagccacuuaccuuggccucccaaaaugcuggaauuacaagugugagccacugcaccgagccugguuuucuaguuucuuauuaaaguagaagcuuggaucauugauuugagacuuuucucccuacucuugcuguuuagcuauguauuucccucuaagcaugacuuuggcugcauuccacaaauuuugauaaaugugguuuuguuuucauucaauuuaaaauaauuucuaguuucucuugugaccucuuauuugaucuaugaguuauuuagaaguacauuauuuaauuuccaaaauuugaggauauuccagauagcuauuacugauuucugguuucauuugguaaugguaagagaauguuuuaugcuuuccauuuuuuuaauuuguuaaaguuuguuuuauggcccagaacauguucuauuaugcuaaguguucugugugcacuuuugaaaagaauguauauauagucuguuuuguuggguggagugucguacaaauguuaggucaaguugguugauauuuuucugucuuucccuguuaccuauuuacuuguuuuaucaauuacugagagaaaaguguugaagucuccaagauaauuguauauuuuuaauuuuuauuucuuguuuuaguucacuuagguuuuccuuuauguauuuugaagcuauuuuguuacauagaugcuuaggauuguuuugucuucuugguaaauugacccuuuuaucauauaaugucccuuuuuauugaugauaauauuucuuauucugaaguuuacacccucugauguuuagcacaacagcuuucuuguagauugucugcaugacauaucuuuuuuauuguuuuacuuuuaacuaauuugucuuucaagcagguuuuuuuuaggcaacauguguguaguuauuuuuauauccagucuagccaucucuguuuccuaauggguauauuuaggcuauuuauuuaauuauugauguggcuagauuagaucuaccguuuuauuugcuuacuguuuuucucuucaguuuuuuuccuuuucuccuuucuuguggauuacuuuauguuuauuaguauuucauuuuaucuacuauguauuuguuuaauaucauuauauuuaaauauauauuuuagugguugcucugcagcuuaaaauauacauaccugaguuaauauuauacuucacguaaaaugccaagcuuuacaaccacauagguucauuuaccuucccuccuuuacgcuuggaagucauugcugcgcacaccaauagcauaguuuugcaguuggcaccauccucaggaaaaguuaagacagaauaaaaaaaaaaauggcaaaauggauccuuguaaggacgggccauuuuuuacauuuuggcucccuccuuagucggccugcuauuuuuuauuuuuauauuguugcuuuuuguauucuauccagaacuuuuagugucagucuguuggggagggaggcuuuagugguccuuguugaucuuguuuggaauccaaagugccacuuuuuaauugaagagauacuagcaaaaaaaucuuaaaauuuuuuauccugcauacuaccaggugauggugugggggaauaaaggaauauucauuuauuaagaauacagaugucuacucaguuguauaucuuggacaacuguaguucugaucaugaagaaccugugucacaggcagagaagccaucaguauucuuuuccaccauaacuuucucauuuggcagucacuguccacacuccuuuccauccacuagaaaauagcucuuuuccuauuuaguaggaaccuggaagaggcauggagaggcaggacaaagauaaguagguuuuugcaaccuuuaaagauuaacagcucccuuggcugggugugguggcucacgccuguaauccuagcacuuugggaggccaaagcagguggaucacuugaggucaggaguucgagaccagccuagccaacauggugaagcccugucucuacaaaaaauaaaaaaauuagcuagacaugguggugcaugccuguaguuccagcuauuugggaggcugagguaggagaauugcuugaaccugagaggcagagguugcagugagccaagauugcaccacugcacaccagccugggggacagagcaagacuguccccccccaaaaaaaaaagaaagaaagaaaaagagugauagcucccuggcaguugagcgggguacuccaagcugcugaugguuggacaccugaaggaaguggauuccucauagccucuccauagugauaugacugcuccccagcagccucuacuugaguugcccacugccccacaucauucccauugugcgguccacucuugggcucuggacuaugaggugaaaagguuguuuuuguuauauaaacauguuuguuuuucuuuccuuguuucugguguuaaaacuacgaguacccaagguauuagcaauaugaacuuucaguuaugauaagaauacauuauauguugcaaauaguuuacauguauuauagcuguauacuguauuauaaucuuuacuucaacagucaugucuauuuuaaagaacuuaagaggaaaaaauaaucuguuuuauuuauucagauauuuaccauuuuuguugcuuuuccuuuacccaagguuugcucuuguaauuuuucuuuuuagcauaaagaauuuccuucagcauuucuuuuugagcagaucuguuggugaugaauauucuuaauuuguacuucaucugaaaacuuuauuucaccuucaauccuggaggauauuuucacuguucauagguuucugcaucaauaggucuuucaacacuuucagaguguuauuccacuguuuuguagccuuugugguuucugaugagaaauccacaguuguuugaauugguauuccccuguaaaaauacguuguuuuucucuagcugcuuauauuuuuucccuauagcuuccauuuucagcaguuugaaucuaauguguguaggcauaguauucuuugauuuuauccucaaugagguuugccaggcuucuugaaucuguaaguuuauaucguucaccaaauucuggaaauuucagcuacuguuucuuuaaauacuucugcagcaaucuuucauccuuccuucuggaacauuuugguauugucccauagguccuugaggcuuuguucauuuuuucaacuucuuuucucaggagaaguuaucuuuguuauucagaucagauauuuucuauggauuuauuuucaguugcacuaacacuuugcucuucaauagcaauaacaacccauuauucucuuugguaacagcucauucuguuauugagcuuaugugaauguuuuguuucagguaauuuuuuuuucaguucuaacauuuuguuuucuuucuucuuuuuguagcagcuuucuuuuuuugcagcagcuucuguuucuuugcugagagcugucauuucauucacuucaaauauguuuaccuuuacuucauacaacauaguuagaaaugcuuuuaaaaguuuuaaaaaauaaugcauucaacaucuggguuauuucuagguugacaucuguugacugucuuuucucuuauuuggucacauuuuuuggacucuuuaugacaaauaauuuuggacuauaucuuaaacaucccaaauguuauauuguguaggcucugcauccuguuauaauccucuggagacuauugggauuuuuuguuuauuuuuuuguuuggucaggcaaucaauuugcuuagguucagauuccaaauuucuguuuugccuucugugggcagugguucuaaucucaguucaguuuucaaagcuuuugccucuucaggucugucucaugcaggcaccacucaggucuuagucugggacuuugacagugaccuaaguaucaauugaguuuuccagucugugagaauugcugugcuguuuggcuacacaugugcugcucaggguugacccugagauuugcacacauucauucacagaauuaggggauccccuucuccaguuuuuucucugggauuuuccccacauucuucaguuuacaagaccgccccaccuuccccaccacacacacacauacacacacacacacacacacagacacacacggacacacacacacacacacacacacacacacucuuccucuagcccgaaagaugagguuucuuuuggcguuuuaucuacccgugcuguagcuccuguagugcagcuccaugccugggacuugcuuucagcaaaucugcaagagaaaagagggggaaaaaaacagggauuuauucauauacacauacuccuuagcucauaugaccccuuugucugauucaucuggccauaaagaugagauuucuaccagaguuuagcugucucugucucuauaccauugcacaggucugugacugaggcccacuuucaggacaaaacuauuagagaaaagaggaaaggaauagacucucuaccuuuuaugaucugucagaauuuguuuacuuuuuagauuccucaaguaccuuuuuaauuuuaucuauaggcuuuaguuauaaucagagagagaggcucuaguuggcuuaccacuuguaugaguuaucuguugcuguguaacgcauuagcaacuuaaaauaauaaacauuauaucacaguuuuuaaggguuggaaauccaagagcagcuuagcuagcuagguauucucauccaaggucucucauacaauuguagucaggauuucagccagugcugcagucaucugacagcugaggaggauccacuuuuucuuuuucucaaagagucuuacucuguugcccagguuggagugcaguggugcgaucucagcucacugcaaccuccgccuccuggguucaagcuauccuccugcuucagccucccaaguagcugggacuacagguaugcgccacuaugccuggcuaauuuuuuuguauauuuaauagagacgggguuucuccauguuggccaggcuggucuugaacuucugaccucaggugauccacccaccucagccucccaaagugcugagauuacaggcgugagccaccgugccuggccgaggaggauccacuucuaagcucacucucauggccauuaagaggaaccuucauauccuugccacgugaccucucuauagacugcucagcaucugacaacccauuuuucccaaugaguggucaaagagaaaggguaagcacaagaccaaccaagauggaagccacagucauuuauaaccuaaugucagaagugggggaggaagauaguaagacaguucacuuugguugggcagaaaaaaaaugguuuuggguugucgcagcagaaauacauauaagugagagaaaggguagaagauaggggaauuggcuaguuauggaagauuugggugguaagagagaaguaggacuuugggaaaauaucuggauuucugaauugggucaccuaccaagaaaagcaguuguuccuucuucccagucuuucugccuuuuacuuccuuuucuugucuuuuugcaugcagcuagaacuuucaguaugauguugaaaagaagugguaaaaggggacaaccuugucuuguuccugaucuuacuggggaagcuucaaauuucucaccauuaaguaugauguuaguuguaggcuuuuuguagauauucuuuaucaagauauccucuauuacuagcuuacugaaaguuuuuuaucauuaauagauauuggagccacucugccauauuuuuagguggaugcacuauaggcuauuucaauuuuuuuuuuuuuuuuuuuuuugagaggaguuuuguucuuguugcccaggcuagagugcgauggcaugaucuuggcucaccacaaccucugccucccagguucaagcaauucucuugccucagccuccugaauagcugggauuacagacaugcgccaccaugcccggcuacuuuuuuuuugagauggagucuugcccugucgcccaggcuggaguguaguggugcaguaucagcucacugcagccucugccucccggguuccaaagauucuccugccucagccuccuggguagcugggauuacaggcgccugccaccacgcccggcuaauuuuuguauuuuuaguagagacgggguuucaccacauuggccaggcuggucucgaacucuugaccucaagugguacgccugccuuggccucccaaagugcugggauuauaggcaugggccacugcgcccagccuaauguuguauuuuuaguagagacgagauuuuuccauguuggucaggcuggucucgaacuccugaccucaggugaucugccugccuuggccucccagagugcugggauuacaggcguaagccaccgcgccuggcccucaauuuuuauaguaauauagaacaucugauugacaaacuugugguuaauucuuugacauauccaucauuauuuucuuaaaacucaguuaaaugauagucauugaguguuuuacugcuagauacugaguaaagaguagugaacaagaugagauacucuuccuuucuauguacagcgugcagucuauaaaacagauaauacuuauaaugugguaagagaaauuaugacacaaguagguacucuauggaaguauauaggccaaucacccaaucagacucuucuagaguuacaguuaagguugucaggaguacuuucagaggaaauaauacacaaacuuguucuuuaaauuccuucaagugaaaguugcuaaguuaaagagaggcccacuuuugugagaauuugggacuuuaagaauuaguucucgagagaaaagaaagccucuuuaaauuuuccuauaagaguuugaaacuacuuuugaauguucuaaagagauuuuugugccauugaggguaguuuacuuaaaaagcugaugagaaaaucuuauuaauuaggaguggcaucaaaagacuauugauccuacaaaaugcuuaguaacuguugggcgcaguggcucacgccuguaaucccaacacuuugggaggcugaggcggguggaucaccugaggucaggauuucaagaucagccucaccaacauggugaaaccccuucucuacuaaaaauacaaaaaaaauuagcugggugugguggcgggugccuguggucccggcuacuugggaggcugaggcaggagaaucgcuugaacccgggagguggagguuacagugagccgagaucgugccauugcaccccagccugggcaacaagagugaaacuucaucucaaaaaaaaaaaaaaaauugcuuaguaacuauacaagaaaauauugauacaauuugccuuuaauuaagaaauuccauugcaaaaucuaccauuaagaaaguaaaaagguaagccaaagauugggagacugaauuauuaauacauaucugacaaagaauuuuuauccagaauauauaaggaacuucugcaaaucaauaggaacaauagaaaaaugaacaaaauauuugaagagacucuucacaaaaggauaucuaaauucccuuuaaacauaugaaaaauugcucaccaucauuacuuaucauggaaaugcaaauucagaacacaaugauacauacucuacaugcuagaguagcgaaagugaaaaaaauggaauauaucaaaauguuggcaaagaauuggagcaacaaaguuucauaugcugcuggugggaguguaaaauuauacaaccacuuuagaagauaguuuacuaauaacuucuaaagcugaacauucaucuacccugugagccagcuauuccauucuuagguuuauacaaacauuuguuuacauguucacuaaaagaugaacuagaaaauucauagcagcacuauugauaguauuaauaguaaaaaauugauaaacaucuaagugcuuauuaacacuagagugguucaaguaugguauucacacaaugaaauauuauacacuuaugauaaugaguggucuacuacuacacagaacaauauggaagaaucuuacauacauaguaacauuagggccaaaaaccaaacacaaaaaauaaguaccauauggcucuauuuuaugaagagcaaaaauaggaauaauugauccauacugguagaagcccgcaugguaaagaaugggagggagcauaaguggaacuucuagguuugaugguaauggucuuucaugauccaagugcauuugcauagguauguugaguuuuugaaacuaucuagcuguacacuuuugauauauacaguuuuuuuguguuauacuucaauaaaaagguuuuuaaaagaccuaguuuuggccaggcacaguggcucacgccuauaaucccagcacuuugggaggccaaggcgggcggaucaccugaggucaggaguucgagaccagccuggccaacauggugaaccccaucucuacuaaaaauacaaaaaaaaauuagcugggcgugauggcagacaccuguaaucccagcuacucaggaggcugaggcagaagaaucgcuugaacccgggaagcagagguugcagugagcugagaucacgccauugcacuccagccugggcaagaagagcaaaauucuguccccccaaaaaaaaaaaaaaagaccugguuuuaacuauuguaauacgaaaaccauaauaaagauaaaagcuacacaaucuagguuucauuguguuacucauuauacguuaggguuaaagaaguacaagaguggcucauuccugugaucccagcacuuugggaggcugaggcggguggaucaccugaggucaggaguucgagaccagccugaccaacauggugaaacccugucucuacuaaaaauacaaaaauuagccgggcaugguggugcaugccuguaaucccaguuauuugggaggcugaggcaggagaaucacuugaacccaggagguggagguugcagugagccaagauugcaccauugcacuccagccugggcaauagaaugagacugugucucaaaacaaacaaacaaacaaaaaaaacaagaauagucauuagcuuagaugaaauauaaaugucuugagaggucacauuuuuaguuugaagcgauagaaauuuuagaauaauuggucuuaauucaacuaguaguaaguuuuccucuuacaguaaaacagugcuuugaacuucuuggacaugcaacauguuuucaggaucuguugagucacguggaauuuugguguuugggcauaucugcccccaccaggaaaaacaaacaaacaaacauggcaauaacaaaaacaaaauuagggauuuuugaaaaucaaggacaugaugucguuuugguucuauuguauaugacuguaaaauauuaaauuugguuuuuguuaauuauaacucaguaugacaaacuaguaccuccaaaaaggaugacuagaaaagguuuucuggccagggguguuggcacacaccuguaaucccagcacuuugggaggcugaagugggaggaucacuugaacucaggaguucaagcugggcaacauggugaaaccccaucucuacaaaaaauaaauaaauaaauaaauaaccagguguggugacgugcauuuuuagucccagcuacccuggaggcugagguggaaggaucauuugagccugggaggucaaggcugcagugaaccaagcucacaucgcuacacuccagccugggccauagagugagacccugucucaaaaauaaaaagaaaaaaaagguuuucuuuuuuaaaucuuaagugacuuuuuguuaagaaagaugaugaguuaaaaguguguuauuaguucauucuuacucucagaggaggauauauaaauagcuguucuuguucuuuccuccauucuuuucaagagaauguucuauuucuguaguacauggugacagaauuacaacagguaaacaugccaauccauuaccuauuauuguucuuuuuuaacagucaaguccaucaucuccagaaccagcuagucuuccugcagaagauauuagugcaaacuccaauggcccaaaacccacagaaguuguauuagaugaugacagagaagaucuuuuugcagguaauugucauguauuuauuuuuuaauaauggucaauugcaguauauuuucuauuagauagaaaauaucuaaaacaaaacugaaauucuguguaaaguguuaguggcagcucuuguaacaacuuagaaggauggggaauuuccagucacaucacucuaugaaaaauguggacuguccagagaagcaaaaaugugguucuuucuggcuguaagcauuugagaauaaauuguauauuauaauuugauugggggcaguauuuagaugcaaaagacuaaucauugugauguucauacuuugagaaauagcagugauuauaccuuuuuauugcuuagaaguugucccaaagcaaaauuaaacuauggauuuaaaaauuauucuauauuuauguuugaaagcuguuuuaauaaauugcuguacuauuuaccaucuguuccauuugacccacuuuuaggugaauaaauugaugcuuaaggaauuuguuuuugauacaggggcaggauuugguguaguucauccuaacuuaagaaggacucuguuuaacaauuaucugcuuuaaaauuaaaauuaauguuuuaauauuaaaaagcaacaucuuccuuaaaauuaaugacacaaaaaaugaaaaugguaaauuuuauuuuguguguuuaauagccuaauuuaccugaacuggcuuucauugaguuaaaacuuaauauggauggauucuuuuguggcucauaagcuugggauuuucacacuaaacauuuuuaacucaugagguugggacuucacauuaaucucuaaucuuugagauugccucccucaaaccuugcuacaguauuggcacauuacccaucucacaugaaaaaggaaaaagaaaaaaagauaaaaaaugaauaauuauguucucaucuuucauagugguucaauauucaaaccauucuguguuuuuguacaaacauguuugaagacagcaauccuccaucacaaaacuccauauaauuuacaccuugauucauuccaugagaaguugucacuggagaugaauucacauauuuuauuaugucacaaaauuaaaaauaugauaccaaauaccaaucaucuucucuuuaaaauuuuaagccaccuaacaacuuagagucaaaaucaccguuaaccaaaguuguaauauuucaguauuuguuauuguguccuuucauggacuuuuuuccaggcaaucuuucaaaguuguuucaugguauuuguaucuuaugcuaaaagaugacacaaguucuuucucuacuuaacaaguacuaaucuaaaauucuguguauuccuuuaaugguauagggucauacauagagguuuuaaauuauccauuuuuuuaaagacuccuucacccuauagucucagauuucuauguagaugaguauguuuaaaccuuacuguaacaacagaacugugucuguguguguuuguguacaugcaagguuuuuuuuuucuuaacaguaugcacagcugaucaaagaguuagccaagugaggacuauacaaugauauuugcccacuuagcuugguuagaaaaaaaauuaaaaacaguuuuuagacaggucucacucugucacccaagcuggaguauagccaugccaucauagcucacagcagcuuugaacucuugggcacaaauaauucuccaacccuugcuucucaaguagcuaagacuucagacaugugccacuauaccuggcuaauuuauucauguuuuguugagaugggaucuugcuauguugcccaggcuggucuugaacuccuggccucaaacaguccucccaccugggucucccaaaguauugggauuacaggcgugagccacugagcccagccagaaaaaucuucauaguguuuuauucuaccuagcagucuauacuaaauucugugaaucaaauauggugaauaucaguguuuguuuuaaaaaaagagagagaugggaacuaaagaacaauaaacauagucaucugucuccuuuguuaacccaaaaauagaaacauuuuuuaugcuuuagcuuucaucuuaaacucagcuguauuucauaaugacaucauuaagugacugaagaccuaaucugaucauuuuuguaugaaugaaugaguauuacacuugguucuuauuuauaauacauuuuaacagguguagcauuccuccuucuauggaggaguaugguucuaggaaacuauaauagggagcagcguauguuacugggauggugaaaacuauuguccaguaaugagaaaccuauacucgauuugucccuccuauaccagaggagagaauauagauauugcuguagugacauugacauaaucaguucauacaugucucaaaguaugucuccaaggaaaaauuaaucuuuacaguuagcaccuaugaagcaucuuccugaaccuuuaggucugcuuuaaauuaaaccuuaugaauuuguaauauauugguuuacuuaagcuaaaaggugucaugaagaaaauuuaagacagauuauauauauauguugaaucuaaauccuacaauuuuugaaugaagcagccuguuaguguaaauaacacaaaacucaguaucaguaaaguaaaaugugauuaaaaaguuuaaaugacuuuaucuguacugauuucuuaauaaaguuacuaucucucacaauauuuugccugugagucuguugccaaagaacagugccucuuucagauucugggguuuuuguuuuguuuggugcuuguuguuuugcuuauuguuguaaauaucucacacuuguagcuuugauauacugcuuuuuuuuuacuuuaucauauuacucauugguuucauuucuuuacaaaaagaguaauaaauaccagcaaucaucacagccugaauugcauauaagcuuuuauuuuguuacgguaggcuuaucuauagccuguuucaacauauauaguccauuuuccuuccucugguuaccacaguuugaaagauuuuuaguuauugaucauuuucgcuuuuaauaugaaaaagugaagagaucaucuauaccaaguaaggaucucaucaacaugagauaaccaguaagaauagcuugauaaaauguugacguguauaaccuuauuucagguaaauaugcuauuacugcuauaccuugagguauuaaaauuaaaaugguucacugacuaucauuaccaccaucuugaaccucuaagaaucuaaggaccucagguuagaaaccacuggccugguccuguguuuuccuugagguccugccuuccuuuccuaguaucaguucuacagacuagcaaaguuguaguuuacauuauggccaccacuugugauuuucccuuuccuggcucugcuuuuugcauaugcuauuauuccauuaucauggaauucuuucuucauuuuuucucuacccauuucagucuucucagauccauuuuguaaacuguuccugauuuuugucucccagcucaacucaaauuguaguguuuguucuguagcucauguagcaauuaaaugucuuguaacauucuuuucauuguuugccuggguauuauuuaagucuuuuauuauuauuuaacaucccacaugcuuuugucuuguuuuccccaacuaaauuauaaacucucugagggcagguaugauauuuuacauuuuuguguguuuuucuguugcacuuagcacaauguuauguagccuguagacauucaguuuauugauuugguuugauuuuuuaaaauuauuaguauuagauuuuucaagugagugggcauuuuaauuuaaaaccuaaacaccuauuuguuuugugucauauuuguguauccaacuaauuaauauccaguaaucuuuaccaauuaauugcuuuauauuacuaacuuuguagcuuuuccuaaccaguuuuuaauccaaguuaaaauaguuguggacagacuuccaccauaaaauuugucuuuauauguauaaaauaaucauaauauuaguguaaauaaauauuugaaagguaaguuaccacaaguauaaguuguuacaaauccaaacaugaauguggaaucaucugcaucauugcuuuucuuucagccugaucccuaccacuaguauaauuaagcuaacuuaauaggauucuuucuaaaaucaacaaaguuacaguuaguuuuaaaguugugauaaauaaggaugcauaaaauuccuuugugauaauuauuuuuaaaugacauuauuuuuauauuuguggguaauauaaaaauauuuuuuauaauccauuaacugcuauguagaauauuggggguuugcuugccaguguucuuaacuaacuuguuuaaucuaugucuagaagccacagaagaaguuucuuuggacagcccugaaagggaaccuauccuauccucggaaccuucuccugcagucacaccugucacuccuacuacacucauugcuccuagaauugaaucaaagaguaugucugcucccgugaucuuugauagauccagggaagagguacaggaaaauguauucuaaauuaauauguaaauauauaccuuuuuuccccacccaacaucacucugcuguuagucauuucuaaucaaagccuuuuagacauuuugggaaaagaauauuggacuaaauuaguuaugggaucuggcuucuaucuuccccacucuacccagugaccugggcauaucauuuaccuuguuaagugaaggaguuugucauuucugauuuuaugauaauagugugcauuuccuaggguuucucuguuggucagaugauauauaaaagugcuuugaaaacuuaaucacaauaaagugauauuuugaguaaauuuauuugauaaaauuuguaauaaauacuguuaauacuuaaagguugauauugaaaaagaagggaggauguauaucaguuaaagguacauucucaugauuuggcaguaauuucugacaaggugaauuuggaaaagaaaaauuauacagagauuauuuuaauggcaaaauuauguauuuaaaagucauucauggaaauaugucguuaaaaugaccaugauuaaguaacaaccacauaaaaaauauaaacaaucucgcaaacauaauauuaagggaaauaaguaagacauaaaagaauacuuacauaauucuaauauaugaacuuuaaaaacagauaaaaguaaaguacagggcuagaugucaggguagugguuauguuggcagguaaagaauggguaguaacuggaggggaagcaaaagagggccuccugagcuguagugaugaugcuuauuucugauuuagguucugauuacaaacguguucacuuuguaaagguuuauugaacuguacacuuaaaauuuauauacuuuuuauguaaugauuuuuaaaaguuuuacuuuaaaaauaucuguacaagaagacaaccuugaaauaaaacaauuaugguucaaaacacuuugcauuuagauaguguuagacuauuaauaauugccuugaaaauuuugcaaaguugaauaaucucugaacuuugugcuugagaauaacaaagcuuuccugcagagcuaauguuuggauugcuuauuuuuaauggcauuuacaagggcuucucugaagucucgacauaggguugucauuuuucccacuuacugcuuuuucacugagguuuauagugcuuuccuucgcguccagaagaacguguuuauuagauaauuagagaaaucuugauacuaaaguugcuuuucaguauaaucacuucugcugguaaguaagguucuacugguaaaaguaaugacuaccuaccuccuugguauuaaaggguagagagagaacuuugaaaaaugcuaguauuaaaauuaauuaaggagguaauuuuuuaauaaucugaaucugaagauucaguauauagaacaaaaaauuccacaauauuuguacaaaaagacgaaaacauuuuuucuacaucugaggaauuaacaugagauuuugggcugggcgcagugguucacgccuguaaucccagcacuuugggagaccgaggugggcagaucaccugaggucaggaguucaaaaccagccuggccaacauggugaaaccccgucucuaguaaaaauacaaaaaucaccugggugugguggcagacaccuguaaucccagcuacuugagaggccaaggcaugagaauugcuugaacccaggagguggagguugcagugagcugagauugagccacugcacuccugccugggcagcagagcaagacucuaucuuuaaaaaaaaaaaaaaaaaaaauuguuacuucuccaaauggucuuuuucguguguguguguguguguguguguguguguguguguguuuuauuuauaaagucaggaaaugugaaaguuuuuauuguuuuucaaaaaugaagugcuggguggcuaaauuauuuguugugacagugacucuuacagaaaauagaugauaaaaauuagugucaugacaauaauuuaaauuauaauuuuuaaugccaaaaaauaauuuauacuuucuagauugaagaagaagcaaauggagacauuuuugacauagaaauugguguaucagauccagaaaaaguuggugagucaauacuuauuauauuuuguauuuacuuuuuauuaguuuguugguuuuguaugguuuuucuucauacaucaauauaguauuaaaugaguuuuauuuuuaugcaugugauuuuaauaguaguguuugacuuuuuuugcaggugauggcaugaaugccuauauggcauauagaguaacaacaaaggugagcuuuuugugcuuuuaaaaaaacuaucgagcccucauuauguguaguaugaggauauggcuaugauuaagguagaagugaucccugucuuuauaaagguuaccaccuaauaaagauugccaagaaguaggugcaaugaguugugagugguuugauauguaguguucagugagaguaugcaggaugggaccugauuuagaccucuggaugccuaagccaagacauaggugagggaaaugauggggaggagggggggaagaagaagaaugcuugugccaggugaggaauuugcuugugcaaaagccaaaagugaagaaagcauugugcuuucuagaaucuccaagaagugaugcaugauugaaacguuuggcaguaagccuuuguguauuaugagcagccacauuuuaaggaguuuggcuucaugcugaguauaauggagagccauuaaagaaguucaaagaagaguguggcacaaguagguuuuuguuuuagaaauauuucuuuggccucaguaugaauugggagggucaaaguagaggucaggauuuccaguuaaagggacacugcaaugauuaaaggauuguaugccuuuaaauauuaaaagagcaugucugucacagcaguucuagcuguaagcaguaauacuuuauacuaagaaaaugguucuggagaugagcaaaauaaguggcuucuugaguuauguaggcgguagaauugacaggacuuggauguaaugggugaggaaggagaaggaugccuagguuauugacuagagggacuuugcagcugugagagugauccauggagaaaggcaacacgggcaggaacacagugaggaugaggaugacaguuguuaauucauuggauaaauauucauuaaacaccuaccauggugucaagcuuuguugcaagcccugggguauaguaguaaacaauacagacaaggguggcaucuuauagaacuuauguuccagcagggggaaauaggguaaguuugaagugcuggugagauuuaaguggagggguauuuggauauauuggacugaagcuuuguaagauaucugggccagauguaaagauuuaagaauuauuagcguaaauagagugaauaagaccaguuaagauagaauaaugcaaauacuuuuuuguccuauuaagauucuguaaaauacaucuaugguuuagguuuuuuuuuuaguuagaaaccuauauaccacauuaguuagauacucugcauucuuuugcaaaguagauacauguauguguucacaauuauguauaacauuaacuuguggaauaauugcuugcuauucaaaauuugaaacaccucuucuucacuuguagacaucucuuuccauguucaguaagagugaauuuucagugaaaagaagauucagcgacuuucuugguuugcacagcaaauuagcaagcaaauauuuacauguugguuauauugugccaccagcuccagaaaagaguauaguagguaagcacaaauuuuucaaaaauuaauuuuuguuacuguuacuaguucaguuuuaacuguauagauuuguggauuucuuagucauucacugucaacauuuuauaauguguagacauaacugaauuuaaguauuucauuuauacuaaucaugcauggauugaagaauguauugguaauaguuuuauuuucuaacacuugaggauuuuuguuuauguaauacaguaauguuaaauauuggguagaggccgugugugguggcucacaccuguaauuccagcacuuagggaggccaggguaggaagaucacuugagguuaggaguucaagaccagccuagccaacauggugaaaccccugucucuaguaaaauacaaaaaguagccaggcaugguggcacgugccuguaauuccagcuacucggugggcugaggcaggagaaucacuugaacucagaaggcggagguugcagugagcugagaucacgccugggcaacagagugagacuccgucucaaaaaaaaaauuggguugaaauuuaugaaguuaaaagcaguuggaagcccuaaccuuuuagggucacuagauuaccauuuuacugagucacaaucagagaauacuuaauauuauuaauauguuaacauuuuucuaagggauggagguguuagacccucacuagccuuggcucauauaagagcuauuuaaauucaucuuaguucauuucguaccucaauuuaaaguuuaaaaacauuucuacuuuuuuuuuuuuuuuuuugagauggagucucacucugucauccaggcuggagugcaguggugcaaucuuggcucacugcaaccuccgccuccuggguuuaagugauuccccugccccagccuuccgaguagcuaggacugcaggcacacaccaccaugccuggcuaauccuuuuuguauccuuaguauagacgggguuucaccauauuggccugucuggucuugaacuccugaccuugugaucugccugcuuuggcgucccaaagugcugggauuagacgugagccacugugcccggccacauuuguacuuccauaagcaauaaagacuuaguuaagaaacugcagaaaauuacaaaagaggaggaaaccuccauaggccuaccauuaaaagacaucugucaucucaaaauuuuguaguauuuuauucaaugcuuuuucagucauagguuuuuauuuaccuuuuucuuuuuuuuccuuuaaaguaauuaucuucucuguauuguucacaguuuuaguauaugugcugcugaagugagcacuaccauuacuuuucuuuauacuuagauuaaucugaaaguuuuuuuguuuuuugagacggagucucgcuuugcugcccaggcuggagugcaguggugugagcucggcuccaucaugguggcucaugccuguaaucucggcacuuugggagaccgagaugggcggaucaccugaggucaggaguucgagaccagccuggccaacacggugaaacccugucucuacaaaaauacaaaaauuagccaggcaugguggcuccugccuguaaucccagcuacuugggaggcugagaugggagaauugcuugaacuggggaggcagagguugcagugagccaagauugugccauugcacuccaggcugggcagaagagcgagacuccaucucaaaaaaaaaaaaaaaaagaauuuugcugauuuauuuuuucccccaagcuggucucaaacuccuggccccaagcaguccucucaucuggccucccaaaguggugggauuacagacuggagccaccaugcucagccaaauuuugcugauuuuuaaauuauuguuuuuacuuuuuuaaacauuagguuuauaaagcaauguuauugguacccuuuacaguuucagaaccuaauguauuuagaugaauuuguuauauucuuucuuuuuuuaaauucaaaaauugaguuuagugguucuuuaacuuuuuggucuuucaagaccccuuuguagggaugguucaauccaaaguguugaaaucuguagggaugguucuauagggacgguucaauccaaaguguugaaucagggaugguucaauccaaaguguugaaauuacaggcaugagucaccacacccaacugaaauacauuuaauguggauuaaauuguuuaaaacuuuuuugcuuuuucuugagauggagucuugcucuguugcccaggcuggagugcaguggugcuaucuuggcucacugcaagcucugucucccggguucaugcuauucuccugccucagccuccugaguagcugggacuacaggcgcccgccaccacgcacagcuaauguuuuguauuuuuaguagagaugggguuucaccauguuagccaggauggucucgaucuccugagcucaugauucgcccgucucagccucccaaaaugcugggauuacaggcgugagccaccgcgccuggccuguuuaaaacuuuuaugugugugugugugugugcguguguguauauauauacacacgcgcgcgcacacacacacacacacacacacacagcccaccauuccaaaaaggauuucaggcaacuacagauaauacaguuuauauauagagaaauuaucaggaaaaaaauaaauguagucaaauaguaauaugaagccaagcaaaacaauuucuucaaaguauggugaagucuugaauaauuauuaaaggugggugacaaauuaaucuuugaacuucuaauuacauagcuggugguuuucagguaacuuacacuuauagcagggagcauggaaaaagagucauaacuucuccuguuugcugggaagcuuuauaacugccacugaagggagagucuucauuagcacguaacucucuacuuugguaggaccuuaguugaccuaagaagacuauuccauuuaaacuguuagaacaacaaaguugaaaaguauuaaaaguuaacuaguuacgguagguuguuugggguuuuauuuauuuauuuauuuauuuauuuauuuauuggucacaaugucccuuaacaauuaaccucuaaaaaguagaauggauagaagguuuuuaacuucagugaagaacuacccaguggugagauuuuuuuucagggaaauagaguuugugaaacaauucacaucccaauuccgguaguucagucagagguaguuguaguuuuaggugucuuauuuuccuuuugaagccauuguauuccauuggaauuuuaaauaaaacauuaauaggugauuaauaaguuaauuaaugugccaaacugaagauguaccaaacugaagaauuguaugguuuuacauaauccauuuuuaaaaggcuuuauuggaauauaauuuacauaccauauaauucauccauuuaaagugucuaggucgggugugguagcacaugccuguaauccuagcacuuugggaggcugaggcaguuggauugcuugagcucagggguuugagaccagccugggcaacacagcaaaaucuugucucuacaaaaaauuagcugggugugguggugcgugcugguggucccagcuacucaggauugcuugagccugggauauaggggcugcagugaaccgugaucaugccacugcacuccagccuaggugacagagugagaccguguuucgaaaaagaaaaaaaaaaggguauccaguucacuggcuuuuaauauauuaagaguugugcauacauuaccacagucaauuuuagaauauuuuuauuaccccaaaauggaaucugggaucccuuagccaucauccccuaauguccucauuuuccccagcccuaggcagucacuaauuuacuuucuuucucuaaguauuuaccuauucuggacauuucauguaaaaaggaucaugcaguagaugauuuuuuugugugugacaaauuccuuccacuuagcaucauauguucaagguuauuucauguuguagcauauaucaauaccuuguuuccacagaauacauuuuugaaaggaaaaagaacaggagaauaaaagagaaaaaucugcagccugaaauuaaauugcccuuacagaaguaauuaacaugacuuauuuuuuaaaucugaaguuauaaaugacucugugaaagagcuuuuucuuucaaucauuguaaaaccagcugugauaaguaaauaagaacaugcucuuagaaucugcaggagggaaaacauaacaaauucauggauuacauuuacuuuuauuuuugucaucccaaaguaaagaauuuuaauuauugcucaugagaaaugaaaauguuaauugagcuuaaauuuauugauuugaaauuccauuauguauaucggguuagaaacacauuuuaauuuaccaggaguauaaaauacaacagauaagggaucuuuuugauguaagcuuuucuguaaacaaaagcaguaugggucagaaaacuauaaacauuuuaucuguucucucauguuuuaaguauuuaccaaguaaagauguuaacguaucaugagauuuaauuccucaaaacguuuuugcuuuuuagauaagauaccaguuacaaguuuagggcuguuaaguucaaauuuugaguguauuuuaaauuaugaagaaaugauuaugaaagacuuucacagcaauauaaagucaucaugaaucucauucaacuucuucaaagggaugaccaaggucaaaguggguaaagaagacucaucauccacugaguuuguagaaaaacggagagcagcucuugaaagguaauucuagacagcuauauuuuauuacucucauguuuguaccuuaauauaaauguaauuccauuauauggcaaaacuguguuuuaaugauuaaauuuuuuccaaaguaccacuugguggcuuuuaagacugcuuuaaacuuuuuuaagaaaauuacuucuuucaacaaaguacuguauaauuguucuguauaauuuuuaguaauccucaucaauagucuaacaaaauaacacuuguuuuucuauuauaugcuacaagcaggagcauauaauagaaaacauauaaagacaugaguuagcuggggauagaauuguaucauagguagucaccaagaguuacuaagaaacugcuaaacuuggaaaacauggaaguugugaauggggggaaaaauaaaaauuuuuggaugcaaauaaucccacuuuggucuuauuuagguuucugggaaguuauaccacacucauguacuguguuggauaguauagcuaauuauaguucaucuaaauuaacuuuucugaugaguuuuuacuuaguaagaacauuauuaaauacagugagaaguacaguuugugccccccuuguguuuguauaauugauuuuuacuugaauguacaaaaguauuagucuuugcuugaguugacuauauacaguugacccuccauaucugugggugccuuauuuguggauucaacuaacuauggauggaaaauauuugaaaaaaauaauuacaucuauacuaaacaugugcagacauuuuuggucauuauugucuaaacaauacagcuuaacaacuguuuucauaguauuuccauuauauuagguauuauaagucuagagaugacuuaaaguauaugagaggcuguccauagguuauuaugcaaacacuacgccauuuucuaucagggauuugaacauuugcagauuuugguauccauaggauguccuggaaccagucccccacugguacugagggacagcuauacuuaaagacuaauauauaugcucuguuuuccuuuagaguacuugacucuacacauuuccuauagcuuugaagacuugucuuccuugaagcagacuaaaagggggacagaugggaggaugggaagaaccacacuuccauaaucuuagaauuauuccuuccuugcuaugcugacaaagugagaaaacaaauauaaauuaucuuaaagcccagcauuuaagacacaaguugguaauuaccuaggcuugaaacuuucuaauuucacugguuuuuuuguuugcuugcucuuuauuuuucucuggcuuaaaaucagugguuagggugaauagcacaggucuugggggugguaucuauuucucuaggucacaaauuuuuuuuuaaacuauuucaaggcaacuuauuucuaguuuucaguaguaaauuguuuaaauuucaagaaaaaugguacagugaaguuagauuugaacaauuuaagaaaagcuaaagaauauguaguuuaaaaucuuagagaaggcuuaaagaugggauuaugucugagaaucugcaguuacccagaaaaaggauuuaaauugcaucaagagaaguuuagguuaggcauuugaauugauuuuauuguaggagaggucauagacugaauauuuuuaagaauaaagguaaaucggaugguugccgggucuguguggauagaaguagacaugggagacuuuucauuuuguucuguacuaagaaaaauucuucugccuugggauccugucgaucugugaccuuauccccaacccugugcucucugaaacaugugcuguguccacucaggguuaaauggauuaagggcggugcaagaugugcuuuguuaaacagaugcuugaaggcagcaugcucguuaagagucaucaccacucccucaucuuaaguacccagggacacaaacacugcggaaggccgcaggguccucugccuaggaaaaccagagaccuuuguucacuuguuuaucuacugaccuucccuccacuauuguccuaugacccugccaaaucccccucugcgagaaacacccaagaaugaucaauuaaaaaaaaaaaaaaaaaaaaaagaauaaagguagauaauggucugccuugauuucgcuuagucuuuccugaaaauguaaccaugacccuuugagagaccuuucaagucuuauuuuucuaugaguaaauuugaaguauuucagauggcaugcuugauaaggaacuuaaugaagauuuacuguaccaaggacauauaauuugauucuaccuuuacguuucuuccaacuuggcugcauugcauaguacuuaccauaccuucauguacuaugaaauguugaggagaguuuuaagggauauugaaacuugacccuguuuguauaaagacacuuucuuuacugauaaaugcuacuuguuaaaugguaccauaguggaauuugcaauagugaaaaaaagaaagaaacaguauaguaugagggaaaaguucauuuucaauuagaaaaaaaucacugaagaaaauauaggcauaaagguguagaagcaaaggaacuggaaugguuucuuuuaaucuaaucuuaauucuucugugcaagcuaauuuuccuguacacauuuauuuuuuaaucuguacaggauucuaaaacugcauuuuucuugcccuuucauauagccagcuuuucuaaagugauuuuucugugauauuucuuaaacuuuaaacaucaaacagguaccaucugugggauacccaacccaguuggaucugguggguuagggaagcauuuuucuucguauuauuuuauucaauaguaugauauuuacguauucguucaaacuuagauaauccagaugacuaccuugaaugaaaggauaaauaucugguauuaaagguuaggaagagaaaaggagugguuaaauacccaaguauuccccugugccacacucaguaaacuaagcagagacugcuucuauuaagaguagcccuaacaucacuugcuugguuuucuugagagugcuucagaucuuuagaucauauugaguguauuuuauagguaaggauacacaucugcaaauacaaaaugagaaauuuagagcauaauaauaaguguauaagauuuauaauuccuuuucaguugaaaccugugcuaauacuacacacuuucugugugaccuuagguaaauuacuuacaugcauuugucuuuaaaguguaagugugaggcugggcgcgguggcucacaccuguaaucccagcacuuugggaggcugagguggguggaucacgaggucaagagaucaagaccauccuggccaacauggugaaacccugucucuacuaaaaauacaaaaaauuggcugggugugguggcgcgugccuguagucacagcuacuugggaggcugaggcaagaggcuugaacccaggaggcagagguugcagugagccaagauugugccacugcguuccagccugucgacagagugagacuccgucucuaaauaaauaaauaaauaaauaaauaaauaaauaaaauguagugugucaggauuguguucauuucaagcaucuaaaaauccaacuggccuaaacaguuaauguagauuaauuaauccacucuuucaaaucaaagaguuuggaguaggcagcuguucaggauuaucuaauucauuaggaaauucuauugcuucuuucugauaucugauaauacaaccuuuucucaccagucuacugacugaguccaaagguguuaauuaacugcaguagccuccuaauuggugucccugauuccauucuuggcacuucuacuuuaauacagaacuuuacaguagucauucuaaaauauaaaucagaucauuuuaaccccuccccacgcuggccccaugcccccauuuuacucaauaaaagccagaguccuuuuaauggacuacaagacuuuauaugaccugcacgccucacucuguuacccauuugaucucauauccuccgugaucacucacucugcuuuaggccagacuaaccuuuugcugcuucucaaacacccuaggcauuuuccuaccuuagucuuuucaacugccugcucccucugccuagaaugcuuuguuccuagguaucugcauagcuaacucauuuccuuguucaaguucguauguucaaauaacaucuuucaagugaagccuauuccagucauuggcuuucuucugaccuauucuauuuauauugccaccaaccacaucuuaaauacuuggucccauuuaccccauuguucugucuuuuuuucccauagcuuuugccaccuugucacaugcuuuaucauuuguauguuuauuauguuuauaguuuauugucuaucuuguacuaaaauguaagcuucaccagggaaagaaucuuagucccuuuugcucacugauguguuccaaguacucaaaacagugcuuaauagguaguaagagcucaguaaguauuugcugaaugaacaagugaauguuauccaagacccaggcucuuucuaccuuuuuauucucccauuaugugcauuuguguuuuaguuucaagcaagauaaauauuuguaacucuguugcucucaagcguuuuauauaaccugcuuuauuuuguuuuguuucugguaaguaaauaagaauuugaaagccuugagugauuuuucaucaguaacuugaaguaaauuugaagaacaauuacugagcaccucuuauuggaugugauauugaucaauuccauugucuuuuauuucugacuuuuuucaguguuucuauuucuccccauaccucuuuuccugucuucuuccuacacucauuuacccuuuuugucccgugucuuuccuuuguauuacaaccaucucuggucuuaauuccgaauuggcauauguuuauaaauauuuauuguuuuaaaauccauuuuauguuucuguucuuaauuucaacauuauguaaacauauauauaaaagcauauaagcuuauauaugagaaacauauauauaaacuaaaaaaugcauacauguauuuuuuaguauauguauuuaguauauguauuagcuuuauuuuauguugcccuugagaaggaaaguuuuauucccuuuuucuggaauaucauuuuucaaaauugauucuucagaaugcuaauauguaguagaaugaaaaagaucuauagucaauugaguuuugucaacauaggauuuaacaaaguuaaacuaggguuauuuucuguaggaguucucacaacacuuaauaaaaugcuguuugauaugaauuuuaaaagacaggaauauauauauauuucaaacuuucuugauauggaaucagucuuuuucauggaauaguacgugagacuaguauucuacagaacucacuuuggaaagcuguuuuagaauauaaauuauacaagguauuuccacuuagguuugaaauauuagaauauuuccuuuuuuuuuuuuuuuuuuuuuucugagacggagucucgcucugucacccaggcuagagugcaauggugcaaucucggcucacugcaaccuccgucuccuggguucaagcaauucuccugccucagcuuccugaguagcugggacuacaggugcaugccaccacccccagcuaauuuuuguauuuuuaguggagaugggguuucaccauguuggucaggcuggucucgaacuccugaccucgugaucugccugccaaagugcagggauuacaggcaugagccaccucacccugccagaauauuucuuagagguuaaguacuagauguuuuguccuucuuggguuuuuguuuguuuuuuacaaguaucugagugccugcuauuaccuagcuguuguaugcacugagaugagcaacuuaugcaaacugccuucaaguaguacucagucuaaacaacgaaauaacuuaucugauauauugugagagaacuucaguguuaaaauuguaagucaaauucaaguggggaaauaccaacauuucuuaaaccugcaggauuaguguucuugcugcaucccuuuuuuggcuucauaauauagguagcaaaaauuuuuuuaaacccagcauagauuguaucgaagauaccuguuaaaugcucugguucuaguauaaugacuucuuaugugggcuacugacuuaaaacgaaguuuaguaugcuguauauuuuauuuaaauauauaaaaacagaaguuaacauuuugauacugauaaaauagucauuuuuaucaauguauagaauuugacuuuagagaagauuaucacuuuuuuggaaaccuuaauuuuaggcauauuuuauaaucuuauaaaaagguagaagaaauuacugacuacauuuauucuaaagaaauaaaauaaauauguuauugcgaggaaaaauauuauaacugaaauauuacugcauaugguuauuaacuuggggaaagauagcagguuuuuuuuuguuuuuugagacggaguuucacucugucacccagacuggagugcaguggcaggaucucggcucacuccaaccuccacccuccagguucaaaugauucuccuuccucggccuccugaguagcugggacuacaggcaccugccacugcgcccggcuaauuuuuuguauuuuuaguagagaugggguuucaccaucuuggccaggcuggucuugaacuccugaccucgugauccacccgccucggccucccaaagugcugggauuacaggcgugagccaccgcgcccagccgauagcaguuguuuuuaaugggauuagaugaguaaucgagaaucaucaaauaguugaccuuauuuccuuuuaugaagucaugauugguaauuuauuaugggugacaggcacaugugagcuuuucuaauaaagggaaauugauuucauagugguauuucuaacuuuuucauuuuuauucauuuuaugugguauucguuuauuugauuuuguaugguaucaaauuagauaagacauuuaccaaaaacagcaaaaccuuaaaaauagaaauacugaauaaauaccuuugaagagguauggggaaaauacugaagaaaauuuaguucuugucaagugaggacuaaagcuaauugugaucauuuaaauaugcugacacgcaaaaaaguauugguagacucuuccccauucugaugauaauagcaguuuaaaacuugguugaguggaauauauauaguaauauuaauauguuucuuagaacucuaaaauuauaguugagaacaugacuccacccaaagauaaaaugaugcaacaaacucacauaccccuuugcaacauaauacuuugcaaugagaaguuugguaaguuauuuaaccucuccccacucccaccccuugccauuucucuuuuuacguaauuaugaaaacuggauaguauaucaauuuucaaaagaugaacaaaaaccuuuuuaauuauuaaauugcuguaagauucuaaguaauuacagugagaguagucuaauacgagguagugaggacacuuuuuuuuccuaguauuucuauuuuuuuaucauuuuguugaacuguaauucaagaugcuacugauaaaggagcaauuuuacucuuaaaucuagguaucuucaaagaacaguaaaacauccaacuuuacuacaggauccugauuuaaggcaguucuuggaaaguucagagguauuauuucuauauuaaauguuuguauaugaauguucucguuauuugucauuguaauguauaugacuauauauaguaaauaauugaguuaauagauggaauaaagcaauuauuauuauuauguuuugcuuagugcuuuaauuacccugcuaaauuaguagcaaaauaucuuugcuuugauacuuguagggugauuagucccuuucuugaauacuuaaaacaagauuuaagagagugauuuauaaguagucuaacucugaaugcccuaaguuguuccucaggcaucauguugaaauaaguuuauucagacuucauuuuagagaaagagaaaguugaauguguauuugcuugucuacauuuugguauccuuauuaagguuuugaaaugcaaauuugugacuugaaagagccuaaauucuaaacaugaugcucuuuuuauuugaaauguuugguauauuuuuggcuccuaagagcaauuugaguucuaguuugcauuuuuuucuuuaaauuacuugaguugcagaauuuuuaaaaaacucaaaauuacacaaagcuaacugagcauaaggagauuuuucucaagacuuucuucuuuccuuauaaacgguuuauuucuguuagcaaacagguggccaguguuaggguacuuggcaauuucuuaauauauuuugacaaacaggguguuuguuccaucuaaauguaaacgugcagaagaaaagcaaauggaaagucuauuuuuuaaguuuuccuuugagaauguacaaguaguauauuugagaaauuagaucucacuauugaaauguaugagagugaagaaaauacaaccucuuuuuuaaaauuuguaugugggggggaggggggaggaggggggaucacuuuugugccuaguuaaaccuccaggcuuuuaaccgguuuguuugcccuuauuugucauucaauuccagcugccuagagcaguuaauacacaggcucugaguggagcaggaauauugaggauggugaacaaggcugccgacgcugucaacaaaaugacaaucaagaugaaugaaucggaugcaguaagagcugauuuuucggcuugaauaaugagaugaauuaaugagcccaacaauugcauuuuaaagcuguacaaguggaaaauaggauauuaauuugcuuauugaguuuaguucucagccacaucaguuggccaccaugguuauaagguuaauuuguugcuuuaaaacaaggaauuuagcuugcuauugguaaccuaauuuacaaugguuuguucuuccuaaauuagcuccauuuuucauuuuuuucuuagugguuugaagaaaagcagcagcaauuugagaaucuggaucagcaacuuaggaaacuucaugucaguguugaagccuuggucugucauagaaaagguuuguuugccuuacuacuuacguaguuagcaccauaaaacuaaugaaaauauuuuauuuaaauuuuaugaaaauaaauauucugaaguuauugcagaagagagaaaacaaucauuuaagacaauguuuucuaguucaacuuuauuauguaaauuuuuuuuguucuauuuugcuuuacuaucuaguuuagaaguagaaaaauaacgagcuuagaaaauuauuuguuaacugguacagaugugagcuaaaaaaaagaacaaagaaaacuauauuugaauuuuggauuaaaacuuggucacuugauuaacuuuuuguuaaguauaguuacaguuaaauggaugaagaggucuuaucaauuaguaacuuugauuauaauaaaaaaacuugagauuugaaaauugcuuuuugaaaauuuuuuggaaaguauuuguuuugugugucuauuuccuguaaaacccuuugaaguauuuucuucauuuuugaacugcaauauugaaaaaccuggagguuuugcuaaaaauucauagaaaauuugaguuguaauauuuuaauccacagugaaauuauaguuuuuugguuuuuuaaagaauccaacaauguaaauaucaauugucuaagacauuuaauaagcaaauaauauguaacauuaccagcaauacauuuuauuaaaauaauuauagaaacuuauuaauacauuuauuauugaaaguaguuuguaacagcuuuugccauuugaauuauauauaucucuuagggaaugggcuuuuuuggagaacuuuacauaauguagagcaacggagcaguuuccacgcaguguaauuguuagucauugacaguauucagccuguaaacaucuacuuuucuuuauuugaaauaucugaaaugaucacauucuaaaucuuuuuagaaauucuaauauuuuacugagauuguuguacaacaaagaaacuaacaguaaaauuuauguuaauuguguauauaauuuuaccuuugcuccuguuagcuaaauaauauucucauuaaaauuauagacauuauuuucaaugacaaauguuuaaaggccagaaaugugguauaaaucaauugugaguauuaccaguucuucucauauuaaaaauauauuucauuuuuaggaaugggcagagaaacagugaacacugugggagaaaaaacaggaggcagauuuuuauauuaaaugauuuaaacauaguucaucccuuuggaauauaagcagugauuugucuguguuuucaguagaucuccgagcacuuggcauuuaugccugaggcauuuuaacgacuaauuguuucauauuaauuaauuuaaaauauuauuugagcaacuugugcauaaguaaaauuuagagaaaaguggaaaaaucaauacaauauuuuaaaauuuuaugagugaacacuaaaauugcauacuuuuuuuuaaauuucagaacuuucagccaacacagcugccuuugcuaaaagugcugccauguuagguaauucugaggaucauacugcuuuaucuagagcuuugucucagcuugcagagguugaggagaagauagaccaguuacaucaagaacaagcuuuugcugacuuuuauauguuuucagaacuacuuagugacuacauucgucuuauugcugcagugaaaguaagcccuuucuugcaugcuucucacuugugucguguacuuuaaaaaguauuuuguuuccuauuaauuauguauuuacaugucuaaauuccuccuauacuagcaugaauaaaauggcuucaagauaaguauacauaacuuaauacuuucuucccuaugacuugcacaguacaauagauagaauuaauguuuuuaacaggucuaaggaaugacagauaagauagaaaacauuuauacauuuacuuauguauuugcuuauacaaguuuggaacuaacuaauagcauuuguuugcucguucuagcacuaacugaaacuacucaccggacucuauuaucauuaguaaagcugacuguguaauaaauaggauaaaaccagaaacgauuauugcagugaauauguuuaaugggggcuuuaucauaaauuuggauguaaucagacuuuguauccucaaauauguagucaccauguguuuauagaugagaugggacuagauuagaucauaaauuguguuauugaaugguaauacuuauauaauaguccaauuucugaauaguugagaaaguaauccaguuaguaaaaauuaguauucugcagauaucugcaguuuucagacaguuaaacugaacugaacguuacccaguguaucauguuucagaagauacuuuaagaucuuugaauuuuuguuauggauauuaguuaucaugggguuugagggguacuggguauuuacuuuuuaccuugaauuuaaacaucuagaaaguuaaugagaucuuguuucuuucuuaugcaaaauuuuuucagcuaaagucugugaucaaguuaauacucaucuacaaugagcauauuuauugaugguucuguucuuaagcaacuggugacauuuauuacuagagcauucuuagcacuucagaauggugcuuucuuuuauuugguaaaauuaccaauuuuacuuguauuuuaccguuuuaaauguuccuaaugcuguuggugauuaauuucucaguauuuagaaauguuaauauacauagcaauugucagaguauauauacuucauuauauauaggcagcuugugauguacagagauccaguuuacagauuugucccaccuacucucacuucuuaccagagcacccaauagcaugagaccuguuguaaaaaagugugacacuuccaacaaacccgugggucaaaaaaggggaguugggcagugucuguaagaauacauaucugggccgggcacuguggcucacgccuguaaucccagcaccuugggaggccgaggcggguggaucacgaggucaggagaucaagaccauccuggccaacauggugaaaccccggcucuacuaaaaauacaaaaaucagcuggacaugguggcguaugccuguaauccuagcuacucaggaggcugaggcaggagaaucaccugaaccggggagucagagguugcagugagcugggauugcgcaacugcacuccagccuggcgacagagacuccaucucaaauaaaaaaaaaaaagaauacguaucugcuaauaagagcuaaccuggaaaaagacccccuggcagugauggccugccuguguaauggauauugaucccucaaaaauagcuuuccucauacccuaagucuuuuugcuguguuacuguauuuccugaaauuacaguuauauucauguuuuccaaaauauuuucuauagaacacuggcaccaaaagauggauuacaguuagcuaaguuugggaaguuauguauauaguaucccuguuugcgagauucagaaugccuuuuaaaagcucagaacugguuaggagugaaaaagaaaacaaauuuuaauccagaggcuucuaaauucauuugaacaagaauuauuuuccaccaaauaucuauuuacauauauggaacacauuuguggaaauacugaauuaaugauucauugacuaaaagaguuaaagagcuguggugaaguugccuucagguaaauuaagcucuuuaagauuaguuucuacugaaaccuagcccagaucaacuacacaaaggaauuaagauauuauggaaggaggugacagguaauuuuuaugguuuuuguuuuuguccuauucuuuauuuuaaacuaauucacuuguauuugaaaaaauaaugcacauacaugauaguucuaauagcucagcaagguaaauuugccugcagaacuaagaccuguagucucugaccucagucauaaacuguuagguucuugugugucuuuacagaauuagcuaugcauguacaugaagcuaauucucccucuguccauuuauuccuuccauccccuucucucccucccuuccuuucucaaaaaggaauauacuguguguaguguucuuugucugcuuuuuacacccacuccacuuaauagggcggucucccuaucaacauaaguagauguccuuuuuuuuuuuuuuucgcagacggagacucgcucugucgcccaggcuggagugcaguggcgugauuucggcucauugcaggcuccgccuccggguucaugccauucuccugccucagccuuccgaguagcugggacuacaggcgcccaccaucaugccuggcuaauuuuuuuguauuuuuaguagagacgagguuucaccguguuagccaggauggucuugaucuccugaccucaugauccgccugccucagccucccaaagugcugggauuacaggcgugagccauugcgccuggccgguagaugucuuuuuaaugguuguauagcauuccaucauauaacauuuagauauaccuugaauuauagucuagucuuuuaaaaaaucaaguguuuugauaacucuuuggacauaaagauucuauaaguagaauugcugaccagaggguauaugcauuuuaaauuucaauaaguauugccaaauuacuguucaaaaagauuuuacuuuguacccuaaccuaccuaaaccuacauguuucuuuuuacuagcacccaagaaugaagguuuuuuguuuuguaaguugccauuuacuuagugugaaucaagacaucuuuacaaaugauaaaccauuugcauuucuuuuucuuucuuuuuuauugagauggagucuugcuuugucgccaggcuagagugcaguggugcaaucuuggcucacuacaaccuccgccuccuagguucaagcaauucugccucagccucccgaguagcugggacuauaggcgugugccaccacagccagcuaauuuuuguauuuuuaguagagacgggguuucaccuugccaggauggccuaucucuugaccucgugaucuacucaccucggcgucccaaagcgcugggauuacaggcaugagccaccgcacccagcccuacauuucuuuuucugugaaugaacucuucauguccuuugcccaguuuuuguuugguuauuaucuauuucgaauaggugcuuaauauuaauuaaccuuugguuuuauccauaucgagcguacuuuucugaugauaguucuucaaauuaggaauacuuuggggauuaauauagagccauuguuaggaucaaaaaacaucaggaauuggaacacuaaagaaaaagcuacauuuuacccauuucaaaauauugccuaagccuggcguugugucaggaaacgccuguuuuccucuuuuguauaguacauggucucugcaauuuagaacuauaagaguuggcuguauccuuacaagcauugucauguauugggcuucuuugaaccacuagaguagggucagagauugagggcaaugguucuuaauguuuuuagcacuagaacucuucauaaauaauuuuuguaggggaucccaauuuauaaaacauacuaaaaaaauguauuuaacuaaaagauggauuccccaagggguuuaaacgcuuuauucuuuggcuauaaauacucagcaccucuucagaacuccaugaagcugggcagcauauuuucagauuaacugaauuacaauaugauaauaauuaaaauuguagcaucaaauuuccugaugggccaaaaaaacuguuagacaucugcaaucuugucuaacugagagcagcuugcauacaaauguaugccauaaauuagcagaguaauggagguccuaaauggaugauccguguaaacuuaucccucuuauaaugguucuacuagaguggauuaguaucuugacauacaaagggacacauuguuacgauuuaauugauuuaauauagcauuguuagaaguuugacuggugcugguucuuuuuuauuuucuguuauuuuguuacaaaggaaagaaaacaaacgaagaaaaaguuaauuuguauauuuaagauuaauuuuuuuuuccugaaauaaccugacuuuaguagucuuaccuuuaucauagcuccuacaucuguaccacaauaaacauguccugguucuagaauacuaugagauaauaaauuggacagggaccaaauuaguuuagauuuagcauaucaauggaaaagccgguugauguauacauugagaacuuaagcaaauauugaauuaaagggcauguucauuagcuuuuucccuguauugguacauauuuuaaggaaucaaauuuuuacugaacagaggaauuuauaaaugaagaaaagauauggcccuguuccccuaaagcaagacuaggucuaaaaucuuacauuacuuuuugguggucguguguaugugggugugugugugugugugugucggaagugagagggauugucuuaagcuuuccaacauguggucguguguguguguguguguguguguguguguguauguguaggaagugagagggauuguuuguguuaagcuuuccaacaugcggccggggacagcuuugaaugcagcccaacucaaauucacaaacuuuauuaaaaugucauggccgggcgcgguggcucaugccuguaaucccagcacuuugggaggccgaggcaggcagaucaugagaucaggagaucgagaccauccuggcuaacacagugaaaccccgucucuucuaaaaauaaaaauaaauuagcugggcaugguggcgggugccuguagucccagcuacucaggaggcugaggcaggagaauggcgugaaccugggaguuggagcucgcagugagcugagaucgcgccacugcacuccagccugggcaacagagcgagacucugucucaaaaaaaaaaaaaaaaaagaaaauuguaaaaaacacugaugacauuuuuuuuuuaaagcucaucacuuaguguuaguguuaguauguuuuauguguggcccaagacaauucuucuuccauuguggcccagggaagccaaagcauugaacacugcuguuuuaaaugauagugacuuuuucugaaucuauuuguguuagauauguuacuuuuggauuuuaauaagggauguuuuaggaaaaacgugguauuuuaaauauaagaaaagcagacaaaggagacaguaagauucacuuaauaauguaagaaaaauuaucugagaagacaaauuaaauauagcaaaguggauuuaaauacccauagauaaggugcuuugacugccaguuugcccuggauaucuuuuguccugguuaauuuaaaauguucacgauccuuaagaauuccuuuggaaaaaugcuuugguuucugguugauuggauuuuuuaaugcuauuaucacauuuuuaaaaauugccauaugauauaaaugcuuuuuaguuauacauuuuuuccauaauacuaaccuauccuuugcacuuugguauagaaagcuuaacaguuaacuacauuuacauguguauguuauuuagaaguaauccauaauggcuguaccuacugauuauuaagcauccacuagguuaagucacuaugcaauaauauacuccuuauguuauuucuaauccauaaauguagacaucacuucccaccuuucguauuugggaucauuacagcuuggagaaguucagugaauuuacccauggucauacggugacaaaacuaauauuagaaccaaauuugauuuucuccaaagccugcuuuuuaaaaauauacuaccuacauauuuuucucuucagaucccuauaggaacauguauuuuuacugcuucaugguucaaaaaguuuuuuauuuggaauaaauuaaaauaacucggguuuagugcuuccugguucacccaauuuauuaacauuuacuucaugaauguuugauuaguaauuacuaaaauaauuuuaauauuucucuaacaucaagccagaaagaggauucuuaguggguucucccauccuauccaucauuuuuuucaugagacuucuaauuacacuaauuuguccauauuucauuucuuuucucuauucacuugcccuugcucugccagacuccuugagagaagucauggauuugguugacuuauuguauuaggaucuuuuugucuauuucuuuaguucugcaguguauauauaaaaaauauauauaguccucuucaucuuuugcccuuuucaucuuaagacugucuuuuuauucauuuuguuauauuuuacguuuugauugcuuugccuuuuuuuauuugcuaugguaauuucuucuaccacauaucuuaugaguuuuucccauuuugucuuuucaauuucagacauguuucuaauacuuaauaugcuucuaauauuauuuagcgggaaaauuuccaguguagguaugacacuagcauuuuccuauuaaagacaucuucaaagcauaaaacgcuguuauaaaucuuauaaaccauauuuaaagcccuaaaggcuagugaugaaauggguuuugaauguaguuuuuauucugaacauguuucauccagugacaggguuuuuuuguuuuaagcaaaugaauauggagauuauuuucuuugauauuggcauacuuacuuucaguaucuuaguauauuagaauagaacuuaaauacuugguuuuauuguuuucaguauuauaacacuucuaguguuaagaaaguauuuuaaauguuacucuuacuuaauagcauuaugucauucacuuauaggguguguuugaccaucgaaugaagugcuggcagaaaugggaagaugcucaaauuacuuugcucaaaaaacgugaagcugaagcaaaaaugaugguugcuaacaaaccagauaaaauacagcaagcuaaaaaugaaauaagagaggugauuacuaaaugcuuuaaucucuuuacuuaaguuuugcaugagucauucauauauacauaauuuuucauaauuuuuuguaaaccauucaacacguagcuauuuuugcauauuuuuaugaacuguguuagaauuacuuuaacauuuugaucauuauuauuaaaaucuccagagcccuucauuacuuauggaauggauaaagaagcauacaaggaaaacagcuaaaauuaaccuuuacauuaauaauuacacauuuuuauuagaugguuaauuuuauuucagauuauuauuuugugucuaaaaaugguuuuagagcuagaucucucccacauuuagcuguccaggcaacauuaucccccauauauauguauuauauaugguauuuuagugaauuuguauaaguuuauuauaauuuauacacuuuucuuaccaugcuucaauaaggaaauugaagagguaggacaaccuuuauguuacuaaaaauaaauguaccugcccuuugaagaguauguaccaguguuuugguuacauagugggaaaaauaucauuucauugcuuaaaucuucaguuauuuuaguuguuucauuguucacuaaucacaacauuuuguuguuucuguacugaauuuaauauuuauugauggucuucaguagaccauaauuccacauuuuuuuccaaucuggucauuuuaccauuacaaaaauauuuuuaaaauguuuaucauguaauuuuccuaauuuaaaauauuuccaucagcauauaaauuuugaagaacacauauccuuggauuuaacaguauugauauauucugaaauaauuauugauauaaaaaaguaauuaagaaaauuacacuauagcacugauaauuuauuuuguggugaauuuuaugcccaaaaucuuuccucuuaguuauauuuaauuaagcuuuggacauuguaguuuauuaaguacaguauugaaauaucuuaauauugagcaaaucuguggaauauuaaaggaaauuaagcuaacaugcauuucuauugguugacaguuaaaugcaauuucuguugaugcuaaauugugcauugccaauauugagcuuucucaggauuuucaggcauugugauuaaauuaagugaguggucuugacaguacuauacuuuuuuuugagauaagcauaaaauauuucuuuguuuuuauuagugggaggcgaaagugcaacaaggggaaagagauuuugaacagauaucuaaaacgauucgaaaagaagugggaagauuugaggcauguauaauaauuuugcauuuaucuuaacaacauggucacauuuugcugcaauuuugugguaaaguugaauuuagcuuucuacuaacggacuuuuuaaaauguacuucaacagaaagaacgagugaaggauuuuaaaaccguuaucaucaaguacuuagaaucacuaguucaaacacaacaacagguaagccauuuuuguuuauaacuuaaacuucuagaauuuguuuuugguauacuuucuuauuuuaaaaagaugauuaaugaacugggcauuuaaacucaagaauaagaaauggaagacagaaagccagugaugguaaaggauaaaaggguaaacuaaucggaaacuaucucacguguuuuuuuuuuuuuugccucugcuuaacacuaaggcagagauagacuuuucccaguuuuaggccaucagaaaccucaugggcaacuuuccccuuucacugucuuucuaguuuguuuuccuuguuggucagaccuguuugaguaaauucucauaguaaguucuucucuuccauaacaaauagaacuuaagcuaaacacuuuuucagaauuaaaaaaaaaaacuguacuguuuucauuuuugcuuuauuuuguuugggguugguggugguugaaugcugcaaguggcaguuaucucauuuaccauggauuuuaaugguauauuaaauaaaaagauaaucacagaaaauuuuccuguauauuuuaauguaaauuagaguaacaggucaaguaauuuaauaucuugaaggauuucuuccuuccaguuuuaaaauauguggaucuagaaugucauuuguguaaaacauaauagguuguuuuugaauuaagugguaugaugucuucaaauuguguuuaauuuuuauuuaaacagcucauaaaguuaaauuuuuuuaaauaugaaaauaagucauauaagcuuguuuuuaaaggaauuguuuuaaacaugacuucaguugauauuucagucuguucucuggacuauucaaggaagacugacagcuaauucuauccaguccuuuuuuuuuucuuguucaguauuuucuuuucuuccuccuuauaucccauuuuuuuuugucuagcaauaacauaaacugucaauaugcucugaauugggaaauccugucacuuuaugcuggaaaaggucauuguaguuguauuauuugcuuuaauauaugguaacacuguucuguguaaaauuuugcauaaaacaaaaaauuguacauuaaaagaacuccauuauuuuacaucaaaaacuaaaaguagccaggaguaauuaauguuuuaaauaauuuauauaugaaauauauugacggacuucagauaaggaaauuaaaaugauuccuuuaagaaccagacauuggccgggcgcagcggcucaugccuguaaucucagcacauugggaggccgaggcggguggaucaccugaggucaggaguuuaagaccagccuggcuaacauggagaaaccccaucucuacuaaaaauacaaaaaaauuagcugggcgugguggcgcaccuguaaucccagcuacucaggaggcugaggcagggaaucgcuugaacugggagguggagguugcagugagccgaggucaugccauugcacuccggucugggcaauaagagugaaacuccaccucaagaaaacaaaacaaaaaaaacccagacguuaguaaauauuagucauuguuagcuauuuguaugguuuuuuaauguuguuuuuguuuguuuguuuguuuguuuuugagauggagucuugcucuguuguccagguuggagugcaguggugugaucuuggcucacugcaaccucugucuccuggguucaagcuauucuuguaccucagccuccccaguagcugggauuacaggcaagcgccacauugccaggcuaauuuuuguauuuuuaguagagacgggguuucaccauguugaccaggcuagucuugaacuccugacaucaggugauccacccaucucagccucccaaagugcuggaauuauaggugugagcuacccagcccggcuuauguagauuuuuuuuuaaugcuguacaggauauaugcauauaaaugacaaaaagguaaugagaauaacuuauauuuuaauuaucauucacagcugauaaaauacugggaagcauuccuaccugaagccaaagccauugccuagcaauaagauuguugccguuaagaagaccuuggauguuguuccaguuaugcuggauuccacagugaaaucauuuaaaaccaucuaaauaaaccacuauauauuuuaugaauuacaugugguuuuauauacacacacacacacacacacacacacacacacacacucugacauuuuauuacaagcugcauguccugacccucuuugaauuaaguggacuguggcaugacauucugcaauacuuugcugaauugaacacuauugugucuuaaauacuugcacuaaauagugcacugcaagaccagaaaauuuuacaauauuuuuucuuuacaauauguucuguaguauguuuacccucuuuaugaagugaauuaccaaugcuuugaauaauguucacuuauacauuccuguacagaaauuacgauuuugugauuacaguaauaaaaugauauuccuugugaa

SEQ ID NO: 192755 - RNA, 59868 nt, Homo sapiens
ucaauauuaaaagagcuuuuuuauuuguuaaugucacauaagaaauuuaagcaaguuacacuaucuuaaaaaacacaacgaaugcauuuuaauagagaaacccuucccucccuccaccucccucccccacccuccucaugaauuaagaaucuaagagaagaaguaaccauaaaaccaaguuuuguggaauccaucauccagagugcuuacauggugauuagguuaauauugccuucuuacaaaauuucuauuuuaaaaaaaauuauaaccuugauugcuuauuacaaaaaaauucaguacaaaaguucaauauauugaaaaaugcuuuuccccucccucacagcaccguuuuauauauagcagagaauaaugaagagauugcuagucuagauggggcaaucuucaaauuacaccaagacgcacagugguuuauuuacccuccccuccucauaagaacuuaaaaaaaaagaaaaaacacacauacaaaaaaagucaaaaaauuugaggaaccccuuccgaacaguacacaguuauuaaguucagugucaauaauucacaucuugcaacaaaguguauggacaugauuucuuuuacaaaacuuucagugucaaaaaggaaauuaaggccaucagauuugcagcuuaaaaauucacauaaaggaaauauaaaaauauucugugcuucugagaaggcucugcacuguauacagguaaagauuaccauacuucuuuauuuugaggaagacaguugaaaauuuuacauaauugcacagcuucuauuggaugcucuugggguucccugaugaggaaaacagaaggaaaaauuaauacuaaagaaauagaucacaguauucuaaaauaagacaaaaacuuuuaacuacagggauaccaaaccauauuaccuaaccucaaauggacccuuuaucaucucucaucuuuucuaaccuuuucuuuuuuucuuuuucuuuguuuguuugagauagagucucacucuguugcccaggcuggagugcaguggugcaaucuuggcucacugcaaccucuaccuccuggguucaagcgauucucaugccucagccucccgagcagcugcgacuacaggugugcaucaccaccacguuagccaggcuggucuugaacuccuggccucaagugauccaccugcccuuggccucccaaagugcugggauuacaggcgugagccaccguaucuggccucuaaccuucuuuuauggacuucuuucuagaauaccccccaacaaauuccagaacaguaauugucaacucuggcuacacauucagauccugaggaguuuaaaacaaauucugaucuaggucccuugaucaaucaaauaagaauuucucauuuuacugggaaaggguagcuaucuauauauaauuuuaaaguaauucuaaugugcagcucaauuugaaaaccauuguucaauaaccucuuuugauaacuuaggaaauaggagaucaguggaucagcuuuuaacaaccacaucggagacuacagcuugcuagauccugaacuuacacaucccaagccaucugcaguggauuuguccuccaaggugaagucaacauggcuccucuacccauuucuuuaucacucauuaauuucauauaaccucacaauaugacuugugacucaccacugauugaacuaaaacugguuuuuugaaggucaccaaaauauuucuaaucaauucaaaaggcgauuggauucauccucaaauaugaaguucaaacgccuguucugcccuuccaucuucccucuuaugaaccuugguaucauuaguuucugugaucacaaaagcuaaaaaccucauacaucuuuauuuuuuuucuucucucacccucaaguuuagucacuaagccuuaauaaauuuccauuauauauucccucacugccucuggaaucuccucucuagaguuagucccucugauucagcuuggccagugauauuuuaaaaugcagucuuaacuucuccuuuguuccaaauuguacagaagcuacaucccuaagcauuccagacuaugucaguuuaauuccaaucuuucaacuucauuuaacucucacaugaacccuacaaaauaacuggaugagcggauauaguuggugcauuaagucuuuuuuuaugaggcagagucucacucugucacccaagcuggagugcaguggcgccaucucagcucacugcaagcuccgccucccggguucacgccauucuccugccucagccucccgaguagcugggacuacaggcucccgccaccacgcccggcuaauuuuuuguauuuuuaguagagacgggguuucaccguguuagccaggauggucucgaucuccugaccuugugaucugccugccucccaaacugcugggauuacaggcguaagccaccgugcccggccacauucuuuacacauccucuguagugaguuaaagaucaccaugaauucuuugccauuccucccaccaacagguggagacuauuuacccccacuuugaaucuggacuggccucaugacuuugacuaagagaauguuacaaagggcccuuuaagaaaccugguacucucuugagauugagauugucguggccaacauggugaaacuccaucucuacuacaauauaaaaaauuagccaggcgugguggcgcaugccuguaaucccagcuacuugggagacugaggcagggguaucucuugaaccugggagguggagguugcggugagcugagauugcgccacugcgcuccagccuggcgacacagcaagacucuaucucaaaaaaaaaaaagaaaaaagaaagaaaccuguacccuccacuuacucuguuagacaauugccaugcuauaaagcuuugacuaaacucuuaaaucauagaaauccacacagaaagagaccuaaaagauauuccagccgaggccaaccucugagcugaacacagccugcucgauugaguucagucugcagcauguggaacagaaacacugcccagcugagcccagucaaaccacagaauuaugggaaguaagaaaucacuguuuuaagccacuaagcuuugggguggucuguuagugaagcaauggugaauuccaacauccucagagcaccaucaucugccuucucuccaauaaccaaauaaucacccauccuucaaauuaguggacaagcaucaccucacagaguucuucucaacuacucugcuggccuggaguaccuccucuagcaucugacaugcuauauaacucaugcugacccucuugucuggugccuugaguuaucucuuacauaauuauuuuacuucuaguaauuacgaugguucccauugaagcacagaaaauggaacuugugcuuguuucuuguaaguuaaguguaacauauguguuuuaaaauauuccuccaaaauguaugagaaggcauccagguaaaaaauucaugcuacuucaugcaacccaccucaagugguucucaacccuggggguuaaauauaugagacaguguuuauuuagaccaggacuagggcuaaugaagcaaagcagacuuaagacuaaaaaucuggagccauggaaacaaagucuuaucaggauaaggguagacacuuugauuaaugaucggacucaaacagcuugagaauauaaacugaaggcucauuaguuauuaauaauuccaauuuaauuauaauuaaaaccaaauuuggaguuucuuuauuucaagggcucucaaaagcccaaccaucagccaaaaucuaucuucaauuagauaaugauuaggaacuuaauacagcaagaauuuuguuucacacugaaguugaauauuacuuuguuuuuuuaaaguuuauaugcagauucuugcucuaaauuagugaucuaaaccuuuuaaucauaggacccuacagaguaaacaaguuuggaguaaacauccaauccauagacauguuuuacuguaacacauaaugcacauuagaaaacaaaggacaaaacugaaacuugguacaaugagaaaaaauaaaaauaaaagugccaacauauucuuccaguacccuaaaguaucaccuugaauaucccuuuggggaguacaaaccccacuugguagauaacugcgcugguucaucaacugauaggggaaaaacccaaccacacucuuggucuucauguaauucugugaauaaaauuugaaauaaauauauuaaauaaauaaaguaauaccugcugguggaaaaguucuuccucaacaaccacuccagcugcuucuuccuccuccuccucuucuucagguaugguuguuuuaaagacuguacuucuuugagcaaccuccuaaaaacaauaguaguuuaaguuaaaaaacacacuuaaaaucaccaaaugcgggggagagggaccuuuucuuugcuuaagagacagcauuucuugccaggcgcaguggcucacaccuguaaucccagcacuuugggaggccaaggcaggcagaucacccgaggucaggaguuagagaccagccugaccaacauggugaaaccccgucucuacuaaaaauacaaaaauuagcuggccaugauggcacgugccuguaaucccagcuacucaggaggcugaggcagaagaauggcuugcauugagguugcagugagccgagaucacgccacugcacuccagugucacagcaagacugucucaaaaaagaaaaaaaaaagagacagcauuucuguuuauuauuauuacuauuauucaucccuuuuuuuggagacagagucucacucugucgcccaggcuggugugcaguggcaugaccucgguucacugaaaccuucacuucccagguucaagcgauucucaugccucagccaccccaguagcugggauuacaggcaugcaccaccacgugcggcuaauuuuuauacauuuuuaguagagaugggguuuugccacguuggccaggcuggucuugaacuccugguuucaagugauccacccaccucagccucccaaagugcugggauuacaggcaugagccuccacacuuggccccuguuuauuauuuuuaaagggguggggcggggggagcuguauaucaguaacuuucugguuacuaaacugaaauuuccgcauaauuaguagcaguucuuauaccuuccauauuuccugcaggggaggaaguacuauccaauucgaaauaucugcugagaaguuuccacugcuuuuuauccuauucuguuacuaagaauucuacaaauuauuugacauacuaaauucuuuauaaaacucaacaugaauucagcuuaaagaucuuagcuccuggcaaagauaaggugcuaaauaaaugcugaauaaaaugaagcuggaagccaacugugaucucagggacuaccagcaacaggaccaccugauaagugagaagaaaggacaagcuccuuucauuccuuucagcaacugauaccucuugaaugaaacaaaaucaagacagaugaacacuguacacuauuuaccaauaacguacuagugagguuccaauguauucuguacagaaauaggucuccuaucauucacuaaagguaugacagaaagcaacuauuuccauuuucuacuaaaaaggucaaauacagauuacuuuccuguggaaaaugcugacuuggcacaaaugcagcaguguuuuugcuuaagcacaaggcuaaccugaugaucuggcagcaaguaaaugaguguguccucaagagugcugcagagcauauaauuuuauucuguacccuguccuaaggucacucaagaaagagaaugcuacaggggaagacacaauauuacuucaguaaaagcuuaucuaacacagaccagcuaguuuacaauggcagagaaagaaaaucaaaacccagugucacagaaaugagacuucgauuugaaauaugcccaauaauguguuuuguaaauaaaguaagguggcagaacaguauuuuguggggauuuuuuauuacucuugcaggaccaaggaagauggaccauuuugagccucucaauuagccaguaacuucaauucugugaaauuggucuaucuuuacaaacagaaauagccauuucacaaauaucaguguuuuaaccaaauuaguaauaaaaaaaaugugauucuuuagaucaaccaccguucaagcuaucaacuaggagauagcagcauauaaagcagaaaaauaaauucuuaaaaaacuuugagaguacccagcuuuucucaacucaucuuaaaaugaggaacgagucaaauaaaaucuucuauaacaaaauuaccacauuccagcuucuagaagcucgugguauacaucccauaugcaaacauuggcucuuaaggcucaugauguagcuuaagacuauuagccucaaugagaaccucagaaaacagcaacuugccugucuucauuauuaugaauuaccuuaacauaacuacuuuaaguguaacccugcuguuaagcacucuucauuugaaaacaugcaaaaaccaauuaaucuaauacagaaagccguauaaaaaaugggugagcuaaugucuaaaaaucuagguagaaaaauaauaaauaauaauuuagaaccaaaaagcuguugggagguuuagaucaaggaaauuguuauuagucaagaugcuacuaaauaaauguguuuaccccaaguguccugaaagguucacauaaauagucuuacaugacaggcuuuacucugucuauaaaaugcagcauugguccgccccugcugcgagccuugggcauaugaaggugcacugaucugugcaguggugcccggagcuggcugcaccugcugaugcugcucaucacugcacagcucugugcucagucacauaaugcuggaagccuggcaucagccacaguaggaguauuuauaccacagaaauuagcaaaugcuacaaaucagggcgaucuuauguggacgaaagaugauuguuuauauuuuauauauugcaucucuacauauauaaguaaucauuugcauauacaaaaguuuccauuauaucuauauucuggaaaguuuggaaggacugcuuuauuuuuuauuucccucauaaaaaacaucuuguuuuugccauggugacaaucgcuguuuuuaaccacccagugcccccucccuccugaauaagagccccuagguuuaccuggguacacaccccccauggagcacacgugugucacaaggagcccagugcaauguggcuguagaggggaggaagaagucuugagcucuaauuccgcccucccaacuccaggaacugguuuagaggugggcacgugacccacccuaguccagugugagugaagcccaggaugggugccucacaggggaugaaguuuagcuucccuccauaauucaaacacucaauaucagauuauuuggugggcuggauuguccauucuuuuaacaaacuucuacugccuucugcuugcuaggcuguucugagagaguucugucaggaacgaggagagaaagugguaugaauacaggucuuauuucauuagacaguuacuuuugguauguauucauuuaauuggguaagaccauguuuaucugucaguaguaccggaccacguuagcaacaaucuauaaacuccaccauaaagagcacuuuuuugaaagaucaccuucccacaaaaagcaaauagaaaagacguaccucugggagcagccagcagcuauccugcguccccaagggaggcaaccagaagagaaacaacagacagauccccggggacaugcugugagccacuggauuagguccacuauuuaaauuuuuuauuaugugagcccaaaaaauuuccauuauuucuaagccaguuuaauuggguuuucugacauuuccaaugccccagcaagaagaaaaaaaaaaacauaagaaacaaaacugacuaagccaguuaccaacaaucuuacugcaaacuggucuuuauggcggggauuguuuauagauuguuccuaauguggucuggucccuacugacaaauauggucuuaucgaauuaaaugaauaaaugccaaaaguaacugucuagugaaauaagaccuguauucauaauacuuucucuccucauuucugacagaacucacuuaaaacagagccucgcaagcugaagguauuagaaguuuguuaaaagaauggaccaaccuuggccgggcaugguggcucacaccuguaaucccagcacuuugggaggccgaggugacggaucacaaggucaagagauugagaccauccuggccaauaugguaaaaccccaucucuacuaaaaauauaaaaauuagccagguguguuggcacgcaccuguaguuccagcuacucaggaggcugaggcaggaggcggagguugcagugagccgagaucgugcuaugccacuccacuccagccugggcaacagagugaaacuccuucaccaaaaaaaaaaaaaagaauggaccaaccaaccaaucaaucaaucaaauaaucuacuauucaauguuugaguuaugaaauggagcuaagcuucaguuagcuuuacuaauaugucaucaguaauacuaguaauacugucugaagaugcaucccaugucauaauaucuacuacuuuguucaugucacuguaucuauuuuuuggggcauuuaaaccuacugcuccauuccaaauauccuccuauaacauuguuucuaacuuggaacacacuuucacagagaaaaaaaaaaugacauaaauaaugacuagauuccauggcucacgaaaguccauuuaaucugccuuguaccccuuauaacagugcuuuucagucuuaucugagccaaucaccacucuuaacaauguuucacaagagacaugguuacagugagggauagacaggaagauggccaugaacagaacuuuuuauccaggcaccucagacucuuauaaugaaugcugcuauugcuuuauuucucugaacguaagucaagguccaugucugauuuuuuuuuaaaaaaugcauccaguaaaugcuuccugaauuccuguuaugugccaagcaugauaccaggaucuaccagaacaggcccuugcccucagugugcuuccucuagugagugagaacaaugugaugagcaccacgcagguuagaggccugcccguggcacuaugggagcagacaaaaaaccccuaaggggacggugugauuugacccgcugaccacuccuuucacagauacuuuccucccuuggcuuuccugacaucacacaccauuuuccucugacuucacuggcugcaucuucuacuuccuuugcucuuauuccuaaugucaauauuuucuagggcucaauucuggacccucuccugacaaacuuuacucagcgaguccuguaacuuuauuuauuuauuugagacacagucuugcucugucgcccaggcuggagugcaauggcgcaaucucagcucaucccgaguucaagcaauucuccugccucagcuuccugaguagccuggacuacaggcacgugccaccaugcccggcuaauucuuguguuuuuaguagagacgggguuucaccauguuggccacgcuggucucuaacuccugaccucaggugauccacccaccuucggccucccaaagugcugggauuacaggcaugagccacugcgcugggccugauaccacaguuuaucuuuauuaccuuuaucagaaaaucacuuuaucuuauucccuggcucccuuacucucuuuacaaugugggcuccaugaugccagaaaccacguauggcuuuuuuccugcuuauuccuaacacaaaguggcuggcauacagcagauacucaggauuuuccaaauaaaugaauagcccugcacuuguaaauaugguuagcuucccuaccagguuugccagccuaacauucccccuauauaucuccuuucagcaccacucagacugaaaugcauacccagucagguuguaagguacaaacagcagagccugccagccuggaaacugggugaaaaggucagaaucaguaagcaugucagaacaagguuaugaccaauggcuuccuugcaagccaacuuacagcucuccugguaggcaaaggaugaaaaagcaguauuacaacuaaaaggaaaaugagaagaacaaaccaugcugaacucacaacaaaagcuccauuaacaugcuuauggcaauagcaacaaaggagggacucaaauucuaaacagaggcucagugaugcgugguacagcaccuggauaaggugauucgcuagggaaagacaaggaggaagccauguuuuacuagcuucaaagcacacuuuagccgcuuuauuaggaaguaguauuucuaagacuaguauugguagggguauaugcagugucuuuauguggcaauggggaagguaagguacuuugacaaggauucuaagacugacacacugaaaacacacacuccaagaagauguacacuccacaaucuucaaacucacaguuucaugaacauucugagagcuaguaacaagguuaauaauuuaagcauuuacuagauaaagguacuaugccagauacuauuccaagcauuucccaaguacugucucauucuuauuauuagcucauggauauugugucauuaauauccauuuuuaaaugacaaaucuaagagaggugaaguaacuugcccaaagucacaaagcuaaugugcagugaaaacagaaacaggacacagaaaaucuguucuggagccugugcuaauaaucaguacucuauaauacacuccuauuuauuccuaaaacuuaaagacagcuucaguucaauuaacuuagcagcuuuggucuguuuaugcaaucgguuauugcacguuucaaucugaucuugauuauacuugcacagugaacuuuaagugaaauuaacauuguggugguccugauaaacuggccauaccucucccugagaauuuuucaauauaaccuucacaucuucgccagugccccacgaguucugguucuuccagaugaggucaguuggggggcuggcugugacaccagcguuugcagcccaaaucuguaaaaaaccaaagcaugucaguacacccagaacccaguucucccacacgccaacgacagcaaugcgaugagacucaaacacuugauucuaaaagucugagaacuaugccccagcuacagagugcuauacacagcuauguggccaggagaacucacagagcuucucaaggccucagcuuccccaucugauaagugaagaugauaauauauaagacccugaaguaaaacugccuacacucacauccuaguuccuuuacacaccagcugacccugagcaaguuaccuuacuuuagucauccauaaaacaggguagaaauggcaccuguaacaggugcgauuauugaaaagagcaagugauaacccacauucaguggcuggcuaacucagugaaugguagccucagcguucuauuacucuguggguuuuauaggccauccuuccauguuagagccuucugugacucccucuaauaauguucucuggcugccuacagcaagaacuaaagagaccuucugcagcagagagccuaucuagaauaaucuuauggaaacugguacgucuccaaacagacaaugucacaauacccuagaguaucugagacugcgcuccaaaaagaaugcuggaaauguauaaaucacucgcuguucaagggaaaauauaauugcuauugaaauaggucaaagaaauaauuauauuucccuucucaugagcaugaaauucuuuuuauauaucuacuggcaaaagagaauggauagagugaagaacaccuggcagucagaaagccuagguuugaauucuggacaaaucacuacaccucuaggaaacucaaugccuuuagcuacagggauacuacuagcccugaucucuuagaaagaucauuuaaaaacaaauagaaacagaaaaguuuguaauccauacauuguuauagaauauaaaagacuuuaugacugcaaaaggaaagcugaagauggcaaagccaaguauuauuucaaaaugggggccagguguaguggcuccagccuguaaucacagcacuuugggaggccgaggcgggcagaucacuugagcuaaggaguuuaaaaccagccugggcaaaauggugaaauccugucucuaucaaaaaaaagaaagggugggggggugggguggaaacaggaaaaaaaaaaucuaugaauuacugauuaggagagagcccuuacuuuugagauguuccccugaagcauccagaucuuucaucagcauuacaaauggaaaagggcacaagauauuaacugggauuaaacugaaaaaaagaacugaaucugguccaacauucagacuauguggaauguuaguguuucccuaauuguaagcaauauuucucacuagccuauauguaaucacauaguugauuuauguuaguaaucaucaucauaaaaugucaguauccuugcuggcuaacuuaaccuaaaacuaauauguccuauagccaugucauucaauaccgcagcaaaauguggcuuguuagcacuuaaaauauggcuagucugaaaugaaugugcuguaaggguaaaauacacacuagauuuugaagacuuagcuaaacauaaaaaaaaaagaauguaaaaauaucugacuuuuuagacugauuacauguuaaagcaauauuuuggauauauuggguuucauaaaauauaguucuaaaauucaugucuuucuuuuuuacuuuaaugcggcuauaagaaaauuuaaaauuacacaugugguucucauauuucuauucuagaguuuuaaacugaucuuugcuuuugccucugcaauuuuacagaaagaucacuuauuacuaccauguuccaaagagcugcuuaucacauuuaaugccaguaacugaagggaaaaaaguaucacauuauuuuauaugauaauugaguuauccacuagaucucuagaauccauguauuuagucccugagguaguauacccaguagaaaaagcacaugauuggcauaaggcuuccauauuacuucugagauagagagcacacucaauucugaauccucugaacuaaaaugucagauucuuuuuaccacauuauacagcuuccauaagacauauaauagcaauugcuauagugagcaauuuuuucucacuauaguaauuacuaacgagaagaaaggauauuguaguuaggauaguugaucccauuuuuacccauuauuaccaaauuagcauuugauauuuucacaaaguggcaucaugcucucugaauacaccuuuuuaaagagaagucugagccuuugaucuucaacaguaagguuuguaucaacauaaaauuauaaacacauuuaaaacaugcguuuaauauuuuuuaaagaauauauaaaaggaaagagacagucaccucuacauucuuuuaggaugaaaagagugacuucuuugaaaucuguaucaaaguuaacauauuuuauuguuagcuaaaucuaccuacuaaguaaaagcaaaagaaucuuugauuacucaaugaaacauacuucucuaaaaaguaagcuaauaauaauucaguaacuauuaaagauguaguauuucagaacauaccaauagagagccauuuagaaaucaagacacagaaugccaauuagugaaaauuuacaagggugccuauaaucuaaggacuuuuauucaaaaccuaggcuccuaccccaacccuaaagauagcaaagggugaaguagggccugaacaccaaaauacuacccaaaugauucugaagcucacccaaggcuagagauugcuguuuuaggcauauguuaaugcuaaauucuuaacaguucuuuaugccaagcagugucuccugaaugacacugggcuauaaguaucagccuagagauagcuuuuauaucuacuggaauagacaagauaaaaauaauucaaagguccauucuucacuacucucaauaagacagaauuuuaaaaaucuuuuauagcacuuguaaugcccuaauaauauaaaaaguacuuuaacggccauuucuaaaaugcuucucuuuuagccaaaaaacuuuuugaguuacuuuguuaguuaacacaaugaaguuaaauuaaaugaugacuagauucacuuacuguaacagucuggccugccuucagcacauaucuugagguauauuuauaacugacugaugugucuccaauuuuucugaucaucucccagccucccauugguugauccuacacacagaaaggagggugagggguguuacuucaaagauaaagaaaguuguggaauaaucaaauaaauuaauccauacaggcaguuaaacuaagaccgcuuuauggucaucuucccacauuucagguuuuccuacuauaaaaagaaaacacgauucugucauuuugucaaacaguaacuucaacaaugaguuaauuaguaagguacuugacuuuaaagaggacagaacuggaagaacaggguaugaaccaaauuaaauggucaaauucacugcuagauaaggugggucuuucaaauuuacagcacuaucuagcugucauaaucacaauuuuuaaacaucaaguauuggauuacuucaagcuuuuaaaauagacacauaagcuuagaaacagaagaaaaucugucauuuuccuucugcaucugucccacuucugcccacauucagcucucauacaugaaagcauaaggggcucaaaaaaagggucaguggggcugggcaugguggcccaugccuguaaucccagcacuuuaggaggccaaggcggguggaucaccugaggucaggaguuggagaccagccuggccaacauggugaagcccuguguaaaaauacaaaaaucagcaggcgugcuugcgugcaccuguaaucccagcuacucaggaggcugaggcaggagaaucucuugaacccaagagguggaggagccaagaucaugccacugcacuccgaccugggcaacagagcaagacucaaaaaaaaaaaaaaggcuacaaagagaccuuagagccuauucucuuuagcauuaaaacuguuggugcucauuagugcuccuucacucauccaaauuacauauucauccacaugcaagauaguuuuaauaacuguggugagaaaagacuaauuuucaaaacuacuuuuagcaggcccugaacauauguuucaagaugugacauccaucccacugccgccugcacgcucccagaccaugccuuccucuaguaucaucucacaacccaucauggccuccagcuccuugaugcagagcuagggaaggcccacacuacagagcucccgaaagccccagcccuaaauuucagaaaucucugcuaugaauacuucauguuuacuuuuaaacauauuucaaaauaaggcuucaugcuauuuuucauguaaaguauuagcauuuguucauucauuuauuugcagggaaaaauauucccuuaauaucugaguccaggcucuuaucuccuucuuucaguaagcuuuuuauuaaguuaaugaccgaaagaauauccaccauuuucauccaauugcuccaacuucuucacaaauuuggcuagggcagagaauaauaauaacucauccucagaaccacugugauaaaaggaacaugcuuuucaaaaaagcccuggcccucuaaagaaggguuaaugaagcaaaucuuuaaacuacuaaggguaccuaacucuuccuccuccuauuuuaauuuuuauuuuauuuuaugaauuuaaguaaaaaggacauaaacccuuauuccaugaagacguaaugaauccaaacaaaaacuaaggagcuaugacaauugcaagagaaucuagcaauccacaaagccuugcuagaaaaaaaagggucuauuuuauuaccuguucagaaguguucuucaagcggauaaauuucccaucaacaucaauuucuucgaugcaaacauuuccaguggcugaggcggaaugagagaugcuaacacuacuacucgccucugauucuuccacaucaacccucuuccgcuuuccucuaguuguacguacacuacgacuugaggaugcucgggauacugucacacgggaagaagggcuuggagacagcuucaaccuauaugggaaaaauaaaacaauucauuuuuaaaacacauaugcccuucucgccuuaaaaaaaaaaaaaacaaaaaaacaagggcugggcacagaggcucaugucuguaacccaacagcacuuugggaggccaaggcagguggauugcuugaggucaggaguucaagaucagccugaccaacauggugaaaccccgucucuacuaaaaauacaaaaauuagccaggcgugguggugggcgccuguaauacuagcuacucaggaggcugaggcaggagaauggcuugaacccgggaggcagaggcugcagugagcugagaucacaccacugcacucuagccugggugacagagugaaaaccugucucaaaauaauaauaauaagaagaagaauaucccacccaugcauuucuaaagcaaaauauuacuuacaaucuguuagccaaagccaaaguuuaccuuaacuaauguaaacuucuucauaaggugcccaucgucaauuuucuuuuuuaaaaaauaacaaucugaauguuuucucuagggauggaaguaauauaaccauaaugcaagaagucugguaaauggguagaaagucaucugaucuaccaccacccaccacagccacuguuauaguugguguacuuuuuucucuuuucguaccuguacuuucuuaugaucacaacggauauaauauuaaaauuaucuggcuuuuuauccuaaaucagccacuuuccuuuuggaacuuuuuuuuucuuuuucuuuuuuuugugagacagaguuucacucuugucacccaggcuggagugcaauggcacaaucuuggcucacugcaaacuccaccucccagguucaagcaauucugucucagccucccaaguagcugggauuacaggugccugccaccaugcccagcuaauuuuuguauuuucauuagagacggaguuucaccauguugaccaggcuggucuugaacuccugaccucaugugauccgccugccuuggccucccaaagugccgggauuacaggcaugaggcaaugcaccuggcccuuuuggaacucuuuucugagaacaggugucaaaaauauuuauacauugaccagauuuaaaauauauauaaagccagccgggcgugguggcucacaccuguaauccuagcacuuugggaggcugaggcgggugggucacuugcagucaggaguuugagaccagccuggccaacauggugaaaccucuucucuacuaaaaacaaaauuagccggguguggugacacacgccuguaaucccaguuacucaggaggcugagguaggcaaaucgcuugaaaccaggaggugaagguugcagugagccgagaaucacaccacugcacucuagccugggcaacaggcugagacucugucucaaaaauaaauaaauaaauaaauaaauaaauaaauaaauaaauaaauaauauguaaagucucuuucagccaguuuggcauuuuacaauauauuaaaucaccaaaacacuuaaaaucucaaaggaacuaauccauccugaugcaguucagcauuuaaaguaauaauaauaaauaaacuaagaguacuugagcaacauuuucugcgaugagguagaaauaugaucuauuacuacuucuauaccuagguguucaaagaaaugaccaagaaaauaaaguucuuuuuaaaaugcuauuuauuuuuauuucaauaaaaagggugagaggcaaaaaguggaccauaagguagggugacccuuaaguuccuuaccucucuucuucgccuucuaagaguuuccuguaagcacugauuuccauguccagggcuaacuuuacaucaagaagcuguucauagucauucagcuguugcugcauuugaucccuuauuuccgccaucucucucucuuugucugucagcaugcgacgagaguugucuuuuucuuuagcaagcaaguccucuaauucuugaauccuuuccaaacaugcucuagacuuaagaugcaaggaaacauauuuacuuucuaggaacauuccaacauuagcaccaggcagcuauuuuaaaucauuuccuagacuggaaaacaguacaacccuauggaaucucuaacucacuagaauucaagagauuuuaagaaauuaaaacccaaaauuccucaaauacaaaacacagaccucaggauaguuuuggcugauaaaagaauaaaagacauauuccacaaauguaaguucuguaaauauacauauaauuuuucuguacuuagccaaaaaaauguuaagaugugguuuugguaaaagucaagucuggcucccuuacaaagccuuuacuuccaaaaguauaaauuaaauaaagaacuuaaaaagauaagaacacugggugggugugguggcuuacgccuguaaucccaacacuuugggaggccggggcagguggaucaccugaggucaggaguuugagaccagccugacuaacauggcgaaaccccgucucuacuaaaaauacaaaaaaaauuagcagguuguaguggugggcgccuguaaucccagcuacuugggaggcugaggcaggacaaucgcuugaaccccggaggcagagguugcagugagccaagaucacgccauugcacuccaaccugggcaacagagcgagacucugucucaaaaaaaaaaaaaaaaagauauaaacacugacugacaaaauaaaccuaagaguggguaaaaguacguuuuagcagacugcugaggaauauucagaaaccaaggcaaagggacucugguuacuauguggaaggcacuaccuagugucccuuuaggauugcugggcuaucucauguucaguuagcacacaaaggacacacaauauagggugauuuguaaaguauuacugugaauauagaagcuguauauuuggcauaaaaaaauuaaaaaucacacauccuacaccagaaaguucaucuuagaaaccuuguggcucgcuggguaauuauucuucuguguuucuccaugacagaauucaucucaguagccucagaaagugacaacucaaaaagacugauggauagcuuaggcccucagaaucacaaguaccugcaacagagcaggagagaaagggcaucuaaugugcaaaaacuaaaucuagaaggcuagagauaaaaaggagcuaccaaauacauaaaaacuguacucuugcugguaaauuuacuuuucacagcaguacagguucaaaauuuugaaacugcuuuaacauauacuggggcugaacagauaaguaaauggaugauaaaaaccagguuucucacucugagagagaaaagauacagguaugucagaaaggaagccaaaauugaaugcuguccuacuagauucaagucagagacaucuguaugaauucauguuuaucuuaacacaaaugauuagacagaaaaaguuauaaauaugugcauacacauggguuagcauacauaaaauguuacccacuuuuaucggugagagggccaagaagcagugauacccaguaccagugagcacacucagugcccagaucuuaauuucuauauaccauucuccaauaacaagaaccagggcuccuuggagacuggauaauucuaggacuggggcagggaaaaugcaagaugagccuagagcauguuauaguaccagaaagcaacaaagugcucaaaaaacaaugggacauaguggccaagcugacagaacucccaguggccaaauaugaaacaauuuaagccaaaaaaguaaauacugcaguauuagcuuacaacccaaaguauaaaguaaaugcccaugguccauacggacacaaacaaacaaacaaacaaaccaaacaaacggggaauggauaaaucguuacagaagaaugccauuuaauaaauguagauuucccuccagaauguggcgcuuaaguccugcccuguccuucacccuugaggguaggcuggacuuagugagcuguuuuccaugaacaguguaugggaacggaaaaauaguagcgcuguugacaguggagaaaccugacaaacacuaucuuaaaccaaacaccaccagugaugucaugugguuaucacauacgugcaaucccugauacgaugugacaaaacgggcacuuaaaacccaaaaccccagucuaaucacgugaaaagcaccggacaaauccaaauugggggacagucuacaggauaccuggacaaucuuacucaagacucaagcucauaaaaaacaaggaaagcccaagaaacugucacagaccaggggaggcauguggcaccuggaacagaaagaagauaacagaagaacuggugaaauccaaauagucuggagacgaguucacaguaauauaccaaugucaguuucuuaguuuugacaaauauacuaugguaacauaagaugcuaacaacaggggaaaaugggugagaggaaaacaagaacugucuauaguacuuugccaacuuuucuguaaaucuaaaauuaugccaaaauaacaagguuauuuaaaaaauaaucaagagucacuguaaaccuauuugggggcagagggggugccugguucacacgcacacacaaaaauauauuuuuaaagaaaaaaaauugaccaaucaauuaauuaaauuccagaguaguauaugacuugacaugcuauuuagacaggcacuccucuuaagauggauauuacaaagguagucccugaaccucagagaacuugcauuuaacugcguuugcaaaaaucaugcuauaaauggagaaauccauuuccccgcuaccauguuccuuguauuuucuuuuucuccaaaagaaaaaaaaaaagucauguaaguucaaaaugccucccuuuauuucauauaucagagguagaagauauauuugaaugggcaaaaagguagaaucuaaaggagaguugaugagagauauaaacuacccaagauucacagauaaccugagccgagauuuauaaacccaaugaugucucuguuugacugccuuugauguuguagagcucuuuaagagggaaaaaucaaaaucuagguauaaaaauuuuaaaguuacucugaaucauucuguauuuuaaauagaaauauuuaaauucuauuuucaguagcugcacuuacaccuguguagugaaauauaaggaacacaguaugagaaguuagaccuagauucuccuuucuaauucugccauugaaacuaccuaugaggcuauaagcaagcuguaacuaaucucacuaaaccaguuuccacauaaggaaaaugaagagcucuaacuaucuagaugaucucucagaucuugccacuaacccuaaauuuuaugacuucugaugaucuugggguuuuuaaauauuuuauaguauguaauguaauuguacugguuuauuaaggucuagcugcaaccaaagucuccagaaucuggguguuagaaaaacaaaaguuagagguguuuuuaaguaccauacuguacucuucucuaaggcaagcagacucuaaccaaccaauucauuuggucccaagucaaaaaucuagagaugcuauaagcaauguaaaauuucuaauuccaaaacauaacacugcuaccaucuauauauuauuuaaauauaucuuguaaaaccaguauuuuaaagccaugucaauuuuaaguaaaauuuaagaaguacuucacuaaccugaguuauuuaaccaaaaggaaauucuuauggccuaauaggcagcaugaugaaacugauaugacucagcaacaaacacuauuaagacaaacaauaggaaaauauucaaaaagauaacauuuuuauuuuugaugauuuuucuaaggcuaaaauuuaucaacuaauaaaaauauuccucaaaauauacuguuuaccauaaagucuguuaccaauaaugaacagaggaaagauucaccccagagaaauuaaaaacuauuuuggcuaaagggauugcucgucuccuaucugcuaaggaguuagcuccuggaaacccccagugcacugccuaacauuacuuaaaaaccacuaagauaagguuaacaaaaaaaacuugcagccaggcacaguggcuuacaccuguaaucccagcauuuaaggcagcagcucacgccuguaaucccuuccauuuugggaggccaagguaggcagaguaccugaagucaggaguuugaaaccaaccuggcuaacauggugcaccccauuucuacuaaaaauacaaagaauuagcugggcgugguagcgcgugccuguaaucccagcuacucaggaggcugaggcaggagaaucacuugaaccugggaagcagaaguugcagugagcugagauagugccauugcacuccagcuugggcaacaaaagcaaaauucugucucaaaaaaaaaaaaaaaccaacuugcaaaaaugggaauucaauuaacagggaaacagccuugaaccuagguuagaacacauagcuacuaaguuucagagcccacuacuacuuauuaauaacagucuccucauccaaagcacagugaagaucaaccucaagagaagaucuguacuaaguaaaucaaauggauuaggcagcagccaaaaaaauaauaauacaguaggaaaaaauaaaauugagggauagacaguaacuaguagacaacuuacuauuaguaaauggaaaagaguaguaaaugccaacucaguacaagaacagagaggcccauuuuuggaaaaguaccuguuaagacaguugauauaggccaggugcaguggcucacgccuauaaucccaacacuuugggaggcugaggcgggcggaucaccuaaggucaggaguucaagaccggccugaccaacauggagaaacccugucucuaccaaaaauacaaaauuagcagggugugguggugcaugccgguaaucccagcuacuagggaagcuaaggcaggggaauugcuuaaaccugggaggcggagguugcagugagccgagauugcgccauugcacuacagccugggcaacaagaacgaaauucugucucagaagaaaaaaaaacaacaagaaaaacaaagacagugauacagucuguguguuuguguucccacaaauuucauguuuaaauccuaacccucaaggugaugauauuaagagguagggccuuugagugguaauuagaucaugagaggaaagcccuagugaaugggauucaugcccuuauaauauagggccaagggugcucauucacccuuuaaccaugugaggacacagcaagaaggcaccaucuauaaaucggggaacagcccucaccaggcagauauccaaucugccagugccuugaucuuggacuucccagccuccaaaacugugagaaauaauuucugacauaucuguuguuuauaagcuaccaagucaauaguaguuuguuauagcagcccaaaaggacuaagacagauggugcaauggaaaaaaagauuaucuguuaaauuucuaaaaguaaaucuucuuugaagaaaaugaguuauaaaaggaaaaacugggaaggaguagagaaacccauuuaucagucugcagccucugggcaacgggcaaaucauuaaacucaccuagaucugugguuacauggaaugaacucagaggugcuuccagcucugcuauuaaaugaaaaucuucaaaacacuaucagcacaaaauagguuuaaaauaauuuaaaaauuugugccguaaguaacaaagcacaugauagacaguguaaaagccccuguguuaacuaaauuauuuuauaucaccccauuuuaugggacucauuuucugcuuuauuucuaaguuccugcaacagaggucaucaguuuuauaauuagaaaaauauuuuacuaaaaaugguaaaaagaaaaaggaaggaagaaaagcccaaucaagaguaaaauaggcugggcacgguggcucacgccuguaaucccagcacucugggaagccgaggcggguggaucaugaggucaggagaucgagaccauccuggcuaacacggugaaaccccgucucuacuaaaaauacaaaaauuagccgggcgugguggcacgcacuuguagucccagcuacuugggaggcugaggcaggagaauggcgugaacccgggaggcggagcucacagugagccgagaucguaccacugcacuccagccugggcgacagagugagacuccaucucaaaaagaaaaaaaaaaaaaaaaaaaaaaaaguaaaauaaaguuuauucucauguggaaaauucaaaacaagauuuccucccuugaggaaaauagaagcggaaguuauuuccaaaauaauuaaggugacgaguuaauugcugaaucauucugaaugcaguauauggaguauauguacuuuguguccacacugacaucacccuaggcuaaaacugaucugaaguaguguccaugccugcuuaagcagcaccugaagcacaccaucacacccugauaggcagccagucaacacagccggcaauaaugccauuugucacuuaggcguaccaacgaaugaaugagucacuaaauucuuaucggaauaugcaaauuaaagcuacuuuccuggauccuaauuguuauauacuuuaagcacuaaagaauuugucuagaaacacaaagcauucaccacccacaaagaauuuuugcauguuuuucuucauuuugguuuucaaaugauauaaaaaaggaagguguugagaauaacucuguagagaugaagcuguuagacaggucggaagauccggguccuaggguaaguacagugaauaaacuagcaggcuccuuccucaagggcaagucccuuagcucuguguaaucuacuaauuaggaacaauaguaucugcucacaggauguuuaugcaaugcaaaaugaacgaaucuagaaaaguacugugaagacgaaagcacaggaugacaccauccucuguaacaaacagagggaggagugacaucagcccaagcaaagcagguaggugcccguggugaagguagccuucaagucuaacuucuuacagaaagaugauuauuuaccucuuucuguagauuagaaagcugggaugaaaggcucucaauucucaugcggcuuuccaucaguucuucccuggcacuguugacaguagaaguauucaucucugaugacagucuggcauucucaagcuaaaagaagaagcaaagcauagucagucuuaucuagaacugaaacaaaaaaggaagcaugauucaccucaaggcauuucaaaccuaaguccugcugguaacugguagaugaaacacaggaaaagcaucaugaaguuugcugauauggugugaaugaugguaauucugugugacuuuuagagucacuuccuaaauaaugagcuuuaagaaugcuaauauaccuaggccuuuacccaaagcuuauuacuucaauauuucaucuauuaaaccuuuaaugucuaagauaacacugauaauaagaagacugggcaauagcaacuugacugugguggugucuguaagaaaagaaacaucacauaucccuaacccaccaaauccaauacagaauguaaaccaacaagcagaaaauacuaguuuauagauucguucaaaccagauagaaacacuuccuuucagaagcaaaaaaaacuccuugaguaaaauacaaaucccauaacacuauuguguaugugugucucagggacaugcuccugugucuccucccuggcucccugugaggccacagucugugacggauccuuacuuuagcuccuucacuguauagcucaaugugugauauuagauaaauguuauacaacugaaguuacugcuuauaauaagaucuuucacuuucacuaacugcuacuucauacaauagauaaaaagcaacaugaacaguuuaaagccaugcaaugaaaauuuucaauaacucugugacucuaauauucuaagucaaccacaaaaaagucuuuuuaaucaaaucauguaacauuuaaaacacaaggcaaaaucauuuaccagggaaagccuguacuaguuggugauuuuuaugaauucuuguaaggucagcuaauauaagugggaaguuucuacaauauuuuuuuaagugaauaauagugacagaagaagaaauagcagagacuuuccauuuggcccuuaugcaaaaaagccggaagugugguagucacaaucuaugcacaaugaugacaugaaagugagaucuaaugcagucugacauucauucauuacuaaauggauguuuauguaggacagcaugaucaguacuuguuauuggaagaaaguuauuucacaugguuuggguucaacuacuauggcauaguacgaaugaucaaugggacaaaaagacaaaaccuaaccucuaauaaaauugcaacaacccuacauucuucuaguaauuuuuaauaacauuuaguuuauagaaaacugcacuuuuuugaaaaaaucaauuuucuauauauuucauggagacuaggggaaucauuuuuaaaaacuagaacaaaauaaacauaaagccauguucaucaugggaauugugaaguaaugauuuuaaguguucaaaagaaucuucugaagagagcucacuuuggcaugguaagucugcuccagcuccuccuuauacagccucacuugggcaucauguugcucucucaucucaugaagggcuugcgccagcuuguacucauacucaauuugacgcccagaauccaccucuaccaagcgcguuucaugcuuccuucuggucucguuaaucuccuggggaaaaaacaaaaagcauaaagccaagcuacuuaccauggcugcauugguacacaucugagugacaucacagccaucugaaguuuuacacacgaacuuccuccuguuuguccucaggcggucaugugaauaaacacuuuuuugccucuuaguuuucaguugagguuuuugaaauggaacuaaugacagaagugguagcaucucaagccuuaggaacuuucuauuccuuuucaggagcauagcuauuuauuuuucugaagccaaggaaaggccuggauggccuacuaaaacuaucugcaaucaaggauuuauacacaguauacuauacuaaacacuaagcaaaaauuauuuuucugaauuguuucauugauaaucuuaagaacaucucugaaaaaacagcacauggaaaguuaaacuuaacaguugugauaaauucauguaaagauuuaugugaaaugaaacuauuuucuuuucuuuucuuuucuuuucugagauagaguaucacucugucgcccaggcuguugugcaaugguaugaucucagcucacuacaaccuccgccucccggguucaagcaauucuccugcaucagccucccuaguaacugggauuacaggcacauaccaccaugcccagcuaauuuuuguauuuuuaguagagaugagauuuccccauguuggccagacuggucucaaacuccugaccucaggugauccaucugccucagccacucaaguugcugggauuacaggugugaaccaccuugcccagccauaaaaccauuuucuuagacauaauaauaggcagcacaagcuaauuuacaugacuucuuuaaaagccgguauuaagcuaucauuaucaagugacacaggaucuuauuaacaauauuaguugacuaacucaaauauuuaugaaaaauuuaccauugaagaauagaaguaguugucaugauccuuuccuuuacucuguuuuaaggaagugucuaaauaaaauuagaauggaaggcugggcgcgguggcucacgccuguaauccuagcacuuugggaggccaaggcaaucagaucaccugaggugaggaguucaagaccagccuggccaauaugguaaaacccugucucuacuaaaauacaaaaauuagucagccaugauggagggugccuguaaucccagcuacucaggaggcugagaugggagaaucacuugaaccugggagacggugguugcagugagccaagaucgcaccacugcauuccagccugggcagcugagcuggacuccgucucaaaaaaaaaaaaauaauaauuagaaugguaauaucugaagaagccacaagagggaaguauaacccaccaaaguugcuguuuguguauauuagcgcauguauuuuccuuugcauuucuucaucuuucucuuaacuacuacacaggagcaugcacuugacaaaaucugaaaaaucagaaaaaucaggaggauucugcuaucaccuucccagagaucacaucuauuucaugaagcaaauaauaccuaaaucacaaaaauacugaagagugacugcuaaugguuuguucuuugucuaccuccuccuuccucuuucgucuuucuccuuccuuuuuucccccaacuguucauaauaaggaaguuagauauuauuacugaauauauaucaugaauguaaaaaaaaaaaguuaaggccagcguaguggcucacaccuguaaucccagcacuuugggaggcugaggcgaguggcucaccugaggccaggaguuuuagaccagccuggccaacaugguauuacuuaguaaaaaguaaggaaaaaaaaaaaaaguuagccaguugugagggugugaaccuguaaucccagcuacucgugaggcugaggcacaagaaucauuugaauccaggaggcacagguugcagugagccaagaccguaccacugcacaccagccugggcaacagagugagacucugucucacacaaaaaaauuuuuuuuaaaguaaaaaaggccaggugcgguggcucacaacuauaaucccagcacuuugggaggccgaggcagauggagcacuugaguucaggaguucgagaccagccuggccaauguggugaaacccugucucuacuaaaaauacaaaacuuagccgggcaugguggcacaugccuguagacccaguuacuccagaggcugaagcagaagaaucgcuugaacccaggagguggagguugcagugagccaagaucguacuacugcacuccagccugggcgagagagcaggacucugucuccaaaaagaguuaaaaaaaacaaaaacaaaaacaaaacugaagaggacuaucuuaacauccauucucaaaaaggcaaaggccaaaaauucaaagaugcuaugcacucuaaaaauauuaaauuacuuuuuacugaugcuauuuuuuauauagaaccagugaccuuacaaagaaaaaaaacccuacuccugguugucuacacacaacaucagaaauaaguaaugauaaaucacaauuuuuacaaaacaaaacaaaaauguaagucaaccucauaucaaaauaucugcuuuaacaaagcaacacuuaguaacaauuauaugacagcacuugcuacaguauccaaagaguuuucacacacaguauuccacuuugauccuuaccacucauugaagaaaaaaauagcaguauuaguauuucauuuuaaauaagaaacugacacuaagaguuguccaaggucugacugcuugucuggugcaccuugcacuaauaucuauuuuguuuaaagccuguaauuuuaaaaaauaaucagauuucuauuauuuuuccuccaacuaaaaaacugguuugcuaacugcuacaaugaauuccuauuugcacuguuuucaaaauuacacuacuucuaaaaacauuaagccuagcacauuaacagcauguucucccccaugaguugauuucaacccucuacaauuuucaugaaauauacauuccccuuuccucaauuuuauuacuuccuuuguuugacaacgguuuugccccugccccuugaccacagcaguuaaggcuuauaagugauauuuuaagauuuccacaugagugagccgggcacgguggcucacgccuguaaucccagcacuuugggaggcugaggcgggccaaucacaaggucaggagauugagaccauccuggcuaacacgguggaaccucgucucuauuaaaaauacaaaaaauuagcagggcgugggugcaugcgccuguagucccagcuacuaggggggcuaaggcaggagaauagcuugaacccaggaggcagagguugcagugagccaagaucaugccacugcauuccagccugggcgacagagcgggucucgugucucaaaaaaaaaaaaauuuacacgccuauaaaugcugugaguagccgcauuuccagaugugagccauaggagaaggccaaagugaugguauguaaccucugugauuagguuauagaagacaaucuggcuucugccuugguagcugguagcauguauucauguucucguuguguuucuuucucucucucucucucuuucucaucacugacccuuaggggggccauaucaugagcagcccuaugaagaagaccaugaggugaggaacugacacguccugcccacagcccugugaaagagcucagaugccauuccuccagcccagguuaaaagcuguacugcaaccucaugggaccaagaaacagaaccacccaguuuagcagcucugaauucugaccuucaggaacuaagaaauuaauacaagucugugguuuuagguugaugaacuuuggaaguaauuuguuaggcaggaauagauaacuaaugcuuaaacauguugacaguaauuagcugcugugaccaagccuuuauaaguuaagaugaagugaggccggaugugguggcucacaccuguaaucccagcacuuugggaggccaaggugggcggaucacgaggucaggagaucgagaccacccuggccaauauggugaaaucccgucucuacuaagaauacaaaaauuagcugggcgugguggcgcacgccuguaguuccagcuacucgggaggcugaggcaggagaacugcuugaacccaggaggcagagguugaaaggagccgagaucgugccacuguacuccagccuggcggcagagcaagacuccgucucaaaaaaacaaaaacaaaaaaacaaaaauaaguaagaugaagugaaaucauaucuguuuacgguaacagcuugaguucucaaaugcggucuuuuagcagcaguagcuugaauaaucuaccugcaaaauuucuccccauccccaaaccuuauuauuucuuuaucugauauauuuuuguggcaaagaaaucauaaauaaaauauaauuacauguuuagcuaugacaaagucauucuagaaccccuccauuccuuuacaaagcaaaauuauauauaguuaccucuucauacaugcuuuugcgaaacuccaaguccucaguaaggcucugacaacgauucuccaaaucuacuuuaaguaaaguuucaucugcuaacuguuuuuuggcugcagcuaaggaggcuuccaacuauuacaaggaaaaagaauugugauaaaaauuacauggcaaucauuuaauaaugaacauaagauaucuaugaaucaaaucaaaucaaguguuaaaauuccuauauauuuaucaauguauaauuacuucaucuuaacauuuaucacagaacuggguauucauuugcuggucccacccacagaguaucauaccaaacgaccagucaaauuguuaauuggcaacagggaauagaacagagacguaugacucacucacauuucaaaaaucaaacuaguuauuuuagcuaaccacuuucauuuuuuccuguguggagagcagcauuuuggcaucucuuuucuuacuuauuuccuaacuaacaaaauaggcuuugagagcagagacagaaugagugugugcacaauagggaagaagaagggaaccacaagaucuggccaauccagauauaaugccugggaggugauaauguuuugcauguuagcuaccucaagacuuuucuucaaguaaaccaucagaaaacaaauauauaaaauuucaaaaauaaaauacauuugaaaaucaaucaaucaaucaaacuauggcuuaaggcagaugaggcaauuaaccugucacauacggcucaagaguaggcuugaccuuaccugggcaaucugauccuucagauccuccaaaucucccucuaaacuuuuuuugucaccaagugcaguagcaagagcugcaucuuucgaauucagugcugcuucauauucucgaagcuugaucugggcgccauuaagaucagauuccuucuuagcauagcuggaacagauuuaaaaagcauaagacaucaaaccauacugaugacuugaggucuucucccucucugcugaagggacaaacaaaagaaguaguuuaaauaaaggcucccaucaccuaucaaaauuagagaagcaauucacaagcacuggaucuagaguuuuuguuggcuaacauucucuuucaaugucacaugauuacuaauaacuaugggucaaagacguccauauuaaagaccaauguaccagaauccugcuuguccuugagugagacugcaugucccccuuguucuauaaagaggcacacuaacacaggauauuuuugaagaaaugaaaauucauuuuuuaaauauaaugcauauuauaagccaaaacauacaggaacuguaagucaggauaucaugcugagcgcaguggcuuacgucuguaaucacaucacuuugagaggcugaugugggaggaucacuugagaccaggaauucaagaccaaccuaggcaacauagcaagaccccaaaucuacaaaaaaaaaaaaaaaaaaaagagccuggcacaguggcacacauuuguagucccagcuacuugggaggcuuaggcggggacaucgcuugagcccaggagguugaggcugcagugagccaugacugcacaacuguacugcagcugggcaguagaccaagacccagucucaaaaaaaaaaagaaaaucaaauuacacuaaaugagaagaaaagguuauuuuaaaaaguaauguuauaacccaaugcaugauacugaaacuccccugauauuaguaagaacuaauugaccccaagcuugcaaguaccucccauuuuguuacauagagguaacaauaaauaacggccucccuaauauuuugcauaaaaauuauuucaguuuauaaaaccaacuaccaaaaaacugagguucagggccgggcacgguggcucaugccuguaaucccagcacuuuggaaggccaaggcuggcggaucacuugaggucaggaguucgagaccagccuugccaacaugguaaaaccucgucuuuaccaaaaaauacaaaaacuuaagcugggcaugguggcgcaaugccuguagucccaccuacucgagaggcucaggcaggagaaucacuugaacucaggagguggagguugcagugagccgagaccgcaccacugcacuccagccugggugacagagagagaccuuguaucaaaaaaacaaacaaacaggccgggcgugguggcucaugccuguaaucccagcacucugggaggcugaggugggcggaucaccugauguugggaguucaagaccugccugaccaacauggagaaaccccgucucuacuaaaaauacaaaaaaauuauccaggcauggaggcgcaugccuguaaucccagcuacucagggggcugaggaaggagaaucacuugaacccaggaggcagagguugcagugagccgagauugugccauugcacuccagccugggcaacaagagugaaacuccgucucaaaaacaacaaaaacaaaaaacaagcugagguucaaacugaaguuucuuuuucucuaaauaucacuuuuuuuuuuuuuugagauggcaucucaccaucaccuaggcuggagcgcaguggggcgaucucggcucauugcaaccucugccuccugguuucaagugguucucaugccucagccucccaaguagcugggauuacaggcaugcgguacuaggccgagauaauuuuuuguauuuguaguagagauaggguuugccuauuuuggccaggcuggucucgaacaccuggccucaagugaucugccagccucagcuucccaagaugcugggauuacaggcaugagcugcugcacccggccucuaaauaaccacuuuuuuuuaaauggaguucuacauuauaaaauuauaguucauuuggauauauuuugcccaauaauuauauuuuaaaggucaguauuucucucauccaaauaauuauuaacaguaguuacacagagaagccuuaauaauaccaaaauuauugccgggcauggugggccaugccuguaaucccagcauuuugggaggccgaggcaaguggaucaccugaggucaggaguuugaggcaagccuggccaaaaugaagcccugucucuauaaaaaauacaaaaauuagcagggcaugguggggugugccuguaaucccagcuaccugggaggcugaggcaggagaauugccugaacccgggagguagagguugcagugagccgagaucauaccacugcacuccagccugggugacagagugagacuccgucucaaaaaauaauaauaacaucaaaauuauuaauaccuguucuuaaaacugcuauuguauuuuucuuggagaaacaggaucuuaaaaauaaacuaaaaaaguaaaagaguacuuuuacuuacugauguuugaggacuggcuaaaggaggaaucuuuaauuaauaaaaauuucaaaauaauauuguaauauuaaaauaaagugaagaaauaaacuggccaaauguugaucacauaugaaaagauuuaauaguauucacuuuuuacucaucauaaaagcucagcagucaugccacaugcuuaaaucucaugcuuuaaaacaccacacgauggcaggcuuuaacugaagacuaguccagaagaggaaaaaauuaacuguuaaaaaaaaucccauacuguaauaauuuacaaccaaaaugccuaguucacacaagugcugggucuccacaggaaugaacugacacuugugaaggagucucuauuuugccccacuauaaaacuaccagaagggcuaggauacaugucauaagacauaugacugaaaauaaaaccauauuuuaaaugcaguauuacacaauacuuacaaaagcuacugacucaaaauuaauuacuuaacaauuacaaacaguaauuuuuaaagcucaggucauaaugugguacuucucaaugugauccugccucauggcaggagaaugaccugugccuuccagggaccaaaaugguccagcaagaaugauacugcauaaaacagcaugucaacuuuacaaguuauuguauggaacaaccuguaaaaucggcauauuuuaugcaguauuguucuuguuuauuugacuucacagauuuaauaaguaauacaugcaaauagcucaaaacucaagaugucauacuaccaagugaaagauacuguguucaacaucuuguggaguguagaaaacacaagaagccaaaaauuaacccaaggcaguacauccagaugacuagaauauggugauuucuuccauaaaaauaaaaaccaaagaagauaaggaggacaggggaugaagagaguauuuacuugugguacccugagggccacccaaugauaccaguggaaauuuuauaggagcuuuaauuucaaucaugacuaaugcuucuacuguucauuuuaugucaaguucuuagucacauaaaacacuguucuaugaaaauauaaauuguucuguuauaaauuacuucuuggccaagugcgguggcucacgucuauaaucccagcacuuuggaagggagacuagccugggcaacacggugagaccccaucucuacuaaaaauaaaaaaaauuagccaggcgugguggcacaugccuguagucccagcuacuagaggggcugaggcgggagaaucacuugaucccaggaggucgaggcugcagugagcccugaucgugccacugcacuccagccuuggugagagagugagacccuaccaccaaaaaaaaaaaaaaaaaauuauauauauauauauauauauauauauauagucuggcugcaauggcucacacuuguaaucccagcacuuugggaggccgaggcaagcggaucaccugagguugggaggucaagaccagccugaccaacauggagaaacccagucucuacuaaaaauacaaaauuagccaggcgugauggcacaugcuuguaaucccagcuacucaggaggcugaggcgggagaaucgcuugaacccgggaggcagagguugcggugagccaagauugugccauugcacuccagccugggcaacaagagugaaacuccgucucaaaaaaaaaaaaaaaaaaaaaaaaagaagauacaguguaggguccagugucccaucaagccccaucccaacaguccuaguuuucugcaaaacaguuugaaaacuucugaccaccaagaaauaugcaagcuccuuggcauggcagucccccuagaaagcccuucaggucuaaguccuaaagaccuucugagccucggacuucacucucccccacuccaugccaucuauucccauuccuaacuccaucuaauuccuaaccaacugccauuggaaacuaagaccaaggauggaacaaaugucauccuuccucuguaaugcuucccugcuuuaccucuccuagcagaaaaaaaucauguaccuuucugggcuccacagcacuuggugcaucauucucauauggugcaugguauauacaucuuuuuaaaauuuaagauuccaugucugucuccuacacuggaauguggguaaaaugagauuaccuucagauccucagugccuggcaaugucugguauaggguggggauacucaauaaaauuucuguuaaaaaaugaaagaagcaagccacaggaaagcagugcuuacaauuuuacuuuaauauaacaacucaugaaaagauaaguacucagccucuguuacagaggacccagguuauucugagacccaaauagucaaucuagaucugcccugcagugccuguacaagccaccacagccuucacaagcaggugggcagcaggcauuguaccaggcacugaagagaacucaagagucagcuaccgcccuuggugcaaaguaauuuauagucucuucucauaagagguuaugaacacacuuuugcuuuuucuaacccacacaaauguacaguggcauuuauaugcacucuuaugcacagguacacaggagaguuucgagacggugcggaaaggcucaguccaggucccuaguuuugagacauauuuaccuaauccagcagacauuacugaguaucuacuauguacuaccaggaagagaaagauaaauaaauaagacagggucccaacuaagugcguuuuuaguauucccuuccuucuucuggacccucaguaccuuuacugcucagggucaggcacuaggccaugucaccacacuuagguguguagcugucuagguagcauaaagacuuaucuugcagaugcugaaguaaaaugaugaaaagggacuuguggggcuaccugcacugggagcucagggcagacaguucuuacagcuguccuuaccuugugagcccuuuaacuccacaaacaaauuguucuguguucauauauuuuuccucuuccuccuuaggccacaauauuaacagugaaaaagucaaugcaucgcggccgggcgcgguggcucacgccuguaaucccagcaguuugggaggcaggcggaucacgaggucaggagaucgagaccauccuggcuaacacggugaaaccccgucucuacuaaaaauacaaaaaauuagccgggcgagguggcgggcgccuguagucccagcuacucgggaggcugaggcaggagaauggcgugaaccccagggggcggagccugcagugagccgagauugcgccacugcacuccagccugggcgacagcgagacuccgucucaaaaaaaaaaaaaaaaagucaaugcaucaugaaguggcuaauaaagagagaagaacugacuacuaucucuuccucuugcauauacagcacuuacagugcauugaucauacaaaucccuguauuuguggauaugcuuagcuaccucaagagacuguaaacccuuugagggcaaggcccaugacuuauuauuccuacaucuucugcacagaaaacucagauaaugacuauuuugcuaaauguuacaagcacacgcacacacacacacacacacacacuucucuuuuuucauccuauguaaaauguaucauguguuuuccaggaaggaaaaaaaaucacacacacagacacacacaacuucucuuuuuucauccuauguaaaauaucaugucucuuccaagaagaaaaaaauaauaacugaugcuucuauaaucucuaaaacucacaugcauggguauccucucuuucuuccuaccaauuucccaggcugaaugaaucaugaaaaaaaauucuuaagguuacacccaugucuccaucagacaauagcaauaaaucaaugaguuggaguuuuuuuguuuguuuguuuguuuugagacagagucucgcucuguggcccaggcuggagugcaguagcgcgaucucggcucacugcaagcuccgccuccuggguucacgccauucaccugccucagccucccgaguaacugggacuacaggcacccgccaccaugcccagcuaauuuuuuuguauuuuuaguagagacgggguuucaccguguuggccaggauggucaacuacugaccucgugauccaaccgccuuggccucccaaagugcugggauuacaggcucggugagccaccgcgcccagcuuguuuguuuguuuguuuguuuguuuguuuguuuugagacggucucgcucuguugcccagacuggagugcaguggcacaaucacggcucacugcaaccucuaccuccuggguucaagcaauccuccacgaucauggcugacuguaacuuacaccuccuggguucaaacaauccucccaucucagucccccaagaagcugggaguauacacaugugccacuacgcccggcuaauuucuguauuuugcuggggcagaugggaagacaggguuuuccuauguugccccggcugguuucaaacuccugggcucaagugaccuguccgccucagccucccgaagugcugcgauuaccagcaugagccacugcacucagccaaaucaaugagucuucuaugucacaugaguugucaaggauacauggggagccaugcagugaguuaauauucugaacauauucuugucauaauuuucuaaccauauuauuuuucauucaucaauauaauguagaaaguccaaguguaauuaucagcacauagucaaagugcagaaaccuguagaacugauauccuaaaacauacauacauggacuugcugcagcuaucaccuaagcacagaaugacaucugacaaugccuccaaacacagagcaauuuagauaggaauccuaaauuacuagaagcuaucuaacacuuaagauauuaguauacauuuacuuugaguccauuuccugacuggauuuguuguguuauccaccugccugauuaaacuauuuauauuccagauaaggagaucuuccuauguuaaauucaacaugugaaucuaauacuagaaauauacacgcuccugaaaauaagucacaaaacauacccauuugcuuuagauguuuuacagaagaaccaaacucuaacugcaaccagaaaaaaauaaaguuuuauaaauguaacuggcauucuaugcuaauuaagaauuuccucccuuaauaaaccaaauuagcuuucauuucaaguaagcuugaauuuuauuggucuaacaaguaaccagguguaaucaaguaucuggccauuaaaaagaaaauuagccaggcugggugcaguggcucacucuuguaaucccagcacuuugggaggcugcagcggguggaucauaugaggccaggaguucaagaccagccuggccaacauggcgaaaccccaucucugcuaaaaauacaaaaauuagccggacauggugguccaugccuauaaucccagcuacucgggaggcugaggcaggagaaucgcuugaaucuggggguguggagguugcagugagcugagaucgugccacugcacuccaacugggucaaagagcgaagcucuaucucaaaaaaaaaaaaaaaaaaaagaaagaaaaaagaaaaagaaaaagaaaauuagcuagaaaggauauauuuauauuccugcuaacauucuacagcagugacuuaagacuaacauacacagcuuuacuaugguuguacuuucccaauaaaaccuaguaccauguaucugggacacaugccuauccucuccugaggccuauagaacuaaucuaaauccaguugguuaacacuuucuaaaaugcuccuaagcaccuucuaccaccagcaauaccauauacucugcugcuuuaaucaugcugguuguucaacaugccgccaguuugaccuugacuuguuuuaaggucauuuccaacccuggcuucugcauugaacuacuugguucuggaacuuagugucugaacuuugcuuggccucugcacuaguccuucugugaggaugacucucucucacucccuggguguccuucauuugucuagguguacccuacuccagacuaguccuaccagucagaaaguagagaucagucagcaccauaagaagacagggcaaggcaaaaaaaggagauuaaaaaaugcauccagggccgggcacgguagcucacaccuauaaucccagcacuuugggaggcuaaggcuggcggaucaccugaggucaagagcucgagaccagccucaacacagagaaacccugucucuacuaaaaauacaaaauuggccgggcguaguggugcaugccuguaaucucagcuacuugggaggcugaggcaggagaauugcuugaaccugggaggcggagguugcagugagccaagaucgcaccauugcacucccaccugggcaacaagagugaaacuccgucucaaaaaaaaaaaaaaaagcauccugggccaggcgcaguggcucacgccuguaaucccagcacuuugggaggccaaggaaggcggaucaugaggucaagaguuugagaccagccugauccaacauggugaagccccgucuaacuaacaaauacaaaaaaauuagccaggugugguugugcaugccuguaaucccagcuacucgggaggcugaggcaggagaaucgcuugaacccgggggggcagagguugcugugagccaagauugcaccauugcacuccagccugggcgacagagcaaggcuccaucuaaaacaaacaaaugaacaaacaaaaaaaccacauccaaucacagaaucgcuggaaaaugaacccucaauggaacucuuagagaaauauaucauuacuaggugauaacuuuaggguacauucuuccaaaagucauaccacauacauaacaugcagaaagucauuccaggccugcaauaacaauaacuacuugaaaaugaauuaggaggccaggcccggugguucaugccuguaauccuagcacuuugggaggccaaaaugggcagaaugcuugagcccaggaguucgagaccacccugggcaacauggugaaaccccauuucuacaaagaauacaaaaauuagcugggaguaguggccugugccuguagucccagcuacuagagagacugagaugggaggauugcuugggccagggagguuaaggcugcagugagcuguggucaugccacggcacuccagccacugucgcucugggcaacagagcaagauccuuauuuaaaaaaaaaaaaaaaggaaaaggaauuaguuagcauauuccaaccauaaacacuugaaaaaauaagauuguccacuuaaacagggaacaaagaauuagugugaaacaaaucaauaaguaaacuugcagggacaaauacaacauaaucugaagcucauuacaaaauaguuuuaauuaauuugguaacggcaaauuauugcccaccuguuaacauucucuuggucaguuugugucaguaccuaucccuaacauuucaccucaggcccauucuuauuuagaaaaacaaauauauuacaggagaugaaagagaaaagccauuuaguuuuucaccuguaaucagcuaacagaaaucauucuauacaaaauucuuauuucuaaucaaagccacaaaacaaggauuuuuaaaucccuuaaaacagacccacuguacauacagagccaggccaauuaggccuagcuggcuaagcucuguuccugcuuucauauacuguaagguucuucugaacagcugucugguagccccugaacaccacucaacacuagugcaguacucaagugacuaucacacaaauccgugucuggggaucucuucacacccagagcucagcaucaacaugccaugucucuuauaucuagccaugcuccagaccuuuagagaaaaaauaaaccuuauuuucaauuuaaaguaaaauauacccacauaaaaaccuuguccuaaaacuagauaauuuuauuucguaacaggcucaaacugcuuaucaagcaugcauuugcuccaacagccacucaucagcuucaacacuguccucauguuaacuucccuuccaaagggaaaaaggaugugauccacaguauuuuuccaaaggaaaauuaaugaacuuccccgaaauuaaaacaaauauaacuuaauacacaaaaacucggccaggcacggugguucacuccuguaaucccaguacuauagggggccgaggcaggcagaucaccugaggucaggaguuagagaccagacuggucaacauggugaaauacaaaaauacaaaaguuggcugggcgugguggcucaugccuguaaucccagcuacucaagaggcugaggcaggagaaucgcuugaacccaggagauggagguagcagugagucaagaucacuccauugcacuccagccugggcaacaaagcgagauuccaucucaaaaaaaaaaauuacacaaaaacucuagaaggucuuaugaucacaauuucuuucuuucuuucuuucuuucuuuuuggagauggaguuucacucuuguugcccaggccagagugcaauggcgcaaucucagcuaacugcaaccuccgccuuccggguuuaagugauucuccugucucagccuccugaguagcuaggauuacaggcgcccgacacuacauucggcuaauuuuugguauuuuuaguagagaugggguuucaccauguuggccaggcuggucucgaaccccugaccucaggagauccaccugccucggccucccaaagugcugggauuacaggcgugagccaccaugcccggccuugugaucacaauuucuauuaacaagggucuccucuggcauaugcaaaaagacuaagaagaugcuuuugcauaaacucaaaguuacaaaggauaguuuccggugccaauaaaauucugcuacucacugaauaaacuaaucugucaaagaauuagcaacaaccuaaucagacucaggcaaacucuaguugaaacucggguaaaauuaggaaaaauacuaaaugagauugaaacuggaccacaaaaccacuucuuugaaacaaaaaaaaaaaucacuguaacauaaacaggcacaggaguauggagcagacucguacagauuaagucuuaauuuaaaugacugauucauuuaaaaagaaaaagaaaaaccaauaacuacuaccuuugucacucaucuacaaugugcuaggcacugaccuggguguaaaauauuucugaaacaguguuccaauguccauucuccaguuugcuggguguuaugaggcagcuauuccuaaagcaauagcaguggcagcuuccuaguccugaauaguagcuauauacuguuuuuaaaacaguuuacugguuccauugguggccucacacauaaaagcucccaaagaaggucaguucuacaacaauguucuaagcaucauuauugcuccucuagccucucuaaaaaucauuucuaagcaccuacaucucauauuguuucccuuucugcuuaaaaucccuagugcugccgggcgcgguggcucaugccuguaaucucagcacuuugggaggccgaggcggguggaucaccugaggucgggaguuugagaccagccugaccagcauggagaaaccccgucucuacuaaaaauacaaaauuagccaggcgugguggcacaugccuguaaucccagcuacuagggaggcugaggcaggagaaacgcuugaaccugggaggcggagguugcggugagccgcgaucgcgccacugcacuccagccugggcaacaagagugaaacucuaucucaaaaaaaaaaaaaaaaaaaaaaaaaaucccuagugcuuucuguucccugcacugagugaugacacaaagaccuaaacagaaaaagaaauuaacuuagcaaagagggacuaugaaggacaaugaagacuucugcaaagauaagagaaaguaccaaacacaccaggcacaguggcucacgccuauaaucccagcacuuugggaggcaggcgaaucaccugaggucaggaguuuaagacgagccuggucaacauggcaaaaucccaucucuacuaaaaauacaaaaguuagccaggcguaauggcacgugucuguaaucccaguuacucgggaggcugaggcaggagaaucacuuaaacacaggaggcggagguugcagugagcugggaucaugccgcuguacuccagucugggugacagaguaagacucugucuccaaaaaaaaaaaaaaaaaggaaccaaauccaucaaauuuagacaaaaacaaugcuauagagcuaucaagaagagaauaggcuggguacaguggcucacaccuguaaacccagcacuuuggaaggcagcgauagguggaucacuugaggucaggaguucgagaccagccugaccaacauggugaaaccccgucucuacuaaaaauacgaaaaucagcccggugucauggugggcaccuguaaucccagcugcuugggaggcuggggcaugagaaucacuugaacacggaggcagagguugcagugagccaagaucgcaccacugcacuccagccugggcaacagagcaagacccugucucaaaaacaaaaaaagagacaucaagggaauaaaaaaggcuaggcaugaugguucacaccuguaaucccaacacuuugggaggcugaggcagaaggaccacuugagcucaggaguuugagaccagcaacauaguaagacccugucucuaugaaaaaaaucaagaaauuagcuagguguaguggcacacacccaacuacuccaguaguagucccaacuacuccagaggcuaaggugagaggaucacuugagccuaggagguugaggcuguagugagccaagaucaugccacugcacuccagccugggcaaggguaagacccuaucuuuaaaaaaaagagacagaauaaaaagaagcuauuagaaauuuaaaauacaauagcaaaaauuggaaaacaaaauugagaacaucucuuaguagagaaaaaauauuuuuuaaaaaagggaagaaaaccaaaggaucaauguaagagauccaacauuugaauacuaggagucucauaugguaauaaaagaggagaaaaucucaagaaaauuuccaacaacugaaggacauaaauuucaagaccaaaagaauucaaucagaugaucaacacaauggaugaaaagagaucuacaacaaggaacaucccugugaaauuuuagaacuggaucaaaagaagauccuacaagcuuuuaaauuuuucacucaucauuacuucugcagccaaugaaagcuagaaaacuaaagaacacgucuucauuuuauuuauuuauuuguuuauuuguuuauuuauuuauuuauugagacagaguuucgcucuugucgcucaggcuggagugcaauggcgcgaccugggcucauugcaaccuccaccucccggguucaagcaauucccuugccucggccuccugaguagcugggauuacaggcacccaccaccacaccggcuaauuuuuuguacuuuuaguagaguacaaauguuggccaggcugguugcgaacuccugaccucaggugauccacccaccucggccaaaacaugccuucaaaagucuaagaaaauagcauuuacaaccuagaauucuauacccaaacuaucaaugcuuauacaauacaacuagacuguagaaaaacacaagguacccaaagguaauucuuuauuuaaugagguaaaauuaauuuaaaaaugauccuaaaugauuugauguucuaacaacuggcauagacucuauauaauuauacaaaaaaguaagugggaaaaaguacuauuuuuauaggugaucaaaaggugugauaggcaaaaaaaacuaaucacaguauauuacugaguucugcuggggacuauguaaguauuucugcuauaacauauguugcuucugacaacuccugcauucugcacaaauuaaaaauaacacagcagaccagaugugguggcuuacaucuguaaucccagcacuuugggaggccgaggcaggcagaucaccugaggucaggaguucgagaccagccuggccaacauggcaaaaccccuucucuacuaaaaauacaaaaauucacagggcuugguggugcacgccuguaauccccgcuacuggagaggcugaagcacaagaaucacuugaacgugggagguggagguuauacugagcagagaucauaccacucacuacucuccagucugggcaacagagcaagacugucucaaaaauaaaauaaaauaaggccgggcucaguggcucaugucuguaaucucagcacuuuggaaggcugaggugggcggaucaucugaggucgggaguucaagaccagccuaacaugaagaaaccucaucucuauuaaaaauguaaaauuaggccgggcacaguggcucacgccuguaaucccagcacuuugggaggccgaggcagguggaucaugaggucaggagaucgagaccaaccuggccaacacggugaaaccccaucucuacuaaaaauacaaaaaauuagucgggcucguugguaggugccuguagucccagcuacucaggaggcugaggcaggagaaucacuugaaacuggaaggcagagguugcagugagccaaggucacaccacugcacuccagccaagaagacacagcaagucucguccucaaaaaaaaaauucaaaggaaacuccaaaugcaaagucccuauuuuaagaggaucacaguaaacgggacugaauaaaggauuucauggcuaaagaggaguaaacaaguucaacugugguaugagaugaagcuggagggucagacugggaccagcccauguagggaaagaacuuuuagguaggauaaccugggcaaauaugucccagauugccaaggacaaguuccauuuaugcgagcugucacugcauaauuauuaacagcucccucuuucauacacaaaaguaucccaauuuggaugccaaauuauauggucacccuacuauuaguagggucuuagucuuuacccuagaagcuacuaaaauguuuuauaccaaaaggggugaaaugaucacauuuuaggacacaaccuuagagagauaaggguucugguccccuguccaauguuuuguuacauaaacacugaguaagaaucuaguuuaaauugacccuuaagaaugccucccucccgccagacacaguggcucacaccuguaaucccaacacuuugagaggccgaggcaggcggauugcuugagcucaaaguucaagaccagccugggaaacauggcaaaacccucuccccacaaaaaauuagccagucgugguggugugugccuguagucccagcuacuccagaggcugaggugggaggaucacuugagccugggagguccagguuauagugaaccaugcaccacugcaauccagcaccggcaagagaacaagaccuugucucaaaaaaaaaaaacaaaaaaaacaaaaaaaaacuugucuccuucccuucacugccaacauucuuaaacaaguauucuaaacucauaaucuuuuuccucucauucuccccuuaauuauggccagugguuuccucuauuaaccaaaggcucuccucucagucaacaaucaccuaaggcaccaaaaacaccaaugacaacagauacuuuuuaggcuucaucaaacaaaaaacccuuguuccaugacucaccucucuuuucucaccuuuuaggacgaagugucccucugucacacaggcuggagugcagaggcgcaaucucagcucacugcaaccuccgcccacuacaaccuccgccucccagguucaagugauucuccugccucagccuccacaguaguugagauuaaaggcaugugcaaccacgccuggcuaauuuuugcauuuuuaguagaaacgggguuucgccauguugcccaggcuggucucaaacuccuggccucaagugauccacacacucagccucccaaagugcugggauuacagacaugagccaccacgcccagccucaccucucuauuacuuaucauccccauuguggguucuccuuucucuacccaguccucauaugcgcaugcuuuccaugucucuugaguacuucaaauugccaacuaacauugcuaccuaaaguccggcaaacaccacuaauucacugacuuaggguccuccaaaccuguucauuccccaccaauuucgguuaagagcaauauugucuacucaggcacccaagcauggaagcagucacccuagacucuuucuucucccuaguccuuuauguucaguaucucuuaaauccaccuucucuccuuucuuccaccugccucaguucaagggcugccuuguuacuccccaaguguucuuacuaguguuuguaccucuccucuuuuuuucccuccacagcauagccagaaugaucaugucacaauucugccuuaaaaucuuggguccacucauuacuaaaaauacaauccccuuccccaccccauguauuaaauauauauauggcuccaguaggccaggugcaguggcucacaccuguaaucccagcacuuugggaggccgagguggguggaucaccugaggucaggaguucaugaccagccuggcaaacauacugaaacccugucucuacuaaaaauucaaaaauuagccgagugugguggcaggcggcuguaaucccagcuacuugggacgcugaggcagaagaaucauuugaacccaggagguggagcuugcagugagccgagaccacaccauugcacuccagccugggcaacaacaggagugaaacucuaucucaaaaaaaaaaaaaaaaaauauauauauauauauauauauacccccacacacacacguuauauauaacauauacuucauauauaaguaacauauacauaaaguauauguuauauauaacauauacauauaagauguauauauacacacacauacacauauauauggcuccaguuauauaaauuauuugacauucaggacaacucacucuccauuuuccauuuagaagcaaaucccuacuuaccucccugcacuuagcucagauuccccugggaugucuuucaaaauuucacacggcuccuagccugccuuagguagcgguccuuguuucuccacagcaacaccuggauacuggcaucacagcacuuaauauauuuuauuaguauacugcacuuacaguaucacaauccuguaguguugguuuucugucuuccccacuagacuguaaguaacuugauaauggggacugaguaucccauuucucuauucccagcaucugguucaagaccuggcauauaguaccuguuccacaaaaaugugucuugaauaaagaaugaaagaacacccugucaugaguauuaaagauuuauuuagagguuuuaauuucuuuuaaauuauuaaggcauggaauaaaguuggaaaguagcuuuuuaagaagagaaaaaagauaaaagcgaucucuuucaguaauucaucuucaccuuucuuuagcaaaugaagcccucaguauuucaaacagcuguuucaacuacugaccacuacccuucugacaaauccaaaauuaccucccuugaaggcuacaaacuaucaacgugaaaaacaugcaacuaguagcauuuccaaaaguagcacccaaagggaucugaaaaucaacuauccuaucugagacuucaaguaccaaccacagauaaugaugcucugugagccugcuacaugucgguaaaccagaguaauaccuguagaacacuguuguauggaugaaauaagguuauguaugugaacacccuaucacaaugcuagaagucaggcuaccauccuuucuagcuuucauuacuugcuaaguaauaccaggcaaaauacuuaaacucucugagccugaaguuuccuuacucaucagcaguuaucaugagcuuaaaagauaaugucuggccgggaacgguggcucacgccuguaaucccagcacucugggaggccaaggcaggaggaucacgaggucaggagaucgagaccauccuggcuaacagugaaaccccgucucuacuaaaaaauacaaaaaauuagccgggcguaguggcgggcaccuguagucccagcuacuugggaggcugaggcaggagaauggcgugaacucaagagauggagccugcagugaaccgagaucgugccacugcacuccaggacuccagccugggcgacagagccagacucugcaucaaaaaaaaaaaaaaaaaaaagauaaugucuguaaagcaucuacuguaaugccuggcaaacagaauuggcacaaaauaaaugucagcuuuuuuuuuuccugcaucuuuucccccaccccccaaagggagucuugcuuugucacucaggcuggagugcaguggcacgaucucggcucacugcaaccucugccucccagguucaagcaguucuccugccucagccuccuaaguagcuagaauuacaggugcccaccaccaugcccggcuaauuuuuguauuuuuaguagauacaggguuuugccauguuggccaggcuggucucgaacugcugaccucaggugauccgcccaccucggccuccaaaagugcugggauugcaggcaugagccgcuggucccaaccuaaggguugggcccaaccuaaggcccaaccaagaauuuucuucuugguguuuguguuuucuccuuuucuauaaugaauauacauuugcuguuuaaaaaauuuaauuuuuggccuggcaccguggcucacaccuguaauccuagcacuuugggaggcugaggcaggcagauauugccugagcucaggaguucaagacaagccugggcaaccuggugaaaccucgucucuacuaaaauacaaaaaaaaaaaaagaaaaagaaaaagaaaaaaaaaauuagccgacgugguggcgugugccuguagucccagcuaaucaggaggcugaggcaggagaauugcuugaacacgggaggcagaggcuguagugagcugagaucgugccacugcacuccagccuggcgacagagcaagacucaguuauuaaaaaaaaaaaaaauuaauuuuuaggcagggcaccguggcucacaccuguaaucccagcacuuugggaggccaaggcgggcggaucacgaggucaggagaucgagaugauccuggccgacauggugaaaccccguuucuacuagaaauuaaaaaaaaaaaaaauuagccgggcaugguggcgggugccuguaaucccagauauuugggaggcugaggcggcagaaucacuugaacccgggaggcagagauugcagugagccaagguugugccacugcacuccagccuggugacacagcaagacuccgucucaaaaauaauaauaauaaaauuaauuuuuaaaaauucgggcggagggcaguggcuuacgccuguaaucccagcacuuugggaggcugaggcgggcggaucacgaggucaggagaucgagcccaucccggcuaacacggugaaacccagccucuacuaaaaauauaaaaaaaaauuagcccggcgugguggagggcgccuguaguuccaguuacucaggaggcugagugaggcaggagaauggcgugaacccgggagguggagcuugcagugagccgagauggcgccacugcacuccagccugggcgacagagcaaaacuccgucucaaaaaaaaaaaaaaauucaagccaggcacgguggcucacgccuguaaucccagcacuuugggaggccgaggcggguggaucacgaggucaggagcucaagaccagccugggcaagauggugaaaccccaucucuacuaaaaauacaaaaaauuagccgggcgugguggcacgugccuguaaucccagcuacuccggaggcugaggcagagaauugcuuaaaccuggaggggcggagguugcagugagccgagaucgcaccacugcacuccagccugggcgacacagcgagacccugccucaaaaaaauaaaauaaaauaaaauaauaaaaauucaaaugacagccggccaggugcgguggcucacgccuguaauccccgcacuuugggaggccaaggcgggcggaucauccaagguugggaauuccagaccagccugaccaacauggaaaaaccccaagucuauuaaaaaaaaaauacaaaaucagccggguguaguggcgcaugccuguaaucccagcuacuugggaggcugaggcaggagaauugcuugaacccgggaggcggagguugcagugagcugagaucgcaccacuguacuccagccugggcaacgagagcaaaacucugucucaaaaaaaaaaaaaaaaaaaaaaaaaaaucaaaugacagccaaagcacaaucuccuuaucaaagagguacacuguaaaaaggguuuaaaacugauuuuaaaaacuucccugauccuaaaaauaaugggaccuauacagggucccauuacucaacugauaccugaggcucauucucaacauuuguacaugaaagagacuuacacuaauggcauaaaaaaaaagucugaagauuucuaacucagacauaucagaggugacaccaucuauacaaacgaaagaauaaauauaaccagcaacuguguaaagacacaaaaaagaaaagacccaccauauuuuaauagugcuuuaucuuucauucugccuguuuacuuccuugaaucuggguaugcaaaauauuaccuagucucauccccuaaguuaaauaaacaacuccaaaagaucuugcuuuaucaaacaucuuuugaaagcaugggaaggaaaugucaugacaguuuaauuacuugggaccugcuuccuagacuuuuaaaucauuuuuagggguuugguccuuccaagucuucccuugaaaauuaaaguaacauuuaacauaacucuguuauaaaagaacuaugaaaagcaguuuaacuaguuuuauaacucuuauaaagaaaacuaguuuuauaacucuuauauuuuaaguuauaaaaauauaaaaguuugauaacucuuauauuaaggccaagauguauacugucaaucugcuucaaauagggcaaaaucaguacauuaaaaaaagauauaguaauacacaggaugaugaagguuuguuuuuugugguuuuuuuguuuguuuguuuuuguuuuugagacagagucucgcucugucgcccaagcuggagugcagugguacgaucuuggcucacuacaaccuccaccugcuggguucaagagauucuccugccucagccucccaaaguagcugggauuacaggcgugcaccaccacgcccggcugauuuuuguauuuuuauggagaugggguuucacaguguuggucaggcuggucucgaacuccugaccucaugacccucccaccucagccucccaaagugcuaggauuacaggcgugagccaccacgcccagccaaagguuuuuguuuuucaauuaaucauccuauguacaaagaaaacacuccuaaagaagauuagcauguuuuugaccaggcacaguggcucacgccuguaaucccagcacuuugggaggcagaggcgggcagaucacgaggucaagagaucaagaccauccuggccaacauggugaaaccuggucucuacuaaaaauauaaaaauuaccugggcgugguggcgggugccuguaaucccagcuacuugggaggcugaggcagaagaauugcuugaacccaggaggcagagguugcagugagcugagauugugucacugcacuccagccugggcaaaagagcgagacucugugucaaaaaauaaauaaauaaaaacaaaaauucaccaucuuuuaucuauacuuccagaguuugaaaaccuaaaauuuuuauuaacacauuuaguggcaaaaccugaccugaaaccaggucuauuuucaaucugucuuucuccacuugccaugacaauaucuuucccucagaaauguuucaugauagagugcuaacucuaucuacccuaacucuaucuauaaaccccacugggggugucauauccaguaugugcaucauauuaccgucuuaaauuggaauugcuuuaacuuccaaagcacaucuggcccccaggguuuuacagaaaagauacgggaccuguaucacugaaggaaaauaaaugucugaauccacaaaaucaguuauugaagacugauguaaacacuuaacuuucuguuauaucuaguuuucccguauaguuaacagugaaaaucugaaacaagucaauuucucuguacuuuuuguuuaaaguguugagugauggcauucaucaucauuuuuggaaacuguucucucaaaaaagcuuucagcaaaauauaaucagucuuggacugaaucaaaguaacuguaccuuacauaugaggucuguuuucuauggauucagacaccaccugcauggaaacuguugccaaauucucuuuagaccaagcauuuccaugcucugccucuaagguaucuuguuugcugaggaaccaaaaagaaacuaaguaaccuggaaucuauaauucucucaaagcuguuuucuuaaucuaaaucuaccuaaaugaugauuauacuuaauuacaaacacucuaguuccaaauaaaaaauuaaauauaggccaggcaugguggcucacgccuauaaucccagcaccuugggaggccgagguggguggaucaccugaggucaggaguuggagaccagccuggccaacacggugaaaccccgucucuacuaaaaauacaaaauuagccgggugugguggugcacaccuguaaucccagcuacuugggaggcugggucaagagcaucgcuugaaccugggaggcggagguugcagugagccaagcuccgucucaaaaaaaaaagaaagacauuaacaacccuagaugccagaagacaauagggcaaaauaauacuuuccaaguucuggaaaaauguuaaccuaguauucuauaccuagcccaaagcuauuuucagacauacaggacucagaaaguuuaccuccugccauccuuucugaauaaauuacuuaaggauguucuucaacaaaauaugaagaaaccaaggaaaaggaaaauacacccaggauggagugcgguggugugaucucagcucacugcaaccuccgccuccccgguucaagcaaugccuccugccucagccuccacaguaacugggauugcaggcguccacuaccacacgcggcuaauuuguguauuuuuaguagagacggggucucgccauguuggacaggcuagucuugaacuccugacuucaggugauccaccugccuaggccucucaaagugcuuuacaggugugagccaccgugccuggccaggaagcugucuuuaauaaguuacaggacaucaguacacagccuaccuuaagcaaagagaacucuagggaagaaagcagauucaugugauagauauuaugauuaaauaucuucaaaaagucugcaaacacacugagggcaaauuuuucuuaacaagaaaaaugaaaagcuauugaggaauaaauccauauaaaaaaaguccuaauucaaauaaggagcaaacuaaaauguggcauguuuugagcaaaugaugguauguuggggggaaaagaagagucaucuaauccuggcaauaggaauauacauacaguagcacagacuuaagaaaaauauaaucccagaacacuacuaacccucagagaauagguacugucaacuccucagacaggccuuccuuaaucacacuaacccuucacuccgcuuuauuuuuauucccuuagcaucugcuauuaccuaaauuguaucacaugcauuauuucauugauucuaauacacauuauucucauuuuuuaaccccgcugaaaccagcaugcauuuuagaaucgauacauuuacaacuacugucagccagguggcagccuuguuacugugugaaaaaccuccuguggcuaacuccuggaaagauuacaaaagcgccagcaucaaaaugcuucacaucagacaaaagacaaucuuucuuuacuugcugggauauagcucccccacuacacucucagcaacaaagaacaguaauucauuuuuuuaaaaaaaucuucauauccucuaacauagaacggugacugguacgcaacagauauuugaucuguguuaauuuuuuuuuuuagacggagucucacucugucacccaggcuggagugcaguggaccaucuggcucacugcagccucugccuccuggauaucaagcgauucuccugccucagccuccccaguagcugggauuacagacgcccgccaccacgcccggauuuuuuuucuuuuuugagauggggucucacucugucgccaggcuggggugcaauggcgcaaucucagcucacugcaauauccgccuccuggguucaagcgauucuccugccucagccucccaaguagcugagacuacagaugcaugccaccacgucuggauaauuuuuuguauuuuuaguagagacgggguuucaccuuguuagccaggauggccucgaucuccugaccucgugauccgcccgccucggccucccaaagugcugggauuacaggcgugagcccccgcguccggccaauuuuuguauuuuuaguagagacgggguuucaccauauuggucaggcuggucucgaacuccugaccucaagugauccgcucaccucgccucccaaagcgcugggauuacaggcgugagccaccacgcccggcccuguuugacauuuuaauaucuaugaaacccaucaugauggguccaacaggauggauccuacacaguugguccugauguuuuuauuuucuuagugguacacauaauaauggcaagucuuacaagcaacgauaucuaagauuugaaggaauucaguggcaaaaaauuuggaggaacauagaaauaauagugugaguuaacugacugcucauuuuaaaagaugaaaccaaggcuuaguaaauccaagaaagggaaauacaagcuuaguauuauuuucgaguuguauaacuaaauauccaaagaaauaaaaacaaaaagggauaaaugugauugccuccggaaagagguagugcaguuaucguuuuucgcuacaaaccagucuauacuauuuuauucuuaccacgugcacaugcuuuuuuaugaaccgaaaacauaugauaggagggauaaguaaaaauacacaaaaucucagagacuucggacagggacauucacgcagauacagacagaaagacauccaggggcaaagggugucaaagugagaauaagguaccuccagaaauuucagcuggcagugcuaauggcgaccaugaauuucagacccaaauuuugcaaaucucuaaagcaugacaucaacacuuguugccuacugaugacaggccauuuugcuuaucagaaagucaaaauaaggccagcaaaggucugcaaauguauccuugugcacuggaaugaaaacucgcacucgcuuaggugaauuacaaacucuccuucgcucaaacacucagcauuuacacagcacccugucaccugcccuggucuacuaucugcacaguggucgacuaagggguacuaagcacagucucuacccgaaagccugacuauacuacgaggaggcaaaagcuggggacagagggccgcugccugagggguaggagaaccgcaauucuaagaacgguagccgugacaugcacaaacccagcuuuccuucccugcgcagaaccacccgagggaccgcaccauccccgcugggacaggacacauuuccccagagaaagcuaaccagcuagcaaaccuaacuugcccggggcuggcuggaggcgcacggaucaagcuccgccucucucucccgccuaaagcaggcguagaaucuucgcaaaacgucacagggccaagacugagcgcgccaaagcgggacccacccccaggagacgcggaugcugcgggaaggucccuccccuuccucucucugcccgcgcgaagcucauucauucuagaggcgggcugccaguccuccccggccgcccaucccggcacugcaaauccgcuagacgcuuugucucgcgccggccggaaacuggggcgcgcacgcgagcgcgcgcucgcgcuccagcuccccgcaccuggggccugaggggccgccucuccgcgccggcuccccggauucgagugcgaaagcgggagcuccuucucggcagucccaggcgcgcacuuaccacgucccagcggguauccaaaaucuagaaaugggcaucacggccccccagcgcuacagcucgagcccccuccgcgaccccugcuccgcuaugaacucuagauucuuucuccuuuccggagaccgagacccuguuccuucagaaggacgcgugcauccuggccucugcucccuccccacggcagaacccggugagcuggucgccgcgguugcgcccccgccccuccuuggcgcuaacgcggccgccagcuagcacucacuugaggagcagcuggucguguuccgccuugcacuugcccagcucgaucugcagcuuggcgcgcucgcgggccgugucgucgagcgcgcgucgcgcgucggccagcucggucucguagagcgccuugaggccggugagcucacggccgcgcaccuccucgcgcuccgucaccugcagcugcagcgcgcuguucuccgucuccaggcugcgcaccuugucgauguacaccgccagccggucauugagcucgcgcagcuccuccuucuccuggagccgcgacaggcgcguggggcucagcggcgugguggggccgccagcgcggcugcccauccgcggcggcacgggggucgcagucgccauggcgggcggcggagacagcggggcggcgaggccgcgagcgggaccgugauaaggaggggacggcagggggcgaagcggggaccgaaggcacaaaccggcgaccugcgcucacguccagacgcuggcguuuagaggaacggagaagcaccugggauggcgggagcucgauuacagcacaaagggcaaaggcgcgcgggggggaacuacgaaucaaucgaucgaucgcgaaauacccuuuguaagaaaacacacacacccacucacacacgcacgcgggaaaaugcaagacgagggugacuggaggcccagcaggguucgcgccgccgccgucuccugcucgcagcacuuuguuuccu

SEQ ID NO: 192756 - RNA, 49459 nt, Homo sapiens
acacacagggccauuauuuugauuuauugcauucugaaguacuccggggggagggccugagaacgauccgcuuuaucagcaguucuaaagccuuauuaccugagauuuauauucuggggggaaaaaucaagauuggauuaucaauacguauuucacaggagauuugaguuuuggcccugacagaagaacacguacuaaccugaaaaaggcuacgugagauuaaagagagaaacagcuaaacaccaaauccuggugagagagacgucgauuuaaaaggccagccacucacuguagcgugacaacucccucugggguagccaggagcagagcgugagccacuggcauggagcgugggccacgagggccaccuccccaggagcccacagcagcccagggaggccuugggagcagcuuugccucagccgcagucacuucucaucaucccgcccauaguuaaucgucuguaaggccugagcuaugagcaucgccaucucccgggugcuggccgcaaccacucugcaagccaugaggucgagggguccaccuggggacagacagagagagccaggcauccggguuaccagagagggcugaacaauguuguguaacaacuuaucccacaugcacacagcacaggaaauggcacauggaaccgugcccaagccccaacacucguauuaaacagguggucuaggagugaauucggcaaagaauagagggauggagccucucccgccccaccccagugugaaugcagucaagggcugcacagaacagagugcggcucugaagcugccacugccuuaagagauggagaacauaaaaguccuaagaaaugcaagcaaugggcuagacccgaacaggggagcugcccuucucaagcuugacugugcacaggggucagccaggggcuugugaaaccaaggcucugccucaacaggucuggguggggcugaggcuaccugcccacaagcuccugggggugcaccgcugcugcgggacccacacucgaagaagcucgggcaagaugauaaagccuugcaucuuccugagggauaugaaacagcucuggaugcaugggcuggagaccugcuugcacauacgugagccuucaggugcucuagugguaaaaucagagugaugggggcuuuaaaauauggaauggaggccgggcaugguggcucaggccuguaaucccagcacuuugggaggccgaggcgaguggaucaccugaggucaggaguucgagaccagccugaccaacauggcaaaaccccaucucuacuaaaaauacaaaauuagcugggcaugguggugagugccuuuagucccagcuauucgggaggccaaggcaggagaauugcuugaaccuggaaggcggagguugcagugagccgagaucaugccauugcacuccagccugggugacgagugaaacuccgugucaaaaaaaaaagaaaaaauguggaauggggucgggcauaguggcucaugccuguaauuccagcacuuugggagaccgaggcaggcggaucacgaggucaggagaucaagagcauccuggcugacaccaugaaaccccgucucuaauaaaaauacaaaaaauuagccaggcaugguagcacgcaccuguaaucacagcuacucaggaggcugaggcaggagaauugcuugaacccgugaguaggaugguugcagugagccgagauuguaccacugcacuccauccugugugacaccaagaccccgucucaaaaaaaaaaaaaaaaaaaaaaaaacagaaacucuggggaaggugggaaauucaguugguggggacuucaggaagugccccacccacagugucucucagucuaguuucugccgcugcauuucagggacaggagagcucacccgaagugucuaucacgaugccgccugcuucucugaugaugacuguggcagccgccagaucccagcagugcaggccaaacugguaauaggcauccgcggccccugaggccagguggcagagugccaauguggagcuuccaaucacucggacccuggggagagggaagggaggacagaugcaggcgggaguggagccuuuucuguggugugcaagccgacuucagccagguaccccggcugggcauuuucccuagugaaaaaugaagcacagcacuucugccaaagcucuggaggcugaauauagggccuggagccaccaaccaacaggccuccgccagacgcaaaugccuugugccaugacagcucccagcugaccuagcuacugagcaccugagaugcagcaaccagagaauugaauccuccucuacugaacgugacauuaagugucaguggucucacauggcuagggcucacagcacagcccuacugggaaggcaagagacaaagaggauucacugggcuuugauaaaccugucugacgccaggcccccucgggaaggacuguaaguauuugcaccauucgcugguugagcagcaugaggucaguuccauggauucugaucagaagcaacacaggugcccacgcaucuccagaggccuggcuauaggaguaucuacugcaggcgggccccucacagggcuucccugagucugauguucaugugccccucccacucuuuccacgucaggcuuccuccucaaaucccaggggaguuuuagcaaguccguguuccguucuuccuccucgggcugcaggguguuccccgaacugaaccuccuacccaugcgccuuggcaugcagcagccgcuccauguuacucaggaacagcuucagggucgcagggucacguuuggggccaauuucugucagaaccaaggccuuugagagaucugcaauaaaaagaauuuccugucaccagaaaaaucaagucuugguucuaacuaaggaguacaggcuuccaacgugagccuuucuuucucagaguaaggaucaucuuucgacugguucaugcugaaugcuuuuuugauaucuauguugaaaacuaaggauggaccgggcacaguggaucgugccuguaaugccagcacuuugggaggcuagggaacaaggaucaccugaggccaugaguuccagaccagccugggcaagauggugagacuccaucucugcaaaaaaaaaaaaaauuaaaaguagcugggcaugguggcacaggccuguaguugcagcuacucaggaggcugaggugggaggauugguugagcccagggguucaaggcugcugucagccaugauugcgccaccacauuccagccuggaggacagagcaagucccuguuucuuuaaaaaaaaaaaaaaaaaaaaaaaucaccaucauucaaccaaaaagaaaagcaaaaugacuccaaacugggaacacucaauguuuggagggaaaaaaugcuucauuaaucgucuaacugcugcaaucgcaacgauagaaauaccauuuucuuggagaaagcaacuuuuaaauaaugcugcuuuggaaagggaagcugcaggagugagcccucuggaugcaggggggugccgacaccuggaauucauggccugccguuuauguaacagcaggcgaggcugccagggcuggcaagccuggcucagggcaggacgugaccgggauucugcuccugucccugacucacugcuggggaucagagcaguuuguccuuguugugccacacacccaaacacagccaaacuucggucaugucccgucaggccucacugcccgggcaggacagugccaaaccaggugugcuccaugacaaaauaaagccacucccaaagucgggggaaacaaauccuaucacauuacugcacucaauggacccaguucugugucaccacuuucaaauucuccgcucacccaggaaaucucucagccagaauccagguccaagugucccuuuucuuccauggaaacucucauuuuacaccuuaaagcacuuucugcaaaacaccuggcuccacaccaaagcaaccugccugcccucaggagguccagaucauucaccgccggccaugcccagcacugaagcugagcuaugagggcacuccugcccugggacuggcagcaggcccuccacagauaccaccugagcccugcagcugccacccacagcugggacaaaaggcggcuguuccaggugcucccuaauccacacaggaucugcagacaggcuccagcaacccuuccauuccuuacccuccaaaccccacccucaccuggccacaaacagaugguauuuuuuccgggguggggguggggaaggcuuccauuaaagaaagagacaucagcagacccaggcugagugggcacucgauaaacaguuacugaaugaaugagugcuuucccucaaaugccagcgcucaagaagguaggauuggagucuuuguuuugauuugguucauuaaauuacuaguauuuuaauuuaugggagaaauguuugaggcagaauuuuguuggcuaaucuaagaaucuaaauacuauauacaauacugauuuuggggguaaacuaauucugaauuacgaauauuuuaguuagaaaugcucuuuuggucgggcgcgauggcucacgccuguaaucccaacauuuugggaggcugaggcgggcagaucaccugaggcugggaguucaagaccagccugaccaacauggagaaaccccaucucuauuaaaaaugcaaaauuagccaggcaugguggugcaugccuguaauccaagcuagcaggaggcugaggcaggagaaucgcuugaacccgggaggcggagguugcagugagccaagaucacaccauugcauuccagccugggcaagaagagcaaaacuccaucucaaaaaaaaaaaaaaaaaugcucuuuugaaauauaauaauaugguaaucuggggaaugcguguuaaauuaaaauuaaaaaauagaaauuggacucacaagaagagauacagauggcaaauaagcauauagaaagaugcuccacaucauauguccucagggaaaugcagauuaacaacgagacaaagccaggagcauggcuuacgccuguaaucccagcacuuugggaggcugaggcgggaggaucaggaguuugagaccagccuggccaacauggugaaaccccgucucuauuaaaaauacaaaaauuagccggguauggcagcacgugccuguaaucccagcuacucaagaggcugaggcaggagaaucgcuugaaccugggagacagacguugcgguuagccaagaucacaccacugcacuuuagccugggugacagagugagccuccgucucaaaacaacaauaacgagacaccucuacacaucuguuagaauggagaaacaacacuaacuacaacaagugccagccaggauguggagcaacaggaacucgcaugcauggcugguggaaaugcaaaauggugcaucugcuuuggaggauagcuuggcaguuuccuacaaaucuaaacauacucuuaccauaccguccagcaaucgugccccuugguguucacccaaggaguugaaaacuuguuuucacauaaaacuuucacaccaguguuaagagcagauuuauucauaacugccaacacuuagaagcaaccaagauguccuuuaguaggugaauaaauaaacugugguacauccagacaguggaauauuauccagcacuuaaaggaaaugagaaagcaugacaagauacggaugaaccuuaaaugcauauugcugggugaaagaagccaaucucaaaagcuacacaccguaugauuccaacuccaugacauucuggaaaaggcaaaacuauggagacaguaaaaagaucagugguugccagaggcucaggggagggaagaauaggcggagcaugggggguuuuuagggcagcgaaaauauucuauaugauacuguaaugguggaugccuuacaacaccaacagugaagccuaaugaaaacuaugaaccuugggugauaauaaugugucucauuuuaacaaaugcaccauucuguacgcgaugcugauggauggggaggcuguacguguguggggacaggagguguauaggaacucugucucucugcaccuucugcucaauuuugcugugaaccuaaaaccguuacucuaaaaaacaaagugaaagaaagagggaggaagggcagggagggaggagggagggggagaaaagcaagggaggaaaaggaaagaagggaaggagaaaagaaaaaaaugggauggcuugcaugauacuuuggccaggaaaaucaaggaagaaugaauugucccagaggaggccaugggggacaagaaagugaaguggcagugacaucuugucuaaucccacccuauuucuaauguacucaucuaacaacuucaagucauacaagugcauacaaugcuuuuguguuuuuuugagauggagucuugcucugucacucagccugcagugcaauggugcgaucucagcucacugcaaccucugccucccagguucacgcaguucucuugucucagccucccaaguagcggggauuacaggugcgcaccaccaugcccagcuaauuuuuguauuuuuaguagagacagaguuucaccauauuggucaggcuggucucaaacugcugaucucaggugaucaacccaucucacacagugcuuuuuaaaaaugauuuuauagcuuauucuguugcucacucuuucaauauaaaaacaucucauauacaucuuuugccaucaguaucuuacucuuaacagccgcacucuauuccaucuggugcaauaacugcaauuuaugucaccauuccccugaagaugaacaauuuucauuuuuauuguaaacaaugcuucauaaacaucuuuucuauagagguuuauacagucauacugauuuuuuucgagauagaugaacacaagugggauuucugaaucaaacggugugcauauuuuagguuuugauauaauuuuccaaauugcccucugggaaagcugaaucaauuauacauacgcccccucaacccuacugggcuaugagggauccuguacuauuuccaagucccuaacaggcaggcucacccuggagguacacucuaagagugauuuucucugagcaguaaaaucaggacagugaaauccuaacacacagggcacuugcuggcaccaguguuaaugacccugggaagagaugaaggaagacacugaagauuucuccccaggaacuaggaagcugagcaaucaauuuccauugggagauaagcaccuacucuuaaaggccucacccagucuccccacaccugagggcagagaugagcacagggcggguggguggaggaaaguccgccagugccagccuagacaggcagguacuccccaugccagggcugguguaggaagcacagagaucuuccaaccaagugcccugggguauuucacaaagggaaguuaauuugugugcaagaaacagcaauuuuucacuugcugacagugaccagguccucacucuuccugacaggccugugcgagcacuucccagccuacgugccacugccccgugcaacagaugagaaacccaagcuuggagaagcgacaugagcugcucaggccauggagccauuacaugguggggccagacuuacacccaagcuugucuggugauugugugaaggcagggguuucuuccauaguuuuccuguuugugaaaagcuugcucugaauccagcaccuucuucuucuggccacccugaauuaauuccuucucauucuugccaacauacguuuucccacaugaaaucaagaacagaguauaggcugggugcaguggcucaugccuguaaucccagcacuuuaggaggccaaagcagguagaucauuugaggccaggaguucgagaccagccuggccaacacagggaaacccugucacuacuaaaaguacaaaaaaaaaaaaaaaaaaaaaaaaauuaggcaggcgugguggcacacauuuguaaucccagcuacuggagaggcuaaagcacaagaauugcuugaaccugggaggcagagguugcagugagccaagaucgugccacugcacucuagccugggcaacugagacuggcugucucaaaaaaaaaaaagaacagaguauaaaggaggucugaauguugccaccuaaaagcaaaaugcuuucuacuguuugauuuugcuccagauaagggggaaaaaacuuaugacaaccccuacuuaauauuaucuuaugauuauuucugacuaguuauccacaauuacuaugauuuuuguauuuuauuacccuuuguccuauauuuaccauaucuuaggucuuaaacgcacacacacacacaaauauauauauauauauauauauauauauucuuuuugagauggagccccauucugucagcaggcuggagugcaguggugcgaucuuggcucacugcaaccucugccucccagguucaagcaauucuccugccucagccucccgaauagcugggauuacaggcaugcggcuaauuuuuuuuguauuuuuaauagagacgggguuucuccauguuggccaggcugaucucgaacuccugaccucaacugauccacccaccucggccucccaaagugcuaggauuacaggcgugagccaccgggcccggccuaauguauaucuuuuuaauuucaaauauucugugauuucaugggaagcagggaacagggaguucuugcuuaauagguggaguucuuauuuguaggaacaaacauuuuggagauuauauagugcugaugauuguacaacauugugacuauaauuaaugucauugaaugguaugcugaagaguaauuagaauggaaaaucauauuuacauacauuuuacuacaauaaaaauaucucauacauuuugaaauaggacaucucuguuuauucuuucaauaaacagauuuuaggaugaaaaugaauagccagugacuuccgacaguuuggaaacccuugcucugguugagcaaugcuaagaguaugcugucuuaggggaaacuuuacaacucaaauaaugagagaagucauuugaguacacugaaauacguacucaugagcugggcguggugguucaugccuguaaucccagcacuuugcaaggcugaggugcgccgaucgcuuugaggucaggacuucaagaccagccugggcagcauggcgaagccccaucucuaccaaacauacaaaaguuagccaggcaugguggugugugccuguaguuccagcuagucggaaggcuggcuuuggagaaucacuugagcccaggagcagagggugccgugagccgagaucagccacugcacuccaggcugggugacggagucucaaaaaaaagaaaaagaaaaaagaaauacguacucacagaguaagaggcaguugugcuuuaaagccuauaaaacaugccuguggcacaagcugguuuuguuggauauauaacuucugugacuacacuuucaucaguguguuguuuuggagguuuuuucugagacagggucuugcucuguuucccaggcuagagugcaguggugcaaucauagcuucuguuaccuugaacuucuguuaccuugaacucccaugucagcccucugaguagcuggaacuacaggcaugcaccaccacacccagcuaauuuuuaaauuuuuuguacagauuggggucuugcuauguggcccaggcuggucucaaacuucugcucucaagugaaccuccugccucagccucccaaagugcugggauuacaggugugagccaucgugccucgccuaacaaggccaauauuuuaauacuucacaaaaacaaugaagagggagcucuagaaccaugaaacuacaaaugcugucuggagcccccacccccgcccuccaagcccccaaagcccaggaauccaaugucaaguaacaguagguaaccaaaaagaacuaugguugaaucccacacacaauuauccuaagaaaaaaagagugaggagcagaguaacauguauaugccaauaaaagaauuuugccaaaaaaaagaaaucuaaccacaaaauaggaguaauaaagaauaucaggaaaaaagagcauaauccaaaucacaggucacagaacuuaggaaaaauuacauaaaggaaauauuucagaaaagaagacaaacuaaaaggaacauaaugaauaaacacaagagauuaugcuuugcaggaaauugagggugaaaaagaggaaacuuuuuuaaauaagauaauugguggaaaagauaaaaagaguacaagaggaaaugauagugaaagcccaacauacauucaagucccagaagacaaaaaacaaagcaacacaauugggaaauaaaaaaaauauuaaaaacuguaauucaagaaaacucuucuacaauuuaaaaaaagaggccagucacaguggcucaugccuauaaucccagcacuuugggaggccgaggcgggcagaucaccugagaucgggaguucgagaccagccugaccaacauagagaaacaccaucucuacuaaaaauaccaaauuagccagacaugguggugcaugccuguaauuccagcuacuugggaggcugaagcaggagaaucacuuaaacccaggagguggagguugcagugagcugaaaucucaccacugcacuccagccugggcaacaagagcgaaacuccauuucaaucaaucaaucaaucaaucaaucaaucaauaaauaaaggccgagugugguggcucauaccuguaaucccagcacuugaggccgaagcguguggaucaccugaggucaggaguuugagacaagccuggccaacauggugaaauccugucuuuacuaaaaguacaaaaacuagcugggcaugguggugcaugccuguaauccuagcuacucaggagacugaggcaggagaauugcuuaaaccuggaagguggaguuugcaguaaaccgagauugugccacuacacuccggacugggcaacagagcaagacugucucaaaaauauauauauuuuuuuauuuuuuugaaaaaucguaucuaacacuguaagccugacaacuuuccaacacuucaagagcucuccugaggaguggugauauuaauaugacauuuuuaguauuuuauuaaaaacuacaucagcacuuagaagcgcugaaaaucucagugaaaccauuucccaaacgaccaauacaugauguuauaaaaucaacaaugaacaaaagauccauucaaaguacaagauagcccaauggauuucaauguaacugaguaccaacaaauccacuagauuucacacugcaacuaaccuuuaagaaaucucuacuuggccaggcgcgguggcucacaccuguaauuacagaacuuugggaggcugagguggguggaucacuucaggucaggaguuugagaccagccuggccaacacggugaaaccugaucucuacuaaaaauacaaaaaaaaaaaaaaaaaaauuagccggacauggggugcgugccuauaauuccagcuacuccggaagcugaggugggagaaucacuggaaccugggaggcagggguugcagugagccaggaucacaccauugcaccccagccugggcaacagagugagacuccaucucaaaaacaaaaaaaauugcuacuuuuugaguuuugguuugauaucaaacaaaaaugcccucaguuaucugaaaagagauuuaaaacacuucuccuuuuuuaaacuacguaucuaugugagguuagacauuuuuuaagacaucaaaaacaggcuggguugguggcucacaccuguaauuccagcacuuugagacgcugaggugggaggauggcuugaggccaggaauucgagaccagccugggaaaccuaucgagacccugucucuacaaaaauauuuuuuaaauuauccgggcaugguggugagcaccuguaguccuagcuacuugggaggcugaggugggaggaucauucgggcccuggaguuggggcugcauugagcuacgaucacaccauugcacuccaguguggucaacagaacaagacugucucuaaaaaauaauaauaauaauaaaagacaccaaaacaacuuauuauaacagauugaaugcagaagcagauaugagaaucuaguugucuuacauuaagccagacauaaagaaauuuggaaaaaauguaaaacuaucccacucuccucacuaaagcuuucuuauuuuggaaaauaugauuaguucccauaaaaauauauuauucacguuaaaauguaaugaauuuuuaaucuuaaaaugaauuaauaaauguuuuaaaggccuucaguaauuuuuuuaggaguaugaauggguuuguccuaagaucaaaaagcuuuaaaaaugcuauacuagagaauguacuucacacaaccagaaugacuggagaagcaucagcacacaggacagugguggcguuaaaucuguacccaccuguggaaccaugacugaaugauggcuuugaggugagagcguggcacacaguggcugggugcuaucccaaugaggaugcagcacaaccauccagagguggacaggugacagagagaggacaugacccauagaacaagcuugucaacuguuacugagagcaaagguuaucuuuuuauuuuuuuaagagaugggguugaggccgggugugguggcucaugccuguaaucccaauacuuugggaggcccgggcggguggaucaccugaggucaggaguucaagaccagccuggccaacaugacaaaacccugucuccacuaaaaauacaaaaauuagcugggcaugguggcaugcgccuguaaucccagcuacuugggaggcuuaggaggaaaaucacuugaaccagggaggcggagguugcagugagccgagaucgccccauugcacuccagccugggcaacaagagugaaacuccaucucagaaaaaaaaaaacagaaaaaaaaaaacccaguauaacucauuaucgacucuauauuuuaaaaauauggucaggugcaguggcucacaacuguaaccccagcacuuucggaggccgaggcaaaaggcucacuugaggucagcaguuugagaccagccuggccaacauggugaaaccccgucucuacuaaaaaauacaaaaaaauuagccagaugugguggcgcaugccuguagucccagcuacucaggaggaugaggcaggagaauugcuugaaccuaggauguggaggcugcagugagccaagacugcaccaccgcacuccagccugggugacagagugagauccuguuucaaaaaacaaaacaaaacaaauaaaaaauacguacuuccuagcacaguccagugaaaaggcaacaaagacugacccaggaacaggaaguccccccagaacgcagacuaugaccuuaggaggccacuuuccauaaaaacgagacaauuggaaauuugaacacugaugggauuauuugcugauuuuagggaugcauuuuggguagagagugauauugaugaugugauuguauuuguaagagagcagucuguuuuuggagacacgcugaaguacugacuaggaagugaccugaugccugggauuggcuccaggcagcuggggguggcgggagcugguggacacacacgaagcaggcgugcugccaugugaggggucauggggcaucauuuugcuuuuucuguguacuuuguguaugucugaaauuugcaugguagaauuugaagaagcagcuaauaaaauucuugccuucuucuaauccuuuaccucuauccagugcuguuuuuuaacuugugaguugaagauauuccagcaaggcauaauagaaauaagaaaggggaagccaagggaagcagaaagagagagggagaaagagagagagauuaguggugcuuguuuuaaugacuguguccuccagaaacaaguccuaauuuuaacaacggggcaugacuugauugguuuugugcaaagauucaaguuucuucuuugauaaugguucucauuuuaggauacugugccccaggcacuaugcugggugcuuuauaugcguaacuuauuuaauccucucgguuauuuuuauuaucaucagcauccccguuuucaauaugaggacugagauucagagagguuaaggaacuugcucgaguucuagucaccuuagaaaguggcagaaucggccaggugugguggcucacaccuguaagcccaacacucugggaggccgaggcggguggaucacuugaggucaggaguuugagaccagccuggccaacauggugaaaccccgucucuacuaaaaauacaaaauuagucaggugugguggugcgcaccuguaaucccagcugcuugggaggcagaagaaucacuugaacccaggagguggagguugcagugagccaagauugugccacugcacuccagccugggugacagagcaagacuccaucucagaaaaaaaaaaaaaaaagcggcagaaucaggaucugaaauugggucugcauggugccaagagaccgugcugcugaagagcaugcacugucaccuccugaaguccaucuacccauaggaaagaaaacaaccaugguagaaaacacguggaaccgccuguccugaaugggccaguuuagguuuucacugauucuuuuuggccuuucucccauauggaggaauuuggugauauuuuauagcauugugagacagguacuguagggaacagaagaauaccagacaaaugagagaagccucagacuagcagcagcuaucugcuaugcauuuuauccaucagaauuuuucuaaagucacaaaugaguuucagaacaugagcacuucauguuuccuucauucuacgaaauuaccaggccuacugggggccacauaaaggggcccuggacaaagcccuugcccuaguggaguuggugcuugagcuagcagccugcaggcugggaggacgcagaguugcagccugacugagcuacacgggcgggcagccaggaugccaagagcauguuaauagaguucaguguuauaauccagugaaauauagagcaaaguucacccgagcaugcuuaguagcaugcuuccucaccaccaguuacacaaugaggcuggagugggcaccuccuggcacgcacagcuguaauuaaagcuacuuuuuucacugccaaacaaaacacuucuggagagggaaggugaggcagggccagaggccauuccaaggccucucugggaucagaagcucuaacuggugaguccaacugcugguugccccucagaggcccccaugacuucucccuuccccugcucugggcucuccugcagccaccuccucuccuuugcacaaucuugcccuucgugucccucacacaguggcgggcccucuccugacaccucauccauccuggcccgccacuuuccuggccgcacgggcucacagcagcagagaugggccauggccauagcuccucucgcugccucgaaggccaucugggcacacaggcaucagccagggaggaaagaaguaggaauaaauagagacaaugaagaaagguugccaggaaaggaauuuuuaagagaggcuggaagugggucaagaggggaggcggcagggaggcugaugggagagcagaagaaagaguguaacuggcagggaaugagauggggggcccugcaugauguccacgccagagacacacaaggcagaaacaagcagcagugcacuuccgccuuuucaaacccagacaugcagguauuauggagcuuguaaaaucucccaugcagcugcugcuagucugaggcuucucucauuugucuggcauucuucuguucccuacaguaccugucucacaaugcaguuaaaauaucaccagauucauccaugugggagaaaggccgaaaagaaucagugaaaaccuaaacuggcccauucaggacaggcgguuccaggcaguaugcagggaaugggaaccccucucucagagccacuggaugacccugagauucugggcuaaggaaaucacggcaggccauaacugcagaggggcuaaggugccucuucacaugacucauuccccaggauggcucuucucacagaagcugaagccaguuacuguugugcacacucaggggccacagacugcaccugggcagcagugccugggcaaaaucgggaccaccgaggugugccgggugcucugaggggaacaagcaccuggccucgggcugcucacccaaucccacuacaaccaaaucgugacugcgacuggaguacuuuuagccugaaagaugagggaugugagcgcaaagcagaaugagguuauuuaaagcuccuggccacgugaacaaaaacacuaacauacagaacuggcuccauuuccaguucaucagggacacgaugucccuaaaaagagaugacaccaucagcaagggaccuccaccaccgucccacaucaugguggcuuuggcauucuccuuucacacuuuuauuucagaaguaaacugagacgagcguugugaagcccaccugucuccccggagacccggagccgcuggccauugcagaaggcgccccgaccccgccggcccguguacagccgcuccucugugcagugguaaaucacuccgaauucaagcugugggcggcagaggcaggacagaaaacaaagaugguucacucguuugaugugggaaaaaacauuguuauucaaagaugaaggcugcgcuaggcguuaggauaacacauuacacugugacagaaauuaccuuuccaaaaggaacugagaaaaagcagugccugcauuuaaaaugagaccuggacauaaaagcaagcuugcuuuugcuaaauaaguacaauuuuaaaauauauucagacaaacaaaacuuuaaaaauuaacaucauaaucaaguauuaguaaccagaaguuauugaaaaagcuuaauuuuuuagaaaggccccuuuuguugcugaaaaaaagaauguuacuugugacucuaaccaaaccccacaagaaauccucaaaauugcugaugugugaagaauggagaaugcaucuguaaagccagcggaaucucagaagcccaaggacagccccagcgaggaagaggcaccgccgcagacuggggacugauccgugagcaggcagugcgcugaacaguggcccgacugccccacaucagggaacaaagcaucagaccacagccucccaggaugaagcagcaaaaggaagaggucagcguggaaaaggacggcagcccacggccgcgugccucugugaucuuuccucuaccgacuuuucaccacucaggguuaacaagggccagcaugcuugcuuagcaaguuagccaaguguucaccucucuggaaaauuaaaaaaacacccuggccaaaugccuuaggaaagccuuggcuggcccuggggugagcacaaacacccuagaguggacaccccaagcuacagagaaaggguuuauuucuggcgguuggaggcgucauucagucaacgcuuuuucagagccugcaggugucuggcagcauuucaucauccuuccccuuccgguacccuggcuuuaaaggaauccucaugaccaggucaguccuagaauucggcugguuccugaggccugugaagagcucccagagugcagaggaaugucccccacucccauggggaggagcccaccacgaaaagccaggagcucccguauucaguguaguaacauaggacagacccuagccaacccacagaagggccaaggaccuagccagcuguuccagcagccccuucacacagucacagaacaucaaucaaccccugaaguacugcucagccucccacccacucugggcaccacaauauuauuuaacagagaaagacgucaaucauugcauccuuagacaaauuacaguauuacaauucuuacuuaucuucagcuuaaguacuuugagauacuuuaguacuuaacuuuaaauacuucaacuuaaguacuucucucagcuccccugccagggagucugugcugagacuaaggugaagcugcacaaaugcugcucugaagcagggcugcuuuugagaaacaugcagcccucggcccuauuuaaauaaaacuguuucaauuagaaagaaauuaaggcucuucucagugcugcugcuugaauuauuuaauaagcuuuaaaccucagccccacgccuuccaugcaggucgcacaacacuguguaguucagaaggucuaugggaaccaugaaagagcuauguucucaugcuaauaaccagaggaagauaagaaagaauuauuagaauauugggauugaggaugcucuccaaaacuaagugcuccuuuuaguuugugagaucacacgcucuaggggucagcuggagaugcacuuggaccguucacuuaagacuuccgcuuccacagcagugucacaaauagaccacgguugacacgaggccagcccuccacgggggacaagggccagccacggagccccaccccgcacaccccaaagccagucuggacuuguuuauuuucucggauuugaaacccacaggcuuggauuugccagucaugauuaaggcacagggcaaacagcaaaccaggcgcacagaggcugaagccagaaaggaaggauggccagagggagcccagggaggggcccuggggaccugggccacacccgcaccucuugucgaacagcaaauccaaugcuaaccgccacagucgggaaucugcaaaggaaaauagaaagguuuacucucuggaacaagagcggcagcucucgggagccugugugcugugcggcuccccgcaggcucagaaggaccuuccuacacucuggguggguugguuguuuaaaaacuacuucccacaguuucacuaacugcuuccaagacaaacagaauaaacugaccaugucguaagacaguuaaccuugaaagaaaacagcacugugaaagucacauaagacugauguaacucaacaacccucugaagcccaauuaggaaggaucucaaucaucuguuuucugguucuccagaccuaaagggacagcagagcccuccccaaaggccagacccagucccagguggggcgccaggcagguggucccagaaggcaccacagccuccccaugggggccaguucugagccacagcucacccuguggcacugcuagcaucccugccugagugcccaguagccagcugcagggacagccacggcugcagacaguuuucaugaucaguuugccugcaguuuugugauucugcuauugccgcucaauaucuucaaaauaauccuuccuuuauagggagaucacuggagcuuaaaaacaggcaggaaaggcuggguacugcaaacugacaggaaaaaugcaaaaccaauuguacacaaaugcaacucugacugccagggugugugggaccuugggaugagccgcuggcuuccagagcaaaugcaccaugugccaggccucacgcuuguuccagugcccaggagagcuuucucccacugcuguggcccagcacuggugggcacaggggugaacaggcgccaucugaguggcagaugcugguggcuuucggaugucuucagaccacaacaaucaccacagcuauagcgugggguucaggaacugucaggaucagcucuggagacuguucugaaauugcugcucuuuucccagucaccuccccaguaccaggauccccccaggggugcagacaggaaagcacuggaaacuaugucucuggagccacugaagacccucgaauggacguguggccuucaccaugugacggggcuucaccugccaugucaccauuaugagcacccuggaaccacgagcaggcagaaguaaugaggcuccacucagugacauacucuggggaggagagcccugggaaggaucaugcuuuaguugaaaugagaggagagauuggugacacauuugcuggcaccagauggcacgacuccacugccucgaaagggucaccuuauguaggcacaacugaauucucgaggcaacucaccuagaaaaaggcugugcuuagcauggaauaacuucauguuuuacauauaaacaugccaucagaggcagaucauaaaggagcccacacccgggcucugcucacccuuccugcuuagcgcgugcagccuagugugcuggcgugcacugugagcgcaggagcugcaagccacccgcccauggaaugggaaucucuccaggguucuccagagcuggagaaccacgcuccguuuaagccacaucaugcucugugccccaggcccccagccaccugugcguguagacaggcagcgcagcaccaucaccugccacugccagagaacaccuguggucgugucccugucaccuuugcauccugucacuucaccauccccgaagcuccauucccuucaccuccccacacgggcccuucugaccuccccaaaccuccugcuuuuuguaaccacaagguuugcucucauacaggaagcuggcucucaagucucaccugucacaggccacucucuacaccuugggcuccgggccacuguggggcagcacaggcuuuguaucccaaccucaccuuuuucuccaguggggguggggugugaggggagucagacuccuucaagggguccuuguuaaaugcaacccaacauuuuuaacauaacaaacugguuuuuaaacaagugcagauuuccuaacauacuccaagagccucucacaaacggaaaaccuuauuuuaaaaauaucaagaucugaucaucuuucugaugagacuaugaguguacuauagguuuguuuauauauuccugccuuaaaaaaugcugcuuuugaaaagacaaaaccucacagaagaggacauguuaagcccugcaauggaggcgaucccugcucagcucaccugugcacaaaauugcaggugccgucgauggggucgaugauccacgucgggcugugggugagcacacacuuggccccagaagccgcggccucuucugcaaugaaccugcaguggaagaacccagccugagaaaaugcaccaaggacacagaauaacgugccugaaauugcuuccagucccauuaaagaaaaagguggcacagcaaacagaugucaucaugguuucucugggucaaacagaggcagagucuuuaaacaaccaugugcuuuuugaccugccugccagcggaccuacucagcaggauuuagaaaacagagugacaccucagugccagcguucagaaagagcaccagggaauuccagcaggccaggcagagaaaugcaagcgugaagaacacuggaaaacagaucuucugaagcaaaacuaaacucgauuuuaacuucagucuguaggggaggaggcugaugagauaugaccaagcaagguggcccaggacucugacuuugauucucccagucaaugcugauaccugggcaccgagggguuaaaugucacuugcagcugagaucucccacgucuguacccagccuggcucaccugaacugcagacacaggugacaaacagagcccccccgcagcugguucauuucccaaaggugcccuuccugcccugguaucugacuucccugguuuuuuuguuguuguuuuuuaagagauagggucuugaucuguugcccagcuggagugcagugguaucaucauagcucaugcagccucaaacuccuggauccaagcaauccuccugcuuuguucucccaaguagcugggacuacagaugcauaccaccacauucagcuaguauuuuuauuuuuguagagguggggucuugcuacauuggccagucacaaauccagcuucccucugggagcaagcaaggguggggcugcaggaaggagagaggcugggacgcucccugccccaugugcccugugcaggcuccacuccuccauguggccugcuugacacauuccugcuagagggacaugggcggccugcuccugcacucugcagcaggcccugggcuggccccuccuuuguaaugagucccucugcaaacaaggcccccuacaauccucacuugagugugcgucuguccugcuaggaaccugaccgagacaauguucucucaagauucaccugcacagaagggaacuccugguuuucucuacuugccucuaccuccacgaauggcaacucccagcacccccugcucaggccaaaaacaagggaaagcacucucgccccaugcacugucacccuuccuccugcaccccacccacacgcaggcccacacacacagggaagaugcuguggucagguguauucgcagcccaccuucugcaggcuggucccuguggagcuggccgcuguuuacaccuuccaaaggcauucucaggaucaaagaaaagacuagaucuaaagcauucagggcagugcuuuugacacucuuggacugucccaaguucacuaagggugaggccuugggcaggcgcuaagcaaacaucuguucugugcaugacuauguggccuugccgagagguuuucuauccaguuccugugccggguucacauguguacuagagaaaaaggagaccugcagagaguaagaaaaagaaaauaagugaaaaacaagcaaggcgcgguggcucacgccuguaaucccagcacugugggaggccaaggcgggcagaucaccugaggucaggaguucgagaucagccuggccagcauggugaaacccugucucuacuaaaaauacaaaaauuagcugggcgugguggugggcgccuguacucccagcuacuugagagacugagagaggagaauugcuugaacccaggagguggagguugcagugagccggagguugcagugauccuaacguugcagugagcugagaucacaccgcugcacuccagccugggagagugagacuccaucucaaaaagaaaaaaaaagaaaaagaaauaaaaauacaaaaauuagcugggggugguggcgcacgccuauaaucccagcugcuugggagucugaggcaggagaaucgcuugaacccaggacgggagggaugcagugagccgagaucaugccauugcacuccagccggggugacaagagugagauuccaucucaaaaaaaagaaaagaaagaaaagaaaaagaaaagaaagaaggaagggaaggaaggaaggagagagagagaaauaaagaagggaaggagggaagaaaggaaagaaaggaaagaaaggaaagaaagaaagaaagaaagaaagaaagaaagaaagaaagaaagaaagaagaaagaaaaagaaagaaagaaagagaaagaaagaaagaaaagaaaagaaagaaaagaaggaaagaaagaaagaagcgucccauguucugguguuugguguauuauccacuguggucaucagccuccuggaagccacuuuccccgcacgaaccauguggucuaagauuuggcaucaaugaacuuuuggauaaggcuggagacuugagugugaauggaaagacugaaaugaaaaccucugugaccgcucagcgccuuacaguagccagucaccgcauauggcugcuuacauuugaauuaaauaaagacuucaguucuucagucucaugagccaccuuucaagugcuuggcagucacgugggugagcggcuaccacuguggacacagcagaugugggccaccccugcagcaacagacagagccgcuggcagugcuguccucccaccgagaugcugagaggcaacagcaggcaucucaugguauucgaugucacuuuuuuuuggagacagagucucgcccugucgcccaggcuggagugcaauggcgcgaucucagcucacugcaaccucugccucccggguucaagcaauucuccugccucagccucaugaguagcugggauuacaggcgugcgccacacgccuggcuaauuuuuuuuaucuuuaguagagaugggguuucaccaugcuggccgggcuggucuugaacuccugaucucgugauacgcccaccucaggcucccaaagugcugggauugcaggcgugagccaccacgccuggcccgaugucacuuuucuaugcacgggagcugccauacacacuguaaccacccugguccccauccacucugggaccauccuuccacugcuggguuaugaaguucaugccugggaugcagagucauccagccccuccauuuugcugauaaauuaucuagaaauacaacccugggauacgacaagugcacgcauacaucaucucaggcugugcgaccuccuccccggcccccuggagaaacccacgaauaagcaggggcuucugagccaagaagaccaggucaagucaagccaggagcacuaagcaagacacccaaggaaucaucagcuguuccuggagagccugggcaggcucagucugccccuggagcuuucagccuagccaggcaaggcagaugagaugcagugaacccaggcuucugguucuucaucuacacugcacgccuugcuccuugcaggaacugccucuccacucucaguuguccacaugcuucuaggucaggugaugcacaggcccaccagccagagccccugcucaggaacuggugcuccccaaacagaucuaggaggaaaaaugguggguagaagccacaauggcagccggggcaggggguggagaggcugccuccugacaacagcagccugcaggagacacacaggugaugauuccacuuagggcgugaucauaagugcugucagcacugccaguuuuccuagaaacuucaggcacuaaaucuguuuuuccaugucuucuguagcuaugugacuuuccucuucuguaauggcuugcaaugacguuuuuaaagaaaacgcuccacacccugaaaacacacauacaaggagcaacuacgaaagcuuaaacugggcacaagguugacaaagcagcgaacagauaugacucagguccagagggacuagaaaugacucaggcacaaagguaaguuucuaagaaacugaggaggaaugugcaauucuucuccuuuuuaaaccugacuucaaguaggaaacugaagcgguggaaagaaaacugccagugagcccugaaggaggaggcagugugggucugcaggcacugacacuccacacccaggacaacucacgcugcagcacccagaccacccacgcggcaugcccacgugccucccaggacacucgggagcaggagcucugucuguucauucgccagaugcgugggacacccuuuagggaagucaccaagcagcuuguuuucccagcagcaacuauuaauauaaguuaauuuguuaacaaagcuucugcuguguguaaccuuuauuauuuaucuauuuguuuuuuagguuucauuuaguguaacccagcaaguacuuuuagaaauuuuuuuuuuuuuucuuggagacauggucucgcuuugucagccaggcuggagugcaguggcacaaucauggcucacugaagccacaaaccacugggcucaagcaauccuccugccucagccuccugaguagcugggaccacaggcaugcaucaccacaccugacuaacucugccucacauuuuuuaugagaauaacucuaaguacccacacugagcacuggauguuuuucagcagcugaucauucauacccuagagcugucuuccucaucacccaccuuguguacaccucugcccaugagacugccugcccgccuacaagguggcacgagcaucccccuucccaccugccucaugcuugugggcagcagggagcaggcuucugcacuguguggcugcagcggugugaaggccagcagaggcgugaaccgugcucggucuuuggaggcaccaaaaauacuucccugguacaugggaagagaugcacaauuuuuauucacuuaaaccugauuuuacucauguaggaagcuaauaccugugagaugaaagacaauguuuuacagcugucugcagagggaguggggagagucugcucugcagacaugacuguagacagaugugugaaaucauaaagaccuuccuaaaagccacuggaacaucuacauagaauccacaauauaggcagggcacgguggcucacgccuguaaucccagcacuuugggaggcugagguggguggaucacuugaggucaggaguucaagaccagacuggccaacauggugaaaccccgucucuacuaaaaauaugaaaauuacccagacauaguggugcaugccuguaaucccagauacuuggaaggcaggagaaucgcuugaacccgggaggcggagguugcagugagcagagauugcaccacugcacuccagucugggcuacagagcaagacuccaucucaaaaaaaaaaaaaacccacaauauaaauaggaaaaaaaaugcacaugacuaaauuuagggaaaaaaagaacauuccauacgucuauccaauagacaagaggaaaauagcaacuggauuaaggcuaaaaguuugguaauaaguuauuauagaauauuauauccuacugcauaacuuaaccacuuuucuuuuuuaaaaaauaguuuuaacaaacccuccuuauaauuuugacagcugagugccuuuaagccccuuuuuucuuucuuucuuuuuuuuucuucuggcuacuuagucuguuuagucugugacaagaaggucaggaucaucccugcuguccacaaaggagaugauuuaugauacucuguccccaucuucacaagccacugcccagugggaaagcagcuggaugucaauguucagcuggugguggcugggagcauguuuuucccaugucaaggauucuguuugauguuuugcuugacucacgcauucaacagacacugcucugugcugggcacugcagggcagcagguuacaugggggcucuggagcagggcugggaagacagcuaaaaacacuagacccuugagcugcugaccucaucucugggccuaggccaacccagagaagcuccaacaggcugcuccacagaagggacaaggacgggguuucuaucacuauagcucagggaugcuacugaaucuuuuccaaguagcuacacuuguaucucacucaaaaucaucaucugaaaacagguuuaggcgccccacaaagccagggcauggcaggagacagcuauguggccaaggccaacagcacacuccaaagacccaaucuauaaaaacccggccuuaccaugcugccuuuuuuuuuuuuuuuccuuuucuuuuuuuuuuuuuuaagauggagucucacugagaugcccaggcuggagugcaauggugcaaucucagcucacugcaaccuccacuucccagguucaagcgauucuccugucucaaccuuccaaguagcugggacuacaggcaugcgccaccauggcccagcuaauuuguuuuccuauuuuuaguagagacgggguuucaucauauuggccaagcuggucucgaacuccugaucucaagcuauccacccaccucggccucugaaagugcugggauuacaggugugagccucugugcccagcccugguuugcuuuuugucauguuacgaguuaaaugcugggacuucagggaugaccauggucaggucccucauucacaggugaggaguucgaggcccuaaguggugagauuugccaaagcugcuagggccagugacagaagcaauuuuauuuauuuauuuuuuauuuuuugagacagaguuuugcucuuguuccccaggcuggagugcaguggcgugaucucagcucacuguaaccuccaccucccagguucaagcgauucuccugccucagccuccugaguagcugggauuacaggcacgcacuaccaugcccagcuaauuuuuuguauuuuuaguagagauggggguuucaccauguuggccaggcuggucucgaacuccugaccucaggugauccacccgccucggccucccaaagugcagggauuacagguguaaaccaccgcgcccagccuauuuauuuuuuuguuuugaggcagggucucacucuguugcccaggcugcagugcagugggguuuuucauagcggcugcaucaauuuacauucucaccaacagucugcaaggguuccuuuuaaucuacauuuuuuuuuuuuuuuuuugagacaaggucuugcucugucacccaggcuagacugcaguggcagcaucacaacucgaccuccaggacucaagcgagccucucaccucagccuuccaaguagcugggagcauaagcgugcaccagcaugcccagcugauuuuuuaauuuuuuuguagagauggggauucaccauguugcccaggcuggucucaaacuccugggcucaagcaauccucugaccuugggcuccugaagugcuaguauuacagacaugagccacugcaccccaccagaaggaaguuuaaaccuuaucauucuuugauucagucuacaccugucuuccaggucaaggagcaaaccuuuggauuucauggaugagugaaauaaaauaauaaaacuggggagccuguaucagguuuuuaaaaaaauguuauuaagucuauuuuuaauaucauuucaugaaagacuaaaaucaaggaaagagaaaagcucagaauaaaagucuuuccuaaaggaggaugagaggcaacuucaaauuaaauauauuguuuaagggauauauuuaaauacuuagaaagcagaaaaaaaucacaauguccuauuuuacaauauguauacaauuuucucucaucacaaauuuaucaacuuuucuaugaucuaaaauacaauuaaauccccaaaauuuacuuucuuuuuaaucuuagucauuggcaaaaaaaacucacuucacauaaauauguugaaaaacaacugcauuugaugucaauuuuugaggcacacugagcagagaagagaacagcugcuuucaccguguccacacauucacccucagagcuagggaagaugggggugacacacagacuggggcuguccguggugcagccacaguccacugacuugugggcuagagcuugggaaccccagauuucaaucacugauuccuggacaggugugugggucugacccuaccagggggccuuuucagagauggaggcugguguucagcccgggcacgcucccagguaagccugucucacccuaccuauaauccccugcucugcaucaugguuuucccaaggaacucuggagucuggcggucccuggcaacccuaaggccucaaggguggagggagguaccugugcucaccccauaauacauuaacuuuuaccuuguguacacaacagcgaguaucuaaauuuaccuuuuacaaauggaaccaacugcacacauuaacccaacaguggguugcgugcaaucucagagugcaguuuguccaagugaccugacugaaacacaucacagccccaauaacuucacugugccugauccugcaucuccuccaagccuuuaccagaccccacgcagaugagccagcccucccaugccacggccacacggaucaucaccgcagaaaccucuaggccaauaugguuaauaaaggaccuggaaacagccggcucguuacugcagcaugcuuccucucaaagaauccauaugauaaauucuuuugcuauugcccuuugauuaaaauuagguuuauuuauuuauuuuucgagacagagucuugcucugucacacaggcuggagugcaguggugugaccucggcucacugcaaccuccgccucccagguucaagcaauucuccugccucagccucccgaguagcuggaauuacaggcccacgccaccacacccggcuaauguuugcauucuuaguagggacgagguuucaccauguuguucaggcuggucuugaacuccucacucgugauccgcccgccucagccucccaaagugcugggauuacaggugugagccacccuaaaauuagguuuuaaaaggcuuuuuaaaaaucacaaacacuggggccgggcguaguggaucacaccuguaaucccagcacuuugggaggccgaggcgggcggaucaugaggucaggagaucgagaccauccugacuaacaaggugaaacuccgucucuacuaaaaauacaaaaaauuagcugggcgugguggcgggcaccuguagucccagcuacucaggaggcugaggcaggagaauggcgugaacccgggagguggagcuugcagugagccaagaucacgccacugcacuccagccuggacgccagagcaagacuccaucucaaaaaaaaaaaaaaaaaaucacaaacacuuuacacccuauaacuacuguaaccaauucuugggauccugaccucaagcagaguagggaaauaggaaguuagagaagcuuaaacucaaagguugucaacaaaacaaacaugagcgacuggcaaacagaaauucagagggagagcugguaaccuugagauaaccuaacaaguuagaaggaaacgacgggaaaaaaaaagaagguaaguguuuaacacucgcuuguucuuucauuuauauaaucauucacagaaaaaaaaaaaaaaaaaaaagagccagguggaguggcuccuguaaucccagcuacucaggaggcugaagcaggaggaucacuggaacccaggaguucaaggcugcagugagcuaugaucaugccacugcacuccaaccugggcaacugagcaagacccuaucucuuaaaaaauauauaaaaauaaauguaaagaaaaguauuuuaagccuaccaugugcugaauggacacugagggagaguaccaucuauauuucugccaccuaaguccaucuaaaccuggaaccugacaguuauaauacccuacagccagaaauccaauaacugguauuccaguuuuaagaauccaacaucuuuaaaagauucuauguaacgaagaaaaaagaucccuugcauggucuucagcauuuauacugcagaacucuagaggugagagaggggccuuagagccccccagaguuaaagaagaugucucaaucugggguucauggcucccuuaaaaugcuaugcaaaaugcuguguaaauauuuuaauuuuucugaacaaaagauuaauagcuagcaucaaauacucaaagggugaccccaaaaagguuaagaggugcucauacaggccucuugcagggacagcucuggggcccggcuguggcagccauucccacugcgcccucuggccugggcgagggggcgugcaucacuaagcacuaguggugggccgggggccccacgcggcugccagugccacuuggcaucccauccuccugggaaaguugcccaggcagcugaacaggcauaggccaccaggggacaucaccacuccaggcuucuuagggugggucacacuucuaguggguccuuccagaaauaacaaaugguugaguacaggggugcaaggagcuuuuccugagcauguguuguaaaaagagcugcuucaauauucacaagaggaugcauugacgugaugguuguuaagaugacaguaaaaagaaugaaaacagggcugaguuugcuuacuaaguaacugacaaaucgcagguuaggcugcguggcuuagggcuucacgucuggccacaucaacaaacagcagagcccccugaccccggcagacccugcauucucuaugaguguggccaggguuacuggggguguuucccagaggaguacaccuaccugugugaaggaaaccucucucgcaacucagaaauaauuaaaucuuccacaaggugaucuguuucugucacaagaucugcagcugauguuuuuguugagacacguuuuuccucaguaagggcuuuucugaugaucugaaauaaaaguacgggauuuggguuaaacaugcaaacauccuccucccaggcaaaggaauuauccacuccuucgaguccccucuguauucagccugccauuggguggggggggggggggggggcggcgggggcagcagguguggcucugugggucacugacuucuugcaucauugaccucagagcuaauaucacagccuaggcucucuggguuucuagugagccuuaaugacuccaccauuauucuuuuacaagaaaaauuauuucuccauuacuugaaauuauuucaaaauuauuuuguugcaccugugaaacaacuucucuucgaguaaaagaaaaacacagggguuuugaaaagagcaugaaacuuccucuguaagaacggcccaaaacaagaucauguuacacaccugugcccuguauaaucccaugaauucaaauuuaggagauuucaguguaaaguaaaagcuuauuuucccuaauucacuuuaucccaugaaaugggauaugcccucgaaucugauuguaaauguucccacugagaaacccgggagagcuaaacuguguuucaggaaccauggccagcucucacugcgcucugggcuggagcagcaucagcugucucagaguucaugcaaggauccacagggcugagcuccgacacaggcuccgcagcugugcaagcugccaacacacuggucuaaacccaucacagcuauacauaggagcaaggacugggauggucccaagaaccccaggaaaacccaaacaggaagggauaaagaguggcuaaucagucccuggacaacuccagagggaccaguucugguccagcccaggccuuucuucuccuuuuuguuuuguuuuguuuugcuuuguuuuguuuuacagacugggucucucugucacccaggccgaaguguggugucacaaucacagcucacaguaaccucuaaccccagggcucaagugauccucccaccucagccuccccaauagcuaggacuacaggcacaugguacugcacccagcucauuuuuuauuuuuugaagagacagggucuugcuaugcuagccaggcagaucucaaacuccugggcucaagcgauccucccacugcugccuccaaaagugcugggauaacaggcguaagccaccgcgcccagcucuugcccauuucugucugucuuaacaacuuggugucucccucaucaugaugacaaagucagggcaccuaaaaacgaacucagagccuucuuccuaaacuagcuacaucccagaauccuguauuucucucaaaaggaccaucaauuggccaggugcccggacgugacauccaucacgucuucugauaagcacacaccaaggacccgcucaugccaggcccugugcugccagaagaagcacacggggaauucuacagaacaggcaggagcccccgaaacucagccucccaugugcuccuccccauacggggcugccugcucuucucacugccuacaucccagagcuggcccacgcuguacugagccaaggcaguuuuuguuuuaaucuugguugcaaaaaaaacagauauauguuauagaaaauucagaaugugauaggucauaccaaaaaaagcauacagcguccacauagccauguccacuggguagccauaacuccaggacuucauauuccuaugacagccuccagcucccacugcccaggcccugccucuggccaggguuuccuaguuccugcucauugccaccaggucaauuuucucaaaucaccaauuugcacacaggacucucaacaaaucaagcuccacaggccuugucugugaaucucacacuccucacauguggcucccguagcaucugcccaugguccaggacccucaacccugagcuggccagacaggccuucggcacaaagcuugucucauguauggccacggugauuccugaugugugugugucucuguuguguaccuguaaguguguguucaugugguauggggggagucagggugugugucucuguguguaucucuguguguguguguguguugcuguggugugagaggaugcagggugugucuguaugucuaucucuggguguguguguaucgguguggugugggaagaugcaggguaugugugucucuguguguaucucuggguguguauggauuucuggguguguguguguguugguguggugugggguuguggggagugugugcauagagcuggggugagaaaggcagccuaaccaggggacacagccccagagaggauauggcagcagagccucugggaucaucaaggaagggcagacugugcugcacaggucugacuggggucugagagcugcauuucugguaagcucuauggugacccugaugcaggggugcucacuucaguagcauggagcuagagcagagucucaaacucccacgugaagagagccacuaggagaccaggauguuccaccucagcgggcggggugggcagguggugguggguucugaacccaggaccaccaucugagaagacaguggcuuuacuucaugcuuguggcauccccacauggggagcagccauaaagcuaccugcaaggguggcugguauuccacucguccacacuugcagccucuacgcagcagcuggauggggaauuuucagacaccaauuacaucacaucacuguacugcagaaaaugauccaacggcuucccgcugcucacagaacacaucccaaaccccagggcccuugggaaacuccaaaucccaaaucccagggcgagcccuucacagcucaccuccgacaggucagccccaaguugcucuccugcugugcucugggguuuucucacugauccuaaccaaaucuguuucugcccccaaggacuuccuguuuucugauccuucuacaacuuaccauaucccaucugaaaccauccuuccugucgguuuuguuuuugacugucucucccaggcaggagcucagagggcagagcucuuucuacuucccuucguccuuccugucuguuuuguuguugacuguuugucucuccuaggcagaggcuucugagggcagagcucuuucugcuucccuucuguaccccuagcaucaggaaugcucccuggcauucagcagauacacauacagcagguacacagaguucuuugaaagaaugaauaaaacacacauugggcugcuugaauagacuguaacauuuuuccaaacgggaacacuagugucugugugagugcugaccacccagguccuucugucuggcuguuuuucugguugcccuguugaaaagauccagugcuuccauccacaagucccaccuccuggagcuagaccagaucugcuuccugcacucagacccacucucccggcacagccagacgcacuuccuaaaacauggucacggugaccaugcgucuccccagcagagcacuugguggcgcccugucacuauguggauaaagucaaaaccccugaagggagcauaaaauagcuuccagauuugcccuuguagcagagaccauuugaccccaaacguccagucuccccuucuuccuuuuaggaacagaaccuccaaguuggagcaagcacagagcugccuugcaaucugcacaccacgcggauacguguggccucagcaccaaguucugccccagaggaugggacugaaagcaagaccugcaacuuccgagucacauccucaaaaggauacugccuugcacuuccucgugucccauucccccucaccacaggcuacaaaguagguguggugcugcccaugcaggaagaaacaccucggagcaaugagggaggacaaagcuggaucccuggaugacuuuguggagcagaccaccccaccccauaccucuuacuaacuagacuuccccugcuccucuuacuggccucugugaagaaaccaaacaaaccauccacucagcagcugcgggccuuucccgaccccuuucucagcuccccuccccuccccuccgagcucugagaaugccauggcccugucacauggaaucauuaacccuggagucuccugauggaaccgccucagccagcccacuguccuccuccuucaugacucaguucaaacaucaccuuccacaugaggagccuccagcuucugcgggcagaggggcacucacccaacugugacuacagcacuuacacaagccaccaacuggcacccacagcacuuaucacuccaugugucugcucaaccagccuggguaaggaacccuacccucucugucucuguccaccuccaacaggccauggugcacccugcaugggggcugccucaugggggucuccaggaacaccugcugagugaaugcauaaagaguccuuggcugcugcacacugagcucacaguuaacuaaaugcuagaagauuuuguaauauguccuuuugugucaccuuaucgaagcucacugguauuuauacacucaguuuuccacauucaaaacauacacagcuguguguguggaggaggcgggugcugggggcccuuggggcagcuuggagaaugcugcaaucuggguguguccgccaggaaaacagggccgagucauggguuacagagugggaagaguggauucagaggcaggaugcuguguuguguuaugcucuguuguuauuuuucucuugagacagggucucucucuguugccccagauggagugcaguagcgcaaucuuggcucacuguagucuugaccuccugaacucaagcaauccucccgccucagccuccccaguagcugcaacuacaagcacgcaccaccacacccggaucauuuuuauuuuuauuuuguagagcugaggucucacaauauugccaaggcuggucucaaacuccaggccucaagugauccucccgccucggccucccaaagugcugggauuaagacgugagccacuacaccuagccuucauaaucuuuuaaaauauuaacuguuuucugcuuuuauuaauauuuauuauugcaguuucucugaugacuuucuuugugagugugucauaaggaaggccauggggcucgaacaugccuguaccuccuaccagcagggcaggugacccuguggccagccucuuccacuagaccuggccucacaaucgggcugcugucuugcaucaggugugcaaggcccuucacacccagccagggcagcaugccccaugccaggcucaagcccccucgaguguccucccuccuguaccuccaugucuuuggacacgaucccuugugccugcaaugacaucccuggccaccuucugccugucugugcucucagccuccaucuacuccagcacagcugcuccaggaggucgcccguguggccguccgcccacugcccuggcugaggccccucuuccugggucagcuacugcacaguccacuguacuuggucacugcccugucuccuccacugggccaugcacuccuccagguugggagcucugcauuucaucccaguagcuccaggaacuacccucaccccggcagggugcugaugccagcgacaugcacccauauacaccagauagggcucuaucagguguacucgggggccuugcacacaugggggcugcgccagcuagcuuccuucagucaccaacagacaaugacacuaagcuaaccuaaaaaaagucagaagccuuguccuguagcucuucaugaagauggguaugaaaaauucccuuccaggauguaauucuuguuuucagcaguuucauaacaucagugggaguagagagggauaaaguacacuccagaaucagacagcucuaaauucaaauucuauauggguucucauggccuucauuuccucuucuguaauaacaguguaucuaacacauuggguuguuuuaggaaucacaugagguauuguaugaaaaggucuugguccacaaacuuauuuacacacagaaccucaccaguaucaguugugagaacauguaucugagaaaaucuaaugacuuuuucagcuaauuuuuguauuguuacaaaaaauaagaaccuaccguacauacaauguacacguugcaaauaggaugcuaaaauacuagguuaagaaaaguuuaauucacgaauuguccuaugcuaagagaaaaagugaggaaaagugcuguauuucuaaaaucaguaagcgagacucaaacagcccugcccuuuagccaggaucacguccacagggcgagggagcacaugggguugccagguaaggucccgcugaaccccuuuaccacggcuauuuucccucagucuuagagauuuuaaacacucucacuccaccagcaaugaguuagguauccugguuuuuaauuaauguuuuucagcuacucgcuaacuaagcaugcacuucacagaccccccuggcucgggucucuccuuccaguagcauucuguuaauguauaacauauaaaauaugggccugaagucacugaagccugaauuucaaaucuaaaaggaaaggucaccaucaaccagcuucagagacauccuaggcuaacauauucauggagacguccaacuaucuuuccugucucaccccaucuuguucuugugcuccuguccccauccgaccuuuaugccagucacugcagggcagcuggcaugugcucuggaacccaggcccugugcaucauccacagagcagcacgccggagccuugccagagugcaguuucaauaggagaugugucuuucccucugucaggucaggaagauguggccacuggaggugugcaccugacgacacgccccauguuuaugcuuccagauuuacugcaacacaagugaauguguugugaugguuaauuuuaugugucaacuugacugagcuacguggagcgcagauacuuggucagacauuguucugggcuaggcgugguggcucaugccuguaaucccagcacugggaggccgaggcaggcagaucaccugaagucaggaguucgagaccagccuggccaacauggggaaacccugucucuacuaaaaauacaaaaauuaggugggugugcuggcacacgccuauaaucccagcuacucagggggcugagguaggagaaacgcgugagcccaggagguggagguugcggugagccaagauuacgccacugcacuccauccugggagacagagcaaggcuccaucucaaaaaaaaaaaaaaauuguucuggguguuucugcgagggcaucagcaucuuaaucaggaaaguagaucccucuccuuccugugggcaggccuuguccaacagcugagggcccaaacagaaugaaaaggcugacccucccccaaguaagaggggguucuccgcaaauggccuugggacucuguccacaugaacaacucuuccugcccuauggccuucaaacuggaacaucagcugucucuccgcgucuccagcugccagcccacccugcagacuggacccacccaccuccugccgguccuguuucucugaagaaccugauacgugugacaaucaauaaaaccuaacaguucaucggguacccagguaauaacacgccuaucacauggugucauguggcacauguggucagcaguucacagcuguugaugcgucacaaaucucuguacaaccucaacccugggaggaagaggaggagcugguccaagcagacguggcucccaggccagcccaccucaggcucucgaauccucaacgccuccuuuagucucguggcuauuuuuccccucaccuugaucucuagucgcccuccgcccugacaaggcacuggcaccuuccauaccaaugccagcagccacccgucacccacaucccagcugcauucccuguguuccagggcccguggccuguggccccugccuccccucguggcuuuccuccuaucuccccaccauucugcggcucaucucccucccacuauuccuugaaaguggguguuugcaagcccucggaccugccuucagcagcugagcuuccuggagauggccuccaccucacacccugcccagcuccacggccugagcucaagcuuacagagcgcuucuucugccccgugcuguucugagcaguucacauguacauuuauuccacacaguaacucugaggacagcaaaaauuauucuccacguuaaagaugaggaaacggaggcaaaaagaaauggagaaaguugcccaaggcccugcagcuguaagguauagggaagggguucccagcaccacaguccaaguccaccaucgcuaaacagagccgaccccacggcuggagccgucacaauugauuacuuccuaaucccucuccagcucacauuucucucaaaagcaaugagagccagccagcugcaugagccagaaacccagaaguccuuuauuccuaugucuccuucaauguacgacucaucaaguccaccccaacucacagcccccaagggccacaccccaucaguucgagcaggacacccaccugcaauucugcccuccacacggggcccccaaguccugaccucucccaccucaaacuuuagccaaagugcauuucuuggagguccuuggugcuauguucucuuuugccccuucugcuuucaucuucucuauuggccccgaccccuccucuucucucuccccuccccaagcccaucaccuaaccuuccuagcugacuccugcuuuuuuucuaaagacacacucagcugugacuucuuccaggaagcuguccacaucccaggugcugggauggccucccaguccgccugcacacugcagugacuggccaggucugcaccuccuccaucucucacaugaaaggugagcccaggggcagggcgccagccugcagaaggccuccugcagcgcucauggcaggcuagggcagagcugggacaacggacacaggauccugagacuggcucagccuagagaccaaagccuucccucacucccacagaagagagaagacgcaaaccaggcuccaggcuccugucuccacugggcccaggaggaggccaggagagagggaggggccuagacuccggaacuccccucuccuucucaaugucucagcuccccaugccuuugagcuccugccuuccuccaccccuaaagcucgaggagggggccuguaucucacuagcagccucuccauccucuggcugagugauuucacccacccuccugccccaaacuccaaagacaguaaucuccccugggcagcgcuucauuggggugagcaagugacaagcucagggccacagaguccaggacucacucuccccguggggaugagccaucuaccagccucuccuuaagggggcacaggugggaccucacuggcacccuggagugccaagggcugggaugaggcugcccagaggcaagggcagugccuucugcccucccccuucuucugagacagcuuuuguuagcaaaauggguaggaaaugauagggaccucucagauagggucaggagcagugggccucggacccuuggagaccauguaccgacccccaccccaccaaagggacagcugcuacucugugccugccagcugcugucucacaggaauucugucucugcugauguuugaaauguuguugaguuuucgaauuucucacguaggcugaccccacccugcagagcuaagcaaacacugcagguguggaccaggcgaggcaggagcuggaggccaucaccaccgccuccucucccccuccugccuccucuuccuccagcgacaggugcgcucagcccaggcaggaagagcagggaagccuuuucuggagaaaugaaccacuucagaaaugaccuccacaaacuggcauuugugaggcucccaaggaggaaaaugggagccugaccugagcucauccgacggcaaagcccaucaguggccaagccugcucuccuccuguccgggacauggcccuaaauaccaucuccaggaauaugacuuccacacugcaucucugccgucagcuugggugcaaauccaacaucuccacuuagugaaaccccgucuguacaaaaaauuaaaaaauacauauuauccaggcauggugacacaugccuguagucccagcuacucaggaggcugaggugggagaaucacuugagcccaggagguagaagcugugauugcaccacugcacuccagccagggaaacaaagcgauacccugucucaaaaaaauaaaauaagaaaucuacuggcaauucgagcuuaaccugcacagaagagaacacucgacucucagcuccaaaccuguuccuccugcaguuuugccaucucggaaaguggcaaauccauucaaccagcuuuucaggccuaaaccccugaagucacccuuggcuccucucuuucucucacaccccacauccaacucagaggcugucaucucagccuccaaaguaaaucuucuucaccaccuucuucaugcaccccagucaaauccacccucauuucucacguggcuuccuaucagauaccugauucuggucucccuagugucccacaaaggaccucaugcagcagccagggugguccccuauauagaguccuauaaagccccacacaagacucugccccaaaccuccccucacauucagaguaaaaaggcuaaaguccuuuccugaguuguuaaugauucuuuguuggaugaauaaauuuauaaucaauguguuauuaccaucauuuuaaaagcaaauaauaucaaagaagccaauaaacagcugggcacaguggcucacgccuguaaucccagcacuuugggaggccaagguggguggaucacaugaggucaggaguuugagacuggccuggccaacauggugaaaccccaucucuacuaaaaauacaaaaauuagccaggcgugguggcacaugccuguaaucccagcuacucgggaggcugaggcaggagaauugcuugagcccgggaagcggagguugcagugagcugagaucgcaccacugcacuccagccugggcgacagagcaagacugugucucaaaaaaaaaaaaaaaaaaaaaagccaauaaacaugugcauuuaacuucauuaauuaucuaagaaacgcaaauuaaaacuacaauaaaauaccaacucaagcccaucagaauggcuacaauauaaaagacagaccauaccacauguuguggaagacguggggaaaagggaacccucacacacugcaggguggaguguaacuugguacauccucuuuagagaacuacuuggcagaauuuacauucccaaugacacagcgauucuacuccuacuauuaauaaauccccaacagaaaugcacacauaaucaaaagacaugugcaagaaaguucacagcaacguuacccguauuaacuucaaacuggacauuauccaguuugcucaagaguugaaugaggccaggcgcaguggcucgugccuguaaucccagcacuuugggaggccaaggcggguggaccacuugaggucaggaguucuagaucagccuggccaauauggugaaacgccgucucuacuaaaaauacaaaaauuagccaggcaugguggcgcaugccuguagacccagcuguucaggaggcugaggcaggagaaucacuugaacucgggaggcagagguuuugaugagccaagaucacgccacugcacuccagccugagcgagagagcuagacgucgucucaaaaaauaaaaauaaauaauaaauaaaacaguugaaugaauagugauguacucacauaauaaaauaccaugcagcggaaguucccauugugccacuccagacuagcagcaucuaugucagcugggaauguuagaaaugcguauucuggugcccacuccagaccuagugaaugagaaacccugcggugggaccccauuugccuuaauaagcccucuugggcuuccaacacagccaaagcuggagaagcacugcuccacagcagcgacccaaggagugugaccacaccaaggagaucaugaaaaauccugcugggaagauggauggcucacaauagguauacagaaaacuagacaaaugcaaagcaaaacaaaacaaaacauucuuuaacgaaaauacaaguugcauuagaaagaaaggaauacacugccgggcugaaccaugaguuacaucugcauggccauccgaacauggacauggacacccacagaaccacacgggcagggccacuacacggcguaacacagaauaauucugucaacaaugaacaacucaagaaagcacgacagaagcauauuacuuagaaauggguguaacucucagaaaauugagaacagggacuccggacacaggacaaggggugaggagugugggccaggugcugcuguucuucaucaugugcuuucaguguuacgucacucauuaaauucccggugugaauaaccagcaaaaaggaaaaucacaaaucaaaacaauacuguguugguaaagccagauggacaaguggggacacggguccagagcccaccaaugugccuucugcccugaagagccagagguagacaaaagaguauucauauuccaaggacccacuguguggagggcacaccaccaggcaaggauaaauaaagucaugaggagugccagcucagcaggaccagguggggcacuggaaagacagggaaggccaccugagaagcgguccaugaaggaaggggcucaggagccgggcucuggagacaggcaaugguuugcauacuccauaggccagaagaaaggcaagaaaauacaacauguguuuugcaaacaccaagcagagcgaccagaucuggccggacaaggggacgacaggcucacuucgcaaggccgggccucgggaagcauaaccugcaagggugugcaaggccaacuagagaagggggaagucugcgguccugaggucagugcuggguuuuucuuuuucugcuuuguccugagauuuuguuacaaguaaacagagaugaauuuccugugaagcuaaugacgcuuaagcaucaaggcccccacuugccugcaagggacccuaacaaaguguucacaaagccguacacaaaccccuuuuguaaugggcaaaagucagcuguuuugacuguagaucuaaccuugugccuuuccacuuaaacuguccuuccaucagacuuugcaucagguggcacuggcguggauacagccagugugggcuaaagauaagcugaguagaugaacuaacuuugcuucaauaggguuugcagucacauuucucuguaaguuacugagagccauccaguguagaaagggcuuccaggcauacuccccuguccaucacgccgacccaccuggcauggugacaaaaacauacaggaccagaggagcacaugagguggacacagacacuggcacugaaaauguguggaucacaaaaauaaaccagauuucaacugcacagagccaggagcaagucugugaaaaacagacucacuuacaacuaauguauaaaaaaauucauagaagguucucaauuugaugacauccuaaaaauuuauaagccaauuguuaccaguaacaaguuugaagccuaaauuuucuaaauuaucaguaauaaauuucaauaagccaagcaacaggaaaugcugaauuuaucuuucuauucuccccauauaaaguauuacaaaaucauuaucauucaaaagaugcaaacaguaugaaaccagaaaaagggcaaaaaguauuacggaaguaugagaagcagugaaagaauuguuauuuuuguguauuucgugauauuugcaguauuucuuagcaccuuagaaauuuauagaugugauuguucuuauucuaaauaacuuuuauaucuaaguuugaauuuguaauuuuguauuuucucuuuuuuuuuuuuuuuuuuuuuugagacagaguuucgcucuuaucacccaggcuggagugcaguggugcaaccuaggcucaccacugcauccuccacaucccagguucuagggauucuccugccucagccuccuuaguagcagggauuacaggcgugugccaccacgcucgacugauuuuuguuguuuuuuuuuuuuuuuuuugagacggagucuugcucugucgcucaggcuggagugcaguggcacgaucucuacucacugcaaacuccgccucccggguucacgccauucuccugccucagccuccugaguagcugggacuacaggcgcccgccaccacgcccggcuaauuuuuuguauuuuuuaguagagacgagguuucaccguguuagccaggauggucuugaucuccugaccuugugaucugcccaccucggccucccaaagugcugggauuacaggcgugagccaccgcgcccggccacaguuuuuguauuuuuaguagagaugggguuucacuauauuggucucaaauucccgaccucaggugauccacaagccucagccucccaaagugcugggauuacaggcuucagccaccacaucuggcaaaguuuguauuuucuuaaagagggcccccuaaauugucuaaguuucuggcccaacagaagcugguucagcuccgcggggggauuugaaaggcagagcugucuacaauacuucuguucacacaucacacaaaagaugacaaccauccacaucagugaauacugucaucuguacuugggguggggcuguggucacucccuccccaaaagcccaacagccagggaggaggcucccgucacaguguggguggcuggaacuaggagggcagggaugauccccacggucacggaaggaagaguggcacagaagcauggagggggcaggugagggaauugggagccugggacagggaagccugccagaacuggggcagaggggaaauggaagcaguuucuccagggccaccuugagcggaaccagucuaagagagaaaggacagugcaccuuuaucucuuggaaggucucuccuucggcucccucaccuuuccgcaucuagaacacagacuccaucucaggggcagcugagagcagcgaacaacagagugguagaaugcugggugcuagugaagggugagcaucugggggcccugcgacuuugccaacaugcucuucacuaaggagaacuccaaaaggaucaccacucacgaccuuuacaccccgaaccaggucaucuggcuaaaggauauguuuucuccagucagcccccgauugcauuagaagacaaucugucccucuuuacacagguuccgaugaccucguguggcuucuguuugucccagcagcagaccuucaggccauucccucagcacugcccggcaggcaggaagcaucagcauaaugccugagggggagccccgggcggcccgggcuuccugaccggacuccuaauggcagcaucuuuauugcaacccucuccagcguuuaaaaaaagcuuuuuuuguugcuggcaaguugcaaaaacauaaaauaucucuuaaguuaaaagucauaggagccuuagaacuguuccugcucuauugcaagcucuuuaugcacauuuguuaaauaauaacauaaaauuuuaaaaucuucuguuucuucaaggaucuaaauuugaaaaccacagaaacuccuaacuuagcucgccaggguuuacacagcaaugucugaauccuaagcuggcuuuucacugccucaaggaagaaaaguuuuacaguagaaccuaaaaguuccuaaauaucuggcugaugcuugcucuggaaggaaagcugggaggcagggaaggauggaaggagaacccguguuccaugcacacagcagcucugcuuuccaggaagaacgcuugcacugaagcuacaagcuucaucugccuugcaggaagguuuaggguccuccuuuuccuacaggagggaaaggucaaaggguggaguuucgcaacacucuuaaauucauucauucuuuacggucugaggcuuggguucuucaaacuacaaagggaaggaaggcccuucaacaaaaaaugagucuacuuaguauugcagauuaauuuuuaaacaggauuagaggauuugcaccaagguaaagcacuauccacuuuaugacgacucacuucaaauuuaagauugauaacaguccgauuucaacaucuagggaaacugguagagcauuuucggacugucagaccucaaaaaagaaaacaaauguuugaauauaaaaggccaaucugcucucagcacaccuccugucucuaaaauccccgaaaacaaucacuuuuuuuuuuuuuuuuugagacggaguuuuguucuuguugcccaggcuggugugcaauggcgcgaucucagcucacugcaaccuucgccucccagguucaagugauucuccugccucagccucccaaauagcuggaacuaaggcacgcgccaccaugcccagcuaauuuuguauuuucaguagagacgggguuucaccauguuggucaggcuggucucgaacuccugaccucaagugguccacccgccucggccucccaaagugcugggauuacaggcgugagccacugcgcccggcccacaaucacauccuaagagacaaacauggaguaagccaucuuacaguccugggagaaccaacacucgcuugccuaccacuaccgucggugugucaggcacugcuaaagguacugaggaaaguggaaggaacaaucacaaaaaugaaaaagagaagagaggaacugcacuccauuuuaaacucugcucgcugguuuucgguagcucugcggcucgguuuucauccuuccgggcaguguaacaaguuccuccugaacucugaguccguggccgucgcggagcugagccacuuucagggugugggucagaguaaguuuggguugaggaugcugcagccaggacaaucaaacggcagcccagccagauccccacgcggcuggggcuuagccccgggcuuccuaccgcgagcugaauccguucauagguccuuaaaaaucaacagccccguacgcuaccccuggagagauuucuacauucugaccacucacucaaacgcaaaggucacguuagccgcugaacuccaaagcagaggggcucgccgccagggcuccgggaguuggagaagggcgcgggagguguguccaggacaccagcacaaaggcuccuuucaccgcuccgcgccccgcgcccucgggugcggacccugggcgcccgccggcugcgcgccaggaccccgccacuccaggcggcucccaaggcccacgcgcuucugcuccgcccggacuuccgagcccagccguggcgcucaccuguccugcccgcagcgccagcugcacggccgccuggaagcacuccucccaggggccggccgccagcgccgccugguccucgccgcucggcuucaucgcggccucgccgggccccuccaccuccagccccccucggcgggacuccggcucccaccggaucccgccgucccgccgccaggcuccacacucccugugccugcucccgcagcucugugccuaguccgccgcccgucccacaccugcgcuggcgggaagggcagccagcgggccgcgggagccgugcguccugcuuuccgcuccccacccuccgccccgccccgugccgagcccagcccagc

SEQ ID NO: 192757 - RNA, 24342 nt, Homo sapiens
cccgcccacgccgcgcccggagccgcgcggcccgaagcacccggcccggaucgcagagcccgcgcccugcgccggcggcaaugaagaucuggagcucggagcacguguuugggugaggccgggcugagggccgcgguggggccguccagacgccggcuccugcucccgagcccggcuggagcgguccaggaaaggccggaccucacagcgggccucgcggagauccccgccccgcgccggccguucccagaccgcaacuucggcgucccggagagggcacgcgcgcuuccccgggaccgcggucugggcgaggcucugcgccggguacggccucucccccggcgugcgcaggggccuggcugcaggcacagaggccccgcugguggucgacagccagggcgggggcagccggagcgggggcggccggggcgggggcggccggagccgggggggcggccgggggccuggcgcucgcugcucuccuuggggucgggagcagggcaggggagaggccugcaagcuggcgccuuugcugagauugucauaaaccuuccgcgcguuucacggagggcccacggcgggcugugagcucuggaggaagcuaaaggggcagaaggcauuucgggggcccuggcucugaacucacuuguaggcauggaaggccuccaagcuagcguggaaaaccucgaacuguuuaaaaaugcucccccggcacacggauggaaguggaggucauuaucuuaagugaagccaggcccagaaagacaaguaucgcauguucccacuccuaagugggugcuuaagaauguguucacauggauguggagaguggaacgucagaugauggagacucugaagggugagggggugggugcagggaggauaaugagaauugcuuaaugggugcaagacaccuucccggguaaugcauacccuagaaguccugacuugaccacuacgaaauuuaugcauguaacgaaauugcacauauacuccauagaauugugcaaauaaaaagaagaaaaaagugcccuccuaaccuaagugguaucuuuuccuuaagucagugaucugugacacacugaaauuauucuuuaauguuuauuuacagcaacaaagauuuuuuaauuaucugaccucacuuaagcauuaaauauuuuauuuuggggggaaaaaaaguacugcguggaaggaaauugucauccuuugacucuuuuuauuuauuuuuuucgagacagagucucauucugucacccaggcuggguuuuuuuuuuuuuuuuuuuuuuuuugagacauaggcucgcugggucacccagguuggagugcaauggcgcgaucuuggcucacuguaaccucccccuccuggguucaagugauucucgugccucagccuccugaguagcugggacuacaggugugggccaucacgcccggcuaauuuuuguauuuuuaguagaaacaggguuucgccauguuggccaggcuggucucgagcuccugaccucaggugauccacccgccucggccucccaaagugcugggauuauaggugugagccaccgugacuggccugacuuuaaacauguaaaauuauaauaaaaauauaucaagugguuucaaaaccucugaaauuauuuuucaugaagucuuuagacuugaugggaucuaauuuuuuguauggcuugcaguguuucucaaguggguuuccaucagcaacaaggaugggggcaucacugagccgucuggaugcuguggacaguuaagucauugcauaccaggagugccaggugguuggggcucaguuuucucauggaauggccgaggucugcccuagagguuugugaaaugucuguggacaagcacaaaugaauagcuagcugugaaaaaucacaguugaugcuuuugaaaauuguugcagcugcuaacucccauuuauuuuuuuuaagcuuuaccgaaggauacuuuacauaccauaaaauuauacacauuuuaaguguauaauucauuaaguuuugcuaaguaugaccaucacacacacaguccagucuuagaacacuucuguccuccugcagaggugccccaugcucauuagcuucacauuuuaccccauuuucaccccugccccaggcaaccaggaaucuuuucuguuucuaugaauuugccuuguugggacauugcauguaaaugucauccugcaauaugggguguuuugugucugucugcuuucacuuagcaugauuuucuugaggcucaccaugugguagagugucaguauuucauuucucccaucauucauuuuguauuccuggcaccccgccggggcccggcgccuagcaggugcucggaaggggugaggaaucuuacauggagaucagauguccuuccaggacaggggcagcuauccaccaaaggaaucccggucaucccuggagcugcuguggacuaggugcugauucucugccauagacuuuugaacuugaaagcaaagggccguaaugaagccugacaaauguggaauguggcuggccgaggaugcugucauuggccuguggcuggacggguuaugaaugaugugguaccaugaggugguaccaugaggugucauagcauccaaaugacaguacaaauuggaagucuggcuuccuggcuggacuuacuguguaguuuuccccuuguuucguccauugaaaccccugauuuuuuuccuuugaggauuauagaccuuucuuuuucuuucuauacuuaaaaaaaguuuguuguacuguuaggugaacauuugauuggaaauaauacauuuacuuuuuuuuuuccuuuuuuuugaggcagaaucuugcucuaucacccaggcuggagugcaguggcacgaucuuggcucaccacaaccucugccucuccgguucaagcaauucuugugcuucagccucccgaguagcugggaccacaggcgugugccaccacgccuggugaauuuuuuuguauuuuuaguagagacagaguuucaccauguuggccaggcuggucucaaacuccugaccucaagugauccacccaccucggccuccugaagugcugggauuacaguacuuuugaaaugaagaaauaauuaggcacaaacaguuugaucuuaucaaguuuucuuccuguguccacauugagaagaaacuccgccccugagaucaucauagcagacagcaguguaaacacucagacaaaaacagagagcccggggaaaggccacugaauuaacguguguguuaccuagacaggggugaaaguaguuuaaauaaaauuaaaaguauauggccaaaauauagaaaggggcauuuaaaaaugcgggcguuucacaaggucaggagauugagaccauccuggcuaacacaaugaaacccugucucuacuaaaaaauaaaaaaaaaaaaaaauuagcugggcgugguggcgggugccuguagucccagcuacucgggaggcugaggcaggagaauggcaugaacccgggaggcagaacuugcagugagccgagaucgcgccacugcacuccagccugggcgacagagcgagacuccgucucaaaaaaaaaaaaaaaaaaaaggacaggguuuaaaaugucuucuucccagcauugagguuucaggcagaccuaugacaaaaucaucaauaacaaagcccaucacaaauagauuuccugcaggguucaaggcugcacacaccuuugauucugacagcugccaggaaugucuggccaugcccuucucagggcaggacgggcuuuggggcauggggagucaugccuaaagcaggcuugccuuacagcuaggagcagggaagagaaauugaacauuacagaugaguugaagccugcucuuccccuccccacugguguuccacugugucucccucccugcaggcagccgugaggaucaguuuggugggcauccuucugagggggucuauauuccagagguucacuuuaccgcaucuguguauacgcaugugucauauugucuucuuuucuuucuuuuuuuuuuuuuuuugagacggagucucgcucugucgcccaggcuggagugcaggggcgcagucucggcucacugcaagcuccgccucccggguucacgccauucuccugccucagccuccagaguagcuggaaccacaggcgcccgccaccacgccugacuacuuuuuuguauuuuuaguuuagccaggauggucuccaucuccugaccucgugauccgcccgccuuggccucccaaagugcugggauuacaggcaugagccacggcgcccggccuuuuuuuuuuuuuuuccagguggagucucacucuguuacccaggcuggagggcaguggcgggaucucaguucacugcaaccucugccucccagguucaagcaguucuccugccucagccuccugaguagcugggauuacaagcaccugcuaccacgcccagcuaauuuuuguauuuuuaguagagacgggguuucgccauguuggccaggcuggucuccaacugcugaccucaaguuaucagcccaccugggccucccaaagugcuggguuuacaggcgugagccacugcgccuagcccuauuguuuuucgaaaauccauccauaugagaugucuauagaugucuacauaaauauauguagauauagauagauauuaauagcuguaugaaugugccaccauuuauucuuuuucuuauugaagggcauuaaguuuuccucuuauuacaaaucgaacugcagugaccagcccugugucuauuucccacucaaucaagggcccacuuaggccaauggauuucaagcucuucagccucaggaccucuugauuuagcaaaacccuaaacaguuuugcuuauguggguuaugucugucaauauuuaccauauuagaaauuaaaaaugauaaauugaaaaaguuaauucauuaaauuuaacaauaauaaaccuguuauaauguuucugaauaaaaaacuguauuuuccaaaaauuagugaaaggaguggugcuguuucuguuuuuacuaauaucuacaauaucuggcuuaauaggagauaacuugauucucauaucugcuucugcagucuguguuuggcaauauauaguuuugguugaaguguauggauaaaccccagccucacacaaacaugcagcuggaaaaggugggagcaucuuaguagucuuuuuaaguaauuauggcuauucuuuccuguuaugacaaaagaaacgguagcuucuuaacacuuaguuggaauacaaaaccugaaacuauaaugaauagaguauugaacucugaggccuagcggggguaaucgguugagcucaggaguuugagaccagccugggcaacauaguagaauaugucucuacaaaaaauaaauacaaaaauuagccaggugugguggcuugugccuguaguccuagcuguucaggaggcugaggcaggaggauugcuugaccccaggagcuugaggcuacagugacagagccauaccaucucuuaaaacagccaccacaacaacaaacccauuggccuguccuguguaugaaugagucuuuaacccaaguaugacuuggaagcauuuggaauauaggccuccacugagcgugcagcaugaggcagucauccagcuccugguagcagauacaaguuuucugaaauuucaauuaucacuuuauuuauuuauuuuuuuuccaagacagagucucacucugucgcccaggcuggagugcaguggcaugaucucaguuaacugcaaccucugccucccagauucaagcaauucuccugccucagccucccaaauagcugggauugcaggugagucucaccacggccuacuaauuuuuguauuuuuaguagagacgggguuucgccauguuggccaggcuggucuugaacuccuaaccucaggugauccgccugccuuggccucccaaagugcugggauuacaggcgugagccaccgugccuggccaaauuaucacuuuaaagcucaaauuuuaucuuuggcagcaaaugcuaucaguuguuuuccuugaagcacaggcuuacuuuguuaauuuucaagaaaucaucugccagauccccaagucugaauaagcaaaguuuaucuguuuauuguucuuucuguuuauugcucuuucaaguacaagaggcaggcaguggaaagcagcagagagacaggggcucccacucagagugaacaagugccggcgccccccagacaccccagagucgagggacuugggccgcagcagcagaggggcuucuggugcacuucuguucccucacacagaauaucaaagagaagaguacucaggggucaagcagucauaaaacuaaucacuuggccauuuacucacagaugucccuaagagaaacuggcauuguuucccaagugcacagcagugaggacugcggugaccacaugcaauuuggagcccugccuugaugcugggaagauacuggcucuguccuuuuauugcuuuugcagaauuagcgcaaaugucaauacagcaaaaaaggccagucauuggccgggcgccauggcucaugccuguaaucccagcacuuugggaggccgagguggguggaucaccugaggucaggaguuugagaccagccuagucaacauggugaacccccaucucuacuaaaaauacaaaaauuagcugggugugguggcucaugccuguaguccuagcuacucgggaagcugaggcacgagaauugcuugaacccgggagguggagguugcagugaguugagaucacacccacugcaucccagucucacucugcaacagagugagacuugguccuccccccaccccuccacccccaccaaaagaaaaggucagucaugucucaguagcacugugacaacaguuaugucuggaaaaguucuuggagccaccaggguguguggcccaaaugcuaaggagcagcugauggaggccuugggucacuugguggugggguauagcaggccuacuaucuuguuuuuggcugccuacaucuuuuuuucuuucuuuuuuuuagagacggucuugcucuguugcccaggcuggagugcaguagugcaaucacgacuuacugcagccucaaacuguuuggcuuaagugauccucccaucucaggcucugcaguagcugggacuaugguugcgagcuaccacaccuggcuaauuuucguauuuuuuguugacauagggaucuugcucuauugcgcaggcuggucuugaacuccuggucucaagugaacuuccugccuuggccucccaaaaugcugggguuacaagcauaagccaacacaccuggucugccuacaucuuuuuuuuuuuuuaauuuuuauuuuuuuguuuuguuuugagacagggucucacucugucacccaggcagaagugcaguggugcguucuuggcucacagcaaccucugccucccagguucaagcaauucuccugccucaggcuccuaaguagcugggacuacaggugugcgccaccaugcccagcuaauuuuuguauuuuuaguagagacuggguuucaccauguugggcaggcuguucuagaacuccugucaagugauccgcccgccucggccucccaaagugcugggauuacaggcaugagccacugugccuggccuuaaaucuuuuuaagacagauuuuugcuauggaaauuucacaacuaugcaaacauggagagacuagaauacugagagccggugccacccccagcuuaacaguuacccucuggcagccaguccaggguccucuguguccccacccacugcuccuuccccuggguuauuuuaggcaaaucccagacaucauguaauuuccuccuucuucaucuucccgacacuguuggugcuuagagaguccuuuguuauuccuuuucauuccccagcucagaaaccagcuucccuuagcccgccaggcagacccaccacacacauggugucagagcacuugggacacguguauguggggagccauccaugcuggguggcagcggaggccucuugcccuugggggauaggauuccccagaggucuccacgaacagcagcagaggaggcuccugccgccugguuggggaucucugaguaggcaguucucugcuccucuugaaaauaaacuucagcacauuccucuucugccucaaccaggcagcugagaacccugacugauuucggcaggggcgggguguccauuuucagcuucucuggguaaacugcugccauuagugccugugccaguuuguguccaccagcagcacuuccuguuguccuauuuccuauacccuuuccaguacucaauauugccagacuugucuauuuuugcccauugaaagcgugucaggcuauuuuuguucuuucuggguuuuuguuguuguuguuguuguuuguuuuuuuagacaggcauuugcucugucacccaggcuggagugcagugguacaaucauggcuugcugcagccucgaccuccggucuuaggugauccuccugccucaaccucagccucccaaauagcuaguaccacaggggugugccaccaugccugguuaauguuuucuguuuuuguagagaugaggggucuugcuauauugcccaggcugggcuugagcuccuagcaucaagcagucuuccugccucagccuccccaagugcugggauuuacaggcaugagccacugugcccagacaaggcuauuuucuuuucuuuucuuucuuucuuuuuuuuuuuuuuuuuagacagagucucacucuguugcccaggguggagugcaguggcaugaucugggcucacugcaagcuccgccucccggguucacgccauucuccugccucagccucccgaguagcugggacuacagacgccugccaccgugcccggcuaauuuuuuguauuuuuaguagagucgggguuucaccguguuagccaggauggucucgaucuccugaccucgcgauccaccagccucggccucccaaaguacugggauuacaggcacaaacuacaguacccagccagacaagacuauuuucuuuaaccaagugugugcuauugacuugcugugcuuagacuuuaucauuuuagagauguugagauauuuuuauuauguuuaucauuuuccuccauuguucuguugcuauauguguggucauccugcuguaauuaguaaaauuauuuauuaugugcauauuuuaagcagauuguauuuaguuuaaaucaucagccagaaagaugcaaauuuuuuuauuuuuauuuuuauuuuugagauggagccuugcuucguugcucagacuggagugcaguggcgcgaucucggcucacugcaacuuccaccuccuggguucgagcaauucuucugccucagucucccgaguagcugggauuacaggugccugccaccaugccuggcuaauuuuuguauuuuucuuagagauggaguuucacuauguuggccaggcugguguugaacuccugaccucaagugaucugcccgccucagccucccacagugcugggauuacaggcaugagccacugcauccagcccuaagaugcaagaauuuuauaugaaagaaacauuauuugagauaagcuuaaugcaaaaaucucucaauguuuagauuauuuuaagcuuaauguuagaaggcauacccuguucugcuuaaaguaaugauuucuaugggaauaagucuaaggaacuuaacugaaaagccaucagacuauucauugaggaggcucuccugggugacugggacccuuucugcuucacauguaucucuagauucaccuuccuuaccuagaucuggggucugccaugucccugacaguucuuuccuaaaccucagagagacgaaagggcuccacucugacugaauuccuagagugaucaggaccacccagucuuggcuucuucaucccucucuucucuuuauguuagccaguggaaugcgucagcuuagugacacaauugcaugguucaaaaaacugaacauaaguguucuauuguuaagagaggauuccaggccaggcccugacaauuuagaggccaccgaauguaauagaacagguuagggagcugcgagaccugguucucaucugggcccugcugcuaacuuucaccuaggacaagaguguuugaugaggguaaaguaaauuacugaucacucuguuauauugaaaauugaccucaaauauggaagaaaaaacuucaguauccucauaaucuuucauauuuuauuuggaaauuucauuucuacaacuuuauccuaaggaagaauuagauauguugaaagacuaauguacacaaauguucacuacuguuauaauuuaucguguaaaagugaaagcaaucuacauaacauaacccaccauagaggacuggugaaauauacacagccacaagaugaccuaguguacagcuguuuauaaucauauuccugaaaauggcuucaugauauaggaaaauguuuaucagcaguuauaaaaaauggaugguaaacccauauauugaguguaaucccaguuuaauuuuucaagaugugugugcaugugcauguaugugugucugcaugcauaugugcacacaugugaaugugauggugcauaggugugugcacacaucugggcuugccucugggcugugucuauacauaugcuggacaaaccucucugggcacuucugaagaaaugaugaucuugucagagaauguuuguccuugcaggaggcucagaggcuuccugggagagagcacaccuugaaggaaggguggauuaggacaauuagggcaauaaagugacuugcuagcaaccccuuagcaguccgggggaagguccaugcuggacaggugugguggccccucacuuggcucccuucagacgugugucugacccugcagguuucaggccuaaacaagugcagagcucuggaaagcaaugggugacuugcaaccacucugauggcaggaaauaaaacaaggggaggcugagugcgguggcucaugcccauaauuccagcacuuugggaggccaaggcaggaggauugcuugaggccaugaguucgacaucaaccuggcaacauaaugagaccuaaaaaaauuguuaaaauaaaaaguugggcugggcacgguggcucacgccuguaauccuagcacuuugggacgcugaggcaggcggaucacgaggucagcaguuugagacaagccuggccaacauggugaaaucccgucucuacuaaagauacaaaaaaaaauuagcugggugugguggcgggcaccuguagucccagcuacuagggaggcugaggcaggaaaaucgcuuguacccgggugguggagguugcagugagccgagacagagccauugcacuccagccugggugacagagcgagacuccauaucaaaaaaaaaaaaaaaaaaguuggccaggcgugguggcuuaugccuguaaucccagcacuuugggaggcugaggcaggcggaucacuugaggucaggaguuccagaccagccuggccaacauggggaaaucccaucucuacuaaaaauacaaaaauuagccaggugugguggugggugccuguaaucccagcuacuagagaggcugaggcagaagaaucacuugaacccgggaggcggagguugcagugagcugagaucgugccacggcacuccagccugggugauagagugagaccccaucucaaaaaaaaauuaauuaauuuaaaaaguuaggccgggcgugguggcucacgccuguaaucucagcacuuugggaggccgaggcgggcagaucacgaggucaggagaucgagagcacggugaaacccccucucuacuaaaaaauagaaaacaauuagccaggcaugguggggggcgccuguagccccagcugcuccggaggcuggggcaggagaauggcgggaacccgggaggcggagcuugcagugagcugagaucgcgccacugcacuccggccugggugacagagcaagacuccgucucaaacaaaaaagucauucagguuugguggcacacgccuguagucccagcuacuggagguggggcaagaggaggcugaggcaggauguucacuugagccugggagguuugagucugcagugacccugauggcaccacugcauuccugccugcugggcgacagagugagacccugucucagacaaacaaaaaccaaggggcugccaggugccgaggcgugcaggugcugagccggcggccggggagggcucgcgggacuccucagauuugucggaccagccuuucauuaaagugaagagacuagcgcguugcccaggccuggcggcggcuuuuccuccccuucacccuugcggccccggccccggcgcuugcucaccgccgccuaugcucuccccgcagccacccgugggacacggucauccaggcggccaugcgcaaguacccgaacccgaugaacccgagcgugcugggcguggaugugcuacagcgccgcguggacggccgcggccgccugcacagcuugcgccugcucagcaccgagugggggcugcccagccucgugagagcggugagcggggcgggggcugcggcuccgaacgcgcccgacucccccacucccgcccccgcccucucccgcgucccuccuccccucaucagugccucugcugcuuuggcugccaucggggugggagggcggcggggggccuuuccugagaucagggggcgcgggguggggguggcgguggggggaacuuccccgagaucagggggcacgggcuggggggcuggugggaggguuuuccucgagaucggggggcgugggguggggggucgguggggggggaucuuccucgagaucgggggucacgggguggggggacggugggggggucuuccucgagaucgggggucgcgggaggcucugccuggcgcguggcgucuggcauccccaucuguccucccaaagggcccgggccugcuggauuagcacugccaggcgccccuccuccugguuuaaccgccucuaaagcccagcguccgcagccagccgcauccuagggcaccgggauuaggcuucaccaugguucagccccccguggccucuuccucagagccagggaggucgcuggaaaugcaaaucugagcacggcucaccccaacccggccccuggaucucgccuccaccugcaguccacacccuggccuggcgcaggccucucagucagcccagcuccugcugcaggggccugcaccugcugcccccagccugacacccccaccccagcacuauggugguaccuuccucuuuggggcucugcccagacuccgcccggcagaggggccuccuagcuccacugcccgcagccuguuuuauuuugccgggagcauagugcugcugcacgcuccacucuguuggaauucauuucuuugcucaguggcucaccugcuggagcggaagcgcccuggacacagggguuuugucucugucccuugcugcaucccaugauaucauuucuugaauagugaacuaauuaguaaaugcaaugguauucgguggugauaugaaguagaauuuuuaacguuccacuaugcuaguuuugcuuuguuuucuagauuuugggaaccaguaggacauugacauacauccgagaacauucugugguggauccaguggaaaagaaaauggaacuuuguucuaccaauguaagcaauggccucagaugagaaacgggcucagugugucugggugguggugcguaaggccuucguuuaauucuauuuccagcccaccuuuggucuagguguugcuuauuuuuaacagaaaggcugaauucauuuagcaguuuaucuuuuuauucaaguauaauaaguauauagaaaaaugcacauaaugaugaauugucacaaagaacgcaccucuuaacuagcaggcaguucaagcaacagaauuugaccagccccugagaccccuugggcaccccccacaggauaaccacuguccugacaaccagcagacguuuuuguuuuuuuaaagauggggucuugcccugucacccgggcuggagugcagugguguggucauagcucagugcagccucgcacuccugggcucaagugauccuccugccucagcuucccaaauagcugggaccacaggcacgugccaccaucccuggcuguuuuuuuauuuuuauuuuucacagagauaggaucucgcuguugccaaggcugaucucaaacuccuggucucaagugaugccuuucaacgugcuuuuuuuuuuuuuuuuuuaauuuuugagacagucucucucucucaccuaggcuggagugcaguggaucucagcacccugcaaccuccacuucauggguucaagcgauucuccugucucacccucccaaguagcugggacuacagguguguaccaccaacaggcauuuuuuuuuuuuuuugagauggagucucacccugucgcccaggcuggagugcaguggcgugaucucggcucacugcaaccuccgcccccugguuucaagccauucuccugccucagccuccugaguagcuaggauuacagccgcgugccacuacaccuggcuaauuuuuguauuuuuaguaaacaggagguuucaccauguuggucaggcuggucucaaacuccugaccucgugauccacccgccucagccucccaaaguacugggauuaugggugugagccaccgcaccuggccccaacagguauuuuuaaagcuacuuccccccuucacuccucucucacuucucucaauuaaaaaauguauauuggccuaaugcaaaugcaagaacauguugggaaauaugcaugggcuagcaaaauuauuuauuucaaaaaauaauccuuauuuucagcaaauauagaaaugggcuauggugggugaagucagcggugcccucaucuggccucacuuuucuguccccagugccaugguuggcucuagccaccacuauuuacugguucugccaacgguaucaagugccugccagguacccagcacagugcuagggauggggaaugcaaggauuaagauauuuccuccugacuggcucugucaucgcacggugggcaucuagacaacccacauagguggcagcgagcaggagcuccccuaaguggccaugugaagguaggugacagggagccuggcaggacuucuccauacacacuggcagugggcgcccuugagccuuagagagccacaaacagauggcguuagagacuaagaggggaagguggugugggagggaggaggcuggagaggggcaggcacaagaccacagaagaggcagaggagccggaggucguuuucgugguaagagggagccacugagaguuuguugcaggaaggugagguagccggguuguguguugggaagaauaccuuggcagcccuguggagagagggccggggggauguugggaccugagccagggagaccaguaguccgggcagguaauuguccaggugagagguagcagaggccaccuggggugagacauggggaguaaggaacaggaggcucacgacgcagcucugcucucugguuagggcgccaggcugaaugguggcccaugaggggcaggugugagaagagagagguaagcuugcuuugcacaucuugaguaugcagccccugcacagcaggcuguggaguguccagccugaagcugaaggugcggccagcagugcugcagugagggaauggcgaccuggucccaggggcaggcagggcuggugggugcaguggguggggacagggcugaggagcaggucauccaggcggccaugcgcaaguacccgaaccgguaccugggcagcuccccaucuucucagcaucuugugggaggcccaguguuugaaagaaaguggagcugcucuggguccugcggcuccccugccccaaccagagggccucgggagcuccuaugagcuucucagguggccaugggaacagucccccaggaugcucagugcugucggccagccacacucugcccagcugggagcaccuuccguagaaggcagugggugcaucccugugugcugagaugaggcugugagccaccugcaggauagagccuagcuccuuaguguacuaccuggacuucugccaauguucccugguccuauuggcuccuugucccaggcugcacaaagucacaggagccugucagguccccacuggcuauuccugacagcuuacguauuauguucuuucugcccccaaaaccaauauuuacuuaugaaauuccaccuuauccuuccagaaaacucaguuguauguaaaaaggagcaguuuaugcuccagugaagucugaugggaaggaaacaggguuuggagcaagacagacaugugcuugcauccugaagccaucgcuggauggcccgaugacuuggggaugcuauuuacauuuucugagucucacauuucuuguauaaaaaagaaaagaacaaaccucagaggaguaagguuuaugaaacacagugacuugcauaaaauauugcacauaaaaugacaacagcuaaucagaguuuaauuuguaauugaugcuguuagauaguucuguugaauguaacgcccauacacgugagacucuugauaaccuggcacucuguaggaggagagagauuuccuacuaaccauuugcauugggacagugaggcugggggagggauucagugagagauuacugaaaaaaugaguauuuaucacuacagaaagguuaauuugcuuuucacuguuuaaacuuuuuaaaacauggucuuuuaucagaauuggcauuuugagaagagggugaacugaguuaaacaaugaagcaauucuagagcucuguuguccaguguggcagccaccagcaacauguggcuauuuaauuuuaagcuauuuauggccagugcgguggcccacgccuguaaucccagcacuuugggaggcugaggcaggcaggucaccugacuucucugaggucaggauuuccagaccagcuuggccaacauggcaaaaccccaucucuacuaaaaauacaaaaauuagccgggcaugguggcgggugccuguagucccagcuacucuggaggcugaggcaggagaaucgcuugaaucugggagguggagguugcagugagcugagaucgcgccauugcacucaagagugaaacuccaucugaaaaaaaaaaauuaaacuaauuaggauaaaauaaaauuaaaaauuccauuccucagucacaugagccacauuucaggugugcauuagcugcauguguguguggcuaccauaucagacagcaugcauaggacauuacuguuagcacagaaaauucuguuaguguggcucuagagcucgaguguuuaaauugguuuugacagaaaauauaggcugggcgcaguggcucaugccuguaaucccagcacuuugggaggccgaggcggguggaucaugaggucaggagaucaagaccauccuggcuaacauggugaaaccccgucucuacuaaaaauacaaaaaaaaaaaaaaaaaauuagccaggcaugguggcgggcgccuguagucccagcuacuggggaggcugaggcaggagaauggugugaacccagaaggcggagcuugcagugagccgagaucaugccacugcacuccagccugggcgacagagcgagacuccaucucaaaaaaaaaaaaaaguagaaaauauaggccgggcccaguggcugacaccuguaaucccagcacuuugggaggccaaggugggaggaucgcuugagcucaggaguuugagaccagcccgggcagcauugcaaaaucccaucucuacaaaaaauuuaaaaauuagccggaugugguggugugcaccuguagucccagcuacucaggaggcugaagugagaggaucacuugagaccuggaaguugaggaugcagugagccuugaucacaccacugcacuccagccugggcaacagaacaagacucugucucaaaaaauaaaaaagaggccaggugugguggcucaugccuguaaucccaacacuuugggaggguaaggcagacagaucacgaggucaggagauugagaccauccuggccaacaugcugaaacccugucucuacuaaaauacaaaaaaaaacuuagccaggcaugguggcacaugccuguaaucccagcuacuccggaggcugaggcaggggaaucacuucaaccugggaggcagagguugcagugagccaagaucaugccccugcaguccagccugguaacagagcgagacucugucucaaaaaaauaagagagaaaaagaaaaagaaaauauaggccggguggaguggcucacgccuguaaucccagcacuuugggaggccaaggcgggcggaucacgaggucaggagaucgagaccauccuggcuaacacggugaaacuccgucucuacuaaaaauacaaaaaauuagcugggcaugguggcaggugccuguagucccagcuacucgggaggcugaggcaggagaauggugugaacccaggaggcagagcuuucagugagccgagaucgcgccacugcacuccagccugggcuacacagugagacuccaucucaaaaaaaaaaaaaguauaaauauguacauaaggaguuagucuguuuauaggaagcgguacuggaggagacaagaacccugcagucuccauguagauucagagucugucccauccaguccuaggagacagugcucugugggcugccauggguaggugaaaagcuuucucucacuuauauggacacacaggccuauuuguccuuuucuaugguacaacugcugauaguuuuggcagcuugacuguaccuugaaggccagagcccugcucacauguggagugggacaugggaagaagauagaugacaguugccagaaggaacagcaaaaccaugguuuccuaggauuuaauguggucguaucuccuaugccuaaaaguuucuucuguucuggccccacuaagugcuaauuuugggauggaagaguaugggcaguuggcuucagaagaaaugcaagagaaauacaaucuaaaccuuuuuuuucuuuuuaagaucacacucacaaauuuggugucaguuaaugagagguugguguacacaccucauccagagaacccagaaaugugagucaucuccugugggauugacacauugaaugccacgggugagggcagggcagacccuccucucucucagggcuggucagccccuuuucuucuugcucuuuugcaggaccgugcucacacaagaagccaucaucacugugaaggggauuagccuugguaguuauuuggaaaguuuaauggccaauacgauaucauccaaugcaaagaagguauguaucucaauccuaggaguccugugugugcucuaguuguuaagugccagauuaagaauaugacauuuuuagucucaucagucuuccuggcugggcaugguggcucaugucuguaauccuagcacuuugggaggccaacgcagguggaccgcuugaggccaggaauucaagaccagccuggccaacaugcugaaaccccaucuacuaaaaauacaaaaauuagcugggcauaguggcacaccucuguagucccagcuacucgagagucugagacaugagaauugcuuggacccaugaggcggagguugcagugagcugaaccaccacugcacuccagccuggguaacagaaugagacucugucuuaaaaaaaaaaauaaaaauaaaaauaaaaaauaaauaaauaaaauccugagugcuggggcucuccauuuaugcugagcucauaaugccacaguauuucaaaacuaggguagggaaaggcugacccaggucugagggaagugugugcaugaaagccaagggagccaaaguuacucuucucaguagagaaaguaugggguaaaccuggagcauaaacccagccaaggcaacuaccacuucaaagagcccaaaugucauaagcucaguuaccaaagcaaacuaacccacaacaucagaaauacaagguguuaacagugucagguaggcuauucaggacuuauaguaguuuccuauuuaaugggcauuaaguggcuuuggcugaaccucuccagcagugacgcuuccauggagccugcugccgucuucacagcuccucucuggcaggauuuggcaguaagcuuuguggaggugagaggagaaaggauagaucccaggaggccauccaugguacucccuuuguguccagggcacuggaacagaggaagagauuguucuaggaguccagguugcccuccccuccagcagaguugauggaaagagcuugaauguuugguaggaagauguuccucacauuuaaaagaugccacuugccagagcagggccuuugcuuuucaccugggcccgccucacaggcucaugucuucucuuugucugucccuccuaccccucacucuucccuuuccucccucuuucucuucccuccuuuuugggggucagaaaugagucuucauuuuugagaucagugggugauuccuaaggcuguacuucccuuuccaauguccuuccaugcuuaacucuccaacuaguggaaaaccauuuauggcuugcauuuagucucaucaccaauagaauagccugucuaucuaauucuguagaauccagauuugagaaacagagauuugagcagcuuagcucaguucagaggagguagggcagcgaaggccaaagggggagagcuuuguccaugcuggaggaaggagaccggaucucacccaucguuguuuccaaugcuuggcuuagggcagaagcccuaaauguuugccaaacaaaauauuauaagaggaagggaauauucagugaggccacagcuaccuuagaccuuuuaugugaaaaauuugggguaaacucagugagggcaaauuggcuuuccuuuauuucacuuuauuagagguuguguugaaggcuuaggagagaaucacuaagguggggagagguguugugccuggaaacagcggagcggccugagggcaggugcaggggaugggguugggggugcguggaggugucacccugggcuuuccuggccuccuggggcagccucagcgcugggauuugggaggugagggacaggacuugcuguauugagcuaagccgggcgcugguuugcuaacacagcagugacucuuaggcacuguuuuccuucccccuucugagcuggaggaacugccugccugugugaagaucacucggaaaggucacugcugugucuccuuguaacugcagcgcuugccuucugcaguuuagccuguggacuugucgcuugcugucugcagcgggaggcgggacgacccacucagugcugaaaucuuucuguguugcaggggugggcugcuaucgaguggauaauugaacacucugaaagcgcugugagcuaaggaggccugugccugugcuugucauaaaugguggugaguacaguauucacucaccuggggggguacuugcagccucuugugacccgugugcauggugcacauggugaggggacgccagaaguacgcagcugcugguggcucuccagcccggagcuccuuaguuuuccacggugacacagaaucacuggguucauccucuuucuauuucauuccuugcuucguggcaggauuuagauuccgaggaagcuugagcugcggcccucugggucgcaugguggcagcucggccucuccagcaagccacccucgggcuggguugcugaggugaccccggugacugugcagaguuggcgcgaguggccaggccuguccugacagggcgcuguccuuugggugcaucugcaucugcugcugugagcgagguccugugcccaccucuucacuugccccaagccaguacauggccacacggcugcagccggccauuuccuuuuagcaguggaagccuuucuggcguuuccuugagcuucacgaacauucccuggcuucuuguggcaucagcagcuggacuucuaguggcccugccccgacggccagcggccaccagggccugauccccggggaggacgcgccucccaccagaggcugugcugcgcugcucugggcugcucguccccaucugucccccguguguguggguucggggauccuuaagaacuucgugcugauuuugccugagucacugaagccacacuuugcucuccuugaacccaagccagggguggccaugggccucgccuccuucauggccgcacccugaguucagugccuguaaggagcuuccuugccuggcauccuguaucugugugguguguggugugugcuguguggugaguaucuauguguguguggugagugcgguguguggagugugugcugugcgugguauguauauauguguguguggugugugugugugugcagcguguauggugugcaugugcugucugugauguguugcauguuugugugcugugugugcuguauguugugugugugcuguguguauauauguggugugugugugugguguguaugcuggugugugaugugcguguguggggugugugugauguguauaugugugugguauguggagugugugugugacaugugugcugugugauguguauauguguggugugugugugcucuguguaugugauguguauaugugugugguaugugucgugugugcauguuuguaugauguguaugugauuggugugugcugugugugaauguguguauagugugugcucuguguaauguguauguguguggugugugugcaugugugugaugugugugcaugcguguaugaugugcaugugugugaugugugugugcuaugggauguguaugugugugguaugggugcaugugugugaggugugugauguguaugugugcucugugauguguauguauguggugugugugcaugugucuaugaugugcaugugugugauguguauugugugcugugugugauuugugcaugucuguaugaugugcauguguguaauguguaugugugauguguauguguguggugugugcauguaagauaugcaugugugugauguguaugugcggugugugucaugagugugguuuaugucuugagugugguguguggugcgcccucugcuccucugcaacccgaccccuggugucucugcagaugcuucccagaagaaaggaaagaaggaggugaggagaggacgagcaaggacgggacggaaaagcacgucuggcugcgagggcacacagggccggggaggaggauuaggcuggacugaucgcgggucgcaggugaccccgggaccagaugucccuccccucaugagcgugcaacagggagcagccccagccagccccaccgccgccgucugcguggauggagggcucgaggcccucgcccgugucccuuaggggcggcgcccaucguccugccugccgcaguggcccagccccuucucucccugcaggugacccgcgccgcccccgcccgcccgcccacgcuguccuccacuuaggcuccuccacaaacgcuggcgggugugccgcccuccagccucuccgcccccguccccucgguccugcagaucaccaagcagcucuccugggcccgcggcugcuccgggccucacaucugcugcuggccucggugggcucugacugcggggcucacggggccuggggccauggcuuucuucucggcccccaaaugccuuuccuggaguggcuaagccucuccugacgaggcuccucaugcggggagagggcugggguccagggguuucccggcccuuucugcaggcugugccagcccccuccagucugccacugccgugcccgggggacauccugcgcccaggcuggaggcccugccucgcugcuugccagccucaccugcuggggcuggaggccauggaucccucauaguauccaagguuugaguuccuguuuuucgccuuauaguuuugugaguguuugagggacaacgaccaaaggucuuuuccccaccaucuuuaaaucaaaguuguuuaaaacaacauuaauuuuaaaaaauacauaaaagcaacccaugcuuaugguuaaaaaagaguacaggagucuggaguccguugaaggguaaaggccucccgcaagcugccagucggcucuuuuucgcaaagccuuccagaaguuuucugugcuuaugaaagcguauguguggccuuucucuucccuucuuuuauuaaacacagauagguuuaugcuggauaa

SEQ ID NO: 192758 - RNA, 30073 nt, Homo sapiens
gccugacgcggcguugcgucccccgggagcugcgcuaggcgaacggcugcggcgcuuugugcuccagucgcuccuaacgcucccuggcccggccggggccgcgcaguuagggcaucugaggcggggagaagcggcggggagacgccggcugccagcaugucgcugccuccggagaaagccuccgagcugaagcagcucauccaccagcagcugagcaaggugagagucgcgggugcugggagagaccgccgggccgacccauaaccuuucccuccugcccggcggccccgggccgacagcggcaucugcuugccgggacuguagcgaggauuguggggugcgcaacgcagaguaggcagagcuuugaguuugaggcaggagagcguccucgucuccgagaaagaaaacgagccgagcaggugcuagcaagagucuggggcgauagaacgagcggucuuggcguuuuaggacggccgugagaaugaagcgcuuagcgagcgacuucuggaagucggaucgaguguaaguuguauuuggagguuuauauucugcuguaagauaucagguuuuuuuucuuucuugagacggagucucucuguugcccaggcuggagugcaguggcacgaucucggcucacugcaaccuccgccucccagguuuaagcgauucuccgccucagccucccgaguagcugggauuacaggcgcgcgccaccacgcucggcuaauuuuuguauuuuuaguagagacgguuucaccauguugguguggcuggucccgaacuccugacuucgugauccggccgccucggccuccuaaagugcugggauuacaggcgugagccuccgcgcccggcagauaucaggguuucuuuaccgcugaaacauguggguaucagcgaaguugaaccaggagcuucaaucagcaauucucaaauaagucauggaagagaaguuacuaaaggguuuguaaugacggaauuuguuaauauuucggagcuccagaagaaccuccaguuucugcagcgcucgcucgacugagugcaagaugcugaagugauaaaagcgaccauuuauggugcccuugugugccaggcuuugugcugucuaguaucuuuaauccucacaacacuaucgugagagggcacuacacuagguuuuuccauucuuaucggugacgaaacagauuuauaaaggguaaauaaguuggcuugagguuacacaucuacuaaguugaaagcugguaagauucccuuaucauuaggcagaucaaaguaugaaaguaauaagaucauacuuugaucugccuacucccaguccguguucuucugauuauacuauacucccucucagaagauuccuuuugguugaguguuguuuguggagaaaugguaacaaaggugccagauaaccaguggagacuauuucuagaauuuguacucaaaagauucauucuuuaaaagcuuaccuuuguucccauucaauugugguaacaauugugcauuuacuguuagcuggagaaccuuaaaacuucagaagcaguauuugacugcuuugugauguuauaaauuguaauaugaguuuucuacauagauggauguccaugguagaauaagagaaauccuugcugagacuauacgggaagaauuggcaccugaucaacagcauuuaucaacagaagauuugaucaaagcccuuagacgucgaggaaucauugacgaugugaugaaagaacuuaauuuuguuacugugaguaaucuuuuagggaaauaaaugagaguauauauguauauacuaaugcguaacacuacuuauaagguuccgauguggggccuuucguuuuaguaaaaccacuucaaggucauucuguuuacuaguguccuuguuucaaguauaggcuagcucugcccuugaauauacugaauaguuuuguguaucaaugaaauuuguguuagauaucuuauuccugucucuacagugacagaauuuucucuuauuuucuaggucuguaaauuugaauauacauacuuuaguccaauuaguucaccauaacaaaguucuuuuucauuaugaucuguaacuuuuuuagauuaagcguauuuuuaaaauaagcacucuuuugggauuauauucucuaugauuaacaaauuacaaauuucuuuaagaaaauaauugacugcauaagaguccucaaaucuuuuaauacaaauaggucaauaaugggaugauagucucucagugcacaauuaguaaguaggccuucauuugaaagugaggcaauaauggaaacugugaccucaauaccuggguaauauaaugugaaaauuggauggacuucauaauacaauagggaauaaguauuuuaauacagcaccuuuuuuugguuuuugaaguuuaugaacccguuuguuauaaaaauugaccuaauaacagcuucuacucugugaugacacuuuauuaaaaucagcucauaguggaauuauaagccaacuguuacauaagguuuacagaaaguuuaaccuuguugaagguauuaaggauuuguuuuuagcuuuauguggauaguauuacuugaagacaguuuaauuccuuagcauuugauuuuaggagugaucaguuuacaucaucuuuuaugcaggcuuuuauuuucauuauuuuaauuaggcuaggaaaauaagggguucuuugaaagggccuuacccuguugacuuuagguucagugcuuagucauguuuauugacauuuccuuaaccuauaauuguuuucuaauuuguuuugauuuuuuuuuccugccuuucuaggacaguguugagcaagaacucccuuccucuccaaaacaaccuauuuguuuugauagacaaucgacauuaaaaaaaaguauguauauuuuaacauuaauuuaguugugguuaauaguaaauauugaugugguguagucuuucguauuugauagaagacauuuccauuuuuuccccccaaaauaaaauacuuaaaauuuuaugguuggcuaaaacagauuguuuugcaugaaguauaucagaagaguuaauguauagcacgguagaagcaaaaacagcaucaccaguuucuuguguuuuaauaauauguuuuauaaaaacuguacagccuugcuuuuaaauauuaauauaauugacaaauacacuugcugaauugauaauuauaugaguugguuugugaagguggaggaauguuggauaagcaguuaaaaagcaaaaguauacuacauauuggcucugaugccuuuuccagcugggagaaaguagccuggauguaaacucagaaaagaauaucauauuuuguguaucuucuccccagagugcaaaugauucuggcauauacaguaauaaauuuguuacucuuuugcuuuuuuuuuagucuuugguauuggguuuuuaucugucaaguuuuuauuuccuaaugucuugaucacauucuuuuaaguuauuuggcaguuuccucauauauauugcuacacuuuacagcuaauauugauccaacacggagguaucuuuaccuucagguuuuggguggaaaagcuuucuuggaacaucugcaagaaccugagccuuuaccuggacaaguuuguucaacguuuacuuuauguuuacauuaucgaaaccaacguuuucguucuaaaccuguuccaugugccugugaaccagauuuucaugauggcuuuuuacuugaaguacacagagaaagcuuggguaagaaacaguaauaaauugucauuuaauugaguaaaucuuuguuauguuuuauugugaaacaauaauaaugacuuuuucuguaaggagagauuuauaauggaggaaucucuauuuuguuucccacugcucuuuucaauuuaaacuacuauccaccuucuugcaauauucuguuugcuauucauuuucccuggauauuauuuuuugacuguuuucauuguugauucuuuaguaauacacacuuaaauaccuauuaugugcauaguguuaugcuaggcaggugcugggaugauauaguggaaaaugagacaugguccuucucauuuauaaaauauaaccagauugaugauguuauguaacuuuuaaaagucgaaguuuaggcugagcacggugacucacagcugaaaucccaacacuuugggaggucuaggugagagaaucauuugaagccaggaguucaagacaagucugggcaaagugagacauugucucuacaaaaaauaaaaaauaggcugggugugguggcucaugccuguaaucccagcacuuugggaggccaaggcaggugggucaccugaggucaggaguuugagaccagccuagccaacaugucgaaacccugucucuacuagaaauacaaaauuucuagccgggcaugguggcaggcgcguguaaugagccgagaucaccccauugcacuccagccugggcaacagagugagacucuguuuaaauaaauaaauaaaugaauaaauauuuauaaauuauuuauaaaaacuucuaauaaauuuuuauaaauacuuacaaauaaauauaaauaaaauaaaaagucaaauuuagaugugaacauauaacugucauuuuaauuuuuucuuuuuuuucuuauuucuccaauaaagcauguaauucucauaacuaaauuuuaugcuacuugauuccuguaauuguuuuacacuauguuucuuucaguaaagguauuuuguauuuuguaauugucaguauggaaaucuuuauauuuguaaacuaagcaaaguuucagaaugucuucacaauuuuagauuuaaagaugacugaaacauuacuaaaauuuauuuuuuucccuuugaaagauguuaccuuaauaaggcaauuaauaggauaaauugcuagauucgaugugcuguauuuuucaguuguaugucaauuauacagugauaauuucuggagguuaaagggauuucuugagguaguuuggggauuaauauugacauacuugaaggcuuuuuauuguaguagcauauacuuuaguuaaguacuuuuaaagaacagacuuaucuuaugaaucagaaagcacugauaugcuguaaguuacuggauaacucaucacaauuugccagucuucugaaaaguuagugauagaaauaggacuguacuuguauuuccaguuuuuugcaugcuuucugagacauuagcaaauuguucucuuugguuuuauauaagcuuauuauuuacuguuuaauaaaaguauucuuuuauguuggccuaacugaauauguagugugguauaauuucguuuggauuauauugcuaggugauggaacuagaauggcugauucaacaacaauguuaucaauaagugauccaauucauauggugcuaaucaaaacagacauauuuggugagacgacuuuaguagcaucauauuuucuggaauggcgaucgguuuugggcucagaaaauggagugaccagucugacuguggaacuuauggguguagguauggugauuaauauaucauuguuaaccuuuuuauagccacaguucauuuguaaauauauuuuauaucuuuaaaaugcuuuuauaauccaagagggaaaccuguaaaauagaauuucguuagaguuacaauuggaccucagcauccuaaucuugagaaaugucuugaagaauaauaucaguauagcacuucauggucaaucugaccuugucuuaggagaaauguuuuuuucuggaaaaugaauacaggaauuuugaggguuuuaauuucaaguucauuugauuaaauauaaggcuauaaagaaaauuaauauucuugacacacauacaaacuuauguguguccagucaucacacccuggaauacauccccuuugguaccagugauucuugcaaaauacagaguagauguucucccaaccuuuuacagugugggugagugagacucggaagaggaaauaauuugcucaguguuaguaucaacuaguccuugagggcagagcuggugccuaucuuauuuaucauagucuccuuggaaucuugcacacugcccgcuauguaacacauacuugcuaauaaaaugagaaaacaaaaccuaccaauguuuuaucuauaacauauaauggaauuacuuugguuuuuaaacuuagucacagaguuaaaccuugccaguggacagcauagccuuaguaauuuagauuauuauuauuauuauuauuauuugagauggagucucgcucugucaccaggcuggagugcagugcugcaaucucggcucacugcaacccccgccuccuggguucaagcgauuauacuggcucagccugcuaaguagcugggacuacaggcaugcaccaccacacccagcuaauuuuuguauuuuuaguagagaugggguuucaccauguuggccgggauggucucgaucucuugaccucgugaucugcccgccucggccucccaaagugcugggauauuggcgugagucaccgcgcccagccaguaauuuagauuuuaauaagucauaccaagaauguauuuuucuuuaaauaaaaauuauagaaaaaguguccuuuauguaagaaauuuauuuucaaaaacaauacccaauuugucuucaaaaauaggccuaacaugauaaucguagcagugaccuggaaacaagcagauucugauucacugaagaaacauuaaaucguuuugaugugaaguauauuuguuuucuaguucuuuaaauccaggcauggauugaaaauuucuacucagccuguaauuggauaauggggagugacaaaugggaguuacuauaagugacaauauaaaugcuuucuaauuuuuaguguguguguguguguguguguguguguguguggagaaggaaugagguguuaacaguugcuuugacuuugaauuuaauguaagucugguugauauuauacauuuaauuaagacaaaaauuaagagucucaaauccuuuaagucagaaaaguuucuuaaaaccuguuagaaaagccagguguaguggcucaugccuguaaucccaccaagcacuuuggaaggcugaggcaggaauaucacuugagcccuggaguuuaagaccaaccugaauaacauagggagaccccaucucuacuuaaagaagaaaaagagugucagaaagcuaagaaaauaaucuccuuauaauuaaacaccuuuguuuaaaaaaauugauuugguucauuuuaauaugaauauuaaagguaauguugaauguuaucuuuauuccauguaagugauaaaacacccaagugccuaaauuauuuugguuagacuuugguugacuaaauauauauaguauugaaaucucugaaguucaaaauauuuauguuuauaggcacagaaucaaaaguuucugugggaauuuuaaauauaaaacuugaaauguauccaccacucaaucaaacguuaucucaagaaguagugaacacacagguaaauacuuaugaguuucucuuuuuuuguguguuuguuuucauaguaguauauuuaccuguugauccuagaaagcacucuauuuuuagaaaauuaccauuuauuacuuucuagauuagcacucaaagguucacaaaaaggaugaggaagaaaauaaagacaagauuguuuuccuagcagaaucuguagucuaguuuaggaaauacgaugaacauuuauugagacagcauaagaauuacaggauaggccgguggcucacgccuguagucccagcacuuugggaggccgaggcgggcggaucacaaggucaggagaucgugaccauccuggcuaacacggugaaaccccgccucuacuaaaaauacaaaaaaaaaaaauagccgggcgugguggcaggcaccuguaguaccagcuacccgggaggcugaggcaggagaauggcgugaaccgguaagaggagcuugcagugagcccagaucgcaccagugcacuccagccugggcaacagagcaagacuccaucucaaaaaaagaaaaaaaaaaaaagaauuacaggauaaagcugaagaagaucaaagaguaaagugcaaccucagugggaugggauuuuaacguucuuucgcaggcguuuauugaaagcuugcugcuuaugucuuuucugcucuguucucucaggguagaagugcuugccacuuuuagaguguguuuggagaggcuuuuuucccuaauuccacugucaggucucugaugaauuacuuucuuccugggucuuaaaagaucggcagauuuuuucauuccuucacauuggauuugccauccauguuuaguucuugccagucuuuaguuuggagguucucauuaucugcugacuugccgggauggcacuuguggaaugguucuccuugauuacauacaccacccuuuacuccacccugccugucauauuguuccuuuuacagaccugugguuagacgcuagugcuucucccucaggcaaacaauguccugcccuguuuucuuuaaacuuuuuuuccuuccuuuuguaaacucucaucucccucuaaucucuagcuucugacaugugucaugggugguauauauaccugaaaccacauagugagaaccaacuuugauguuacucaaauaaauacccagcccugugggaggcuaagguggguggaucacuuuugaguccagcaguuuaggaccagcuugggcaacauagugagacccugucucuacaaaaauuuuaaaaaauuagucaagcauggugguacauacuuguagucccagcugcuugggaagcugaaaugggaggauugcuugacccaggaauuugagguuacagugagcugugauuguaccacugcacacuagccuggguuacagacuaagacccugucucuuaaauaaaugguguauacacacauauacauuauguguauacgugagggguuuuuuuguuuguuuuuuucagacagagucucgcucugucgccagguuggagugcaguggcgcaaucuuggcucacugcaacgucugccugccgaguucaagcaauucuccugccucagucuccugaguagcugggacuacaggugggugccaccacgcccagcuaauuuuuguauuuuuaauagagacaggguuucaccauguuggccaggauggucucgaucucuugaccucgugaucugccugccucggccucccaaagugguauacaugaguuuuaaucauguuauucauauauuuaugugacauauaaaguaaauguuugggcucuacuuuuuugggguaguagcuuguuuuuuuuaauuaaauuuuauuuuuuuagagacagcaucucacucucucaggcuugagugcaguggugugauuauagcucacugaaaccucagacucccagccucaagcaauccaccugccucagccucccaaaacauugggauugcagacauggaccauugugccccaccagguucuccuuuuuaaacuuaacauuauuuuauauguauuuucuuauauuuccacugucauauuuauaauuucuagugacuaaaacauaaguuuauucuauuaucugauaaauaaauugcuucuaauuuucucuuuaaaauugcacuauuaaaacuuuuagccaggcuaauuaaucuguaaucccagcacuuugggaggccaagguaagaggaucacuucaggccaggaguucaagaccagccugggcaacauagguagacuucaucucuacaaaaauuuuuaaaaauuaacugcacaugguggugcauuccuguagucccagcuacuggggaggcugaggugggaggaucgcuuaagcccaggaauucgaggcuacagugagccaugaucaugcaguagcacuccagacugggugacagagcaagacccugucucuuaaaagaaauuaaagucagaaauauguauggauccuaaauagaugucaaaaugugcuagacacuguucuagacacuggagauguagcuguguauagggcagcagacagcuagacagcuugcucucaaggaguuuagauucuagugcaggagaaacaauaagucagcaaacaaaauaaucagauaguagaagguguuuuauggagaauuauuacaggugauaugauacagugguuauuggguggcuaauuauaggucgagugacuaagguagggaaagagucugaacaacaggaaguaaccagccaugcaaagauuggggcugagcuuccagcacugggaacagccuagaacaaaagccccuauggaggaccgaaagcccuguguggcuagagcguaguggguuggggagagaggagaaaaugagauagucgggccagaguucauaggccagggcagguauuuugcaaugugauggagaaugaaguguuuuaacaagagaaugacaguauguuuuuuuuuuuuuugagauagagucucacucuaucgcccaggguggagcacgguggcaugaacucggcucacugcaaccucugccucccggguucaagcaauucuccugccucagccucccgaguagcugggauuacaggcauguaccaccauccccagcuaguuuuuguauuuuuaguugagaugggguuucaccauguuggccaggcuggucucgaaccccugaccucaaaugauccaccugccuuggccucccaaaauguugugauuacaggcgugagccaccaugcccggcuuguaugauuuacuauuuaaaaauuucugggccaggcgcgguaaucccagcacuuugggaggccaaggcgggcggaucaugagcucaggaguucaagacuagcuugaccaauguggugaaacccugucucuacuaaaaauacaaaaaaaaauuuagcugagugugguggcacgugccuguagucccagcuacucaggaggcugaggcaggagaauugcuugaacaugggaggcagagguugcagugagcugagaucuugccacugcacuccagccugggcgacagagcaagacugcauccuccacaaccaaaaaaaaaaaaaaaauucugucuuugaggaaaaaaaggugacuuaugauuauuguauggagaugggauuguacuagggguaaguguagaaauagggaagucaggaggcucuuauagaagaugaugaugacucagauuagggugguaaugauguagagaaguagauaaauuugcuacauauuuuguaguaauuaaagauaaugaauagaaauugaaaaauauuuuuuucaauuucaagcuugcuuuggaacgucagaaaacugcagagaaagagcgauuauuucuuguauaugcuaagcagugguggagagaauauuugcaaauucgacccucacacaacucacgacugguuaagauuuuugcacagguuuguaaauuauauuagaauaauuuuaugccuguauuugagauuuacuguuauguguguaaauuucauuuaauauuuauuuguaaaauguauuccaaaaaauaaaaguguauuuguaaaauaaaaugcugauuuuguaauauucucuuucacugcauagugaguggcaagaucaaucuaugucuuauuuuacuuucaauuucaguuauuguggguuuuugaaaaaucaccuuucucagguugaaucaauuauuguguuuuaaacccuuucugaauauauuugauuuaaaguagaugaaaauccauuuuguuuaacuuggaauguguauuugcuugauacuuagugcuaaauaauuaaccauuuggacacuuugcagguuauauguaaauccagcucuugugugcagaacgggggggggcucugggcauauauauauuuuuuguuaggguuuuaaaaaaaauuguauauaaccacgacuucuaagccagugaccaguaauguuuaacugaagcauuucaacuauauaucucugccuccauuuuuccugaguccuaaacccauuuucucucuuuaacagaccaauauaaaauauauggucaggucagcuaggcgcgguggcucacgccuguaaucccagcacuuggggaggccgagguggguggaucaagaggucaggagaucgagaccauccuggcuaacacggugaaaccccguuucuacuaaaaacacaaaaaauuagccgggcgugauggcgggcuccuauagucgcagcuacucgggaggcugaggcaggagaauggcgugaacccgggaggcggagcuugcagugagccgagaucgcaccacugcaguccggccugggcaacacagcaagacuccgucucaaaaaaaaaaacaacaaaaaauguggucagguucacguauuuuuuguaacuccuaaggaacaguucaaauauuuuguauauauucagccucauacagaugcuuucauauaaguauaguguaguauauuauuuuaaguuaaguuucucaaauccuguacauucauccagcuuuacccuacuuucccuagauuuuggaacaggcuaaaagugguuuaguguccagauggggagcuugggaaugagagguugacuagaggugggaauaagggaaauggcuucugacuuucugauagcguuguuuauauauugaaugacugguuggcaagguaacaacauuaucaggacaaaggcaaggagaaaccaaucaaaauguaacuggcuuccuggccgggcgcgguggcucacgccuguaaucccagcacuuggggaggccgaggcagguggauccucugaggucagggguuugagaccagccuggccaacauggcgaaaccuugucucuacuaaaaauacaaaaauuagccaggcuugguggcaggcaccuauaaucccaguuagucaggaggcugaggcaggagaauugcuuaacccgggaggcggagguugcagugagcgaagaucacgccauugcacuccagccugggcaacagagugagacucugucucaaaacaauaacaacgacaaaaaauauacauauauauauauauaaacuggcucccugcugucuauauagucugaggcauuuauucauugccacguggaauuaggaacuagagaggacucaggauggagugaggcagugaaucagagaaauggcaggaucaaagaggaggaagaaguugaaaugcacuaaggaagucaaggaagugggauuuucuuuuaggaaauauuacuuaaacgacuuccucucucagaauucauuuuaagauuugaaccauagaacguaauuuagucucauaguaaccauauaagauugucaaguggccaggcauuggcucuuuuuguaaacaguaugaagguuagagaagugaacagucuuuucaaggccaaacagcaacucagucauggcaaagucugugucaaauuggaguuucaacuggugccuuuuugguuuaugccaccucuuuccauauacauagaguaaauaaaaugcugauuuaauuuagauuccucagaacuguuucuugcugcuuccuguauuugacuaguucugaaauuaaacaacaacaguguaaaacagucaaucuaauuauaaaaacaauaguuauaaaucaaaacguuaauauacauauccaggccaaaaaaauuucuaauguauccagcacugaaaguaaaguaaagaacuuuuuuuuguuguuguugugagacagagucucagucacccaggguugagugcaguggugcgaucuuggcucacugcaaccuccaccucccagauucaagugauucuccugccucagccucccaaguagcugggacuacaggcacgugccaccaugccuggcuaauuuuuuguguuuuuaguagagaugggguuucacuguguuagccaggauggucucgaucuccugaccucaugacccgcccgccucggccucccaaagugcugggaucauaggcgugagccaccacaccuggccaagaacuuuuugcaaugauggaaauguucuguaucugugcuaaccaguaugguagccaccagccauguacugagcauucaaaauguggcuauuaugacuaaaaauaauugaauuuuaaauuuuaauuaaaauuuaaauagcucauaaugguuagugauuuucucacuggacagugcccauucagagguugaaauauuaacuuuucaaaacaguuaaguagcuuguggggauauauuuagauaauauuagaauauugcuguaauaaaaugauauaucuuacauucuaagaugcuacuauugaugauugacuuaggcaaaugcuuccacuucuuaugugcucaucuuuucuugccuguuaguggauuuguaagaauaggaguaacaguccugcaccucaauacuaaccaaagaucuguagauuugccguggccauuauacuuaaaaauucauuauucuuuuuacccuuuguuagcugguuuugcuauaguauaguaguaauucauugaaugaugcuuuuugaacuuuuuagugcaagaaacuuuaaaauaaguuacagaaauugaacuuuaaggccacuagguuuuguuuuuuuuuuuuuuuuuuugagauggagucucgcucucgcccaggcuggagugcaguggcacgaucucggcucacugcaagcuccgccucccagauucaugccauucuccugccucagccuccuaaguugcugggaccacaugccuggcuaauuuuuuuuguauuuuuaguggagaugggguuucaccauguuagccaggauggaauugaucuccugaccucgugauccacccaccuuggccucccaaagugcugggauuacaggcgugagccaccgugcccagccuaaggccauuagguuuuaagaaaauguuguaaaucacuugaggauugaggauauucuuuuaauauuuaguuugugauuucaggacuuaguauucuuauaccacacuagauuauuaguaaugcuaaguucauguaaaagaaaaccauaguucucuacauccccccaaaauuagaauaauaauccucuguuuuaaaaaucggugcccucuaggccaggcacaguggcucacaccuguaauaccagcacuuugggaggucgaggugggcggaucacuugaggucaggaguuugagaccaagccuggucaacaucgugaaaccccaucucuacaaaaauacaaaaauuagccaggugugguggcacauaccuguaaucccagcuacucaggaggccgaggcacaagaaucgcuugaacccaugggcggagguugcagcgagccgaaaucacacuacugcacuccagccuggacaacagcgagacucugucucaaaaaaaaaaaaaaaaaaauugaugccuucuauaguugagaacuauagguaugaguggaaucuauagccaaguugcucugcaacauaaaaauuaaugaucuuucucauuauaaucaaauguaaauaagugaguuuuuuuuuccuugcuaaaguaugggacuauauuggaaaaagauguucugguuguggagaaagacaucagugguucugauaauucaaacagaugguguuucuuuuggcuggguuagaucucauguccugaggaacccuaucagggaggguaggucaucuccaaaucuugaauaguaaguggcccuuucacagugccguaucaguaaccaugaagguaaagagauuguggacuuugguaauacucacuguaaaaucacagugguagacagucaucagagaccuauauaugcauacaaguuauucagcaccaacaccaggagauauccuguauuuaggauguaaaacuuuuucuagaguguuuuuugaaauuuugcuuucaauugacuugguuaacaaauuauuguuuccuguggaucucuaaauuugaggcccuaauggaaacaaacuagaaucaagcuacaaucauuucuguuauaucagccaaucagaagaguuauuuguucugucuggcuauauguuguuaaauucuauaugguaaugugaaaaaauacuucagcuuagagcaccucucccuccccuacauaccuacccacacauuucucagaggaguucuuauugccacagccuuuggaguaaaacagcucagagcuugaaccuggcucuguugcauaauagcuguagcuccucaguuuucaucuauaaaaugaaaauaacggagaugaggauuaagggaaauuauauacacagcacuuugcagccaaauacuggauacaagguaagcacucgaucaaugguaugcugaauuauuuuauccuacauuaauguauuugaaaaaaacauaauuggggaugauuaauaugucauuacagauguuuuuccccuuuucccuaggaugaaaaugggauaaauagaccagucuguuccuauguuaaaccacuucgagcuggacggcuucuugauacuccaaggcaagcagcaagauuuguuaauguccuugguuaugaacgagccccuguuauuggaggaggagguaaacaggagcaguggugcacucugcuggccuuucucuguagaaacaagguauuauacacacauaauagaauuaaguagcaguauaucauaguuacucugaauuuguaauccauuuguaaaagaaugccuuagaaaaaugcacauauagucaacccucuguacccacagguucuguaucuguagauucaaccaacugcagaucaaaaauacuuacaaaaguaaaaaauuacaauaauaaaaaauaguacaaauuaaaaaaugguguguaacaacguuuauguagcauuuacauuguauugagauuuuuaaacaauuuagaggugauuuaaaguauauaggaggaugugcuuagguuauauauaaaauacuauaccauuuuggcuggccgcaguggcucaugccuguaucccagcauuuugggaggcugaggcagguggaucaccugaggucaggaguucaagaccagucugggcaacauggugaaacccuaucucuacuaaaauacaaaaaauuaucugggcauggugucgugugccuguaaucccagcuacucaggaggcugaggcaggagaaucacuuggacccuggaggcggagguugcagugagcugagaucgcaccauugcacucuagccugaggacagagcaagacacgucucaaaaaaaaaaaaaauacuauuuuauauaagccuugaguauccacggauuuuguuuugcaaggguccuggaacuaaccgcuuuggggugcuaucagcuugaccacgucagaaccuuguucuguuuuucauaacauuuaaauaucaauacacaaaaaacucagcaucuuuauuuucucauguaguuucuuauuuauugugauuucugugauguagggaccuacaaguacuaaaaugucagaaaucaaguugcagaaugaauuaggaacagcaccaggaccagaccauggcuuucugguacuacugauguguugcaauuugcucagauaauacaucuuuaaaaaagagaaaauaaggcugggcgugguggcucaugccuguaaucccagcacuuugggaggcagagguggguggaucaccugaggucaggaguucaagaccagucugaccaacguggagaaacuccgucuccacuaaaaguacaaaauuagcguggugugguggcacgugccuguaaucuuagcuacugaggaggcugaggcaggagaauugcuugaaccugggaggcggagguuguggugagcugagaucgcgccauugcacuccagccugggcaacgagcgaaacuccauaaaaaaaaaagagaaaauggcaguacaaaauuaauauagaaaaaauauuaaaauagaaaaaaaucuugaauugcaugcuauuuaguuuguuuaguuuguauuuaaauacaaauguauauuuaauuacacuuuuugaaugacuugauuuuaguaaacuaauuuuauagauuaugggauauuuccuaaucuguguucuaaaaauguugauaguaugauaacaaacaaguaaaacuaucuuuaggccaggcgcgguggcucacgccuguaaucccagcacuuugggaggccggggaggguggaucaccuguggucgggaguucuagaacagccuggcuaacauggagaaacuccaucucuacugaaaaaauacaaaaauuagccagccaugguggcgggcuccuguaaucccagcuacuugggaggcugaggcaggagaaucacuugaaccugggagguggagguugcagugagccgagaucacgccaucgcacuccagugugggcaauaagagcaaaacuccaucucaaaaaaaaaaaacaaaaaacuaucuuuagccugggugacagagcgagacucugucucaaaaaaaauaaauaaaggugacagcaggccaggcaugguggcucaugcccgcaauuccagcacuuggguaggccaaggugggcaaaucacuugagcccagaaguuccagacaaaccugggcaacauggcaaaaucccucucucuaaaaaacuauaaaaauuacccaggcaugggccaggugugguggcucacgccugcaaucccagcacuuugggaggcugaggcgggcggaucacacggucaggagaucgagaucauccuugcugauacggugaaaccccaucucuacuaaaaacacaaaaaaaggagaaucacuugaacccaugagguggagguugcagugagcugagaucgcgccacugcacuccaaacuggacgacagagcaagacucugucucaaaaaaaaauacauauauauaugauaucauauauaugauauauaucauauauauauuuagauuuuuuacuguacaaacaacagcauuacaacaguaauggugaaacuuuaccuauaauucuauuccuaguuuauuauuucuuuuuauauuuuuucugcuguauauguaucauuuauuucauaauuauaauuguaaauaaauuuuuguaucuugcuuuauaauuaagcauuaugcuaugaacauuuuucuauguguugcuacagucuuucugauuuccuuuuuuuuuuaaaugagacagaguuuuccucuugucgcccaggcuggagugcaauggcaugaucucggcccacugcaaccuccgucuccuggguucaagcgauucuccugccucagccucccuaguagcugggauuacaggugcccgccaccacccccagcucauuuuuguauuuuuaguagagaugggguuucacuguguuggcuaggcuggucucgaacuccugacguuaggugaucugcccgccucugccuccuaaagugcugauuuccguuuuuuaaugaguguuuuaaguuuccuugagucaauauacaaaauacauuuaacuauuucccuauuguaggaacugccaaguuaggcucuuuuuuuuuuauucagugguuuuguuguuguuguuuucuuuuguuuuuguuuaggacggggucucgcucugucgcccaggcuggagugcagugucacgaucucgacucacugcaaccuccgccucccagccucaagcaauucuccuaccucagccuccugaguagcugggacuacaggcauggagccaccaugccuggcuuuuuuuuuuuuuuuuuugguauuuuuaguagagaugggguuucuuggccaggguggucucaaacuccuggccucaagugaucugcccgcuucagccucccaaagugcugagauuacaggcaaaagcuggcacaccuggccauaaaguuaagcucauuuuaaauuuuuuaauguugccaugaaugaacuuucacacugacuaucuuugcagauauuuuuauuuuacuucugaauuuucuuuaggacaaaaucucagaaauaauugggucuaaaagguugauuaagccaggcgcaguggcucaugccuguaaucgcagcacuuugggaggccgagguggguggaucacuugaggucaggaguucaagaccaaccuggccaacaugaugaaacucucucucuacuaaaaauacaaaaauuagcugggugugguggugcacgccuguaguccuagcuacucaggaggcugagaaucauuggaacccgggaggaggagguuguagugagccgaggucaugccacugcauuccagccugggugacagagcgagacucugucucaaaaaagaaaaaaguaaauuaaaaaauaaaagauugguuauuacauuuuuguaaagccacuugaagaacuauaaaaugcuauuuguuuucuuacaguuaauuuuuuuuaaaaaacuuuagcaccaccaaauccaauuuuuuggagaaagaaauuucuuggccagguaagguggcucaugccuguagucccagcacuuugggaggcugaggcaagcggauugcuugaguccaggaauucgagaccagccagggcaacuuggugaaaccuugucucuacaaaaacacaaaaaauagcugggccuggugaugagugccuguggucccagcuauucaggaggcugaggcgggggaaucacuugagcuggggacaucaaggcugcagugagcugaggacgucaaggcagcauugagcugagaucaugccacugcacuccagccugggugucagaacuagacccuaucucaaaagagaggaaaaaaaaaagaaauuucuucauucggacacucaacucaaauaguuauuuuugcuuucgcguguagucuuccuacacuuaaauacgaaauuguaaccauaguguuuaauaucuugguaauuuuuuucacagaacacaguaucagauauuuucuuuucuuuuuuucuuuuuuuuuuuagagacagagucucacucuguuguccaggcuggagugcaguggcacgaucucagcucacugcaaucucugccucccagguucaagcgauucuccugccucagccuccugaguagcugggauuacaggcacacaccaccauacccagcuaauauuuucuauuuuuuuauaggucuuuauaacuuuuuaaaauugaaaguaauauaaccaaagaaaaucuggaaaaagaguggaaaauuauauauaaccuccccaguaauaaccauuguuggcauuuuguuguuguucuugccagucauuuuucuuauguauguauuuucuugaaauuaucacauauagauacuaucagucauugguugaguguuuuccauuuauuugcauuucuugcuguaugacuuguuugcuuguuuguucauguacuucagcuauuaaucuauuaaaauauuccaggcugggcacaggagcucaugccuguaaucccaacacuuugggaggcugaggcaggaggaucacuugagcccaggaguucaagagcagccuggguaacacaguaagaccccuguuuauacaaaaaaaauuuuaaaauuagcuaggugucauggugcacaccuuuagucccagcuacuugggaggcugagauggggaaaucacuuaagcccaggaggucaaggcugcuaugaaucaugucaccagccugggugacagaggaagacccugucucaaaaaaaaaaaaaaaaaaaaauguucuacuuuucuuucuguguugugugaguucuuuauaaacauuuuuuuuuuuuuuuggaaacagagucuuacucuguugcugaggcuggaaugcaguggcgcgauuguagcucacugcaaccuccgccucccaaguucacgugauucucuugccucgccuccugaguagcugggacuaauggugugugcuaccacacccggcuaauuuuuguauuuuuaguagagacagaguuuccuuauguuggccaggcuggucuugaacuccugacgucaugugauccacccgccuuggccucccaaaguguugggauuacaggcgugagccacugugcccagccaauaaauuuuuauuauaauuuaguauuuaaguauguaaugaggaaauaauauggaagaaugaauacuucauuuuaauuuaucuuccagggugacugugaagaucacgcuaaccuucugugcagccuucuucuuggauauggauuagaagccuuuguuuguguugggaccaaggcaaaaggaguaccucaugcauggguuaugacuuguggaacugauggggccaucacuuuuugggagaguuuaacaggacacagguuaguuuacuaaguuuauaaggauauuaaaaugaaguuauaaguuuuuuuuuuuuuuuuuuuuugagauggagucucgcucugucgcccaggcuggagugcacuggcacaaucucagcucacugcaaccuccaccucccagguucaagccgauucuccugucucagccucccaaguagcugggauuacaggcaugugccaccgcaccuggcugauuuuuguauuuuuaguagagacaaguuuucaccauguuagccaggcuggucucgaacuccugaccuuaggugauccaccuaccucagccucccaaagugcugggauuacaggcgugagccacuguguccggcuuaaguuauaaguauuuuaaauuauaaggguuuuuuguccauauugaugguacuugaagguacguguugaugauuuuaguuagagccuuuucagugauuauguaaaaaaguacuucaauuauggcagccaaguaaaugaacucuaagaaaacuuuuaccucaaauauucuuuaccaacaugauguugguaaacaguaaauuauguuuacuaguuuuguaugauuagcauauuuuuuuuucaguuuucucuuuuuuuuuuuuugcagugucucauucuguugcucaggcuggagugcaguggcacagucacagcccacugcagccucccccuccuggguucuggugguccuccuaccucagccucuugcguagcugggacugcaggugugcacagccaugccuagcuaauuuuuuuguagggaugagcuuuugcuguguugucuaggcuggucuugaacuccugggcucaagcagucuaccugccacggccuuccaaagugcugagauuauaggcaugagccaccacaccuggcuggcauauguuuuuuucugaugaucauaccuaagucugaaaauaaguucaaguuguaaaugaugauuucuuuuuaaaauuugaugugguuaccaucuccacguuggcaaauccacuggacacauuuuuuaaaguacuuuagccugucauuagauuuugaaacagcugaguacuucuguuguaggacuucuuccuuaguucagcuaagagcugaguccuugucacauggccacgaaaaauuaggcucgcaggcaauuugaagggggagaaaaauggaauuuauugaacaaaaaggaaaaacacugggaaacggacgcuccacaaagccagagugccugcuagugugcuucgugccugcuagugugcuuccugccugcuagugugcuuccugccucgcagauugaauuccagcuuccacucaggaagaggaggggccaagcuccuccccacugcaaauugcucgaacuucuguggcuucuccccagugugcacuccucccagugcacaggcugguuggaguuucucuggggaccccuuuccaccuggcugucucacuucuuucuucauggaacauucucuuuccuuagcuucuuuuuuaucauugucuuucaauauuuauuauuccucucuggcuguucuuaguuuuuccuucaucuugucuuuaaauguguguguucuagaggcccagcccugggcccucuuuucauucccgaguccucuuucucccugguugauaaucaugccuaauaauguuuugguuaguugugccuaaaaaugcauaaccaaauuauuuuaauuauguuaucugaggcaaacuuuuuuuauuuuuauuuuuuuuucuuggagauggaguuucgcccuuguugcucaggcuggacggcucacugcagccuccgccucccggguucaagcaauucuccuggcuuagccucccgaguagcugggacuacaggcacgugcucccaugcccagcuaauuuuuguauuuuuagcagagacgggguuucaccauguuggucagguuagucucgaacucuugaccucaggugaucccccugccucggccucccaaagugcugggacuaccgcauccggccuuugaucuuaacaguauacauagaauguauucuguuguuaacagaguugguuucaauauuguaaagacguaccauacaauuaauacagaguaaucaaauuguggaaauauaaaaaagaaaaacaaguauuaaacuguaguucugagaaguaguuauggccuuaaguguuagaauaauuuucucaguaagaugcugccuuuuuaauuuuuaaguucucauauauaaaauuauuuaauuuuuuuagguacauccauaaaccuaccaauccugaugaaccuccaguugcugaacagcccaaaccacuguacccauaucgaacaauugguuguguuuucaaccaucagauguuccugggaaauugucaacccucugaugcaguagaaaccuguguauuugauuugaacgaugaauccaaauggaaacccaugagugaggaagcaauuaaaucugugugugcuccuggagcuacaacaucccuuccucccuuuccaccucugugugcauccacaauugacgcgucaguaacaaguaaugaaauugaaaugcagcugaggcuccuggugucagaacacaggaagguaauucacacugaaauaguuguaguuucauacuucuuuucauuuauguauuuaacuguuuuuuggugugugugauagugccagucacuauucuagcccugaacaaaacaacuacagucccuacuauuaugaagcuuauaauuuugaaagucaugagaguucaaguucugagacucaaaaaucuucaaauuaauuaauacuuauagaaugaauuacuuccuccuagaaaugaagaauggugaacuuguucacaucccuuagagucaagauuuuugcugaauaccacuauuuggauuuugucuuugugaaaugcuuauucacauauuugccccuuaaaaaauccuggguuaggcugggcuugauggcucaugccuauaaccccagcacuuugggaggcugagguggguggaucgcuugagcccaggaguucaagaccagccuggggaauauggugaaacaucaucucuauuauuuuuuaaagaaaaaauauguauacuggguuauacuuuuuucauauucauuuuucuccccagguugguuucuguuuguuuucauguuguacucaacuggguagacgucuggcuuuaauuugcauuucccugauuacuuuugagaucaaaccucuuuuuuuuuuuuuuuuuuuuuuuuuugagauggaaucucucgcucugucacccaggcuggagcgcaguggcgugaucuuggcacaguggcgugaucuugguucacugcaaccucuaccucccagguuuaagcaauucuccugccucagccuccugaauaacugggauuauagacaugugcuaccacgcugccaguuuuuguauuuuuuguagagauaggguuucaccauguuggccaggcugaucucgaagugaucuaccugccucagccucccaaagugcugggauuacaguugugagccacugcgcccagccagaucaagccucuugucaaauagcauguagauuuccuuuguaaagugcuuuuaagaagacauaaaaaguauuagucauaaaggaaaagauuaauguaucuuaaagacuuaagcucaucaagagaagacauuaagagauugaagcuguggggugggaaaaguuguuuguaacacauaucaccaacaaaggacuagaauccaaaaugccuacaaaauauuucugauucaccuuuuaggguucccuguuccacuccucaccuugggugagcccuguuuucuguguucuuuggggcuaucaaaggcaaacugauuuaucaaacauguucucuggguucccaguuacucuuagcuuuggccucuaaauauuucuuauucacuugucaacuuaucaaagcauuuaaacauacauuuuggaaaaccuggcauuuguaauauguuuucagcaaaaguuggucaggggaccucugguccauuauauugcuggaaaugaaugccccuuauuacuuuuucuuuccuuccaucacuuguauuggcuuuagcuuucuuuucuuagguucugcuuacaaauaaaagcaauaucuuauaaaaauuacuuuuggccaggcacagugucucacgccuguaaucccagcaguuugggaggcugagauggguggauugcuugagcucaggaguucaagaccagccugggcaacguggugagacccuaucucuacaaaaaguacaaaaauuagccgggugugguggugcaugccuguagucccagauacucggaggcugaggugaaaggagccggggaggcagagguugcagugagccgagauugugccacugcacuccagccugggugacagaguaagacccugucucaaaaaaaaaaaaaaaaaaaaaaggaauuacuguuuacagaaaaagaaaacaaagcugugauagaugccaguguugaucacuauuuaaguuaaggugccuguaaaucagcaaaaguucacauuuugccgcaggaaaagcauuguuaaucguggaucuuugagaccauuugugaugaguuaaaaccuugaauauaaaaugaggaaauaccaaagauccauuaugauaaucaaaauaucuagaauuuugagaauuuuuuguauuuguaauauuauuauuuuuaacuucauguguccagauaucaauaggucuuuugguguuauaaauggaaucaugggcugggcacgguggcuuaugccuguaaucccagcacuuugggaggccgagguggguggaucacuugaggucaggaguuugagaccagccuggccaacauggugaaagcccgucucuacuaaaaauacaaaaauuagccgggcaugguggcaggugucuguagucccagcuacucaggagucugaggcaggagaaucgcuugaaccugggaggcagagguugcagugagccgagaucgcgccacugcauuccagccugggcaacagaguaagacucugucucaaaaaauuuaaaaaaauaaaaaauaaauggaaucauguuguuuuuaacauuccauagaaauauguuuuaagcucccuaagggccuauaaaaugucuucaucuuuuuaucucuuacaguauauaaguuuuauagaguacauguucaguaaauauuuguuuaaucacauagaauuaauuuguugacuuuucucaccucuguaguugaguuuaugguaggaagagucagucuuuaguaaacagauucauucuuacuaaacucuuuuuuauuuauuuuauuuauuuauuuuuuuugagacagagucucgcucuguugcccaggcuggagugcaguggcacgaucucggcucacugcaagcucugccucccggauucauaccauucuccugccucagccucccaaguagcugggacuacaugcacccgccaccacgcccaacucauuuuuuguauuuuuaguagauacaggguuucaccuuguuagccaggauggucucaaucuccugaccucaugauccgcccaccucagccucccaaacugcugggauuacaggcgugagccaccgcacccggccuaaacucuuuaaaguuaaguaaaauaucucaaaauauaagaauuauaccuguccuccauauuaggacuauuucauauaguauuuuguaguagauauuagagaaguacaggauuuggagacuuugugaacauuguuuugaauguuuuuugguuguuucucuaaaaaguaaaaucugaucaccuauaguuccuuuuaucugauuuuuauuucuauguaucccuauaauuauuauuauuaaaauauuaugauagcuuuuaaaaaucuuuucuugguauacauuaaaauaaucaacauuuuuauuuaguugguuuuaaaaauauuaauguauuucacuuuuucuuuuucucuugauugcucauaggaucuuggccucacuacuguuugggaagaccagcucuccuaccuuuuaucaccagcuuuggcuucuuaugaauuugagcguacaacaaguauaucagcaggcaaugaagaauuucaagaugccauaagaagggcuguaccugauggucacacauuuaaaggguucccaauacauuuuguguauagaaaugcaagacgugcauuugccacaugucuucgguaagguguaauuuacggaaucauuuuuucaguuuaggagucuuacagaucaguccggcagggguuuuuuuaauuuccuuuuuuuuuuuuuuuuaacucaaggucuugcucugcugcccaugcuggaguacaguggcacaguuauggcucacuguagccuugaccuccugggcccaagugacccuuccaccucacccucccaggcaacugggaccacaggcaugugccaccauaccuggcuauuuuuuuuaucuuuauuuuguagagaugggggucuuccuauguugcccaggcuggucuugaacuccugggcucaagcagucuucccaccucagccucccaaauugcugggauuacaggugugagccguugcacccagccuaaucugguaguuauuuagaaaugacauccaagucauaugggagcuuuuacaaugacugacccuccuugccacagauuuugauucauuuggucugaaauguagcccuagauagucugggauuauuugcccagugauuuuggugcagucucagguaucucugauuuuguuuggacuauaaggaaauagucuauaauuugaauagcuugaccaaaauuacagugucuuugauagcagagacagaauuugaaaaaauuauuuuauuuauuuauuuuugagauggagucucagucugucgcccaggcuguagugcaguggcacauucuuggcucacugcaaccucugccuccuggauucaagcgauucuccugccucagccucccaaguagcugggauuacagacgcccgccaccacacgcggcuaauuuuuguaauuuuuaguagaggcgggguuucacuauguuggccaagcuggucuugaacuccugaccucaggugauccaccugucucggccucccaaagugcugggauuacaggcaugagccaccacgccuagccugaaaaaauuauuuuaaauacugauuuacuugcaaauaaggaauuaaaguguauggucacuucuuaauugaauaauuuuuuuuuucuuaaauagaucuccuuucugugaagaaauaaucuguugccguggagaccaagugcgacuggcaguucguguccgaguauuuacuuacccugaaucugcaugugcuguuuggaucauguuugcuuguaaauaucgcucgguauuauagggccaauauuuauauaagauuuauaccuguguuuaauuggaauuuuacacauuguacauuacuuagcuauuuagagguuuguuauuuuaaaaucacaaucuggcuugaauggcauacuucaauuuuguauauacuugacugguaauguuuaaaaaaaaucaugcauuccuuuaaaaauuaaggcugaaaaacuuguauaaaucucccuggaauuuaguauaaauuaaguguauauucuauuuuaauaaaugcuacuuuguuuacaguuaucaguaguuuaaauauuaauauaaaaugcauucaguuuucuuuacacaaacagguaaucaaagagauguuugucuaaggguuugagcccuagacaaaucaguaugaucauuacuuuucacagguuaauggaauuauuuuauacagauuaggagaaauuaaccucaugacagauuuauuuauugcauuggugaaaauaaauguuaaugaauuaccacuuuugugguuuauucgugguccuugggauauuugagacuguccagaaauuuaugguuggaccuugaagcaagaguaggaaaaaacuaauaccagaaaagcauaaauauuaauaaccucauaugaaaguacaugaaucauuuagaaauauuuaucacugugauuuguuguaaaaaugaauuggguauuuuagaaaaacuuuauuauaccucuuuguuaugauacugauaaauugugaucuugcagucga

SEQ ID NO: 192759 - RNA, 98858 nt, Homo sapiens
gcucgggcgccgagucugcgcgcugacguccgacgcuccagguacuuuccccacggccgacagggcuuggcgugggggcggggcgcggcgcgcagcgcgcaugcgccgcagcgccagcgcucuccccggaucgugcggggccugagccucuccgccggcgcaggcucugcucgcgccagcucgcucccgcagccaugcccaccaccaucgagcgggaguucgaagaguuggauacucagcgucgcuggcagccgcuguacuuggugagucgcggacccacgcggcagucgccgaccuccuccgagacccggacucgugcccuguccgcagggucccucccgccucccccgccucucgccucuagccucucgcucggggcggaaguggcggcgcgguccgcgucaggggcgcgccugcgcugaccgcucucuugcuccuuuugguuuaaaaaaaaaaaaaaaaaaagcauacuugagcugagcagcucaugguuagcgcaagcgcaguuaguucuggagggcggugccacagcggcuucuuggggagcgcguggaugcgccaccagcguugcgcggcccgggucuggggguccuugggaaagccgugggggcgcucgggcgcgcgcccccgggccgcagcuucgccguagcucccacgccgcugugcuugguucuugcucgcggacagcucuuucucuggccggguguuuuguggccgggugggcagcuggcguccccgggagcggugagggcgggggcgggcgagccgggccgcggcguccggguccagcuggcgcccgcgcaggaccugugggagcaggccgcucugggcgccgggccggccgccgcagcccucugcgaggcgaagcucgcucuccuggcggagccgcggugguuggggguggcucguggccucuggcgagggcagcgcucucgggacccuccgucuucauuuucccccguggcccagcagcgcccagcguggguucggcccccauagaaccuucccggaacgaaagaggcuuugcuuguguucguccagugauagcgugucauucucuuuauaguuuuccuuacugagguauacuuucccuacagugaaacgcagcuuucaugugugcucccagacgggugucacaaaugaauccccucuugcaagcccccucaaaucaaaauagccuuuccuugcccugagaaagugcccucauccccuccccgggggcacgguguuccgaugccuaucgcccuaaucgugccuguucagcucacauagaugcaauauguaguauaaacaccugugauucgcuuuuuuuaugucaacuagacuaccuuuuaauucaaacaaaacuuuaucucuuuuaaaaugauguaacugcuuuccccuucguuuaauccuugucguauuauucccaagauugaauuuggugacgguuaaguuaaugcugcuucugauguuugguucucucuguguaaaguaaaagacgggcuuuccuguaaauggaugauccuggguuuuuccccuuuccauuuaauuagauggcagugaaaaauguguucagaaaguaacguuuucuucuugaacacauuagugggaaguauaaauauucugauucccaugauacagaguauguuagaauagggaucuaaguuuuaaagaaugcugguaaggacucuuccaauuauagacaaucugaaacgcaaauucugguaggaaucuucaugugagagagccugccagcugcaucuucuccaguuacauuuguuuuagcagaggcugcugucucucuaagggauagguuauauaucgaaauagauuugaaaagagaaaagugaauauaacuuaauucagcuuaacauuuugguuuaagaaauuuaauuuucuuugguaucauuaauauccuugaaaauucaaugagaauugugauuccucuuuccagaaaaaugaacuuaacucgcauccacuggagauuucacaugcauuuucaaaaagauaaggaaauccuucuauagauucuuaccgaggaauccuguaguuuccuugguuggucaaugcucauauuauuuuuuccuaguugaaaacaagaccauuaguuuggucaguagaaaccauggcaugcacacugguguuacaguaaaaguaggucacaaaccaagaaaguuaguaauggaaagcaagucaggaaguuugagcuauguguucuccuguggccuuagaacauccauucagccauuccacaaauaugcccggacccccaguggaguugcagcuuuugcuccuggccuuggggauucagcagagaaugcuccuggcaaguuuccuacccucgaggugcucacucuagggcuuauucuuuuggggccucauuguaguuccauauuuucauucauucguucauaacaugcuuguuaugugcuaguguuagacacugaggauucuuguuaaaagacaggagucccaguuuuuaaggaugcagcccuguaaauagguaagcugaugaaaacguuaaagugauacauguaaagcuagcuugaagcacagggucuuguggaguugaguuaccuaggaguccuguauuucccaaaaagggguacacaugggaguucuggugaagcuucucgagggagggaggaccucaccuaagucuugaaagacauuggccaggggaagaggacaagggaggugaagagaauuacuguuccagcaaggagggagugcacaaaggcacugagggaaugcugagagaaccacccacaguuuagccuggagacuggugugaaguugagaugcuggagaguaaggcagagccuagaucagacuaaggaauuugagcuguuuaauaggaacucauuguggaauuguaagucuggaaauaccaugaucauauuugcuucuuuuuuuuuugacagagucccgcucugucgcccaggcuggagugcaguggugcgacgucagcucacugcaaccucugccuccuggguucaagugauucacuuaccucagccuccugcguaguugaaauuacaggcacacaccaccaugcccgguugauuuuuuuguacuuuuaguagagacaggguuucgacauguuggccaggcuggucucgaacuccugaccucaggugauccgccugccucggccucucaaagugcugggauuacaggcaugagccacugcucugggcugaucauauuuacuuguuagcaagaucguucugacugcuagcagacuggaugaggaaaguguaggcacgcagcacagggcaguagucgguuggaguaaaccugaagagacaugaugagcuucuguuaggcaguggcaggagggauggaggggagauacagauuugaaaugaaaugguaaagggguauacguuauguacaaguuugguuuugaaacuuuaauucuguuugagguaccugcgagacacugaaaugaagcuaguugaauguauaaauuuggaguucgggagagagggucugaguaaaugugauuuuggaaaucaugaacacaugggugauauuugaggucuuagacauugaugagaucaucuagggaagauacagagcguuuggaaauaucaaaggccaaggacagaaucuugacagacaacauuuaaaaggauggguggagaaagaggaacuugcaaaaaagacuggugaggaacaaccacagaaguggggaggaaagcaguggagggaguugagggugagcagggccaccugacagguaagggccagccugagagggccaugacauugagcagcuagauuaacagauaccuuaaagggaguugugucagcggacuacacaagacagauaccuggaguucaggagagaagguaggaggaaaugcaaacuaccaaguguacacugcucuuuuuagaagcccaacuugaagaaguggggagagguagcuaaaaugaagcaagauugugugacuucucacuuaaacccuugaacggcuuuccguugcucacaguguaaauucagccccuccuccggcucacaagaccucauggccugugucucuugcuugauuuccccuaucacuuuccucccucuuuuccacuguguuguauucuuggaaguguguguguccauucuccccuuagggcguuuguaaauguuguucucuuugccuuggcacaacuuuccccccuucucuuuccuuucuugcuuaaacugccuccuacucaucccugaagucucacuuccuuggcaggccuucuugaccugcccaugcuggguaugagccccuguugcguacuucuuuagcaucccaagacuuccccuuucauagcgggaauuggaugucauacagcagcaaaugauuucgggaacacaauuugcauuaagcaaaccacuaucuugaaaguaacacagcuugaguaggaaaaaaguguuuaagguggcuuucugcuuuguuuagcacagcagugggugauguuucugauaauguuuuugaagaguugugcuuuuuuugguaaugcucauggagcugggaaaagaaaggcuuugcucuugagcaaaaacugaguacaacuaaaagcuggacuugcuuagugguaggagaacuugauaccuuguugaaauucuagcgggaaaaaugaauuuaguauuuugagucuggaacucuggucccuuauuccuuuuugcuccuuuugaaaagugucuuuuauuucaugaguuugauaauaggagguuucuuagaaaugaauuauuggguuggagcagaacagacucuguuaaucugaguuuauauuuuuuauuacuucuucagaguuucaugaaggcacugccagugcuuugcacaguaucaggugcuuaguaagcacuugaaaauaugugcugaaugaaugacuuuuuacgaggaaagggcaacuugauauauuuaugugauugcagggaugaaccuaaagagagagguggagguugaaauagaagggaugauuguuggagccagaaaucuuagaaagcaagagucaaugggaccaagagcacacagguggaagaauugaucgugaaagagugcuggccaggcgguggcucaucccuguaaucccagcgcuuugggaggcugaggugggaggaucacuugaggucaggagguuagggcugcagugagccauaauugugccacugcacuacagacuaggugacagagugagauccugucucuaaaacaagaacagcaaaacaaagggugcaguuggaaaaguuuaauuuggucugauugugugagguuaauucugacuuuuugaguaauguucaugaucccuuuuuggcuuuuccuuuugucacugcugauugcugucuucaucaggcugagcuuugagaaaggcagagagaaggaauggagucugugugccuacugaggaaaagacuaaaacuggggaaucgcaaaagcuauguuauggguuguuucuaagaagugauggcucagaaggaauuuggcuuauuuauuuuuaaauuccuuucuuuuuuaaagaguucucacucuguugcccagucuggaguacaagugcaguggugcaaucauagcucacugcaaccuuaaacuccugggcucaggugagccucucaccucagccucuuggaaauugguugauuaauuaggguuuauaaacaauggaacuccugacugacuucauuuuucuuuuuuugaaaccaagucuugcucugucccccaggcuggagugcaguagugugaucucagcucacugcaaccucugcuccccccagguucaagcaguucuacugccucagccucccgaguagcugggauuacaggugcccaccagcacgcccagcuaauuuuuguauuuuuaguagaaacgggguuucaccauguuugucaggcuggucuugaacuccugaccucaggugauccaccugccucggccucccaaagugcugcugggauuacaggugugagccaccacgcccagccacauuuuucuuuuucuuucuuuuuuuccuuuuucuuucuuuuuuuuucuuuuucuuucuuuucuuuuugagacugggucucacuuugucacccagucuggagugcaguggcgugaucucagcucacugcagucucgaccucuugggcuuuagacauccuccugccucagucccccacguagcugggccuggcuaauuuuuuuguauuuuuuguagagacaggguuuaacuauuuugcccaggcuggucuucaacuccugaguucaagcaaucuguccaccucagccuuccaaaggcuuaggauuacaagcaugagccacugugccuggccauuuuucuuuuuucuuuuucuuuuuuugagacagucuugcucuguugcccaggcuggagugcaguggcgucaucucggcucgcugcaagcucugccucccagguucacgccauucuccugccucagccuucugaguagcugggacuacaggcgcccgccaacacuacaggcgcccgccaccacgccaggcuaauuuuuuguauuuuuaguagagacgggguuugaccguguuagccaggauggucuugaucuccugacuuugugauccaccugccucggccucccaaagugcugggauuauaggcaugagccacugcgccuggccgccauuuuucuuuauuagaaauuuguaguucaaauauugcuagagaacaauuuuuaccauuugugagucagcuaauuuuuagaagucagauaucaagugcacacuguucuucucauacuuacagcggggcagccaguuaggcaggugaaucaaagcugucuuauucuaaaacacuucccuugccuacuaguuacacauucuccugccugcugucuaaucucagugcuuuuacaugguugcacaaacucugaauucccuugaagauuggcuacucucucacaccuuggagucuucauguguuggauauacuccaugccuaccauaucuauuugggaaacaucuucaagacuagaccguagucuccuugggcaaaguuaaaugcucccccuucucucauuucuuaguucucuauauucuuuuauuagaauaugaaccacauuguuuuguaacugucuacuugucuguucuguguagcuccuugaggguggucuuuuuuuuucuuuguuuucccaccaccuaccuacgggaccugaaacauguuagaugcucaguaaauauucaguaaacacaggaaaacuguucccuuuuaaaaugucagcaccuuaguuuauuccaaaccccucauuuauggcugaggaaacacugggccaauacaguguugugacuuaucugauguuacaauaucugcuagugucauaacugggacucaaauccaguccuucugauucucguuucagcacugcccuaauuuacccaugugacuaccuguagugcuuucuucuuaugaucuauuugagaucaguggcacagagggaaucgucuuaauuuugauggcuaggagggaguggauguguuauaauagguagggucauuuugggacuugaggccuuuaaaacagugucugggauccagggaucagacuugaaagguauuugcaaaucuccugaaacugcuaaauuuuauguacguguguucccagguauuucguuucuaggugauucuguagcuuuugucaguuucuuaguggauuugucugugaucccucaaaagguaaagaccacugcuugaagggaaagcagccuugggaugggugccccaauggggaauguauaccuagaaaucauauuguuuugccuuugacauguguuuauagauuacugauaucuauaauuacggaaauccagauaguugcguuugucuccuagcuuuucuaguugccucuuuuuugauuucuugauuuuaaccagaaucuucuuuuuuucuugagaaggggucucauuccgucacccaggcuggagugcaguggcacgaucguaggucacugcagacucaaaacuccuggcucaagugguccuuugccucagccucccgagaagcugggacuacaggcacacaccaccacgccugacaaauuucuucuucuucuucuucuuuuuguuguuguucuuguuggccaggcuggucuggucuugaacucccggccucaaguggucugcucaccuuggcuucccgaaguggcgagauuacaggcaugagccaccaugcccagcccuuaaccagaauuuuguuuuguuuuguuuuuugagacagggucucacucugucacccagacuggagugcagugaugagaucacggcucacugcacagaugcacgccaccaugcuuggcuaauuuuuuauguuuuguagagacagguucucaccauguuguccagacuggucucgaacucccgggcuaaagcgaucuuccggcuucacccuuccauaaugcuggggagccacagugcuuggccaaccagaaucuuaaaagcccuuuuuacuuuuuccagauaguuacucugcagagaauuucugauucccaguuggagaacuguuacagcucucucaguccccugcuguucuuuuagcuaccuugucuuuguccucuuaccuguccacucucuacuccccuucuucccuuuggucuccaaauaguccagauaaaccagagagauggacagauaaggucuggguacgcgaaauuaaaauuaacauagugugcucuucacuuucuugaauaaacguuacguaugauuuguuucccuuggaaauccucaucuagauucucuacucucuauuccuuaacuuaaugccccauuaagguaguuuuuucuuaauggaaagcuguugagagucagaggauauuuaaaccaacuaauaaacugaacuuuuaauaauaccacccuuacuuuggauaagagugauuagccauauacuaaauccucaaucaguuuagcauguaaaauuuaagacauagcagcugauaacugaggaagagauacauuuccacaggcuaacuuuaaagaauauaagcucucacuuuccugaguagaagaaaacuaaacuuuucuguucuaugcuuuuuuuuuuuuuaauuuuuauuuuuauugaucauucuuggguguuucucacagagagggauuuggcagggucauaggacaauagugaagggaaggucagcagauaaacaagugaacaaaggucucugguuuuccuaggcagaggacccugaggccuuccgcaguguuugugucccuggguacuugagauuagggaguggugaugacuguuaacgagcaugcugccuucaagcaucuguuuaacaaagcacaucuugcacugcccuuaauccauuuaacccugaguggacacagcacauguuucagagagcacaggguugggggguaaggucacagaucaacaggaucccaaggcagaagaauuuuucuuaguacagaacaaaaugaaaagucucccaugucuacuucuuuccacacagacacggcaaccauccgauuucucaaucuuuuccccaccuuucccugcuuucuauuccacaaaaccaccauugucaucauggccuguucucaaugagcuguugggcacaccucccagacagggugguggccgggcagaggggcuccucacuucccaguaggggcggccgggcagaggcgccccucaccucccggguggggcggcuggccgggcgagggguugacccccccaccucccucccggacggggcggcuggccgggcggggggcugacccccccaccucccucccggacggggcggcuggccgggcggggggcugaaccccccaccucccucccggacggggcggcuggccgggcggggagcugacccccccccaccuuccucccggacggggcggcuggccgggcagaggggcuccucacuucccaguaggggcggccgggcagaggcgccccucaccucccggacgaggcggcaggccgggcgggggcugauccccccaccucccucccggaaggggcuccucacuucccaguaggggcggccgggcagaggcgccccucaccucccagacggggcggcuggccaagcggggggcugacccccccaccucccucccggacggggcggcuggccgggcggggggcugaaccccccaccucccucccggacggggcggcuggccgggcggggggcugaccccccaaccucccucccagauggggcggcucgccuggcgggggcugacccccaccucccuccuggacggggcggcugccagguggagacgcuccucacuucccagacaggguggcugccgggcggaggggcuccucacuucucagacggggcggcugccgggcggagggucuccucacuucucagacggggcgguugccagguggagggucuccucccuucucagauggggcggcugggcagagacgcuccucaccucccagacggggucgcgaccgggcagaggcgcuccucacaucccagacggggcggcggggcaaaggcacuccccacaucucagacgaugggcagccgggcagagacgcuccucacuuccuagaugggauggcggccgggcagagaugcucaucacuuuccagacugggcagccaggcagaggggcuccuaacaucccagacgauggguggccaggcagagacgcuccucacuuccuagacgggguggcggccaggcagaggcugcacucugggcacuuugggaggccaaggcaggcggcugggagguggagguuguagcgagccgagaucacgccacugcacuccagccugggcaccauugagcacugagugaaccagacaccgucugcaaucccggcaccuccggaggccgaggcuggcggaucacucgcgguuaggagcuggaggccagcccggccaacacagcgaaaccccgucucccccaaaaaaauacgaaaaccagucaggcauggcggcgcgcaccugcacucgcaggcacucugcaggcugaggcaggagaaucaggcagggagguugcagugagccgagauggcagcaguacaguccagcuucggcucggcaucagagggagacuguggaaagagagggagagggagaccguggggagacggagaccguggggagagggagaggaggcagagggagagggagaggcuuuuuuuuuuuuuucuugagacggagucuuacucugucaaccaggcuggagugcaguggcacgaucuuggcucacugcaaccuccaccucccugguucaagugauucuccugccucagccucccaaguagcagggacuacaggcaugcgccaccacacccagcuaauuuuuguauuuuuaguagagaugggguuucgcuguguuggcugggccagucuugaacuccugaccucaggugauccacccaccuuggccucccaaauugcugggauuacaggcgugagccaccgcguccagccuguuacauucuuaauuggaauagcauugcccugcagugccauuaucugaaauagcuuuuaagaaugaauguaaugccauuuuaaauguauuuaaauguugugccgauuuaauguucuauguacgguacaguacuacuaaugguucaagaaguuguuuugacuuaacagugaaauccuugcuuuuaaagaucauagauaccuuuagacaccuuuaagaugaaacauguuuaugagaggaaauguccgcacaaauacaaucccccgcaaacuuagcaugugguuuuaguagguucauaggcccaccuggugaucccuaggauaagaaauuguggucaagaaacugauuucaggggccgggcugguggcuuacaccuguaaucccagcacuguuugucucaaaacaaagaaacuggcucaagguuggauacuuuucaaacgagaggaauggaggaagggaaugcaaugaauaacuuuucaaauccaguaugucugauuuaauaugccguuugcucugucaguuucauuugguucgugucacugaucauuuauaaccuuuuuucaaacugcuuucauuccccuaaggaaaaucugauacugaauuauuuuauuucuucuuucacuauauuugaacgguuuuauagucugaaagcuaucaauuucucauuacaguuuacuucauaguacuucuaggaauucuuccugugguuugagguaaggcuacaggauuccuagaguuuguaccccucuagucccaguaaaggaccugguacaucaaucaggguagcccuagaaaguuggaguaacuucguaacagugggaacugcuucuguucuauguuuuuuguggguuuuuuauuuguuuuuguuuuuuuguuuuuuuguuuuuuuuuugagacagagucuugcucuguggccccaggcuggaaugcuacggcacgaucucggcuuacugcaaccucugcaugcugaguucaagcgauucuccugccucagccuccucaguagcugggauuacaggcgugcaccaccacgcccagcuaauuguuguauuuuuaguagagacaggguuuccccauguuggccaggcuggucuugaacuccugacuucaagugaucagcccaccucucagagagcugggauuauacaugugagccaacaugccugcccugccucauucuuuauacuacaguaaagucccgguugggcaauaaucuaaacauaaaagaaaugaaaccauaaaauuauauaagaaaacaauggagaaaauuuuuuguaaucaacagagugaaaaaggauuuuuuaaugccaugucacagaaaccuagagaaaaaagguuuaaguuugauuucauaaaaauuuaaauuuuugacauaaauaccauaaaggucaaaagauaaaaaauuuuaaauauuuucaauauauaacaaaaacuaaacuuucuuaauauguaaagaacuacauaucaaaaagagagcggaaauacagauggcuuuuaaaaacagguaaagcuguucaccuucacaauaauaacaauuucaaauuaugacuauaauaauaccauuuuucaccuaucagacaaagaugaaaaaguucauuaauauaauuguguaggugaagcucaggcacuuucuuauauuauuggugacaguauacauugauauagcuucuuugaaagguuauucauagcagcauuauuuauaacagcuaaaaccuagaaauaaccuaugugucccauuauagaugacuggcuaagugaugaauacuauuaaauuguuaaaaagaacucauuaucuauauggaaguacuuuuaauauauacuaagugaaaaaucaaagugcaaaacaguaugcuaauaucuguuuugugagggugggauggauacuuggauggaggaagacagacaggcagucuggcuuauauauggauagaaugucucggaaaauauacaaggcacugguuacaguuaucaccuaagggaaaggauugagggagaggagaaugugacuuaacuuuuucacuauauacccuuuuguacgguuuaauuuuugccaaguccauguaauccauguauacauagggagcauauguauauaaauauauguaaauauaaguaaaaaaauauguaugugcugccgggcgcgguggcucacuccuguaaucucagcacuuugggaggccgaggugggcggaucaugaggucaggagaucgagaccauccuggcuaacacggugaaaccccgucucuacuaaaaacacaaaaaaaguagccgggcgugguugcgggcgccuguagucccagcugcucgggaggcugaggcaggagaaugguguaaaccugggagguggagcuugcaguaagccaagaucgcgccacugcacuccagccugggcaacagagugaaacucugucucaaaaaaaaaaaaaaaacaacacgcuuuucucucucucucucucucucucucucucucucucucuauauauauauauauauauauacacauauauauauacguauauauauacauauauauacguguauauauacauauauacguauauauauguauauauacacauauauauacacauauauauguauauauauacauauauauacacauauauauguauauauacacauauauauguauauguauauauauacauauauauauauaugcuaaaguuaaguacuggauuccuaucuguaucugcuaccuaacugcaguauaaaucuuggaaguugagucuguuuucucauuuguaaccaccucuuagauaacacacauaaaagcacauagcacaugccugacacacaguaggguucagugacagugagcuguuuuagucucuaaacucucuuccucaaagagagcuucucaaagaaaaaaaaauguagugaagaaaagaacuuacuccaccagggaucuucucuccccagccaguggcaggcauauuaagggcuauaaguaagugguuauuuuaccauccuaaaguaaugguguuucaaaguaugcaagauucuucauacuucacuguguccuuuucugagcaucuuuguagagaguauaugcacaaacaucugacuaacaaagggaacacuuuucaucauauaauuuaggauucacuuagagaccuaaaguauaaagaaagaaacuuagguauguuagcccauaaggagaaacucauuaucaauuugggauuaucuuaagguccuaccuuauaaaauuaaaauuuaacagaagauuauucuuuuucaauuuccuaaguucuuauuugcuacuacaucguagcaguucgagggagaauuuggucuaacgauguaauguuuucuguaugccauacauagaacaaagcuauguacgaaauacuaaaaauauuauuugacauuauuuaauaaaauauuauaacuauuucaccccgauaaugauggaaauuaaguugcaguaauauagauuuuuaaaauaaaaacuucaaaaccaggcgccauggcucacgccugugauaccagcgcuuuggaaggccgaggcaggcagauugcuugagaccaggaguuugagaccagucuaagcaacauagcaaauaaaaauaaaaaauuagccaggcaugguggugugccugcagucccaccuacuugggaggcugagguggggggaucacuugagccccugaagucaaagcugcagugagcugugaucacaccacugcauuccagccugagugacaaggcaagacuuugucucaaaaauauaaguaaaauaaaauuaaaauuuuacuuguuuauuuuuuugagacggcgucucucuuuuucccaggcugggguguagugguguguucucggcucaccguaaccucugccuccggaguucaagcgauucuccugccucagccucccgaguagcugggauuacagguacgugccacuaugcccagcuaguuuuuguacuuuuaguagagacaggguuuugccauguuggcaaggcuggucucaaacuccuaaugucaagugauccgccugccugggccccgcaaaguguugggauuacaggcgugagccaccgcacccagccuuaaaacuuuaaaauucagaauaugagccuuuguuuuauagcuucacuuguuaaaacaaaucaggagcugggugugguagcucacgccuguaaucccagcacuuggggaggcugaagcgggcagaucaccuggucucaaucucccugaacucgugauccgcccgccucagccucccaaagugcuggaauuacaaacgugagccaccacgcccggccugaaguuugaaguuuuuaaaaagaaagaguuguuaggcauaauuguguaaauagagguaaaaauugacagcaagaaaggcaguagaaaacuaugacaaaugaaggugauggcucacgccuguaaucccagcacuuugggaggccaaggcgggcggaucaccugaggucaguaguucaagacaagccuggcuaacauggugagacccugucucuacuaaaaaauacaaaaauuagccaggcauggugaugugcaccuguuaucccagucacuugggaggcugaggcaggagaauucacuugaacccgggaggcggagguuacagugagcugagauggcgccacuucacuccagucucuccagucaguccagacagagugagacucaaucucaaaaaaaaacaaaaaacaaaaaacaacaacuaugacaaauaaguguaauuucccaggacuauuaaggucuuguaaucccaugcacuggaagcuuuuguuguuguuuucugauuuaucauugaagugaccaaagcgcagugguaagaacaagccuuugugauuacuucacacuagagaagggucuuucccacauauuugagacuuaaggaguugauagugaacaguguaagcggccacacagguguggguuaagaacugauguguguauucacuuucuguaaagaugaccaaacauauguuguuagacaaacgaaaaauucaccccaagaucauugagggcaugcaaaauaguaugagguagaggcagcuguaauucagguguccaaauacaagagcagguggagaaaagaaaagaaacugagaacaguaaagaguuuuuaaaguuauaacacacaauuguuaaaauagaauguucaguaccaaguagcagaguagauaaugcagaacacugagguggcuugagaaaaaucucucagaacucaggaaagaggugugcgaaaugagcguuaggagagagcacuuccccaagucugugauagaaauuccugaaagggaacagaggagacugaagcgaaacucuauuaagcgacaaggaagacucaaauggagaagcuaacccaguuccgaugaagacuuggcacauaucuauaauguauuuuuuuugaagucagccaaaagaaaguuuaaauuugagguacaucugaaagaguaagcaauacagaaaaaucuugacaacaucugaggacaaaaaaaaaaguacugauacuguugagugugaggcaaaaccucacuuucagucuuucuugagaaauauuggcaaaauaugcccuuaauacaggaguuccauuuuuauuucauuuauuuauuuauuuauuuauuuauugagacagguucucacuuugucacccaggcuggagugcagugguacagucacugcucacugcagccuugaccuccugggcucaagugauccucccagcuuugccucccaaguagcugggacugcaggcacgcaucacuacgcuuggcuuuauuuuuauuuauuauguguuuauuuuuauuuuuauuuuuuguagauacgugguuucaccauguugcccaggcuggucuugaacuccuggccucaaaugauccuccugccuuggcccagaguguuuuuguuuuuuuuuuuuguuuguuuguuuuuuguuuuuuggagacaaucuugcucugucacccaggcuggaaugcagugaguggcgcgaucucggcucacugcaaccaccgccuucuggguucaagcaauucuccugccucagugucccgaguagcugggacuacaggugcccaccaccauggccagcuaauuuuuuguauuuuuuaguagagauggaguuucaccauguuagccaggauggucucgaucuccugaccucgugauuugccucggccucccaaagugcugggauuacaggcaugagccaccacgcccggccgagauauauuucacauaccauaaaauucaccuaaaagguacaguuuagugguuuuuaguauauucacagcuguggaacuaaaucuuaauuucagaauauuuucaacaccccaaggagagacuggguacauacaguuauucuccauucucacccacaucccaaccccugacaaccacuaaucuacuuucugucuccagauuucccuguccuggucucauaccauguguagucuuuuguaucuguuuuuuuguuuuguuuuguuuuguuuuguuuuguuuuguuuuguuuuugagaggagucuggcucugucgccuaggcuggagugcaguggugcaaucuuggcucacugcaagccccgccuccuggguucacgccauucuccugccucagccuccccaguagcugggacuacaggcgcccgccaccacacccggcuaauuuuuuguauuuuuaguagagaugggguuucacuguguuagccaggauggucucgaucuccugaccucgugauccaccugccucggccucccaaagugcuaggguuacaggcgugagccaccgcgcccggcugguuucuuuaacuuagcauaauguuuuaaaguuucaucuguguuguauguaucauuacuuuguuucuucuucuaaguuaguaagauuccauuauauagauauauaccauuuuguuuauccauucaccaguugauggacaaaugauuguuuuagcuauuauuaaaagugcuaccaugaacauauguguccaaguuuuugugugaauguauguauucguuucucuuggguaugugccuuggaguagaauagcuaguucauauguuaacucuuuguucagcauuuguuuuucuaaaguggcuacaucauuuuaaccuuuaguuuuuuguuuuuugguuuuuuuuuugggagugggguggggcuggagugcaguggcguuaucucggcucacugcaaccuccgccuccuggguucaagcaauucucguuccucagccuuccgaguagcugggacuacagacacaugccaugacgcccagcucacucuuuuugcccagcucacucuuuuuauuuuaguagagacaggguuucaccauguugcccaggcuggucucaaacuccugagcucaggcaaucugcccaccucagcaggguuucaccguguugaccaggcuggucucaaacucuugaccucaggcgauccacccaccucagccuuccaaagugcuaggauuacaggcaugagccacugugccccgccucucucuuuuuuuuuuuuuuuuaauaaagacagagucuugcucuguuguccaggcuggcaugcaguggcgugaucacggcuuacugcagcuuugaccuccugagcucaagugauccucccacuucugccucccaaguagcugggaccacagauguguaccaccaugccuugcuaauuuuaaaauuuuuuaauagagaugggggucugucuguguugcccagacuggucucaagugauucucccaccucagccucccaaaguauugggauugcaggcaugacucacagcgccuggccucaguuucuuucaagaccauccuauaacaccaaguuaguuugaggauucuaugaaugucugcuuaaagauauccuucugaauucugugauucucuugaaaggcuuguugcaaugaaaaacaaaguauaaugaugacuuuaugugaaguauacuuuuggaauuucuuaagcagaaguccugagacuuuugagagucccuguauuuaaacaguaccauuuaggcacaguuacugcuuaugaaaugaagaguagcuagaugaauauaaaaaaucuuacucuuacauuucaacccagcauuauuugaacccagcaaaauuauuucuauaguagaaucaauuuaguuccuuauuuuaagccaugcauauauaucucaaagcaaauuucaagagggauuaaauguuauuaugugaaaauauuaggaggugaaauaauaggagaaaguaaacacauugaaaguagguauguucaggccaggcgcgguggcuuaugccuguaaucccagcacuuugggaggcugaggcgggcagaucacgaggucaggagaucgagaccauccuggcuaacacggugaaaccccgucucuacuaaaaauacaaaaaaaaauuagccgggcgugguggcgggcauuuguggucccagcuacucgggaggcugaggcaggagaaucgauuuaacccuggaggcugagguugcagugagccgagauugcaccacugcacccuagccuggcaacagagcaagacucugucucaaaaaaaaaaaaggaaaguagguauguuuacaauuuaaaaucuuugggcauggagauaagcuauaaggccauugaucagaauggaccauuucauaauguuccaaaaauuagacuacuuuggaaaaaggugguguguggucuuaauguaggcaaugcacauguguguuuaaguuucaaauacagcuaaggagcuaaguggaauuuuuuuuuuuuuuuuuuaccaaauagcguguauuaauaauagcucaguuccauuuacugauuuguuuuuccuuuguuuaugucauauauuaucuuuccaagagauugugaguuuaugcuacugccaauuugguaugagggccuguuuuuaaaagagcugcaugauauucacuuggauguaccacgauuuauucaaccagucuuuucuuugucauuagacauuuaguuuauuuaaagccuuucaacauuauaaguaacugugaaagauaucuuugugcuaugaguugccuacauuuuggaucauugccacuaagaaagaaauuaacuagugacucaauuauuccuugcuuuuuuugagcaaaaaucauauuaaaaauaauuagauuuaaaauuuuugguuaaauuauacuuuaaagcaaagauccuugccauuuagaucuaguuugguauuaaaugagaacggugguucucuacuguguuggugggggauauguucaugauggauuuugcuguggaaggacauuuggcaaugccuggagagaguuuugguuguuacagaugcagggaggggugccacugacaucuaauggguagaggccagggaugcugcugcuaaacauccugcaauacacaagacaguccccacuugcccccccccccccaaaaaaaauuagcuagccuaaaaugucaguagugcugaggcugagaaaccuuggauuaacagguuucacugcugaugggaaacuuuuuuuuuuuuaacagggccuuacucuguugcccaggcuagagugcaguagcaggaugcuagcucacugcagucuugaacuccugaguucaagcaauccuccugucucugccucccaagaagcuggaacuacacaugcacaccaccauccccagcuaauuaaaaaaauuuuuuggcagagcuggugucuuacuguguugcccaggcuggucucaaacuccuacccucaagugauccuuccagcugggccucccaaagcaccaggauugcaggugugagccacugugcccagaggaaacauucggaaucugugauagaaggggaagguuuuagcuccagaacacaaguagagcuggcuuugccuuaugugauagaccuagugaauagcucagcugucugcuuuccuaaugccauuuagacagauacuguauauuuuauugcuuaugcaaugugcuuauaaaauuguuuauuuuugugucuuggguauuccugaaaaugccucaucagugucagaucuaguugcuguugagauuugguuuugcugcguauauuacagaccugauuuagcuacaugggaaagaaaauuaaucaauagcugauuuaacaaccaggaguuuauguuucucaugugauaugaauucuggagagagacuuaagggcuguuacuguggcuucuugaugucacccaugacucaaugcugguauuucugcuuaccuuucuuaggaaugugcauuuuaccuugcugucacaggauggcuccugccuguucccaccccucacccccggcagcaaaaccuauguuccaggcaggcagcagugaggacaaagguaccuggagccaguccucuuugucagcguuuuccugcagccccaacccagugguuucugcuuauucccauuggccagacugucacaggaccuuagaggcugggacaaauaguuuucagcugggcucauuguggucugaaaacaaaagcaguuaccuuuaguaagaaagaaaggauauuggggcugggugcaguggcucacgccuguaauuccagcacuuugggaggcugaggcgggcggaucacuuaaggucaggaauucaagaccagccuggccaacauagugaaacuccgucccuacuagaaauacaaaaauuagccaggcaugguggcgcaugccuguaaucccagcuacucaagaggcugagacaggagaaucucuugaacccgggagguggagguugcagugagcugagauugcaccacugcacuccagccugggcaacagaguaagacucugccucaaaaaacaaaaaaaaaaaaagaaagagaaagaggauauuggaauaaacgcuaauaugcaccuuugggagcugcuuuuugaaauauugguucuuguaaguucacugaaauuuuuuuuauaaaguagaacaauauuggagauuugaaagaauggacucaaugcaagagaucuuauuagcugagaaaauguauuuauguuaugaauguauuucuuaaccccaagaacuuggcuguuguauuguguuuuguaaauuuuaaaucucccuacuacuauacugggggccuuacccucuuuuguauagugcacacaaagaaguguguuucucugggcuaaaaauagaaaucugcaccugacagauggccuuaaguguggaaaauggguguguguguaucacagaaguggaagaaguggagggaguccugcucugccuguuguuuuaagccuccccucccugcaaaucuauaucuuuccuauacacuaguaauggucaauagguuuuuguuguuguuguuguuuuaaucccauuuacaguagcgacaaaacuuaucagguaucuaagaauaaaccuuuauuauacauuuaugcuaaccuuuagcauaccuuuaugaagaaaacuacaaaauuaauuaaaauaucaugaacggcaaugcaaauggggagaauaaauaggggacaacuugccuuccagaugcauugauuacaaagcuguaguaacuaaaauuugauacugucucaagggcaagcaaaugcuucugugaaguagaaugaggaucuagaaacagacuccugcgugugcugaaacuugguuuaugauagagcagguguuacugauaaaugcagaaaccaauaaaugguauuaagucaauuaacuuuccauuuggaagggauaaaauuaaauuucucuuccacgugcaggcuaauaacagugucuuauaucuugcaaaaguacuuaccaguccauucacuuccagaaaaauggagaaguuucauauuagaaauuugugcaucauguuucauaaauaaaaacuucagauacucggcugaugguguuggcucaaaccuguaauccuagcacuuugggaggcugaggcagguagaugacuugagcccagguguucgagaacagccugggcaaaaagugagacccuaugucuauaaaaacaaauaaacaaaauggcaccuaacuuuuaaaaugcuuuuucuuacauguaauaaugugagcaaaagcauaauuuaauuuuuccuauuaaaaugcuuuuuuuuugguuucuguuacauuucuguauuuacuugaauucuuagaacacuguuuccugggagaucaaaccuggccauucuggauacaucaguagugagagcuuagugcggacauagccuuacagaaugucuucuauguugaaaugcagagaacccgaaggcgccuaggaugagccucaggccugcugguuguugcaguggcgcaaucucagcucacugcagccuccgccuccuggguuuaagcgauucucaugccucagccuccugaguagcugggauuacaggcgcucgucaccaggcuuggcuaauuuuuguuuuguuuugcuuuuuccgccucacucugucacccaggcuagaguacagugguacgaccucggcucacugcaaccucagccacccgguuucaagcgauucuccugccucagccucccgaguagcugggauuacaggugccugccaucgcgccuggcuaauuuuuguaguuucaguagagacgagguuucaccauccuggccaggcuggucuugaacuccugaccucgugauccacccaccucggccucccaaagugcugggauuacaggcaugagccaccgcgcacagccuaauuuuuguauuuuuuugggguuuuuuuuuauagagucucacucugucgcccagacuggagugcaauggcacgaucuuggcucacuguaaccuccaccucccggguucaagcaauucuucugccucagccucccgaguagcugggauuacaggcacccaucaccacgccuagcugauuuuuuguauauuuaguagagacgggguuucgcuuuguuggccagguuggucucaaacuccugaccucaggugauuccccgccucggccucccaaagcgcugguauuacaggugugagccaccacaccuggccaaauuuuuguauuuuuaauagagcuggguuuucacaauguuggccaggcucgucucaaacuccugaccucagggaauccgccugccucggccucccaaaguguugggauuacaggcguuagccacugcgccaggcuuguugcugaacauuuauggcucuagaaauaauuuuuuuuuuaaggagaaguaaugacaaacaugauagaaauaaaauuugaggauauuucuggguucaaaauaaaguaacaguuaaauagcgugaacaugaagaaauaaauauuuucagguagaaacuccaaaauuuagguagaugcugugaguuuuagucagaauuugaauaugauguggcugaccauagauaccuccauugcauuaauucugcuucauaaaguguuugaugcuugcuuguagguguugaauagagccuaauuagcaguaaguaaacagaucuagagcacagacuuuggcaucugaaggaccuugguucaaugcugggacugccacuuacuagcuaugggaucuuugguggauuuuuaaccuuugaaagccuuucaucccucacagauauaauggggaagaaaaucguuuccauuaguauugugaggauuaaaugauuaauugauguaaacaaugugcuuuccauaguacuuggcauaucauaagugcuucauguuauuuuacgcuggcugggaagauaaguuuugcuguggagaauuuaagagggauauuaaaauauauuuuuguuauuuuaaggaaauucgaaaugagucccaugacuauccucauagaguggccaaguuuccagaaaacagaaaucgaaacagauacagagauguaagcccauguaaguacuuguggguuugugugcauguguauuuuuugguuuguuuuaggaggcaggauguagugaaaaggagggcuuggggucaguguugauaaauacaguaauuuuuuuccuauuuacguaagacacguucuuuaagaauuuaaagguguagaauaguggaaggaaaaauaauuacccauaauuauuucauccuucaaacauaggcaccauuauuuugguguauuucccacaaccuguuuuucuuaugcacaguuuuccuuucuuuaaaauaauuguaauuauagaugucuauauaauauccauauguauuuccuuuucauaucauuccauccccuuuguaaguuuugcuuaaaauaguuauugguguaguuugguuuuuuuccuuccccaaguuauaagaguaguauguacucgcuguagaaaacuuagaaaacagagaagaguauaaggaacaaacuuauuuaaaaauaaauaauaacuuggguuuauauucuuuggaguuuuuaaaaauaaacauguacuuuaaacggaaaauuagaaucuugccacauacucauuuguagcucuuuucuuagcaguacauuguaaacuuuuuuuuauuauaaacaauuuuuaauugcuuugacaguggcuuuggauauaccacucuuuugcauaaguucccuguuguuggacauuuagauuaugauguauacacacacagacgcacacaauugugugaacaauuauaauacuagaguucuuugguguauucaucaucaugcggugauuuuauuuuuuguucugauucaugcagcuuauucagauauuaaauugggccuccuucgugcuucagcauauuucccuauguuugacuuuagugggcuaaacauagguuuucucuuuagggcucccuguugguagggacuugaaaaacaguaucagauugaucacauucugguuuuugcuuguuacugauuguucgccuguugacuaggguauggugcugccugcuaagaucuccuguguagguugaaccauuucacuguucaaggacacagacuguauaccuuuauauacauuguagucauugguuauagauaagauauuuagggucuggauguaccacugaaaaauccaucaguuacuggaaaaaaauccuuauuuuuauucuuacaugaauagaauguuuuucuuauguugaccaaauacauuuccaagaaggguguauuggcugauuuugggcaaaucaaaugagaagcagucucugaaaaucuuucauguuuguuauaaauuacuauuaaauacuauguuucucuuaaugcuuuuuucuuuacuaccaguuagaaguguucuuaaagacaaguagcuagaagagugguuuuccauuuucuucaguugcagcacacuugaagauuugacccacuuccucugaaacagguggcucaucacgguggcaguuccagugugggugugcguucagggaauagcgggugugggcaguaauucugauacuuaggugcccuuccccugccuccaaaucucugauugagaaucacugagcuacagagaauaauucucuaauguuaccaugaguuuugaagacaguauuuuccaguuguacaccuugcuuugaugccuuuaauuuuuuaaaaacuuuugauuuugaaaauuguagauuuggaugcaguugagaaauaauacagaaagaucgaguauaccccucaccuaguuucccccagugguaacaucuugcauaacuacaguccaauaucacaccugggaaccugaaacaauacaguccauccagguuucaccaguuuuacaugcacucauuugugugugcguguaaguucugugcaguuuuaucacguguagauuccuggaaucaccaccacagucuagaugcaaaccaguggagcauucccaucacagggucacuugcacugccuuucuggggccacagucuccuugcuuggauccuccuucccuaaccugguguugccuuuaauuuuuauauauuuguuguaauugcaauuauuggaugcacuacacuacauuugaguccccuaauuaguuuuaucgaauugaucuaaaugggauuuuuuuuuuuuuuuuuuugagauggugucucacucuguuacccaggcuggagugcaguggcgugaucuuggcuuacugcaaaccccugccuccuggauucaagcgauucuccugccucagccucccaaguagcugggauuacaggugugcaccaccaugcccggcuuauuuuuguauuuuuaguagagauggaguugcaccauguuggccaggcuggucuugaacuccuuaccucaagugauccgccugcuucagucucccaaagugcugggauuacagucaugagccaccaugcccagcugauaauuuuauuuuaacuggaauugagauguuuuauuuuaaaguaaaaacauuugcaacuuaaguuauccucaaguauauacaucaauaaaacuuaugauuuuucuccucagcuuuuagacuuauguuguauaccugcaguugaaggcugcagggagacucuuuaaaauaugcguuaucaggccucccuccaucaucauugggaccaggcucuuccuguaugccuucucauugaaaagcacuuagccuugagagaaccaagcuucccuccugcggaccaugcagugguuguccucuggagcugugcucugcugggagcagcccccagugcauguucuccuuacucuucuucuucuuugcccccucccuccccacacaugccucccuaguaagccauguucuccugaucucucagaaagagacugcucauucuugcuucucacguagccacaggauuuucuagucugagccaauaugcuucagccugcaaauggaaaugaucucuuccaaggcuugugcuggccagcacauccccacaccgccuuggcaccucuccucuccugacuucagucauucacugucuuucuccuuacccucuccuucccaccuuccucauccugggugacuucaugucucugggaaagaacuacggcucauugcgcuagaguuccuagaccuguucagcuccgcugacauugaccuuuagucaucuucaccucugaaaucugaaacucugcugccuugagggcuacuuucugucauuccagcuuucacuugcuuacucccacuguaccugcucuuugacuucagcaggaucuuuaguugacuuuuucauguauugugaaguuggaaauguauugaauugaaauuucgauuaaaaaauguagugaagcauauuacuuuguccucuaaccuaacuauuaauaacuuucuuguuguuuuuauauuuaaaaaauaacucuggauuuuuuaauuccaccauuuugugaagcuccaacuuaggaaaaaucagucauucauccucucugcacuuugggcaaaugagcgugugccuuggguggacuccaguguuaggugggcuugggguugccuugcuguccucaugcccucgucugccccacugccaccguguuccagcucugcaccgaguaaauuaucucucagagcuccucaccaugcucaggauaucguccugcuuucaauucuacagauaaaaauuguaaaaaucaggaaacaccaccuuagcuucauguucuaucaccuggaaacucacuuucuuuugccccuauccuucccuaaagucccaggagagaagccuccccucccucuguccuagccgaauccuucguccccauccuccucaugggcccugcucuucaucaucacugcuuuuuguguguuuucagccucuuucuaucucauaacuucuucucuuuuguauaaauaugguucgcucucuuuugucucaacccuuauauccuaccccagcccccacuuccuuucuuaccuacauggauggacauuucuuaccuguacacaggcuuaaaagaaucaaugugccauuugucucuccacccuccccaccaugcacacuucagcccaugcuucuucuccagccuccccacugaaacuuauucuaaaagcacuguagcuguaguugucaaaugcaaugagagacuuuccacugguuuccuucucugugacuuuugacauuauucuccugcuucagccucccgaguagcugggauuacaggcacgagccaugacgccuggcuaauuuuuguaauuuuaguagaaacaggguuucaccauguuggcugggcuggucucgaacuccugaucucaagugauuggcccaccucggccucucaaaguacuaggauuacaagugugagccacugugcccagccgaccgugccuuuuuuccuaaccccguaauuuuucugauuuuccucuuuggccccuccccuauuuucagggugucuccuccucacuuugccuuuauuucuucaggagucuguuucucucuccuucucacuguaacacuuggaugaaugaucucaucugcugugggccuaguuuccaucucugcuuauaaccccaaaucucaucugcagucguggacuuuucugucuacaggucuguguauccaagucaucaucucugucuggguguccuguagccaccucagacucaguauacacugagugaguguuccucccugacacacuucacuggccuuagccccacaccugccuuuucuccuuuuccccauguuuauaaguggugccguuauuuacacauuuucugaagccagaaacagauucuucccucauucauuucccacgucacuaauacuaauuuccauuuccaugauguauuccuauuucuuuuucuuuuuucuuuuuuuuuuuuuuucaagacagggucuggcucugucacucaggcuggagugcaguggcaccgucucggcucacugcaaccuccgccucccaggcucaggugauccucccaccucagccuccugaguagcugggacuacaggugcaugccaccaugcugagcuaguuuuuuagauuuuuuguagagaugggguuucgucauguugcccaggcuggucucaaacuccuggacucauguaguccaccugccucgaccuccugauguguugggauuacaggugugaggcaccgugcucagccuccguaauguauuucaaaucuguuuucuucucuguucacauuggcuugguucaggcccuacuacgcuuuuccucgucauuacaguagccuccaaacccaucuccuuguuucccuucuguucccacuucaguccauuuucaugguaucuggaguaaucuuuguauaaugcaaguguguuuuccacucuccucucuaauagugcugcacaauuuuuaugaaaaaguuaaacuucuuuagcauuaucauacugggcuuuuuggagauugaccccuuuacacaccucucuaaaucuuuucuacccauuuuccuagaaauuauucauuucaguaaaacugaaucacuuggaguucuucuagcgugacugguuuuuaauaccucaguggcuucaaauaugucauucccuuuuugaaauauucuuccccuccucucucugacccaucucaaucaaaguucuccuucugcaaauaccagcucaacaaccucuuucccgugagugguauucucauccaguggagguggugguucucguucacuaaguccagaggggcucaggaauguguauuuuuuaaaagcugggaugguguugcuguaccuuuuccaacugauagucauuauguaauuuaaaaauguguuucuggcugggugcuguggcucaugcuuauaaucccaacacuuuggaaagcugagguaggaggauugcuuaaggccaggaguuugagaccagccugggcaacaucucuacacagaacuuuuuuuuaauuagcugggacguggugaugcaugccuguagucccagcuauuugggaggcuggggcaggaggaucacuugagaccacuaauucaaagcugcagugaguugcaauggcaccagugcacuccagcuugggugacagagcaagacugucucuaaaaaauuuuuuaaaugcauuucuauacauaguacuugacaguugcugauuugguucagaaaacauuuguugaaaaccagcuacauguuugauacuaugcuauguaucgaauaauuuaugguauacuugaggagauuaacacauaagcauguuacagauauuguaagauaugacagugcauugauggagcugagaagaggcucugcccaaggaggcagggauggcuuuuaagaaaaagaaugguagccugaacuagguaaauaaaggggaauggaaaaagaauuuuuuaaaaauucagagucccagaucuuucuuuucuagauuuggauucagccggucuggaaauguuuauuuuuaaacaaucuuaacaugauucuuuuacacucacuauggcaccacuccucagacugacauauggaaacuacauuuggaguucugaauacgagaaacauaaaggaaaaaggauauuuuaaauuaggaagaauuugggcugggugcagcagcucaugauuguagucccaacgcuuugggaggccgaggagggaggaucgcuugagcccaggaauuugagacuacagugagcugugauugugccacugcacuccagccugagcaaugugagaccuugucucaaaaaaggaagaaaauugaaaggauuugaagagguccauaaucugcuacaaccuagagaugccucaguugucucaguuaacugugagacauuguagaagagauggacaagaacuucguuguuugaaaagagaguagcuuguaaugguuacuuugggaaacgucuuuauacuauuagagacuaccaccaaauuuugagaucuuccuauuugcaguacagguagaaaucccaguuuacuauuuggucuaaaagggagugccagcaauugagucaacugucaugucuuuucacuggccaugaaacaaucuguguguguguguguguguguguguguguguguguguguuaaaaacccauaccauaaauuucuuguagguguauauuaacaguauuguuaacuguaugcacauuguuguacaauagauuucuggaacuuuuccaucuuguauaacugaaacucuaaauccauugaaaaacucccuaucuuccucuucccccagccccuggcagccagcauucugcuuucuguuucuaugaguuugauuacuuuagacacuaaauauauguguaaucaugcaguauuugucuuucugcgacugguuuauuucauuugacauacugucuucaagguucauccaugugaaacagucagauuuuaaaggaaauuaacacagagacucaugauucugguagugucagguuacauaguccaugguuuguugcucuacaaaacaaaaagauucucaaauaaacauacuuuuuaaaugaguuacuagagggggaagaaggaagggaaaacuucuaugcuuucggcacgcucccugcaugaucuuagcaaauggcauaacuacuuugaaugcagaugucaguaucagcucugagauuuguaugcagcuaauaaaguagccccaagauguauuaagcaaaaaugaauagaauuuuggggagaaauugacaaauccauguucaugggcuucuuaauaagacaagauauuuguaaagaaauagauuuauauaauauuauucuuuuuucuuuuuuuuuuuuuuuuuuugagacggagucucgcucugucgcccaggccggacugcggacugcaguggcgcaaucucggcucacugcaagcuccgccucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccuauauaauauuauuaaccuuaauauaagaagaaaaauacauagaacccuauauccagcaauuagaaaaugcacauuuuucuaggacugacauggucuauuuguaaaaaauggaccauugacuaggcugucaaguaaaucuuaaaauuuaagaaugccuggcugggcgcuguggcucacgccuguaaucccagcacuuugggaggccuagguggguggaucaccugaggucgggaguuugagaccagccugaccaacauggagaaaccucgucucuacuaaaaauacaaagauuagccaggcauaguggugcaugccuguaaucucagcuacucaggaggcugaggcaggagaauugcuugaauccgggaggcagagguugcggugagccaagauugugccacugcacuccagccugggcaacgagagcgaaacucugucucaaaaaaaaaaaauuccuaucuuauagcucauaauuuuuuaucuuaaugcaauuaaaauauagguuauuaauaaaaagauaaacauuuccauaaauuuggaaguuuuaacauuucuaaaucgugggucaagacaaaauuauaauggaaacuuaaaaauaaacaauauauaaaauacugcuuaucaaaacuuguguaaaggagcuaaaacaguacugcaaugaaaauauauugucuuaaauauuuauauuauauuuuauuuauuauuuuuuagauggagucuugcucuguugccuaggcuggagugcaggggugugaucucagcucacugcagccucugccucucgaguucaagcaauucuccugccucagccccucgaguagcugggaguacaggcacgugccaccaggccuggcuaauuuuguguuuuuuaguagagacaguuucacuguguuggccaggcuggucucaaacuccugaccuuaagugaucugccugccucggccuuccaaagugcuaggauuacaggcaugagccacugugccuagcccaguauuuuaagaugaaaguuaaaauuaaugugcugucuaaccuaauuuagaguaaaaauaagagaaugagaaaaaaaaagcagaaagaaguaacaacaacaaaggagcagaaauagaaaucacaguuacagcacaagggaccaacuaaacuaaauguuagccucgguaagacugaucaacucugucaagaucgagcacgaucaaucaaacaagaaagaaagaaggugcauauaaacaauaucaggagaaagagugggcacauaaauacagguauacaaagaaagcgugaauugaauacugccaacaauuuuauggcaguaaauaugauuuuuuagaaaaaauggaacagauuccuagaaaaacauaauuuaccaaaacugacucaagcagaaguagagucugaagaguccacuuaaagacauuaauaaacaaaauccacaaagaaaacacugggccagcugguuuuaccgguauguuucauaauaaugcaagugaauauagauguagaaauccuaacaaaggauuagcaaacugaauauagcaauguauuaaaaagauaauacauuauguucacauuaaguuuauuucaggaauguaaggguagcuaacauuagaauaccuuuuuuauuuuuuauuuauuuauuuuuugagacaggguuucgcucuuguugcuuaggcuggagugcgguggcacgaucuuggcucacugcaaccuccaccucccggguucaagcaauucuccugccucagccucccaaguaguuuguauuacaggcguuagccgccaugucuggcuaauuuuuguauuuucaguagagaugggguuucaccauguuugucaggcuggucucgagcuccugaccucaggugauccaucugccucggccucccaaagugcugggauuacaggcgugagcuucugcacccggccuagauuauuuuauaauucaccacaguaacaaaggagaaagagccauaugauuaucucaauaaguguggaaagauuauuuaaaguccuugcugaggauuaaaaaugacacauagcaagcuagaaauagaagggaacuucuaagauuucuaagagauaacugcaacaacaucacucauaaugaugacaugaugaaagcauuguuuuaaaaaaauauugggaacaagguaaguguguucauucuuaccacuuauacuuaacauuauacuucugucucccugaccuuauacucuagguccuaguuaguacaguaagcaagaaugagaaauaaaagccauaaggauuggaaagaaauaaauuaacugucuuuuaaucuguuuaugaggccacuauagaacuuucauagccaaagcaggaagguucaguaagaggaauaaaaguauaaaaguuuuaucuguugcuauauaacaaaccaccccaaaacaguggcuuaaaacaauaggagacauuuauuauguucacaaaucuagggguugacuaaccccacauaggugauucuugcucaaggucuuuuguguaauugcauuucaaaugggggcuggggcuggagucaccuugaagaagcaacuucuuuacucuuguugacugugaccucaacugggcugucaccaggaacaccuacacaaggcaucucuaugagaccuggacuuuaucacaaggcaacugaguuucaagagugagcauucuuagagagcaaggcagaagcuucauugccuuuugugaccuagccuuagaagucacauacaacuuccacaacauuccguuugagaaguaacucacuaaggccaugcauguucaaggagaggguacuuaauacucuuauuaguuugauggaggaaguaucagugaauuguggacauauuuuaaaaccaucaccacuauagaugauacgaauugcuucguagauaaccccucuagaaaugugcagacaagucaaagaauuauuaagaaacauuuugauagucuuagaauuauaagaugauagaccuucaaaucauuaaaaagaaaccuuuaaacuuaccagaaagugcuugucaucuuucuuaguaauagcagauuuagauaaaaacuuaguucuauaauaauaauccgaauaaguauagauuuaaguuaaauuuuaugguaacuauuauguaaauauuugcuaacauuuuuucuuaucccauuaaaguuugaaaauaaagaccagaugucaguguagugcuuuaccuucucaaaauccguuguugacagcuuuuuuacuaaaagauuuucucacucacuguuagggucuuuaguucuaucuucaauuuuuuuuuuuuuuuuuuaaauauucaguuuuggccuagugcaguggcuuaugccuguaaucccagcacuuuaggaggcagagguggguggaucaccugaggucaacauggugaaaccccgucucuacuaaaaauacaaaauuaguugggcgugguggcuggcaucuguaaucccagcuacuugggaggcugaggcaggagaauuguuugaaccugggagguggaggugacagugagccgagauugcgccauugcauuccagccugggcaacaagagcgaaaaaaaacucccucucaaaaaaaaaaaaaaaaaucuuuaauuuuaaucaaagccaaaucaaagcuauuuaugauguuaauaauuuauuccugcgggcuauugaugcacuggagugguuccaaggaagaagaacuagaacucuuagagaagaagcuagcauugauuagacagggaaagagaaaaccuaaacagagcagcaugauagcugacuuuagauaccugaacuuuuacauggaaaaaagaguucuuuauccuguguuaagcccaaaauauagaacuaggguucaugagcgaauaauagcacuggugaauaucagguuagcauuagcucuuaagagcuguuuuaaaccuacaaacgaacccucugaacuaguacacuuguuauuggagguauucacgcagaggguggaucuucucacugucagaucuucuagagaauauuugugaaugaauuauagaggguugcauuagauuacuuuggucuauuucuuguaugcuucauuucuugccccuguucaucucuuucucaccaauuucccgcauucaccuuucuguccuauuacauugugaauuccuuaacagaugaaacuuuuuuuuuuuuuggacugacaaaaaucuuguacauaguuuugucauaggguaguaaagagaguauuaaagauaucauuaaguuucucuuucucugucccugaauaauuaaaucuauaaagcacuugggguugggcccacauguggaaggcaugugaguaaaggugguaauguccuugaaaaagaagccuguaauauuggguuagcauugcuguauccagguaugaaugcaugguuuucagugaguauagauacacagauaaauaugaacauagguauguguauauaccuauauuucuuaucccuguccacugggaaaucuugagagcagcgauagcugaugagccauugggcaugcuuagcuuuugauaccaaauuuuauucuccacuaggaggagaauagagcuuuggagaaauggcugguuccacgucugcgacagggaaaguguaagaauagccuggaaugucuuguagugacagaacauaaagacaugcccaaaaaaugaugaagacauaucagaaggauguagaagccaagcugaguccacuggccaaaccugggauaaucugagcaugaaaauaaauaaugguuacaaccuauugaauaaaauaggaauuaaugugucuauacugauguaaagaaacaaaugaauacauaaaugagggauagggaaaguucuaccuuuguauagguugccaacuaauaaauauugaaauggauacuaaaguuggugggugaaaauuuggugaagaacaagguauuuacauaaucuugaaguaucccuuuacaaaauacuuauuaaauauaagaagaggaauaguaccucuacacuggagaagucuggccaacaccagccuuaaauauguggucaugaccagucaugagauauaccaugucagaauccugaaccacccgauaagaugcagugaauacuuagcaucuuucugagaugaacaugccaaaaauauacaaacugaacucaucuauagggaaauagauaucugacaacucaaauggaggaacacuauaaaacaacugacuuacaguuucaaaagguuaaaaaauaccgugaaagaacagauuguauccuuuuguuuaaaggacauuauugggacaguugguagaacuugaauggugucuggguuaguaaaguaucacuguuaauuuuauaauuucgauggcuauacuaugaguaaguaggauuaugucauuguagaagauaaaaaaauggaauaaucagguauguuugcaacuugcugucaugacuugggaagaaaauucuuugugcuuggaauuuuucuguaaguuuuaaaauuauuuaaacauacaaauuaaaaauacauauaaacuugagguacugaauccuagccaguacaugaagucaagaaaaggaaauaaaaggcauacagguuggaagggaagaaauaaaaaugaccuuauuagcagaugacauguagaagauugcaaagaaucuacccaacaauguccuagaacuaauaagugaguuaaacgagguugugggauacaaggucagcauacagaagccaauuguauuccuguauauuaacaacaaacacguggaaaccaagauuaaaaacacauuguuguuuacaguugcucuaagaaaauggaauauguuggaauaaaucuaacaaaauacauauaggaucuguauguugaaagcaccaaacacauggauaaaagaaaucaaaagaugaccuaaauaaaugaaaaaggccuaccauguucauggauuggaagacuuagcauagugaaucaguccuccccaaauuguucuauagaucuauagugacucauagugucaaauuguuccuaaagaucuaacacaauuucugucagaauuucaggaaguuuuuuuguagauaaaaacaagcuuauucuuuuauguggaaaggcaaaggaacuaaaauaaaauggcuaaaaugaucuuggaaaauaaaaacuagaagaaucacucuaccuaguuuuaaaacuuaaugcauaaccacaguaaucaaaacagugugguaguggcagagggauaaauacauaagucaguggaacauaaucuagaaauagacuuguaaaaauauggugaacugauuuuuugacaaaggugcaaagcaauuuaaaaugaaaucucacaccuuacacaaaaguuaacugaagauagaucauagauggaucauaauguaaaagcuuucauaagaaaaugggagaaaauucaggauguaaggcuagaugaagaguucuuagcuaugacaccuagagcacaauucauuuaaaauaucaauaauuuauacuaaaucgaaauaaaaaacuucugcuccucaaaacacccuguuaagaggacaaaaagaugaguacagacuuggagaaaauguaaaccacauaucugacaaagaacuuagaucuggacuauauauagaacucucaaaauguaacaguaaaaagaaacaaaaaccccaguuaggaaaugggcaaaagauaugacacagauggcagauaagccuaugaacauauaaaaaacuucauuagccauuaggaaaaugcaaauuaaaaucaugguggugggaugucacuagacgccuacuaaaacagcuaaaguaaagagaucacaauacccuaaaaaugcagagaagcuggaucucauauauggguggugggaauguaaacugguauagccacucuggaaaauaguuuggcaguuucuuaaaaagcugaacguauacuuagcuuauaugacccagcacuugcacuccugggcauuuaucccagagaaaugcagucauaauguccacacaaaagugugugcaugaauauucacagcagcuuuaucuguaguagccccagauucgaaacaacccacauguccuucaguggguaagugguuaacuaugguauauucauaacacagaauacuacucagcaauaaaaaggaagaaacuugacguaacaacauggguagcucucagaggacuuacgcugggugaaaacaauccaguuuccaaugaugacauaguacaugauuccauuuauauaacauucuugaaaugaugagaauucucgagagggagagcagaucggugguuagggguggaauggggaagagugugccugccaaggggcacacagaaccuuugugcugauggaauagguauguguuguuuuggucaugugaauuuguuugugguaaaauggcauagaacugagcacacacaaaugagugccuguagaacuggagaaaucaaaauaaggucuguggauuguagcagugucuuuucaugcuucugaguuugauggccuucuggaacuaggcccuggacagcgcauugcuaggaguggggcucuguggugagucugacagcgucccuggcugcaaagagcuuaacuguggcaagaaggcugcuacugggugccugggugcuccugcugcccuccaccagcggagcugaucagaaucuugcccuaagaggccccucuuaaaagccacagcaccuugggugggcuggucugcccuagagcacuuacgcuggguggagggagcuguggaagcgugcagugggggagugcuggaguccaggacagucagcuguacucgggauuggggugagggugugguuguuucuagauuaaaauacagauacaugaucaaguagaauucugaaauuccuuuaaauguuuaagguaaaauaggaauuaccaaggaauuuuguacuuuaauacccucuuaggguauuaaggaggguuugucagugaaaauaaucaagaaggacugguccauucgagccacugauuuugacagacaagaaaacagaccccugagugccccuuaucauaggacugucggcgacugggaugcugauaguguuucucaaguaguagucacccuuuucugggaaaucaugacuacgucuggaaucauguagguugguagagccaaaagagagaucagaauccacaucuuuagaucccucaaacuccccucacccauguuuuucaucugcgucgcaaaauuccagguaccuguacuaagaaguccugaagguuucugcgcuuuuccuuucugccgaauuaguuuacgcuuaagaaagucaguuaacgucauuucauuuccugcuuaugguucagaauggguugauagugauuugucauucuaacaaaauucuagcagguguaggaauuugaauaugugaaaaucuucuggaauucaucauauaaacaauguuugaauacuugcugacuuaaauuguuaugacacucuacuagguaggcccgcugagaaaauggaaguagcaguccuuuuucccugacagucaaauuuaggagaaaugaaucaguacaggauuucuugacucuccgaaccuaaacugcagacugcuccucuccgcuuuguccccguggcuccagccacauucuucaugucccucagacauguuagguauguaccaccuuaagucauucgccguucucugugcuuggaacacuguuaacuaaaauauccgugagacugaccccuuccacaucugugcuuacaugugacccaccuggguggucagccacaaggcccauccugaccacccuguuuagaauugcaaccugccccucuccccagcgcugugagucccguuacucuuuuuucuuagcauuuauuacucauauacuuuacuuaguuaugcuuauugcuauaucaccaauauagauauuugguccgcauuguuugcauggugucucaugggccuuuggaugugaugaaaguuaaaucuuuuccccuaagucccuccaccuucaauuuguuuaggcucuaacucuccuagaagcggagagucugaguuucaaagaaaauggugcaauacugcugagcgccguggcucacuccuguaaucccaacacuuugggaggccgaggcagguggaucaccugaggucgagaguucaagaccagccugaccaacauggagaaaccccgucucugcuaaaaauacaaaauuagcugggcgugguggcacaugccuguaaucccagcuacucaggaggcugaggcaggagaauugcuugaacccaggagguggagguuguggugaacugagaucgcaccauugcacuccagccugggcaacaagagcgaaacuccaucucaaaaaaaaaaaaaaauggugagauacuuacugauuauuuuaaagugaagauuaguaugucuuauuuuauacaagcuaccaaagaggaaaaaugucuguuuuccaaacuaaugaauuuuaccuauuuuguaaagacauuucucagguauucuuuucauugcagacucuuggggacagauuaaagaggacuuuuucaauuaggagauuuguggaaucagaauuuaauuagugacauuguccugucaaguuuaggaucuugaaaucaugauggguugaaagacgcugaugauuucaaggacaguaaacuauuguuuggaaaagguugaacuuaccaaauguuuccuaaacaauguauacuuuauuagcaaagcugugauggugcuaccuuggaaauacucuuuacauucccaccgccacuacuugauucaggccucaucaccuuuugauuacgcuuucaguguauugguguaugaaguugccuucuucuugguucaguccaucuucuaugcugcugagaguuauuuucaugaaaaucaaauguguuuauaccaguccuuuaaagaacuucacuggggcccuguccagagccugugccuguagcacggcccacgugcccuucaggguccgcccuuaaugugucuggggagcccucucuagccagcucgccagccuuucugaaucugccaguccugccgcuacaccauucccuuucauuccucuuuaugaugugcccucugcuggaauuuccccuuccugcugaucucacuaggccuauucagguagcaacuacucaagcuccuucccacaauauuuuaugcaauaaaguaucaguacucagagucacggcuuaauauaauuucuuuuuuccuuuuuaaaagcuucaaacaaauaaugucuuaccuuuagaucccuauagguuaaaauauguuuguugacuaaaaauuguguaugauugcugaaaguauucaaugcagggaacagaccaguucaucauggaggcauuccaucagagcgucuaguuagagaagauaugucauggacugcaucggcacagaagugggguuuaugugagagaggaguuggaagucacaccugaguggagagcaacgugaaaaggugaugucagcaagaauuuaggauguauggaaaggaugguaaaggcaccaacuggauggaucagggagacauggaaugcagaaugcaggaaauagguaaucucuuaaauugcacaaaucuagguuucauuuuugugcucuaguguguuacacuugugaugacuugacuucccugagugacagugcgaugggugugauccauauucauaugcacuucauagggcugugaggacugagagaggugacccagugacgagugucacacaaaccugacaugucguaggcaccaaaugguucuagacagugguucugguugguuuuguggucaauuggaaaccuuucaucaaguagaauuuucuuugcagagcaaacaauugaaauguuaauauucuauguguacuaaaguuuguauucuccauuaauaugggggaguauauggugaccugguguuuagugccagcuuuguuuuugguucauugcucgauuuaugagagagaaugcauaauauuuguuguucgacuauuuuacuugcaggauugaagagaguugacaaaucuagaaaaugcuuugaguucuuggacaucacuguuugaaaacguacugauuacccuuaguugagaaugggaaaaucuaaaggggaaaagucacugguucacgcuguacuauuagaauuggucaucuucuugccugacuuguaaguuaaggaugcuugaucuuugcugugauuuaaccuguucaggaugaauuguaaccaguuacaaugaauacaaauucuccuuucuguuugaccuggaaaacuuuccaaaaggagaugucuuuacaauaaugauauauuuggugaaagcuguggguuguuuuuuuuuuuuuaaagcuuaugaugacaguauugaaagaggaaacuaaucuguauugucagcacagccacagcuagcacuagucauuucuugagagguggagcuguuucucagaaaacaugcuguuugaggguaggaggugaagggacuccuugucagaaauuggcuuaauuuuaauccaaguuauaaaccacaguucuguuuggguauugcauuucuucauuuacucagugacaagaauuaaggcagaugaugccuguagaaaaaaaaguguauguucuugauaguucugcuacuagugcuaguagagguugagaaauaagauuuccugugaagugugguuugguugcuuuugugguaucccaugcaaaagaguuugaacuaucuucauuuuucucccuuuacuggauccuuuaaaagaggaaagggugagauaaccagacuuacaaggaugguaaaguauagugggcuuuggggcuuacuuauacagcccaaagguuaugggaugcugcuguuaugauaaucucaugucagagguuccuauggaagaggagaaaggauguaccuuucuguguguucucauucagaagucaaaaguuuguuuuuuaaugauuaguuuacagauuuggggcugacugauaguaucugggcagggaaaagagaccugugacucagguuguuaagggaaccuguguauaugcucucacaaacucgaaaccguguguugugauccuuaauuggagaagagguagugcccuucuuuguuaucaucacuaaagaguauaaauuauaaagucacaguuucucauaaagaggcuuugauaguuucacuuccugaaauguguauauucacaaucuuuugcaauaguuauuuuaaggugauguguuuuauuuuuuucucuacugccucuucgaaaucaaaaaguuauauauacuuuuuauuuuauauuaaucuuuuucaauuuuuguuuuuauaauuuuaauguauuuuaaauuuauuuuaaaguuuuauuucuccuuuuugcuuuaauauuucuuccuuuuuaaauuguuuuucauuuuuccuuuguauguguuuuucuuaaaagaacagaagaauuaaaauaauaucuagugauguagguauuucaguuuuguuuuuaaucagccuugagaagaaaauacaggcucaaauaacauuuguagucaguucuaaauagcuauagaguuuucccaaggauuaccuuucuuuuuuaguauuaucugauaacaaaauaaaaaaaaauuuuccugagaaaauucaccguuccuuugcuuuuguugacucuguauauuaauguuaaacaggaagcgaggccacugccaggggcugagcccugcagacccagugcccugcagguagugcccuccucccuacugccucccaggacuggaucugggcuuuucuggugugugguuacugugcuuauagagcauugagguaacaccucgugcauauuuuacagauagaaggaaaauagcagugaauuuuaguucagaguccugagggugagguaucaaauacucuggcugaaggucuuucucuagguuuacuuccugcauagcugggcaagggugugggguggugccaugugggguaaccagauucccagcacccugugagguggaccuucccggguuuuauggauuccuaccgcauguuagcuaaauggcuguuuucaguugugcaauagauaugaguagccuuugguuaguguucuuucugugauuacaacaugaggaaauacauuccuuuggugugauauuuuaguggaacuuuaauuuuaaaaucauguaguuuucuaaaaccaggcuuucuuuuuuugguauguugucuaggagauauguggucuuuauuuuaauuaaguugcugaccuuuuuacuauuuuacauaauauaacaguuaaagggugauuaaacuguuuuuuaaaaaagugauuuuuaaaaaaaagugcuuguugacaucaucuuucugagaacacuaguauaugugauuuacuauaacaagaucuuaguuuuuccuguuggcaaaugacauguaauauuuacagaggucuuggguucaguccagcagaaacaucucagauaaauugaugugugaaacuaaagccauuuuacauuuucuuucauauggagauaauauaaacaguuuuuucauuuaaaaguaaggagagacuggcuauuuaguauggauuucuuugagagggacaacuuguaauaguaugcauucucuagaguuaaacaucaaacaccauguuuuuaguuuuauaauucagugauaugcauccggcaguuguguguugaggauucugaguuaauucaugggcuuuuucuccuggugucaugcuucucuugcuuucccaucuaaauguauaaggucacauuuuguauuucacauauuuaaauuagcauaaauucucaaucuaugagauuuuuacuuuuaaaaacuagaaauaucucuaaacuguuaacagagucuaaguagugaaguaucuucaguggucuuuuaaagaauacaguuggaauauuccaacugucuuuaaauauuuucagcauuuaaccuaaacacaguucagugcuaaaauuuauuuaaauauaguggaauucuuaucuguugagaaaugaagagguugaaauauaguaaccucggaaaucuagucucaucuauuugagaccaguuaucguuuuguagguagaccaaucaauucuuagguaccaagaaucugaaugauccuuuuacuuuuaggaagguaaguacuuuauucauuuaacuauguuuacuccuggucgauuuuucaagucacaauggcuaaugugcuacaaacagaagugcuuccuuuccagcacuauaguaauaaacaagauugcauuuuauacuccuuacaaaaaaaguagagaauaguuuaggauuugucucaacucuauuaugaugcuaauucauuuuucuuauuucuucugucuuuuuauaaauaccuagaauauuaauaugaagauaaaaacaguaauuuugaaaugacaguugugguuuaucauucucuauuuucagaugaucacagucguguuaaacugcaaaaugcugagaaugauuauauuaaugccaguuuaguugacauagaagaggcacaaaggaguuacaucuuaacacaggcaaguaauacgauaccacgcaaaugucugaaaaugauguguuugugcuuguucugcuuuaaaucauagguaaaaguauaucuugacuucuuuuggaaaugaaaugguauuucaguuuuuuucugacgauguaaugaauuauggacauuauaagguuuugaagcuuugaguauuuaagauaaaaggcaaguuauuuuugauauuacacguucugugaaggaaaauucuuaggaaauggcuuaggccaguucuuuggcagauuguguuccuuacauuauaucugacacagagugcugcuuaugcuucuuagugucuucuuuucucuucccauacccuguggcaaaaccagaggcccuggacagcucuucuguagcucccccugccucgcauauaucuucagagaguacaccaagcccuggauggugucuggucgucuucaaggaccugagcgggugcugagaccaggugcuccagaggcccagccacaaggccuugugcucccuguggccuucugcccaguugccucugagcgcaucagccacaccugugugcaagcaugauucuuccuuccauucugagauaguaggagagauuuuuguguauccacagcuacucuuuauucaucaaguaauaaagacuugauuaucaacagggcugucuuucccccuaaagauuuuuaaauauucaaaagauauaccauaauauuugagauuuuugaaaacauaacuuaaaucagaaugacuuauuugaaagagaaaaauauuugauaaguaaaaagauaugcagauuaauguaacuaugagcuauuauacuacgucaauucacaggaaacuaaaaugcauuuuuuacuugagguaguacagcuccugcaagucaaaaagaaaaaaaacagcccauggaaaaaacuggcaaaggacauaaacuccuaguucaaagaaucaaagguggacacuuugcacaugaagaaaugcuccauucaguaaccagggaaugggccuuucaccugucagaaaaggagagauuucaaaguguauaauacucaguguucaaauacucugaccgaccaagaaagucuacuuagagaaauacagucagacauaaagauauaugugaucggccaggcgcggaggcucacaccuguaaucccagcacuuugggaggcugaggcagauggaucaccugagaucaggaguuugagaccagccuggccaacacggugaaaccccaucucuacuaaaaauacaaaaauuagcugggcaugguggcggguaccuauaaucccagcuacccaggagucugaggcaggagaaucgcuugaacccgggagguggagguggcagugaggcaagauagugccacugcacuccagccugagcgaaagagcaaaacuguccaaaaaaaaaaaaaagacauaugugaucauguucauugcagucuuauuuuaacgcaucagacucaagcaaucuguaagggacugguuaaauaaguuaaucauacauauaccauuaguaauaauuuguggagcuugggaauagagacuuuaauuuuccauuuuauuccuuucuguaauauuggaaguuuuuuuuaugugcauuuguauuuuaaacuacuauuuagaguuaaaaauuuuauuuucuguuugaaauaccuauaguugacccuugaaccauccaggguugaacuguacuaguccacuuacaggcaaauuuuuuucaaccaaaaacgggucggaaauacgguauucaugggaugugaaauccaugcauacagagggcugacucuuuguaucugcagguucuacagggccaccaguggggcuuggacauguguggauuuugguauacugcaguggguggggggcagguuggguccuggagccagucccuuguguauauugagggacaacuaauuacauuaaaaaauagagaagaauuaccacccuagaucccuuaucacaacccuuucucccucuguacuguucuucuccauuaucacuuacugguuuuuuguucucuucuuaguucuuaaaaacauaggucuuaagauucuaaauuagcuuuuuuuuuucuccuccagucugcacuacagcccuuuaagaccaugguuuucaaccuuuguaaccuaagauaggguagacuacugucaugguaccugugcuggaaucuuggugccagcauuucacuggguauucacucacccagcaaagacuuacugagaccuacucuguggcaggcauuguuuaaauaaaacagacuuucauaaaaacccuauuaugaauuuuaugaauuuuacauuauaauaggaaauaauaacaguuaaaaauuuuguaaugguguuuuuacaugcuuuguauaauuuaaaccuuaggacaacccucugugguaaauaguauuaccuuuauuuuauacacgaggaaucuaaggagauccagagacauuaaauaacuuucuuuuuuuuuuuuuuugagauggagucucacucuguugcccagccuggagugcagugaugcaaucucagcucacuacaaccuccuccucccggguucaagugauucucgugcuucagccucccaaguagcugggauuacaggugcucaccaccacucccagcuaauuucuguauuuuuaguagagacaagguuucaccauguugcucaggcuggucucaaacuccuggccucagaugauccaccugucuuggccucccaaagugcugggauuacaggggugagccaccgugcccagccuccuaguaauuguuuuugaacuucuugucgcuguguguguccugaaggagcccugcccauuuaaugcgagaacucagaagccugugucuggcuuuuucuucucuccugaauuccucucuauguuuuucaggucucuauuggauauuuuuacuggauuucaaagucugcauguucucugucuuuuuuaccaagguagcugccuuccuauuuuucucauugggauugagacuguccucauugucugccaaguucuuucugaucuucuauugccccucgcuuuuuucagagcucucuucaauuacaccuguccuguugcagcagcuuuuuaaggucuccccuuggcaccaucccugucacucuagugguguagucaccaacuacaucccuccacuucuaccucacugaucuauuugucuuuucccaaauaugcccuaaacuuucaugcacuuugccuuaugcuuggagggccuggaguggacccuaacucccucccauucuucugcauucccucucuguauuaggaccuuuuucgaggcucuucuguaguuuccuucccagccuuuccugcucccuaagaccugaugguuuaauuugcccauacucuuguacuacuuaacuguguccauuagucauacaaguacuucuccuucuaccuuugcaagcucuuaaagagccaagacugcaucucagucuagcucuuggccuugcaucuagcagguuguuuggaauggaggauacagaaaacuagagaugcaguaacccagcucuucugauuguccuuuguagauuguuacuucagucaucuuuuucuucugaguuuuaugaauuaguauuuuuuuaaaagucaccuccuugguguauuaugucuguuuugcagaugaagaacauugguagcauugcugguaaauggaagagcugagaugugaaucucuguuccucugauuuaaaaaccuauggcugggcguaguggcucaacgccuguaaucccagcacuuggggaggcugaggcaggcagaucaccugaggucaggaguuugagaccagccuggccaacaugguaaaaccccgucucuacuaaaaauacaaaaaucagccuggcaugguggugcacgccuguaaucccaacuacucaggaggcugagggagggagaauugcuugaauccaggaggcagagguugcagugagccgaggucgugccauugcacuccagccugggcaacagagcaagacuccagcuguguuccuguuuauuauuuagucuuuagaaucaccaguggaauggcauggguugugauuguguguauacacuaaggaguaaccucacuggcaaauugcuacauccauuuuuuuuuuccuaauuaaagaaaaagguauucauuuuacuggggauuuccucauugcuguuuuuaccuuuagacuguguuuuguuuuagaaguagaucaaguaauagaaaaauaaguugagugaggaaaacgccacucucaaauauuagguuguaguuugucaggauccucaguagacuucuagcauuuuuacaacuuaaccuugguuuauucauuuaaguaauauuuauugaguaucugcuacauaccaaggaguacaccaggccuaaagaugcuuuuagucagcugggcaccauggcugauaccuguaaucccagcacuuugggaggcugaggcagguggaucacuugaggucaggaguucgagaccaaccuggccaacauggugaaacccugucucuacuaaaaauccaaaauuuagccaggugugguggcgggugccuauaauuccagcuccgugggaggcuuaggcaggagaaucucuugaaccugggaaguggagguugcagugagcugagaucgugacacugcacucuagcccgggugacagagacaccaucucaaaaaauaaaaaaugcuuuuagucuagaaccacuuuaacccccuuguuguaugugggucugaagcucugggcagcccuagcccccacuccugacucugccccuaacucauaccacucugcuacauuccaugugaguugaaugcauguucauaguuauuuuagguguagcaaaacuacaucucauuuuaaccuucucauuuaaaacucguuaaaauuuguacauaggcuuuucaucucuuauuagaucuuccuuuugcccuaugcuaucauuaaaaugugaaagcaauuggaaauacaugaaauauuuugcuuuuauccccauggcauuguuguaacauggacuguugccccuuuuuaacucugcccaauacucuuccauugaggccguacauacugugcauuuguagauuaacaguuucauugugguucagguacuuuaaugauuccuacuuuuucuagaaaucuuuuuguaguugacuugaguugguuggcuggccagugaugguacagacuuuuuucucauggauuuucuaugaugugugggaggcacauccucuuggcuguagaagaugaagaggacagaaauuuccuuggucuaccuucuuugcagcuagaacaugaucagucagauacuccuacucgugauuuugucucugauuugccuauagauuguacaugaauacuauagccaccuucauauggcagugccagcaaaagcaaggagauaguagugacgguaucaagagcagcaucccagguugacuuucuuuggggcaggaccuugcuugugucuuaacccuugguuccuacccaaguuugucucucuaguccucaacucugaaagccacuugauaucuuacacaauuccuuuuuugccugagaaaauaaaagucaguuuugaucauuuacaaccaaaaauccuaacuaacacagaccuguuuuugaaaucagguagauuggaagucuugguuuacuucuuauaagcccguccgcugucugucuuguaacaucccaggagcagacuuaacaaggccuuccuggagccuugcucuuucugucugcuucccucaucugcucucucuccucucucuucacaggguccacuuccuaacacaugcugccauuucuggcuuaugguuuggcagcagaagaccaaagcaguugucaugcugaaccgcauuguggagaaagaaucggugaguaauauuuaauauuuacaacuuaguauacuguaugugaucauuagcauauaaagauuuucauuuuggggccaauauucauuccuuaguuuuggccuuuaauugcuaaaggcuagcggucaaaguguuucuguccggaaaaacucauguauccuuuuccuuucuuaaguauuuuuauaacaauugcagaccuuucaucuccaagauagaaauacaauggaauaaauauggacuagcagugacauauagaucuuuggaaucccuaggaauccuuauugaccuauugucaauaaguccucuuccagcuuuaagaucuuguacuguucuacuucagauuucuuacuuuauucuacauuucauaauugcugguuuuuaaugaugaugaaaauuuccuaauccacuucuaauuagauguggcaaugacaugccagaauuuccagcaguaucagcauagucauuuacagggguuuuuccugaucuucaauaucauuuaaaaauuaaggauuaggccaggcacggugccucaaaccuguaaucccagcacuuugggaggccgaggcaggcagaucacuugaggucaggaguuugagaccagccuggccaacauggugaaaccccgucucuacuaaaaauacaaaauuagccagguguaaugcuagcuacuugggaggcugaggcaggagaaccgcuugaaccuaggagguggagguugcagugagccgagauugugccacugcaccucaaccuggaugauagaaugagacuccaucucaaaacccacugcacugcagccugggcgguagagugagacuccaucucaaaaaagaaaaaaaaaaaaaucaaggauuaugacauugucaguuugagcaccauuguagacuacaugauuugcaaauuuuauuucucucauuuuggaguauaauuacuguauuaauaagauaacacugccaccagaauuuagaaaucauguuuauggugguugaaccuagaugguuaacaagagucagguuuaauuauuuuggggaagauuacuucagaggugguggguaauguguuauucaucaagagacccauaaugucugauuauuguucuuuuuauuucauuaauagccauuauuggucaguguucagcuucuuaauucauuauggguuacaaaugaugauaauccaauucugucauuacuucucuuaaaagcaguuuuccaaaaaaaaguugauucccuauugaggucaucuguucucaacagaugaccaauuaggaguuuuucugguggagaguggcaggagagguugaauuauuauggguuuggacauacuggauuaauuuuacuccuuugcaguuauuuuccuuauuuuugaucaaauuacccugucauuggcuagcagcaaugucuuuagguuggguccugaguccucuuuuuuuuuuuuuuuuuuuggagacagagucucgccuguugcccaggcuggagugcaguggcaugauuucagcucacugcagccuccacuucccggguucaagagauucucccgucucagccucccgagcaacugggauuacaagcacccaccaccaugcccagcuaguuuuuguagagaugguuuuaccauguuggccaggcuggucucaaguuccugaccucaagugauacgcccaccucggccucccaaagugcugggauuacaggcgugagccaccucacccagcucugaguccuuuuuaacaaaccuuuaauaguuuccuuggcugggugcaguggcucacaccuguaaucucagcacuuuggggagcugaguuggguggaucgcuugagcccaggaguuugagaccagccugggcaacauggugaaacucugucucuacaaaaaauacaaaaauuagcugggugugguggcgcaugccuguagucccagcuaccugggguacugaggcaggaggaucacuugaggccaggaagucaaggcuacaguuagcuauggucgugccacugcacuccagccuggggacagagcgagacccugucucaaaaaaaaaaaauuuuuuuugcugucuguaaugacugcaucucaggcucaucucaaacucuugcugcccagaccuggaaccagccauuucucuaaggaguuuugguuucuuuuaaugggcagcaguauuucaagaucacagcaaaaauaaggauauauauugcaacuggacuggucauuguuuuuagggcuuuucaguggacaaaagcuaaggaacaauaugcauauguuaagauaacauacuucaagaguucauaaugauauucccaguucaaauuuggaacuauaaguguugcuuagccccuuccaucuuacaucugcuauuuccuuuuucauaccaagaauccugguucucaaagauaugagagauguaaacuaucuuguaaugacucauuuccuucuucccauaucauauacaauauauaaccauaaucaugauaucaucugcuaccaaaauaauuacugaaaaugguuuacaauuuuuaauauuuuuuucauucucuuccugguguuucugaguuguacuuuacaaacuguagucucucccuuacaucucuuguagacucuuaguucuacaagcaagcauuauuuaauauucaucaacagucuuugcugaugucucuccagucauucugacuaaagcucauucucuaguggcuccuaaggagggacuugugagcauuauagucugauuuuuuuacaugucagugaugguucaucugcugucuuaauaucugaaagucaguuuggcgggauauaaaauccuuggcucaugugcuauucuuugaacaacuuuuuuuuuccauuuccuucugguauuccaccaaagucuaauggacaucuuauuuccuuuauaagucucuuguucuuuuuaucugcacuacccaaagaauucuuuuuuucuuuuucuucagauauuauuaguuuuaccaaaaauaugucuuaguaauuggccauucugggucaguuuuuacagguacaugauguguucuugagaguuugacuucaaguacuuuuuaaaauuuuuuaaauacuuuuuguuaaagaaauauuuguugaauuacaguccuuaguauuuguucugcucccuugcuugcuuuaauguucuucuuugggucuuccuauuauacguauguuggauuuucuuugccuaccuuuuuuauuugucacguucucuuuaauccuguuuaucucuuuauuucuauuuuacuuaaaaaaaauuuuuuuuuuucuggccagguuggagggcuuacaccuauaaucccagcacuuugggaggcugaggcaggagggucacuugagcccaggaauucaaaaccagccucgacaacaaagugagacccugccucuacaaaaaauacaaaaaguagccaggugugguggcacgcaccuggagucccagcugggguugggggauugcuugagcccagaagauugaggcugaagugagccaaguucaccccagugcacuccagccugggcuacuacagagcaagacacugucucuuaaaaaaaaaaaaaauuauuuauuuuccucuuaaggcauuauuauuauuauuauuuuuuuuuuuuuuugagacggagucucgcucugucgcccaggcuggagugcagugcugcuaucucgacucacugcaagcuccgccucccagguucacgccauucuucugccucagccucccaaauagcugaggcuacaggcguccaccaccacacccggcuaauuuguuguauuuuuaguagagacgggguuucacuguguuagccaggauggucucgaucuccugaccucaugauccgccugccucagccucccaaagugcugggauuacaggcgugagccaccgcgcuuggccagcaacauuuauuuugaagauaaaauuauugcaagaguuugauaauuuuagaaacauaaagugaaugucccaugacguuaaaauauagguaaucaugcuuuaagaaugauaaauuuauuuuuauuuuaugaauaugauaccuauggcuuuuuuaguuuauaaguuacaggaacacuuaaaaaauaccuuauaagaccggacaugguggcucacgccuguaaucccagcacuuugggaggcugagguuggugguucacuugaggucaggaguucaagaccagccuggccaacauggcaaaacccugucucuacuaaaaauacaaaaauuagcugggugugguggcagacgccuguaaucccagcugcucagaaggcugaggcaggagaauugcuugaacccaggaggcagagguugcagugagccaacaucacgccacugcauuccagccugggcgacagagcaagacuccagcucaaaagaaaagaaaagccuauggagacagaaaauggaucagugcuugccuguggcuuggagugggaauaggacacaaggggauuucugagucugagagaaauguucuaaaacuggcuuacagugaugacugcacacacauaaaaaaugcuuuauaaaauuucaaucucuacccgcccugcuccccgagauggagucuugcucugucacccagacuggagugcaguggaaugaucuuggcucacugcaaccuccaccuccuggguucaagcgauucuccugccucacucucacaaguagcugggauuacaggcgcccgccaucgcgccuagcuaguuuuuguauuuuuaguagagacaggguuucaccauauuagccagguuggucucgaacuccugaucucaggugauccucccgccucagccucccaaauuguugggauuacaggcgugagucaccgcgcccggcuauaaaauuucaaucuuacuaaaauacauuaagcguagaauauaguagugacuucuuaguuuuggguacuugaaaaaauauagcauguauauaucugguuuguuuucauuuuuuaacuuuaugguuucaugaugucuauaaacuaaaaaaaaaucauauacauauuucuaaauuuagguuaaaugugcacaguacuggccaacagaugaccaagagaugcuguuuaaagaaacaggauucagugugaagcucuugucagaagaugugaagucguauuauacaguacaucuacuacaauuagaaaauaucaauguaagaccuuucuugcccgaaauuguggacuuuauaugaugguuuaaagaauuauucuuuauuauuagauuugaaguuugauaagcacaugcauuuggauaauuccuauaguaucuagccauaaucacguguuuuuagauugugugucugcaucuaguagcuuucugaggacucugaagaaacaguagaaacuaagaauuucaaaguucaguuugauauuuggggauuaaaaauuaauuaauagaaauacaugaggauuaauagagagggcuuuagaaucaggcaaaccuggauucagauccagcucugcugcuuaguagagcuguacuuuagacuuguuccccacccucacugaucccuuccucaucuguaaaauggagguuaccacgccuucccuccggggcuguccugaaggucaaaugaggauguguaugcagagcaccugaccuuaguaaaugcccagcaagcaauagcucccaggaccugugacugccaagaauagcaaaauagucaagaaaauaacuuacaaagcuauuguuaagugauucacaacacaaaaauuugucccuauugaguuggaaaaaaaaugguguuuuauauauauauguaacacgcacacauacauacauacauacacacacauguauaaauguggcauguggucucaagaacauuuacuuggguguuuguuugguugguugguugguugguugauugguuuuuugagacagucuugcuuugccacccaggcuggaguacaguggcauaaucacagcucucaaugaggccuccaacuccuggccucaagaaauccucccacuucagccuccugaguaucugggauuacaggcaugagccaccauaccuaauuuucuuauuuuuuuuuaauagagauggggucuugccuuguuauccaggcuggucucaaacuccugagcucaagcgauccucccaccuuggccucccaaaguguugagguuacagucaugagccaccaugccaggccuuacuugcauuuuucuuccccagaaacauaugaacuguuccuugggccuugguugagguacauacacauaguggguuaugaaccugcuguugccagggugaugauugaggcauuucucccccuuucgccauuuaccucuuuugcccucuuuguguuguaauagaauaaacuagaaaauaaugaaaugagaguaauucugagaugcuaauagaaacugugauagcuugaaaauaggagaauguuuagccucauaugacuuuaggaauguauguagucuauaagugaaauacuguuuuaguuaaccauuaaguaaauuaagugaucacuaacaauacaaaaaaaccuuaaagagaagggagauauauacaugcuuuuuagauguguggcagucccuuuuaugguggaucccuugaaacacuuguguuuuuugcugcauugaguaagcacaggugcaugcucugugcgugaggccuagguucugguuuuccuucuguccagcuucccgugacauccguacuaagcuuauuauacagucucuugagucaccuaaaaaggcucaaaauuacgaaugauaaugcuuagauuuauuuauacauucccauuacuauauuuauuuugucccaacucuuuccauuuacaugugucuuaaacugcauugagauacaucaauaacucuuugauacuggacugagcuguacauuguucauucccagaaacagaacuguauuuccacaagguucugaaaguucucugaaucaucuucucuugguauuuaucccagguaauuacucauuugcuuauggcauuaaaauugauuuagaugaagggcauagauguguuucccuguuucugaaacaguccuuauugagaauugauuauaccuuaaguaacaauaaaauagaaugauuuuuguguuuuguuuaucagauuccaaaaugcuuucacauauauaucaucugaccaguagucuucaguuaguguagauaguguaaauauucuuauuauccccguauuuuauauuauaaaaaauaauaguuaaaauccauuagguuauaggaauuuuuccaucgauuacuuagcuaauaagugacagacugaucucauuaguucuccugguccccuauuuuuuaagacaaagucucauucuguugcccaggcuggagugcaguggcaugaucuuggcucauugcagccuccaccuccuggauucaagugauucuccuguccuagccucccgaguagcugggaauacaggugugcaccaccacgccuggcuaauuuuuuguauuuuuaguagagaugggguuucgcuguguuggccagacugaucuugaacuccugacuucaggugaucugcccgccucagccucccaaagugcugggauuacaggugugagccaacacgcccggccaucuccuaacuuuugacauggggauaaguccuuuugaaaagaugcuaauuguuguaaagagagauuauugauucugaagcaucuuucuggaguugaggccaucaugugaguuggccagccacucuguuuuaguugcuagcaacugugugguauaaugacaugaucacuggauuuuuuauuggccuggguuuagaacauaccacaauauaauagcaagaauuuguuuguguucuacuuuauaauuuuuaauuagaacuagggauucuuuauucuuuagaaggauaaaguagcauuucaguaugagaggcagaauuacauuugccuaaguagauaaccucuagaaucagauagcccaaguuuaaauccugacucugccauucuugcugagugacuugggucacauuacuuuacuauagaugauaaacaguaccuguuuuaucaucuauaaaaugagggugauaacguaccuacuucauaggauugcucuaaggaucaagugaguuaauaucaugauggugcgggagccacaauuaccuuuuuaguugaucaguuuccuuuuuguaacaguaaugaauuggaagggacaacaggaaccgggaguaguugaaaaggauacuagcaagaaagaaagaaccaaugggagugagaaaaagugaugauggaguagggggcugauagccaaucucaacacgcagaucucugucuuuauuggagucgcuggggugcagagauccaguuugcaucuaagggagucugacacguaucuauuaacaaguccaaagguaaagcuguugucuaagcaagcccugcgccuccuccagucuaauggaacagcaaaaugacauaccaggagcccuuuagugacuuacuuaaagcuaaaaguuugaacucuugccccugaagaagagauugcaucucggcuuucaguguggccuguggcuuaagcuauggagauaauuuugagggauuuuaaaaauauaaggucaucuagaguacuugucuuucaguuuuuucuuuuuaguugcccuucacuauuucuguaauguuggcccgcuuuacguuuagugaguuccaggaauacuguuauaaugcugacugucuucuauuucccugucccuaaagauuuagcaagaugagagucucuaauuauuaugaugcuuagcugggauuugguucaaaauaguuuaaacaguuuauucuaccuagaauguccucucucuucucugcacguccuuaguaaccccuguggcccacuucuuacuuaggucucuccuaacauguaucuaugacacauugaucccuaacagcuaugauucuucuuauacuuuuucaguaauuuaaauuuuaucauucuacugcuuguucaauacaucucucuauguaaaucuugacuccauaaugagguuuuuaacuucgaagggguuggaaguuaucugcugccuugguacccccccgccauuacacaagaguacauuuuaagcacauuacaccugagugauuguuguaaaacacagaugcaaucuuuccaccauccucuaagaauucuucuguggcuuccauugguuaccaaaaaaagucuguguccagugcacaagaccaugacccagcucagccugguccuugccuccuugucuaacucccucuccuucggguauccaggauuuguucgugcuaacagacagacuucucuaauaggugaauuccuugguggggguggguggcaugccuuugcauauugcuuucucucugcugagaaugcaagccugucccuagccguuucugccacuccuccugaucuggugaguuugaucugccuuucacaaugaaucccagucaguaaauauuuaucacugacaugcugacccuggcaaaaauugaugagagacucaacuaaggcagugauagugaagguacagauuugacaucugguuaggacauaggguugacaaacuuugucacucuuuagguguagaggaaauacccaaugaagagguugaaaauguguugaguuuuacaauugacuggagcuuucuaggggccacaauaaaggcaauuggugaguauaguuguuuuaaaaauauccaguaucuguuaagcauuuaccaugugcagggauauggcaggcacuucacauuaauuguuuuauuuauuccuuaacaacaguuuuguaagguaaguaguauuauuaacccuauuuacagaugacagaacuggggcuuagugaaagucuuuuagaaacaaaaucuugguaccuuccauauauaccuaaagugugaaaguaauugggccuggggucauagagcuguauagauuuuuuaugauaauuggaaaauguauaaucuuauuauauauuuaugaugauuauuaacuugcauuugaaggcugugaacagggcauaugcuuaaauugcuguggccuaacaauuccuguuguuacacuugcucaacucacagguuauuuuccuggcuucauauaugcaaguuugacauugcuguucaaagacuuuaaauuuagaauucucuuuuaaaaauguaaaugggauuuugccuuagaacagcaagccacugacauuuugugcagaauguaguauacauaaugcagaguuuuacacagaaaacuuggcaggcauguguggaacggcugcagacagggacagccuauaauugugggugcaacccgcguguguguagggaggggggugaagcagcgagaaggguggagggcagcagcuggggaccagaggagaaguagugugacucggugaccaaggagaagaaaagggugcuuccacaguuuugaaaauaaggaguuugccaaaaauuguaaagucuaaaugcagaccuuguuuggaauaaagaugaauuucguuuuagcucuguauccuuuggcaacccuuuuuuuccccucucauuuuuuuuccugcgugaaaaagagggaaagggguccauccagucaugcauaugaauguuucuauaccagaguaguaaauauaugcaucuuaugccuucgugugguccuuuguaacugugaauuaugauuuuggaaagcuguguuuuuuuaaucuuguuucuguaaggauaaauuaaucaaaguuaaccucucaaaaaaguccugguucuguaggggggaaaaaaaacaacaacugauuuucaaaaaucuauuaguggggaagacuauauuauacaaauagucaugagcauuucugggaacuggcuuccaauaucccagacagcgugaccugaaugugaaaaaaguugagaccacuaguuuugagccaaaaucauacaagcaaagagaaagcaagcuguugcccaagauugugggguaaccauauguuugagccaggacuugaugaaguaauugugcgcaggaccccguagggguacugggccguagcccacagagcacugcaggccccugcucaaagcagaccacaugaaggcccacacagacugagucugguccugcugguggccgcagcaaguaagaaacaaaguggguuauuaacauccacuggaaucuuaaccucauuuaaaggaaaacuugacuuugaguuaacuguaucccccccaccccccgcugucaagaacccaccucucuagcucauuccugugucaguguugccguauuaacugcccaccugcugcuuuguaaaaggagacuagaguuuacccuucuuauuuuagaauguuuugaauucucuuuuuuaaugcaauaaauuuaauuuaccuuuuuuuuuuaaccuacaauaagauugauuccuuuugguguacagucguguugugacuuuugacagugcauucagucauguaaccacugcccauaacagaaacauagaucgguucugucaccucuccccugccccagauguucuuguguugcuuguguacagucaguccuguccucuacccccagccagaaaccaguaaucugguuucuguuucuguuuuucugccuuuuccagaaugucauaaaaauggaauaguauaguauauagccuuuagucuggcuuuguucacuuaccauaauuaauuuaaaaauaaaugucuuaaagcguagaaaccaugaucauuuuaauuuguaauggagaaauuuuuuauugcuuuuaguauauugagaacuuguggaucacacuguauuugaaauuauuaaugcuggauguuaaaaggucacuaaaaguauguacuuuuuagaaaauuuauuucacuguauuuuauuaguauuauaccuuauauacugagucugggacauagaagucuuaauuucuacugcaaaauggauuuuuuuuuuuuuuuuugagauggaguuucgcucucguuguccaggcuggaguacaauggcacgaucucggcucaccacaaccuccgccucccggguucaagcgauucucccaccucagccucccaaguagcugggauuacaggcaugcaccucuaugcccagauaagguuuguauuuuuaguagagacgggguuucucuauguuggucagguuggucucgaacuccugaccucaggugauccacccgccucagccucccaaagugcugggauuauaggugugagccacugcgcccggccgaaaauuuauauuuuuaaagcgaaagcuaacuucuaauuuugaaaauuuuuauugggagcaggauauuauaauaauaaucuuuaguuguuaaaccauuaaacaucaagguuuuuuacauuguuucuaugccuccucccucaaaaaaaaaaaaccuccuacaauaaaacugaaaaauugcacaaagacauauuaguggaagaccacugcuucguuuacacaaaugaagaguauaaagcagagaagugcuccuuggggcaaaaggcaauuggcaaaaagcuaaggaacauuuucauaaugaguuagaaauacagaucaucaggaauauccaggaagcgauagugaauaccaggcaggcuuaagagacaggaaacauuuagcauguugguaaaccacuuuagcacaucagcaaaagcauauaaacagcuuuaggauuggaaauuauugccauggggaaaggcaacaauuuagaggagcaauuccaauuaaaaauauaaagaucguuucuuuagauuaauucuugaguugcuccccuaugccuguguagcagaaucuaaaagauaaucaugugaacgggagauuauauuuaaaaaauaaacuuugaaauucauaaaaaggaaaauguuaaagaauguaaaauuauacugguagaaaaaaaauuuuuuuuuuugaagauggaguuucacucuuguugcccaagcuggcgugcaauggcacgaucucugcucacugcaaccuccaccucccagguucaagcaauucuccugccucagccucccaaguagcugagauuacaggcacgcgccaccacgccuggcuaauuuuuuguauuuuuaguagaaacgggguuucaccauguuggccaggcuggucucgaacuccugaccucaagugaucugcccaccucggccucccaaagugcugggauuacaggcaugagccauugcacccggcagaaauuuuuuaaaauagaaaaaaauagcccauucaugauacaugaauuaaagaaaauauugguaacauguaugguaacagauuaguagcugagaacccaaaggcugccccagguugcuucaaauccugguucugccauguuccagcugugugaccuugggcaaacuaucuuacccuuuguuucaguuuccucaucaggaaaaugggcuuuaauaggauuauuguguggauugaguuaauaaguaaagugcuuagaacaggccuccaaaauaguaaguguuguaugcguuagcuauuauuaauacaucacaaauuuccacuaaagaaaaucuucccuaguuuguauaugggauugucagaaaacaaauggaaaaaucauaguauaaacagccuauauggcuuuaaagaauuauauaaaacacaugaucuuucugaaguaguuuuuuaaaagaaaaaaguuagaacuaacuucucccuugauuuucacuuuuuagaguggugaaaccagaacaauaucucacuuucauuauacuaccuggccagauuuuggagucccugaaucaccagcuucauuucucaauuucuuguuuaaagugagagaaucuggcuccuugaacccugaccaugggccugcggugauccacuguagugcaggcauugggcgcucuggcaccuucucucugguagacacuugucuuguuuugguaagugcuucuuacgaucucauuuuaaucucauugauuuuuuuuuuuaaauugcuuccacuggcagugaauaaacucugaugcuguaucccagaacugagguuuuucaacuuaaacuucuacuuuuggaaaaaccuaaaaaucucauuuccaccguugcaacugccucuuauucaugacugguaggaauguauccaugaugauuuuagagaucccuaagaagguguuuuucuuccugguagcuuuauauuacagaaauaauaggucucucccccacauuuuuucaaauauaaauucauauguaauauugaauuccuuccuccucagacagauacuuuaucucauuuuuuaaauuuaaaaacuagggauaaugauagacauacuucacaggguuccugugagaauucaaugaauuaauacauuaaggagacuuagaagagucccugauguuuucugagcauuccauaaaugucaguauuacuguuacuccccugagguuccugucugugcccccaacggcuaauucuuucuccaccagucauucccagucccagccuguauacagccuagaucuuuucuucucuuuuuaggaccuuuauuuuuucguuacuugggauacaugaaacuucuguuugcccuuauacuucuccuaacuucugucuuuacuucuuccucuuauuauaggaucaaacccaacaauaauacugucugcuuugauuuccaugccaucuacuccuucaguagucccugcagcuuaguuucugcuuucugagcguguucuaagauuaucaauaaccuaagcaguuuagcuuguccugguauucagucugguggggauuuuguuuuugucuuuguuuagacagagucuugcccugucacccaggcuggaguacaauggugcaaucacugcucacugcagccucaaccuccuggacucaagugauccucccaccucagccucccaaguagcugccugcaccaccacacccaacuaguuuuugcuuuuuuauuuuuaguagagacaaggccucacuaucuuggccaggcuagucucaaauuccugggcucaagugaucuucuugccucagccugccaaaaugcugggauuacagguuugagccaccacgcuugacacaagacugguguucuuaaccuugacuuuaaggcccuguauuagucucuucgauguuucuguaaaacguagcuaugcuucauugcaguuaugucagcauucuuaugcuuuccaccaugacugccagcacaaaguagauucccaggugaauuaauaugaugaugcuuuucauuguaaacacacacacaaggagcuugaucaauggagugauacucuuggaaggagugauacucuuggaagaacauuucagacguugcaucucuaaugaaagcuaggaauugggaacgguugagucuuaacuaaacaucuguauuacuuuaccacucugcguauauauaguauacuucaaucaaaauuagauuguuacaucaaaguuuuaaaacucuggugauuauuuuguuaaugacaccuguucccugccaacuauaacuucaacaauuuuuuuucuuuuauuuuuggugagccuggguguggggauucuaacacuaggucaguaguccagagcagugcuguagcucagcaguguuaucguggaucugggcuuuugcugucuuuuccaccgucuuucuucauuuuauuuuauuauucuauuuauuuauuuauuuauuuauuugagacgaaguuucgcucuguugccaggguggagugcaguggugcaaucucagcucacugcaaccuccgccucccggguucaagagauucuccugccucagccucccgaguagcugggacuacaagugcguaccaccaugcccagcuaauuuuuguauuuuuaguagagacgggguuuuaccauguuguccaggaaggucucaaucucuugaccucauaaucugcccaccuuggccucccaaagugcugggauuacaggugugacccaccacauuuuuauuuauuuauuuauuuauuuauuuauuuauuuauuuauuuauuuauuuuugagauggagucucgcucugucgcccaggcuggaguauaguggcacuaucugaccucacugcaaccgccgccuccuggguucaggcgauucuccagccucagccuccaauguagcugggauuacagacaugcgccgccacacccagcuaauuuuuguauuuuuaguagagauggcauuucgcgauguuggccaggcuggucucuagcuccuggccucaagugauuuggccucccaaaguguugggauuacaggcaugagccaucaugccuggccucuuuuccaccauuguuagaugggugcuguauauccagacaucgugucuguagugcagacaugaaggaggcggaaggggaaugagcagaaagguugacuccugccaugacuuuuaaaaaaaaaaauaguccuuauacuagccagaacugguuauaaauccuuccuuuaaccaaugacuggccagaaggaaugagauuacuaugauugguuuggaaucaguugugaaucagcuaaagaaucaaaguccuccaacuacuugagggguugagauguggggagggaugaguaggcugggauaguuguuguguacauaacaguuauagcuggaggguuaaauuaucguuguucuuucagaggagaaaaugcauagcaaaaaucuuagcaaugaucuugcauugauucuguuuccuggguuccaauaacaagacuugucucauuuuuugccuuucuugcagauggaaaaaggagaugauauuaacauaaaacaaguguuacugaacaugagaaaauaccgaaugggucuuauucagaccccagaucaacugagauucucauacauggcuauaauagaaggagcaaaauguauaaagggagauucuaguauacagguaaacuucauacagguuuuaaaucauaucuauuuguuaaauacacauagcaucaaauaacugcacuccacuugagcccuugucuuuguuucaaagaguguauuugaauuuuugugguaaauccagcuggcugucuuaaaauuguaaaauuuuagcuagcuuccucauauauacucagccucagguuaaauccuguguguuacuuaaaagcccuuguagaaacaagauuucauuaaagaaacugaauuuuucauuuugggggugguuaaucuuuuaauuauuaaaguaacuggaaacuugagauacuuuugccuucauuaaacacugauacuugguuuaugugauauuugacuuuauaacaacaagcaacuugaauauuuauggcagauauaaugaaauuccagcaaaauguuauauucuucugguugguggcuuuauucucauuaagcuauuuuuacugcauauuuguagaaccuaaguucaaagacugaucagaaacuuguguuauguacuaaguuaaaauguaaaauagaaacaaccacagacuccauuuuuugucugguuuaaucacauaguauuggacauaagcagauacuguaaguugaugcauaauauaagaagaucgacugucuuuucauuauguuucucaugugugaacauauuuacuagcacuuucauuucucugauuacuagccaauauaagaauguaaauuagaucggaccauuggugucagaauaaagguuuauuuaaaaagauuuuuuccaaaucuuuaaauagcauuaaaauauucuuaaugcacagaaacauuagggcacucagagccaaaauacgcaauguuugggaaacucagcccauuagaacauguccugcuucagacgccagacuuugggaacacuggauuugccagggucacuuuggcagugaucagugauuuaggugaaguaaaaguuauuucagauguuuaagauuaggaaaauuucccuuucuaaucacagugagcuuucaccaacuuaaaucuggaguucaaaaagaaaaguaguucaaucagauuuccccaugccuucacagccugcaugccgccuucccugccugcuuccuggcugugaugagacggguaacugggagggaaauguauuguccuuuggauugugucuuuccuaccacugcuuuuuuuuuuuuuaaguuuugugucuuuaguuuuagaauacauacuuuaucugaggguggaucuuuuuuuaucacagagaugaguuuuucuggacacacuuuuuuguggagucuuugacagugcaguuuguggcuaggaaggauuuuuuuucuguuaauuuaucuggugugauauuguccucaggcucucaauucuaaggcauuuucugccccuauuccagauaggauauuggaaacaucuuuauccuucagguacucaggaucagaaaagcaugcugcccauuccaagggguuaauuucugcagaaauggucuuggcauucugagaaucuuuuuuaauuggugcauuuagaccaucggcauaugaagugauuacugauaaaguuggauuaauaaauacauaccacacaugcuacugguuuuuuuuucuuuuuuugagacgcaguuuugcucuuguugcccagacuggagugcaauggcacaaucucgguucacugcagccucugccucccagguucaagugguucuccccacucagccuuccgaguaguugggauuacaggugccugccaccacuccuggcuaauuuugcauuuuuaguagagaugggguuucacaguguugaccaggcuggucucgaacuccugaccucaagugaucgcccaccucggcgucccaaagugcugagauuacaggcgugagccaccgcacccagcccaaagugauuguaucuuaagucuguaaauauguguaauuauaaucuuaaagcauguauucauuuacagaaaacuuccaaugacuuugacauuccuauagacauauaggcuauuugcaauugccuuucagcacaaggucaggcauaaauacuuaagcugguugcugguauuaccacauauuuauuagcauauucccaguauugaugaugacaguuaaccccccagaguaaauaucuaguuuggcaauucagaacuaauguuguaagaucucuagcugguaauuugauauuacuaauaaaguauuaaauguaaaugauaaacuuuuaacaaauuacagaggauuugaaguuuaauugcauugcuuaaagcuuucuucagugagagaaauggguagagcuaggguucuaggcauuguguggggggcauggcuccuaguggcagugacucauggguuggugcaacgugagcacagaauuagaaagaaagaugaaacaguaccaggccucaaaaugagagcuccuuugagguuauaguuuagugaaauguaauuccuuggcuucaccagucagcauuaaugaccugaggcaggugacucaggagugcuggcucccuugugugucacagggaggacagagacgagugaguuugcugaaccuauauaggcaugagugaguuugcugaacauaggcacgagugagucugcugaucauagccaugaaugagucugucgaacauagccaugagugaguuugcugaacauagccauggcaaaaugacauuguuggguuugugggguuuuuuuaauucacuagcauuaaauaucucuuuuauuucucucucugccgagugcuuuccuuguugacguauucugaauuuguugcauauucugggaagugguccagugagacuugauuuuuggugucaucuuauuuguugacauuguugaguguuguccagcuauaaggccaaguuacauaacuaggucucagucaagaguggaaacuucaaaaauugaccaguguaaauucuggagacaauuuaacauuuuugugggguacuuuguugaacacacaucuuuauaaggggucacagcauagucaacccagacuugccuagguuaaaauucugucucuacuauuuguuaggugcauauccuugggcgaguuaccuaauuauucuccccacaucuuccguaaaaaggguguaauaaugguaauauuaguauuagugcuuaucuccuaagguuauugugaggauuaagagcuagcacauuugaaguguuagaauauggcauggagaguagcaaguacuccaugucuucacuauaaaagauuuggauugaguaacaaaacaaacaagggaacaaagaaaauagacagucaucuaagugaagacauccuuaauuacuccuguguuccauuauauuguaguuucuugauuguuggcacaguauucuuucggggacaugguuugcgcccucuuagggcucaggauuuucaguucuaccccacuacucaugaaguccagagaccucuuucccggaggucuauuuccuuuccagccucaucucuccuacucaagcuuugcguguuuuccauccucuagacaaauuguaccaaacuguacuacuaacuguucuccaaacacaacaaacuguagaauuucacauuuucuaaaucuucuguaaaucaacuauuauaaaacaaaaaagccagccgugguaguucucuccuauagucccagcuacucaggaaucugagacaggaggacugcuugagcccaggaguuugaggcuacagugagcugugaucacaccauugcauucuggccugggcaacagaguaagaccccaucucuaaaaaaauuaaaaacauaaaaagagguacauugauuaugcagcuaaguaaaauagccauaucugggaacggugaaguguggaaaaugcuuuuuuuuuugaaacagaguuucacuguuguugcccaggcuggauugcaguggcgugaucucggcucacugcaaccuccgccucccagauucaugcaauucuccugccucagccucccaaguagcugggauuacaggcuugcaccaccaugccuggcuaauuuuguauuuuuaguagagacaggguuucuccaugacaccgagucucaucuuucacccaggcuagaguacaguggcacaaucucagcucacuacaaccucggccucccggguucaagcaauucuucuaccucagccucccaaguaacugggauuacaggcaugugccaccacacccagcuaauuuuuguauuuuugguagagaugggguuucaccauguugcccaggcuggucucaaacuccugaccucaagugaucugcccaccucagccucccaaagugcugagauuacaggcaugagccacugugccaggcgugccuuuuucuuuuuaauaccucugguacaugaugacaaugagacaaauuagaaacuaguuuauccauuguaugaauggauuucccagagauuuuuuaaagaucugaauacaagcauugcuuuuaacaguaccauauugcacaagaguaacuccagggaaugaauauuccauaaguucuaaaaaacuuuaaguugcaauguuacaucucuguccaaaaucauuagacuccucgggcaauaaguagaguauuccuuauuuauuagauccaagacuccuugcguccuugauaggaucuucaaagaaggccaucccuguccauaccaagucauuugggccagugucagucauagguaaucaaaaccauuggcucccacugcuucugccucuaccacuugccacuggcagauacauagauggggaucauguuucauccuuucaaggacuugagagacuauagucccagugcauagguuauauaugcguuuuucuucucuggcauguacaauugucacugcuuucaucugcaggggcccagauacacucuucuuccucuaccuuugucccuaggaauggugacaagugagagcacaggaaacauauuuucuagacaugaugcugggcgcuucacaugccaucucauuaaucacaacugucucccaggguagaugaugacauccucuuucauagaagaaacugaaauuugucuucaucuugguccgaauccugguuuguguugccaucuacuccugaaggccaugcuagaggcaugcuggaggguguuucucuagcccaguggugggcuagccagcugccuggagcugcuagcguaccugauagacacaaccaaauuaaaguccuuuagcaucacaaggaccagcuuggagaucucaccguuaguucuccccuagacugaacaguggcaaggagcaagaagguuccagaucacauucaagcaccacuguggugacuacuccaguguuacauaccucuggauuagaaguggauuaagauucaagcaaaaucuaccuuggcugaaaucuuuuuaaaaauuuuuguguuuuuugugcagugcuacuuuauuuuuuauuuuguuuuuuugucuguugguugguugguucuuuugagacggagucucgcucugucgcccaggagugcaguggugugaucucagcucacugcaaccuccgccuccuggggucaagugauucuccuaccucagccucccgaguagcugggacuauaggcgugugccaccacacccagcuaauuauuuuguauuuuuaguagagaugggguuucaccauguuagcuaggauggucucgaucuccugaccucuugauccaccugccucagccucccaaaguguugggauuacaggcgugagccaccgcaugccccggccuuuguuuuuaauugacacuuaguaauuguacauauuuaugggguucagugugauauuuugauacauuuauguaaugaccaaauuagacuagcacgucuaucaccucauacauuuaucuuuucuuuguggugaaaacguucaaaauccucucuuccagcuauuuugaaaucucuauuuaauuauauauuauuaugugcuaauauauuucauaguacuugaaauauauauaaguauauauaaguauuucgaaauagccagaagagaggauuuuauguguauauaaaauguguauguauauaaauuuuuuucgagauagggucucauucucuuguucaugcugguguacaguggcacgaucauggcucgcucacuguagccuccgccuccugggcucaagugauccuccugcccuagucucuuaaguaauugggacugcaggcgcgugccaccacauauggcuaauuuuuaaauuuuuguagagacugggucucaccauguugcccaggcugaucucaaacuccugggcucaagcgaucugcccgcccuagccucccaaacugcuagaauugcaggcaugagccaccacacccugucugaaauauuaaauauuauuaaccauagucauucugugcaguaaaacaccagaacucaucccccuguugaacuguuguucaguuucucacuaugcccccucuucccuacucugcgaagccuccaguagguacuauucuacucucugcuucuaugagauuaacauuuuuagauuccacauaugagugagaacauacaguauuugucuuuguguacuuggcuuaauguccuccaguuucauccauuuugccacaaaagacaggauuucuuuuuuuuuuaauggccaaauaguauuauauuauauauauauauauauauuuuuuuuuuuuuuuuuuuccacauuuucuuucucccuccauucauugauggacauuuagguugauuccguaucuugacuacugugaauagugcugcaauaagcacaggagugccgauaugccuuugaaauccuaauuucauuuccuuuggauaaauacccaguagugggauugcuggaucauaugauaguucuauuuuuaaucuuuuaaggaaccuuuaugcuguuuuccaagauggcuguacuaauuuacauuccaccagccguguacaagaguuccccuuucuccacauucaugccagcauuuauuuuuugucuuuuugauaauagucauucuaauugggguguggugauaucucagugugguauugauuugcauuauucugaugauuagugauauugaccauuuucucauguaucuguuggcucuuuguaugucuuuuaagaaauggcuauucaggucuuuuaccuauuuuuaauuggauuacuuguguuuucugcuauugaauuuuguuugaguuucuuauauauucuggauauuaaucccugucaaauguauaguuugcagauauuuucuuccauucuguagauugucucuucagucuaucgauugcuuccuuugcuauacagaagcuuuuuaguuugauguaaucccauuugucuguuuuugcuuuugaggucuuauacaaaagacccuucccuugcccagaccaauguccugaaguguuucccuaucuuuucuucuaguauguauauuuguuuggggucucauauuuaagucuuuaguccauuuugaguugauuuuuuaauauggugagagauaggggucuaguuucauucuugggcaucuagauauccaguguucccaacaccauuuaucaaagagacuguccuucaccaguguauauucuuggcaucuuugucaaaaauaaauuggcuguaaauacguagauuuauuuccaugcucugucuucuguuuuauuggucuuuauaccuguucuuaugauaguagcaugcuauuuugguuacuauagcuuuguaguauauuuugaggucagguagugugaugcccccagcuuuuugcucaaaauugcuuuggcuuuuggggucuuuuaugauuucauacaaauuuuaggauuauuuauucuguuucugugaagaauaucauugguauuuucauugaauugcauugaaucuguagaucacuuuauguaguauggacauuuuaacaguauuaauuuuaauccaugaacauaggcuaucuuuccauuuguguccucuucaacuuuuuccauuaauguuuuauaauuuucauuauagagaucuuucaccuccuugguuaaauuuauuccuagguaauuuuuuugaaaauggaauugcuuucuugauuucuuuuuucagauaguuuguuagugauguauaaaauucuacugauuuuuauuuguugauuuuguauccugcaacuuuacugauuuuuuuuauuaguuauaacaguuuuuugguagagucuauaggguuuucuauacauaagauuaugucuucugcaaacagagacaauuugacuuccuccuuuccaauuugaauacccuuucucuuagcuaauugcucuggcuaggacuuacaguauuaugcugaauaaaaguguugaaagugggcauccuagcccggugcgguggcucaugccuguaaucccagcacuuuggggggcugagaugggcagaucaugaggucaagagauugagaccacccuggccaacauggugaaacucugccucuacuaaaaauacaaaaauuagcuggguaugcuggcacgcgccuguagucccagcuacucgggaggcugaggcaggagaaucgcuugaaccugggaggcagagguugcagaucaugccacugcacuccagccuggugacagagcaagacuccaucucaaaaaaaaaaaaaaaaaagaaaggaggcaucuuugucuuguuccagaucuuaagaggaaaagcuuucaacuuuuucauguucaguaugauauuaacuauggguuugucauaacguggcuuuguguugaggcacaauuuccuccauacuuaauuuguugagaguuuuuaucaugaagguauguugaauuuuuuuuuuuuuuugagacagagucuugcucuguugcccaggcuggagugcaguggugcaaucucggcucacugcuaccuccgccuucuggguucaagcgauucucaugccucagccaccugaguggcugggauuacaggcaugcaccaccacacccagcuauuuuuuguauuuauaguagagaugggguuucaccauguuggccagaccagucccaaacgccugaccucaagugauucacccaccucagccucccaaagugcugggauuacaggcaugaaccaccacgcccagccgcuauguugaauuuuaucaaaugguuuuucugcaucuguugaaaugaucauaugguucuuguccuugauucuguugauuuuugagagaucauguuuauugauuuacauauguugaaccauccuuucaucccuuggaugaaucccacuuggucaugguaaaugauguuuuuaauauacuguugaauucaauuugcuauuauuucauucaggauuuuugcauccauauucaucaaggauauuggccuguaguuuucuuuuuuguuguguccuugucugguuuugguaucaggguaaugcuggccuuacagaaugauuuuggaagauuucccucuucaguuuuuugaauagugugaaaggaauuaguauuauuuaaauguuuguuagaauucagccaugaagccaucaaguccgggcuuuucuuugaugggagacuuuuuauuacugauuuaaucucacucuuuauuggucaguucagguuuucuaugucuucaugguuccguuuugauaguucgugugugucuaagaauuuagccauuuccucuaggcuuuucaauuuguuggcauacaguuguuuauaauagucucuuacaauacuuuguuuaugguauuaguuguaauaucuccuuuuucaucucugauuugagucuuuuuuuuuucuuagucugcuauagguuuguugauuuuguuugccuuuucaaaaaaaugauccuugguuuuguugaucuuucguuucuuuuuuuuggucacuuuauuuccauucuucuggucuuuauuauuuucuuuguucugcuaauuuuggguuuaguuuauuauuuucuaguuccuugagguacaucagguuguuuauuugagaacuuucuuuuucuuuuuuuuuuuuuuuuuuuugagacaguuucacucugaccccuagacuggagugcaguggcaugauuuuggcucagugcaaccuccgccucccggguucaagugauucuuaugccucagcuucccaaauacuuggaauuacaggugcccaccaccacuccuggcuaauuuaugguagagauggcauuucaccauguuggccaggcuggucucaaacuccucaccucaggugauccuccagccucuaccucccaaaguucuugggugugagccacccaccuggccugauugugauuuuuuucuuuuuuuaauuuguugagacuuguuuuuguggccuaacauaugguccaucauggagaauguuccaugugcugaugagaaaaauguguauucuguggcuguuggagggaauguucuguaaauguguguuagguccauuuggccuagagugcaguuuaaauccaauguuuuuuuguugauuuuaugucuggaugaucuguccauugcugaaagugggauguagcguucuccugcuauuauuguauugcagucuaugucucccuuuagauguaauaauacuugcuuuauauauuugugugcaccaguguugugugcauagauauuuaaaaucauuacauccuccugcugaacugaccccuuugaccuuuguuucuuuuuacaauuuuugaccuaaagucuauuuuaucaaaauauagcuacuccucuucucuuuuugguuuuaauuugcauggaguaucauuucucaucccuucacuuucagucuuaguguguccuuacaggugaagugagugucuuguaggcaacauagaguuggauuuuguuuuuuguuuuuucauccauucagccacuguaucuuuucauugaaguauuuaaucuauuuacauucaaggguauuauugauagauaaggacuuacaccugccauuuuguuaauuguuuucuguuugcuuuucauauucuuuauuccuuucuuucucucuuauuguuuaccuuugugguuuggugauuuucuauagugauaagcuuugauuuauuucucuuucucauuugugugucugcuguaguuacuuuuuuucuuugugguuacucuggggcuuacauuaaacaucuuagaguguuuuaagcugauaauaacuuaaccuuggucucauaaaauauuuuuggcuuuuacccuccccccacaacuuauaauuuuguugcuuaauuuacaucuuuuuauauugugugguccuuaacaacuuguagcuguaguuaccauuaaccauuuuuuacuuuuaaccuucauaauggagauuugaaagauuauauuccacaguuacagcaauggaguuuucugaauuugguaauuaauuuaccucugucagugagauuauauuuucauauauuuucaugauaguaauuauacuuuugcuuccagucaaagcagcucccuuaagcauuucuuguaaggcuagucuagugguaauaaauucuugcagcuuuugcuugucugggaaagacuccauuuuucuuucauuucugaaagauagcuuugcuaguaguuguuaucuuucagcacuuugaauauauuaucccauucucuacagucuguucuuucuuggcguguacagguuuucugagaaaucuguuaauagcaaccugccagguucccuuacaugugacuugauccuuuucucuugcugcuuuuagaauucucuaugucugacuuuugauggcuuuauuauaauguaccuuggagagaggaccucuuugcauugaauguguucagugugcugucgaguuucauggaucuggcuaccaauauuaaaauuauauuacugugacuaauaguugaguguggucccaguauaguuugucucaaauagguaaaaguccacaagauuuuauuaagauuauuauauucaacuauauacucauguacauaaauacuaaaugcuuuauuauaaaauuuugaaauuaaaauaagcauaguuguuacaagcuacaguauggcaaaaugccuuuuucuuuuucacucaucuuuuagcaucauuggguuuucuuaacuugaauauaggauuuuaauucauaaauuuuuuuauuuaaggaaaauaaauuuuuaauguuugcauuuguuuuucauuucucuucccuaccuagaaacgauggaaagaacuuucuaaggaagacuuaucuccugccuuugaucauucaccaaacaaaauaaugacugaaaaauacaaugggaacagaauaggucuagaagaagaaaaacugacaggugaccgauguacaggacuuuccucuaaaaugcaagauacaauggaggagaacagugagagguaagcuuucuauaacuacaggcugaaagaugaggcuuuuuuauuuuaaaaauaaauuuuaugggaccaggugccauaggauuucagguauguaauuuuuauauuaggaaaauacaaucacgccuguaaucucaacacuuugggaggccaaggagggaagaucacuugagucuaggaguuugaaaccagccugggcaacauagugagaccuuaucucuacagaaaauaaacaaaauuagccagguguggugaugcgagccuguggucccagccacucgggagacugaagugggaggaucacuugagcuggggaggucgagguugcagugagcugacauaccaccacugcacucccaccugggugacaaagcaagacccugucucauaaauaauaauaauaaauaaauaauuauguggauaugauauaugaaauaauauaggcccuuuuuuuuauugaauuaauauaaccuuuuuuuuucucugucacccaggcuagagugcgguggcacaaccuuagcugcuccaccuccuggguucaagcaauucuccugccucagcccucccauguagcugggauuacaggcgcccaccaccauguccagcuaauuuuuguauuuuuaguagagagaggguuucaccauguuaacaaggcuggucuugaacuccugaccucaggucauccacccgccucagccucccaaagugcugggauuacaggcgugagccaccgugcccagccaaauuaauauaaccuuuauuucuuaccugaggguauuuaguauaugaugacaaagguguucuuaaggagcuuucagccaauacuuagaaaccaguucaaaaauccuuuaaaacaauaaugauugaguguaaaaguuaauauaauugggugcuaaaauauaugguaugguacagaaaauaaguaguaugaauaccugccauuuguacuauaauuauaauguaacugauaauaugccuuuaauaaaacauuuaaacauguaagcuuaauugcauuacuggagaaagaaaaaggcguuuuuuaaaaauccauaugaauguggcaucuauucagaauuuuaaauuacaauuacauuucuaagacugucucucacagauuaggaagcugauaaccugguauaagucacauagcaaagugaaugagguuuuucuuuccucucuccugcaucucugaauaacuuuucuucuucucuuuuugccaaauauacuucuuaucauggggaauuuuaucuugugguuauauuuguuagauuggaaugaaaauagucgaagucugccauacauuauagcuuuacugcuguauuuuccuaauauaaaaauuaaauaccugaaauuuuauaaaugcuaacauauuccaauauauaauacauguauuauuauauauuauaguggaagaguuuauuaugauuuaguaauguuauucccaauuuuugacuucaguaguuuuagacugcaagagaaagcauaauuuuuuugguuccuuuuuucaucuuaaauagaauaucuuuaaaucaggaaauaauaguuuuaaguuaccuuagcuuuuucaauaauaaggcuuucagauuccuaguguuacugcuuuuuccccccuuuuaucuaguacuaucugcagaauuaaaugaaaaacaggcuugaugacugaaauggcauucuuaguauuucagaaguguugaguuuuaaucuacaaagauucagaacaaccauguuaauccuagugaguuaaaucacucauacaagcuugcaaauacagaggagacuacuaaaaccacucuagagucuauaacucuaaggaguuauagagugauugcagaagacuguuuuauggggucuguguguguguuuaugugccuguacauguuuucgcaugugguggcgguguuuucuucuuucccuuuuuuccuucccugucugauaaaugagacuggugcauguuugaaagcagagagucccaacagaaaagucagaauucuaagcggagaagucugauuacaaaaacaagguuacagaaaugaaaaagaggaggccgggcgugguggcucacgcuuguaaucucagugcugugggaggucaaggcagguggaucacuugaggucaggaguuugagaccagccuggccaacauggugaaaccccgucucugcugaaaauacaaaaauuaaccaggcacugagagugagaaacaacuuggacauacgaauuuuaaaauacaaaaauuaaagaggcauuaacgccuguugucccagcuucuugggaggcugaggugggagaauugcuugaacccaggagguugcagugagccgagaucauaacacugcacuccagacugggcaacagagcaagacucuuaucucaaaaaaaaaaaaauguaaaagaagagcauaggaucagggugugaaguaaagguuacucugaacaguuuuauuuuuuaaucagucccaguaauuuuuaauaccuauagauagcuuugcauuaaagauccucauaaaagucuuaucaaaagaauuucaaguuucuuuuuuuucuuuuuuuuuuuccugagacggagucuugcucugucacccaggcugaagugcaguggcgcagucuuggcucacugcaaccuccaccucccggguucaagcaauucuccugccuuagccucccaaguagcugggauuacaggcccccgccacuacacccagcuaauuuuuguauuuuuaguagaggcaggguuucaccauguuggccaggcuggucucgaacuccugaccuugugauccucccgccucagccucccaaagugcugggauuacagacaugagccaccacaccuggccagaauuucaacuuucaaaagaaauagaacacaguacuuucuuguauucauuuucauuguauucauuuggaggauauucauccuccaaagcaguguuuuucaaauugaaggucaaaucacauagucgugaaguuuauuggauuauaaacauuuuuuaaagaagaaaauagaauaaaauagaaauuaucagcauaucacaaauaauaacaugaauuuaacagaugcuggcgagguuguggagaaaaaggaaugcuuaaacacuguuggugggaguauaaauuaguucaacuauuguggaagacaguguggugauuccucaaagaccuaaaaacagaaauaccauucaacccagcaaucccauuacuggguauacacccaaaagaauauaaaucauuguacuguaaagauguaaacacacgcguauguugauugcagcacuauucaccauagaaaagacauggaaucaaucuaaaugccuaucaaugauagacugcauaaagaaaauguacauauacagcauggaauacuaugcauccauaauaaagaaugagaucauguccuuuguaggggcuuggauggagcuggaggccauuauccuuagcaaaacuaauggaggaacagaaaaccaaauaccccauguucuuacuaacaauugagagcuaaaugaugagaacacauggacacauagaggggaacaacacugggggccugucggaggauggagggugggaggagggggacaaucaggaaaaauaacuaauggguacuaggcuuaauaccugggugaugaaauaaucuguacaacaaaacuuguuguacaugucacggagaugacacaaguuucaagcuuauguaacaagccugcacauggacguaccccugaacuugaauuuuaaccuguuuuuauauauguaugugugauguauaaauuccauauauuuacauauacauuguguaccuauguaagugugugugugagguuacucuguugugaugcuauuucuuacuguagguugcagucugaauuugaaaggcaguauucucaauuacaguucaacccagaaacccagaucacugagagugagaaacaacuuggacauacgaaaagucuggagcaggcagaguggcucaugccuguaaucccaacacucggggaggcugaggcggguggaucacuugagccuagcaguucaagaccagccugcgcaacauggcaaacccugucucuacaaaaaauacaaaaauccgccaaauguggugggaccugccuguagucuuaagggaggcugaggugggaggauugcuugagcccaagagguugaggcuacagggagcuaugaucacgccacaugaucuucccugggcaaggguccacaggaggcauucccauugguuaauauccuaaauugcauaaauauacgggaaaaccugggcaggucccauuuggcaagucauuacacagacauaauuucuuuaggccccacuaaggaagaaaagauuuuaucacaaaucgagaguagucuugucauucucuggaauuguguucuuaaauuagauacaggcaugccuugguauuugucucuaguccauuccugaauuauauagugcacuuuuggaaagcaaaaaccucuguuccauucuuuuaaaugagaaaaauaguguguugucagcccaaccagaaagcauaaccaguucccccaaauauaguacaaaaccuuuuaaacuccuauguagcauuuaaagcacuaauuauguaaucauauaacacuuaagggacucauuauugggcuuguaugguaaaugacaaaauacuagauacaaauuauaauugccuucuauaccgcaaugaaaauaaaaaaugaaauaauacguuaaagauuauaucuaaauuggaaccuuguuaacgauacccccaggcuccuggcaaaagcuaauaaagggcccaugggaggcuaacccccucucuguuuuuauacauauuuugccuacacuugaacacaaauguuuucacuaacagguacaugcauauuugugauagugaauuuucaauucagagagugaauucugaguaagaauuuuugcaagucauuauagcagauauucagauggaguucagacagccagggauaccuguauauaugauaacaaaaagugaaaaagacaugagaaagcaccauaagaugaacaaagauagcaaaacccagucuguccucaaguugcagaauaugugaugaagauaaaacaaguacccaaguuagcacauuauuaguaaauuauaaauuacuucaaauuaaaugccguaagaauagaagggcuagaggggguggagcaagauaauugaagaguagaacugaaaugagaggacaggagagaagggaagguuucuauuuuaguggggaacaaauuuggagaacagcaaaaaaacggcaagaacaaaguucugcauagcaggagaauauuggcaagcguuugcauggacauguguucucaguucucuuggguacauaucuaggaguggaauugcuaggucauaugguaacucuauguuuaacuuuuugaggagcugucaaacuguuuucuguggcagcugaaccauuuuacauucccacuaacaaucucuuggggagagaagguuccaguacaccaaagaaguguaacauugauuaaaauauucuaauacauaguucaauucagauuucucuugucugaaagauucaccauauagcuuuuuuaauaaaguuuuauggaaauauaauuuauauagcauaaaguuuacucauuuaaaguauacaauucagugacuuuuaauauauuuaccaaauuguguagcuggcaccacgaucuaauuuuagaacauuuuccugaucccaacuucuguagcuguuuaaaaaauauuucaagauuaaucaaagauugauacuauauuuaguugaugugauucuuuggucuccuuuaaucuggaacuguucccugccuuuuucuuccuugcuugacauuuguauuuuugaagcuucuaggccagauaucuuuuagaaugccccauacaaugcauuucuuuaaucauuauuuaucauaguuaaauucagguuaaacgucuuggccaggaaaaagguagucucaauguaggagacauugaagaggcauuugagauuuuuaagcaccaucgugcacuaggcccgguaacgaaaaaaaaaaaaaaagauuuuaaaucaagcuacguguccagggguaugcucuagaaaaauuaccauggcaauaauauuuaauuugagggcagggaagcugguuaggccuuugcuguaauacagaaaagugaaaagagggaauggaagaaauaguaaccuauauguugccauuggccguuuuuuuguuuuugugggugugcuuuuauagagaggcaagacuugcuauauugcacaagcuggacuugaauuccugggcuuaagccguccuccugaguagcuggauggcauuauuauuuauauagaaccagaacuaaguaucuugagagucagagaccuuccacugaaacaaaauuucugagaccggacacaguggcucaugccuguaaucccagcacuuugggaggcugaggugggcggaucacuugagaucaggaguucaagaccagccuggcuaacauggugaaacaucaucucacuaaaaauacaaaaaaauuagccaggcgugguggugcacgucuguaaucccagcuacuugggaggcugaggcagaagaauugcuugaacccggaaggcggggguugcagugagccaagaucgugccacugcacucccgccugggcaacagaacaagacuccauccaccccgccucccccaccaccccaaaaaaauuucuguauugacuaugaaaaugggagguagaaauguguauggucaaauaaaagaauaagugcucccacaacagaauauucauggaaauauuaaauagcuagcuuuuauaagagccuuaaccaucaaacgugaccaggaaaugggaucagaugcaagugguacccccuugucuucccacuccugcuccugcugacuaguuaacaaggaaggaaagaaaacuaacagucaucaauucacgugucaagaaaguaccuugcuuauuuucaggucccacuaaaagcaguuaucaauauaaaacuguaccaggaaugguugucaagguacaucucugaaucauuaaagaauauugaggcuuuucuuggccgggcgccguggcucacaccuguaaucucaggacuuugggaggccaaggcgggugaauugcuugaggucaggaguucaagaccagccuggccaacauggcaaaacccugucucuacuaaaaauacaaaaaauuagcugggcauaguggugcacgccugcagucucaguuacuugggaggcugaggcacgagaaucacuugagcgugggaggcagagguugcagugaaccaagauuguaccacugcacuccaggcugggugacagagcaagacgcugucucaaaagaauauugaggcuuuuccccucauuauuccaguguucaaauagggugaaaacuauguggaugguuuuauuugcgccuagguccucuguguuagaguacucaaguccugcucugugugcacuuccuuucacuuguuuuuauuuccucauagugcucuacggaaacguauucgagaggacagaaaggccaccacagcucagaaggugcagcagaugaaacagaggcuaaaugagaaugaacgaaaaagaaaaaggugguuauauuggcaaccuauucucacuaagaugggguuuaugucagucauuuugguuggcgcuuuuguuggcuggacacuguuuuuucagcaaaaugcccuauaaacaauuaauuuugcccagcaagcuucugcacuaguaacugacagugcuacauuaaucauagggguuugucugcagcaaacgccucauaucccaaaaacggugcaguagaauagacaucaaccagauaagugauauuuacagucacaagcccaacaucucaggacucuugacugcagguuccucugaaccccaaacuguaaauggcugucuaaaauaaagacauucauguuuguuaaaaacugguaaauuuugcaacuguauucauacaugucaaacacaguauuucaccugaccaacauugagauauccuuuaucacaggauuuguuuuuggaggcuaucuggauuuuaaccugcacuugauauaagcaauaaauauugugguuuuaucuacguuauuggaaagaaaaugacauuuaaauaauguguguaauguauaauguacuauugacaugggcaucaacacuuuuauucuuaagcauuucaggguaaauauauuuuauaaguaucuauuuaaucuuuuguaguuaacuguacuuuuuaagagcucaauuugaaaaaucuguuacuaaaaaaauaaauuguaugucgauugaauuguacuggauacauuuuccauuuuucuaaagagaaguuugauaugagcaguuagaaguuggaauaagcaauuucuacuauauauugcauuucuuuuauguuuuacaguuuuccccauuuuaaaaagaaaagcaaacaaagaaacaaaaguuuuuccuaaaaauaucuuugaaggaaaauucuccuuacugggauagucagguaaacaguuggucaagacuuuguaaagaaauugguuucuguaaaucccauuauugauauguuuauuuuucaugaaaauuucaauguaguugggguagauuaugauuuaggaagcaaaaguaagaagcagcauuuuaugauucauaauuucaguuuacuagacugaaguuuugaaguaaacacuuuucaguuucuuucuacuucaauaaauaguaugauuauaugcaaaccuuacauugucauuuuaacuuaaugaauauuuuuuaaagcaaacuguuuaaugaauuuaacugcucauuugaaugcuagcuuuccucagauuucaacauuccauucaguguuuaauuugucuuacuuaaacuugaaauuguuguuacaaauuuaauugcuaggaggcauggauagcauacauuauuauggauagcauaccuuauuucagugguuuucaaacuaugcucauuggauguccaggugggucaagagguuacuuucaaccacagcaucucugccuugucucuuuauaugccacauaagauuucugcauaaggcuuaaguauuuuaaagggggcaguuaucauuuaaaaacaguuuggucgggcgcgguggcucaugccuguaaucccagcacuuugggaggcugaagugggcagaucaccugaggucaggaguucaagaccagccuggccaacguggugaaacaccaucucuacuaaaaaugcaaaaauuagcugggcaugguggagggcaccuguaaucucagcuacucaggaggcugagguaggagaauugcuugaacccaggagauggagguugcagugagcugagaucacgucacugcacuccagccagggcgacagagcgagacuccaucucaaaagaaacaaacaaaaaaaacaguuugggccgggugugguggcucacgcuuguaaucccagcacuucggaaggccaaggcgggcggaucacgaggucaagagauggagacuguccuggccaacauggugaaaucccuucuuuacuaaaaauacaaaaauuaucugggcgugguggugcaugccuguagucccagcuccuugggaggcuaaggcaggagaaucacuugaacccgggaggcagagguugcagugagccgagauugcaccacugcacuccagccuggcaacagagcaagacuucgucucaaaaaaaaaaaaaaaaaaaguuugaaaaccauugguauagauagauauuuugaauugauuugcauagucuccuugaauguguuaaauuauguugaaaguaugaaagcaggauguaggugguacuacauauuaaauaagauuuauauaacaugugccuguguccugauucaguauuacuguguccuguaaccuugaaauggagaggagguaagagggacauuuuuuuaugucugucugcauuaaaccuguguugaggcauccaagacccuuacauuucagguuguuauugguuuaaaaccucuuuccaguuugcauugguuugucuuugcuaaaugcaguauguuuauguuacucugcaagucacauacagguagaccuuaugacauuuccaguugaaacuaggcuugcuuucgguacacaggugaagacuugaggaagccagugccagagaggacgugccucaccccucagcuggcugaaugcgcuucauuggcuuacgcuuugcuuucuguaugcuuucuguccuucuggguggugucgcauauauuuuuaaaaccacauucagugugaugaacacuuguugguacacuucuaagguuagucaucuuuccuucucugagcagauccuugagaagggcauugacaguggaugcuuuaaauaguguucaguuuuuaccaguaauaauauuuuuugguggaugucaugaaaacacaugacaucguguugugcccaugauaaaaaguccugacuuuuuauugaaugaggugugcuggucaaagagacagacguggcugccuucucugguaacagccagaggaaaaaguuagcaauucuagauggguucuacagcuuuaaaaaacuuguuguauccuuagguccucauaauauuaaauauuuucuaauuuuaacagauuuuaagagucagauauauacuuugacuugaaugauguaguguugcuuaaggaagaaaaaauuauaaaaaaaauguuucuuuuauuuucaggaguuuuuaauucauaucuaguucauuuccacucauaucuauuucugcuaauagauugacagcaaccuuugguuuaaugcuguguucucuagcuacaccaacaaguuauauauuccuuuccaauauuaaccaaguauuuauuuuauguuagccuaugacugaguuuuaucuaugcuugcacauauauagaauguaaaaauauaauucuccauguuuaauguauccauauaaaaaugaaaauacccauuuucugcauucuuaaaggguuaagaaaaguaacauguaauaagcacauggaggacuuuagaccauuucuuguguuagaggagacuuuauacauuugugagguuuucugucuuuugguccuuuuauguucuuaguccauuucauuauuguuuuaauauuucuaccaaggaaugaccaagaaaagagaaaggaagaaaaaaaauguguuaaucauuuucuuuuaaugguaugucagcagaagggguucugacuguaagcuaaugugcacuugugccuguccucuuugucuuaaacuaaaguuggugguaugaaucgaaaaauguguauugguuuaaaaagcaguuuaugauaugaaacagucuuccaguuuuuauaucaacuccuuugcuuucaacagucaguucaaagcaccauuuauugaugguuuacuguaugccagacacuguauuuuuucuuuacguauuacccuacuuaauccucaacacaauuuuaugaaguaguuauuguuagccugaaacuggcauuucuccauccuuuuauggugcugucuuugaaaagucucagauguguaacauguccuagaaguagauaauuaucaaaggaagacugcaacugcaacucacuucccucugagaaaaaauaucccugacuagauuacauaucuaguuccagaccagaaccuggugguauuaaaaguguuuugguugacuauuguauaccauaaugaguaccuacauucccaaauugccugccugguuguuguacagacuuaaaaaucuagccugccuugauuuuuacuuuucagauacacauguuuaaagagaucuuugcuggucacaguagcucacaccuguauucccagaacuuugggaggccaaggugggaggauugcuugagcccaggaguuuguucaagaucagccugggucucuacuuaaaaaaaaaagaaaaauuuagcuggguauguuggcacgugccuguagucccagcuacucaagaggcugaggcaggaggaucacauaagcacagaaguuugaggcugcagugaacuaugauggagccauugcacuccagccugggcaguagaggagacuugucucucucuguauauuugucucucucucccucucucucucugucucucauaauacauauauacauacauauauauauacacacacacacacacacauacagagagauauauaaaauagauauaaaaauaaagauauuuuaaagauuauuuauaaauauauguuuuuuaaaaauguagucuauuauaagccaaaugucauuaggcauguaguccauuucuuucuguguucaggcaggaguuccaguucuauaaacauugguuuaucuguuuuucuagcaggugcacacauggguucucagugauguguagccggggcauagauugcucucagucuguugcacccugcaggggagaugucugagguccucccucgccuggcugugcuggacgcacagugcauagcagaacuaacugcacagcagaaaugccuguucugcguucccauugauacaccaacagcuaaugaagucucuuuuacuuuuaagaaacccuuauuuggcuuuggcauauuuacaugguagaggccuagaauuuuauaaauaaaauuuugaagaauagaaauguauuuuuucacgauuuaaaaaccaccuguaugguuuacucuggaguugaccuguuccacucauccuucuccccaguucauuuguuucguuucaauuccacuuucccuuauagcuaucuucaaagcagugucuaugggacagcauugccaagagcccugacugggccuggcuugguaacucacuccuguaaucccaccugccccuagaagugcagauauacuagaaaauacagcugucuuuguuccagugaauauguauaaggggugacaugccuugguggaaagcagcucagauuguguggacuccucaaucccugcucuaccaagagcucuccaguuccaaaacuguacacucaguggcuauguucugugugccugcucccaauacagccauuauguuguucauccagauuugagaauuuaagcuuuucacuccucuuuggguaguauuauuuaaguaagaacuucuaggaaaauaguaugaguuugguuauuuuucccucggcagcaggaauuuucugaauauuuagcacauucagauugcuccaagaacagcauugagcaaugcuguacaugugcuuucuccuaaggcugucuccccugucuacuggguucuggaaagacucauuguccuucagggaagggagcauuuuuccucacugccauugcugagccuuuucuccuguuguauacuauuuagcccagcaugaagccaucgccgacuguaaggagugauggauagaaguguuuacuugguuugugaggccuugucucuaaaggguaacagucugacaaggaaaacauuucaaagagcccugaccaggccuggcuugguaacucacuccuguaaucccaguacuuugggaggccgaggcuggagaaucauuugagcccagggguucgagaccagccugggcaacacggugaaaccccacucuauuuaaaaaaaaaaaaaaaaaaaagcccugaucccccucucugggcgauccauugggagaauuugaaaaguucaaacuuuugaacucuuccuacuuuauuuuuuuaaauuuagaauggaaggugggaauuaugcaauuuggugaagauguuacagaaacugcuucacgacuuucugguuuuacguuauacaguauguuuugaggagcuccaagaauugcacaggaauuuuuuucuuuauacagaccauuuuuuaaagacgcaucaaguuauucuuuauuguggcucuaauuuggcauauuuuucagacacagguugcucuugauacaucaaauuucugcuguuaaaaacuucaguuauuuugaguuuaguuaauucaggagcgggaaccuagguaagucaucuguagagcaucuuugcaccuuaagagaaguuucugauuagccucaauucaguuuaguagaauauuaguguggauaucugguggcaaaaccuauucuuggugcaauuuggcuuuucguggccucaggcauagagcugacuugguaguggacccucuguccacacccacccggcccuugcgccuuucuagcauaaaguggugugucagagccacugucuccacagaaagcaccacguuuguuucauuugacuuauuugaacccguuucuccugccuuugccuuuuuaaauaaaaauagcaaaaauugauucaagugaaucuauuagaauuuucuaaaauggagcccauuugucuuuucagucuugcaaguaaagucuuuaaaacaauuaagccucccaaugauuuaaccguauuuucuuacccccccacccugaauaauauuuacaaagaaauaauaacgugaauuuuuaaaaaccccguccuucaguuguuauaaaugauaguucauucuugguaaguauaucuguaacaaaauacuggggaaggacaugagguauggugaacacuuaaaauucugccagccagcuuaaauacauaaucuaaauuuaacccacguaacaccucuucuagguaaacagcauucucccuauauucagaugagaaaacugagucaaagaauaaguaacuugcccaagauugcacagcuaguacaugacagaacugagauucacucugcagucuguagacuuccaguaacuccaaaccucauacuuuuucuuuuauguuacacggacucuguuuuuaauggaauauuuaaaugagauauuuaagugggaaaguaauagacaaccacucuuaccuguuaaaauccaaaguaauucucuaguuuuuaaauggagcacauuuaaaaaacuuugugcaccaguuugaacuaccacugcaacagagaaauacuagaacaucagaguauucucuaaaccagaucauuacuucauucacuuugauugaauugaguugcuuauuuuaaaaagacuucuggaugcauggaaaacauauauauuuugcagcacucagaaucaauacaaaguaccuucagccacuuugguucacauucugaagauucauguaauaaacacccauaguaguugugggcucacauuaucuaaugagaauguuuucuugaugacuugacauuucuccgucacuguuggauaaucagagaaaaaaaggacguucagaacaccaaggugcuugguacaauuaugccaagugcccugucuuuaaagggaguagccuaauucucagcauuugggaguuuuugacuaaauguguggauaugauuuguauuuccuauuucuuaauauauaugugaagauacaauacugacaaguacuuagauuuggagguuuugcgguacugaggggaguugggggaagaauggaaauaccauugaccuccuaaaaaguuguuacuugcaaaguuugggaggugacaucaaaaacucaacugcccuuacaauagucauuccauccaucuguugcuuauuugaauucucauuuauuuuuacuuuauggcauuaaaauacaauaaaucugucaauuauguauuuuauauuaguaguagcuuaagauugggucacuucauuucgguagauauaauuguuaguauuauccuucaggacaaaaagcaucugcuaacaaccugugguuuaaaaauauaggccaacuuuauguucaaacauuauguugauaauauuuuuagcaguauuacacaguggagguccaaauuggauuagacuuuugcauugaauuccaaaguauugguaagucuagcacauaguauaaagucuugcuaaauucuuguggguacauuauuuuuaaaaccugucugucugucgguaucacacagaggucacuucuugaguaaaauaagaugaccuuaagaauucacauaauucuugaagaagaauauaagucacgaugcuuccacaugaggccgcgucacaccaccaucguuuggaaauccagcaccccagccguuuuacccuaagauaacagugcagcacuuagugugguugaaugugucaugugggaaugauuuuuggucaccuuuucaguucauuguuaguccuuuuauguuugugugcaucuauguucgucuguguguuugguaaauaugaauugaauagaugacuucuuauuuuauguuuuaggccaagauugacagacaccuaauauucaugacuugagaauauucugcagcuauaaauuuugaaccauugaugugcaaagcaagaccugaagcccacuccggaaacuaaagugaggcucgcuaacccucuagauugccucacaguuguuuguuuacaaaguaaacuuuacauccaggggaugaagagcacccaccagcagaagacuuugcagaaccuuuaauuggauguguuaaguguuuuuaaugaguguaugaaauguagaaagauguacaagaaauaaauuaggggagauuacuuuguauuguacugccauuccuacuguauuuuuauacuuuuuggcagcauuaaauauuuuuguuaaauaguc

SEQ ID NO: 192760 - RNA, 39554 nt, Homo sapiens
auuagguuuugcugcuuuauacacaggaaugauuuauuuuacauacuagucaguuacaacauuagccuguaaaaugaaauccauuuuuuaaggucucauaaggcagaauaaacuucauaauauuaugcuuucacauuagccagucugauaaagcauaaacaacuuaagacuaugguaacaguuuaaaauaaaauuuacagaacaggcacuuugaagucagcuacuguguguaacuucacaguuaacguuacuuggacauaucucauuucaucaaagguuaucacccagugaagcaaauguuccuuugaugcagacgcacaaacagauuuagguuccaaacacuguauucugguuguaauacaugcaagacagacccuaaguuagaaaaaucuucugaaagaaaaugaaaaacaaaaagcagccagaaaugaaagcauuuacaagcacuugaauaaggccuuucaauguuaaaucaguguuuuaaaucccuucauucucagguaagggauuaagaggccgagagagauaucgucugcgagggugaggauacuggagguuggcagugucagcaucgcaagagugcucuaccagaggaggaggaggaggaggaaggagcugggcauaacuggaccaucucgauccagcccguggggaauccagagggguaaagaaauaccugaaacaaugaagacaggaacaaaacaccaaacaaaacaaaaacaggaaaaaaaaaacacaagaaaaagagaaaaguaguaaauacaaagagaaccaaagaggagaaaacacaugcuagaaaaaaaaaaaaaagcuuuaguauauucaugccaaaacuaacagaacauaauagcacaaaucaagacccuuacucaaaucaagauugcuuaagcaaguauagaaacuugaaaggaauacaaucuguuaaacuuaaaauguuaaaaaauauauauaaauguuacaaagaaaaacauuaauuuuauaaauucaaaacauuuucuaaucucucagaaacaucugaugcuauucuguacauuuacagaucuaguuaaguuuuuuaucuuaagcaaugguucacucacagcagcagcaagcacacauuuuuuuuagugcguacaugauacugggaauacacauaguauggcuggcuacugcaacaugcuuuugaagaacuacaaacauugaacacuuauuuuucugcaaaagccuuagaauagcuaccaaauuuugauaaguaaaaggauucacagaaugacugugcccuacuguuauucuucuuccaucuuguaacuuaccgauaauacuuacgcauauuagcaaacuuaaauauuuauagcuuuguuaucaaggucagaacuuuacaggacaugaauuaauuuaaacagcgaacuaaauuaagaaaaucuugagacauggaaugcugacaauuaauuuacaugcacaauuuuaguaaaauuuuaauggcuucucuuaauaguguguguccaaauuuugauuugaaggaagcuaagccauggaauaaauaacaccauaaaaauacacaaauguauauaagaaacauuuaucucuuuagugacuaugaauuaaaaacuuauaaaaaaaguguuuccaucuuagucccaaauuguaaaugaaacaauaccaaaugcuuaaccuggcuacaaacuguacagucaaguuccuuucauuuuacuauuacuacuuuauuaauucacuccuuuacuaauauuuuuuaaauauuacaaagaaaugacagaguuguacugaauaucauggauaaagcaaaucuacaaaaaguaaacaaaucagcacucaaaacaaucuuuauaaaaaauauuuauucaaucuucaaauuaaaauuauaaaaguucaucauuuuaagcuguuuuaagaaagcaaaagaaauaugucuauauuuuccaaaugaacuaaagugguauuccccuccucccaacuacucagauaagaaugguaacaacccuuuuaaucuuuaaacccaaauuaguuucaggaacauuucaaaaaauuguuuuggugacaaugucucaacagaaagccucuccguuuauauuucaaaaguuucaaauagugucaauaaacugacuaguacaaaaaauauacacuguauuuuuaaaggccuuuuggauugcguuuaguaguaagcaggcugcugguguaucuugggagaggucaaacggcgcuggggaaggggaaaaggagcucgcuuuccauuccugugugcaugcaacaagcagcaaaacagcaaaguuacuccaguuagcuuguacucagcugugcuuucuguuaaaggacauaauacaaauggaaaagggaaaaugcaucacagaucuaacacagaugguuauuggcacaauaagaauacagaucaaaaaauagaagcuauuuacaaaagaaaauaugcaguacaggcagugaccaaaaaccagacuuuaaaaaaucaacucuaauauuauuuguuucaugaaauaaucuuuauaaucugguaucuuccacgguaaccugaaauuguuuugaugcauguacuuaaaaccucaaaaucaaaagcagaacuucuuuaugaaaacauaacaauauaaaaauaguugaaauuuuaaauacaauuuucuucuuuuauauaggauaacaagaggauauaaccacaggacaauucauuaggcuguguuuugacguuuccugaauucuauuccaaauuauucacaaaggcauauuaaaauaauuuuaucuuacaaauucacauauuuaaaauuugaacauggaaacagacucuagaugacaucaaauauuccuuauuaugauauacaagaauguaacauaugcuaaauauucuaaaaaucaaucucguguuuuauuauuuccucuuauuucuauuaaaguuuuaaacacaaaagccaaauaacuuaauguacccucuucuagaaagccuuaagaaauguauuuuauuuaaaauuucaguuugaccuaaugcaaagaccacacuacaagcacuaaaaaacacuaauguucauuuggacuaaaacucucaccauuaaaccagauaaccuuccucucacuguugcggaagcaaaguugaaucuuaaaccuguaaacauuucuaccaauagaccacuaaagcuucagaauauaauguaaugacuucauaaccuaccugcaaauauuaugaccaaguaagccaaauacauagcuaacaaaaugaauucuuaaaugcuaauacaagcacaugugaacauuuccacuccaucuuauaauccaugaaauaauccaccuuaaguauggcuaccagaaugauuuaaaacaaagaugauuuccaguuuucccaugaagcagccuaccugccagcagaagauccauuuaaugaauucugaagacuuggaauaguugaaccuagggaaggauuugagguucccugcugagaacucccauugacugggcucccauuaccuuucaaaauaccaguacacuuccaauuguccauauaauuagcugaaaggaaaauaaucaaauacauuaacaugauuaauaccaaugccuaagggcacaaaucuguacccauguccuuaaacuacaauuaaagaaacgagacagaggcuaugagcuacauuucuuucaggauaaacauuaaagacacuuuuuaaaugaaagacauauuaucucaguuuuaacaacuuuuuagaaguuuucaaaguaucacuaauuuuaaaaauauaaagcuuucaccacccaucuuacagauacuagcaaagacaauucucugagcuaccacauuaugaaguuaauauuaaaaucuucauuauaauauuaaagucuucauuauaaugaauuucacuuacauauguauguaagguaaugaaguugucuucuuaauuaugcaaguauaaguuauaaggguaccuaucaugucuucugaaauggauguagguaacaaaaccuuuggagcuucaguggcuuauccaaaauggccuuauuaguuugaaugaaaaauuggucucugaagacaaugagcccaagaaaaucaaguuaggcacccugcuggggagcauggcaaggugguccugaauaaagccuaaaggcagaaaaggacagcaaagccccuaaaaucaaauuacacugaggaaaggaaggucugggcugguuuuaccaaagcccaaaauugaacaugggaggcccucaagcuuacccaaacugcacuuugggaaacaauaacugcuaaauggcaaauaaacaaagauagcuauaauucugaaugcuaaguaugggacaccauucuaugguggugcacaaaucacagacaucucugccuaauggauaaucauccaaggagaagugcagaaccaagcuacagagaccacagucagugucaacugaccagaccuucucacucagccuggcacuuagaagaaacuuacaaucagggcccccaaggcucuuaacuuaugggagcugcagagaagaagcagggaagauacuggauuuucuccuauuaaggauggauugucuaaagcaauuuauuugauaaaaaaggagccacuacaguccuagccugaguuuguagagcagucauguaagguacauauaugacaacugguaucuuuuuauuggagauauugcauauucuguuguaauuacuuuaguuuugaaaacugcucuguuccacauaacuuaaaaaacaauucagucauuaacuucuaugaacuagguaaacugauguucaaaauaacauaaauuaauaugacauuaaaaguaacuguaaaagaccauuuucaaaaaauauuucagaguuuacauuuuaaguaaaaauugcagagcagaaauauaaaccaacaauuaccccuucacugaacucuuaccuuuccacaaucuuacacacccaucaucuccugaagaugcuagcaccguuccuguuauauuccaacucacucgccagaccugagaauuaugauuaucgaacugagccacuauauggauuucaaacuuuguuggcccaccagaggaagucaguucuuuccuguuaauaaaaaacauuuucugaggcauuccaaacaaaguuuuaaaacauauauauauacacacacauauauauauacacacguaaaauucuaaauuaauacaaguggucucgccaccacaucacuuuauaauaaugugcacaucugcccaaaccccacaccuuggcccuugagcugggccaaugucauuuucauuuaacucgccaagaccuggagugaucccagcacauaaaugauacucagugacuguuucauggaagaaagaaacaacaaaacaggaugauuuuauucucccacacaaggcagaagaauaaaauagaugacaauaauuaauuuaaaaaggcagggcaaggccaggugcaguugcucacaccuguaaucgcagcacuuugggaggccaagguggacagaucacuugaggccaggaguucaagaccagccuggccaacauggcgaaaccccaucccuacuaaaaauacaaaauaaaaaauuagccaggcaugguggcgggcgccuguagucccagcuacucaggaggcugaggcaugagaauugcuugaaccugggagguggagguugcagugagccaagaucaagccacugcccuccagccugggcaacggagugagaccuugccucaaaaaaaaaaaaaaaaaaaaaaaaaaaugggcagggcagcaaguaggaaagaaugaaagaauggaaagaaaagaacugaaauucacaauucaaaauuaaaguuaaauauguuauucacaagacugucucaauacuaauuuaguuuucccuaaauagacugccacuugucauuaaauauuuauagauuaucaguuauauuuggagaauuguuaguuucagccuaaauaaagcacaguuaagagaauauaaaucugcucuugacucaauuccccuuuccaaaaagacauauauuuauauauaaaauguucauuaaauaauccauucuucaaaaaugacauuaauuuaaaaguaacuguagguguuggccgggcuggucuccagcuccuaaccgcgagugauccgccagccucggccucccgaggugccgggauggcagacggaguugcauucacucagugcucaauggugcccaggcuggagugcaguggcgugaucucggcucgcuacaaccuccaccucccagcugccugccuuggccccccaaagugccgagauugcagccucugcccggccgccaccccgucugggaagugaggagcgucucugccuggccacccaucgucugggaugugaggagccucucugccuggcugcccagucuggaaagugaggagcgucucugcccggccgccaucccaucuaggaagugaggagcgucucugcccggccgcccaucaucugagauguggggagcaucucugcccggccgcccugucugagaagugaggagacccucugccuggcaaccgccccgucugagaagugagaagccccuccgcccggcagccacaccgucugagaagugaggagccccuccgcccggcagccaccccgucugggaagugaggagcaucuccgcccggcagccaccccguccgggagggaggugggggucagccccccgcccggccagccgccccguccggaagggagguggggggggucagccccccgcccggccagccgccccguccggaagggaagugggggggucagccccccgcccggccagccgccccguccgggaggugaggggcgccucugcccggccgccccuacugggaagugaggagccccucugcccggccagccgccccguccgggagggaaguggggggugucagccccccgcccugccagccacccugucugggaggugaggggcgccucugcccggccgccccuacugggaagagaggagccccucugcccggccagcugccccguccgggagggaggugggggggucagccccccgcccggccagccgccccguccgggagggaggugggggggucagccccccgcccggccagccgccccguccgggagggagguugggggaucagccccccgcccggccagccgccccguccgggagggagguuggggggucagccccccgcccggccagccgccccguccgggagggaggugggggggucagccccccgcccugccagccgcccuguccgggaggugaggggcgccucugcccggccgccccuacugggaagugaggagccccucugcccggccagccgccccgaccgggagggaggugggggggccagccgccccguccgggagggaggugggggggucagccccccgcccggccagccgccccauccgggaggugaggggugccucugcccggccgccccuacugggaagugaggagccccucugcccggacagccgcccuguccgggagggaggugggggggggucagccccccgcccggccagccgccccguccaggagggaggugggggggucagccgcccguccgggagggaggugggggggucagccccgcgcccggccagccgccccguccgggaggugaggggcaccucugcccggccgccccuacugggaagugaggagccccucugcccggccagccgccccguccgcgaaggaggugggggggucagccccccgcccggccagccgccccauucgggaggugaggggugccucugcccggccgccccuacugggaagugaggagccccucugcccggacagccgccccguccgggagggaggugggggggucagccccccgcccggccagccgccccguccgggagggaggugggggggucagccccccgcccagccagccaccccguccgggaggugaggggcgccucugcccggccgccccuacugggaagugaggagccccucugcccagccaccaccccgucugggagguguacucaacagcucauugagaacaggccaugaugacaauggugguuuuguggaauagaaagcggggaaagguggggaaaagauugagaaaucggaugguugccgugucuguguagaaagaaguagacaugggagacuuuucauuuuguucuauacuaagaaaaauucuucugccuugggauccuguugaucugugaccuuacccccaacccugugcucucugaaacaugugcuguguccacucaggguugaauggauuaaggguggugcaagaugugcuuuguuaaacagaugcuugaaggcagcaugcucguuaagagucaucgccacucccuaaucucaaguacccagggacacaaacacugcagaaggccgcaggguccucugccuaggaaaaccagagaccuuuguucacuuguuuaucugcugaccuucccuccacuauuguccuaugacccugccaaaucccccucugggagaaacacccaagaaugaucaauaaaaaaaaaaagaaagaaaaaaaaguaacuguaaaagaccauuuuuaaaaaacauuucaaaguuuacauuuuuaaguaaaacuuccagagcagaaauauaaaccaaaucauaguuaccucuacucucuccuccacaaacaaagguaaucagaaggcaagaguauuuucaaauucauaaaugcuucuaaaacucaccucacaggcuuuaauguaaaaauucucacaucuuuggucgcuauugcuagaauauggaaagaucuucccaaauuuggagcgaaugcaauaucaugaacaggaucagugacugucauaagaguuucagcuuuugcauauuuccuaauggaaaaacaauugacauuaacauuuuagaaauaaaaugugcaaaaauccacacaucacugcaucucaccuuuuuuucacacugcucacaaucauguagugcucaccucuguagugggcucaacagcagcccccaaaagaauauguccaaguccugacccccagacccugugaaugugaccuuauucaaaaauagcgucuuugaaaauguaauuaaggaccucagaaugacauccgagauuuaggguggguccuaaauccaacgugcaguaaguauucuuuaaaaagaagagaagaaacgcagagacagagaggaggcagccaugugaacacagaggcagagauuggaguuaugcugccacaagccaaagaacucccggagccagcaggagcuggacuagaccaggaaggauucuagaggaagcacagccccaacaccuugauuucagacuuccgaccuccagaacugugagugaauacauuucuguguuaagccaccugauuugugguaauuuguuauggcagcccuaggaaauuaauacaaccucccacguuuccuccuuuaauaauguacauuuagcucgaaacgcuuuaauaaaaauuuaauuacaauaaggucuuggcuggccacaguggcucacaccuguaaucccagcauuuugagaggcugaggugggagaauugcuugaacccaguaguucaagaccagccugcgcaacacagcaagaccccaucuuuacaaaaaauacagaaauagcugggcaugguggugcacacccauugucccagcuacucaggaggcugaggugggaggauggcuugagcccaggaggcggagguugcagugagcugagauuacgccacugcacuccagccugggcaacacaguaagacucaacugcaaaaauaaaaaauaaaaaagggcuugauuuauuagccacuaacaucuuucuuaggaaaagaguaacacauugccuaaguauuugaauguaaauaaaaaaguaaagcugguaacaggaauugagguuuuuuugagacaguuucacucuugugcuggagugcaauggcgcaaucuuggcucacugaaaccuccgccuccugaguucaagugauucucgugcuucagccuccugaguagcugggauuacaagcgugcaccacuacgccuggcuaauuuuguauuuuuaguagagacaggguuucaccauguuggucaggcuggucuugaacuccugaccucaggugauccacccgccucugccucccaaagugcuaggauuacaggugugagccacugcgcccagcaggaauugaguuaagugauaauaaaaggaaacuaugcaaaggcuauuucauccuugcaauucuauuucuuuaucuauaaauacagaauaagaggauaaugaaggcagugguagaucagaguuuucuacuagguucuucuaagauugaauauccuggacagaacggcagcaccuaacccccugcauguaggagacuggguggagacaucuccccaucccaccuuucuacagcauucuucacuugaccuucuuuucaucccaacauucuuccuaaaaucucuaccaagcugguacacaccucaagguucucuccuugaucuuucucacccauccaaucacccuaagcaaucucauccacauccuugcuucuacuguguggucugcagcagccugggagcuucugggaaauccagaaucucagcccccuccuggggccuacacaaucagaauaugcuuuuuuuuuuuuuuugagacagagucuggcucugucgcccaggcuggagugcaguggugugaucucggcucacugcaagcuccgccucccagguucaugccauucuccugccucagccuccggaguagcugggacuacaggggccugccaccacgcccggccaauguuuuuuguuuuuuuuguauuuuuuaguagagacaggguuucaccauguuagccaggauggucucgaucuucugaccucgugaucugcccaccucggccucccaaagugcugggauucaggcgugagccacugcgcccggccagaauaugcaugguuucuacacccaugguuucaguaccuauaaaccaauaauuccuaaaucuauccccugcaauucaggggauagauucuggccuucuaccaaaggccagaaauaggacagguggagcuaagagcacacaugcugcagccagaacguguuugaauccaggcuguaacgaccuucagcaaguucuccguaaagugggaggaacacccguacuguggcagagagauucuaagugcccccaugacccgcaccuccugguggucccgcccuuguggaggcuccuccccaugagugugaguggggcccguggcuuguuuucuacccaggggacggaacauggcaagguggugggacaacacccgugugacuacaacacacaagccugugacgccugccucaugagaagacucuccugcuuucaggccuugcagaagcagcugccaugcugugaggacacaagggagggucucguggcaggaacacgagugcugccaacaaccaggugagcuccgaaguggagucuuucccagucuggccugacucuugacccacagacauugaaauaccgaaucuguacuguuucagccacugagugauaaugcugucaugcagcaauagacaacuaaucucagcuauucuauccaucugccuuuacacauccccaccuggauguuccaaacgcaccucaaacauaugucugaaauaaauugugcuuaccacauucacuccucuuugcucaguccccaucucaacaaguggcacuaccaucagcuaggucagaaaccaagacucacgugaccuacagcuggugccuccuagacaagucuccccggucccucuucaucccacgccacagugcauguccucauuccacaucauagugggcuacugcauucaucccugaguuccugcucccaguccacacagcugccaaagucaucucccuaaaagguaaauacaaccuugugacucuacuggacccugcaaaaguccaaaugcugccaggauagagaucagacuuggcaagcaccacucuccaaaaucugccuggccuguuggccugccccuccccugucucucuccugcauuagccuccccacccaccgccucgaccccacgcccuugucuuugcuccugccuccucucugcuugcagaacacccucugucuuucaagauucaugcucaaacaucaucagcugaaacuucucacccuaccaggcagguaugugcugccaucucuagcaggugaccauccucauccauauccuaggcgcuguaagcuccuucagcucuuaguacaguccaugcugcuuaugaaauguugaaaaagugagauuuuuuuuuucuuaccugaggcaagcuauauauuguaauuaauuaagguggcugggcacgguggcucacgccuguaaucccaacacuuugggaggccgaagcaggcagaucaccugaggucgacaguucgagaccagccugaccaacauggagaaaccccaucucuacuaaaacuacaaaauuagcugggugugguggcacaugccugugaucccagcuacuugggaggcugaggcaggagaacuucuugaacccagggggcggagguuacggugagccgagaucacaccauugcacuccaaccugggcaacaagagugaaacuucaucucaaaaaaaaaaauaaaauaaaaauaaaaauaauuaagguuaucuaaagcuucuccuaucagaaggagccaaauaagauccucaaugagaguguaaauaaagagaaugaacaaaaaagacuuuguuucugguccugacucuggaccuuagacuagucauucacucuguuggucucaguuuucucauuuguaaaacaguguuaauaaaagcugucuccucuacuuacaaggugguugguaggauucaaacuucauaacacacauaaaaaugcccgguaaccuauauaaacacauggcacuucuauuaucacuaucaauccuagaucuguuuuaguauuuucacucacaaauaaaaacaaauauauccaacacugguuaauuuggcaaaugucuccugucuacuaaauggugauacuacuuagaaaaagauaaacaggccgggcgugguggcucacaccuguaaucccagcacuuuggaaggcugaggugggcggaucacaagaucaagagauggagaccauccuggccaaaauggugaaaccccaucucuacuaaaaauacaaaaguuagcugggcaugguggcgggugccuguagucccagcuaccggggaggcugaggcaggagaaucgcuugaacccgggaggcaaagguugaagcgagccaagguugcgccacugcacucuagccuggaaacagagugagacuccaucucaaagaaaaaaaaagagagaaaaagauaaacagguauuaauaacgauacuacauaguccacuaucacaucuccuccacguucaaucuaaauaagaaccuucaaacaaugcuuaccucaaagaaccagcaacagaacuccaaaaagugcugaacuuaauagguuugauuacuucccaagucaauagcacacacccccaccugcagacacucuuuccccaacaccacuuccccucguuuuugaugcugaaaaugccagacacuugcugucucacucucuugcagcuaaggcauggcuggaugaccaaacuccagccgccagcaccugauaagaagccugcuaagauacuucuaggaaagguguuuuuuucuagaauacccuucuuuguauuagcauguaaaaccugacauugugcagcucuuuugugaucauaagagggagcuaucaccaguguacuaagcaugacagcaagaaaaaaguggaaaauauuuagguagguccuugaugucaucauugagcaacugagucacuaccuaaccccagaacugcuccacccucaggcuccuugucacaugacauaauacagggaaucccccagucuagauuuauucuguuagcuaagagacuagacucaaaugcaaucucagauuauuuuuaacauuggauuauuuagguaauuuagaaauacuuagguaauuucuaggccggccgugguggcucacaccuguaaucccagcacuuugggaggccgagguggguggaucaccugaggucaggaguucaagacaagccuggccaacauggugaaaccccgucucuacuaaaaauacaaaaauuagccaggcgugguggcacgcacuuguaaucccagcuauucaggaggcuaaggcaggagaaucacuugaacucgggagguagagguugcagugagcugagauugcaucacugcacuccagcuugggugacagagugagacucucaaaaaaaaaaaaaauagguaauuucuauuugccuguauuuucuuucagaacuaacugcaaguuauuuaucuuuuuacucaaaucuuacuuaugaaauauuuucuuuuccuauguuuuagaaaaaaaucuuuuuuugacacugcuggagugaaguggugcaauuuugauuuaccgcagccucgaccucccaggcucaggugaucaucccaccucagucucccaaguagcuggaacuacaggcaugcgccaucauccccacagcuaauuuuuguacuuuuuguagcgaaaggguuucaccauguuguccaggcuggucuugaauuccuagacucaagugauccacccaccucagccucccaaagugcugagauggcaggcauaagucaccucgcguggccaaugauacaccuuuuacguuuuugggcuuaugucuacauauucauucugcucagcucagguugaaauuuacuuuaacaagcccaacacuucaugaagccucuauaaaaugugcuauuaauagggcucauaguuuuuacagcuuaaaacuccaugaaaaucucuaagaccauuucccaucacugcagcacauucuacuggacagcacuguugaagacugagccucucugcagacaccaacaaucuaggaagguagaagguguaagauccccuugguaacccagaugguaacauuuggaauugcagagcccacgggaguaacacuaguuccuucucuacugcuggcccugccuaagaucugacuauuagacucaagaauuuugucuaguaccugcgaagcccaucugaucaccugacaagugcucucuucuccuguaagacugaguagugugccucugagacacugcuuuuggcucucagaagcuuugcagacacuuguaucucggcaugaccaaaauuaacuuaccuucacaugcugccacacucuacccaaaucugccuuguucccagaguuccuuaucucaagaaauuacacacauugaaauuacacacugaacucuuaagccagaaccuuggaaaucaucuuaacaccuucccccuucuuccucaguucaguucucaaauccaaucaaucaccagauccuauugauaccacuucucaauuauucucaaguuguccacuuaucuccaugccacugcuacuacuaucccaaagccacguacucucccaccuggacugucuucauagcauccuagccgugaauccaccauguuucccuccaaaacacuugucacaccuauagaagauccaucugaucccauuauucccuauucacaucaccuguaagauaaaacugaaacaauggacauuacuucuuauagauacaagucuugccuauuucucuccacacucauuuuugcccagcauguuccaacaacaguauaaauauacucccucucucuugcucacggccuuaccacaugcaguuuucuccaccaggagugcuucugcccucuuugucuggcuaacuucuacucacccuauaggucaucuucuaggugaaccuuccuagccccuaaaccagauuagguuccccagguauaagcucuuuagcacccuaauucuuccacuucauaagauucaucacccuuuuuuacuauuauuuuuuguuucacugcaagaugguacaucauacugggagaucaauuaccuucuccucuuuuuuuuuuugaggcaggguuucgcucuuguugcccagccuggagugcaauagcgcaaucucagcucacugcaaccuccgccuccuggguucaagcgauucuccugccucagccucccgaguagcugggauuacaggcaccugccaccacacccagcuaauuuuuuguacuuuuaguagagacgggguuucaccauauuggccaggcuggucuacuuucuccucuuuaucacucaugccugugcuaucacagccuagcacagaacuugguauauuauaguaaaucagcaaacauaugaugaaugacacauaauucuguaaaugaauaaagaaauaacauuuuaaaaaauuaaaugcaauucugaacaauuauuaaaaccaaagcaggacugaccugguguuuucauuauauucaaaaaucugaaccuuggccauugcguuggggcuacugucaucacuuccuacggcgaucaugggggaaugagcacgagagcuagaaacggggagaaagaacauuuuagauaacaaaagaaauacacauuucauucacagaaugaacacacuggaggcaagcagacaaccagcuuacaguuagccugucacacuacuagugaaucuaggucucugccacauagcugacauggccacacugcaaguaugcaccugagaaugucacacaugggaacugaagauuccauccuuaugaacuguuuuuagcauauucuuauggcucagauagaaaggagcucuuugccugaaaaaagcuuucaagcauucaacauauuuuuaaaagauacuuaagaggucuuaguaauuuuuccuccugaaauuuuuggucauuaacuaugaaacaaaaaguaacccuacugugacuaacuucaugacaaaaagaucuuaagugcuuugacaaaaagaagaaacacugcggcaggguggcucaugccuguaaucccagcauuuugagagacucaggagagaggaucauuugaggccaggaguucaagaagaaccugggccacauaauaagacucuaucucuacaaaaaaaaaauuuguuuaauuagccuggugugguggcaugugccguuugucucagcuacucaggagcugaggcaggaggaucacuugcgcccaggaguuggaggcugcagugagcuaugaucgugccacugcacucuagccugggcaacagagugagagucucuuucagaaaaaaagaaaagaagaagaaaaaacagauggacaggggaaaaguggaaaagacuaccccugcagaagucacgauccccacgucauuccccucccuagacucaucuguggucaaccucauuuugaaaaaggcaaaagaugagcaaugaaagaauggcucuccugaacuauaagcugaaugacuuuuuaauuucuaugccuaauuaacauaauuuccuuugccucccucauccagauuaauuaauaucucuguaaaccuggcacccuugcuuaaccuuuagccucaguauugugcacuacuaaccucuuaaagcuaaaaacaaaaugugguaacugacaaaaaaaauuaguucuuuauuacuaaagcuucagguaauuagaucaaauuaucuaauuaagaaaaguaccaggcaaacuacaaaaugcuacaguaauaaaauaaaauuauaaguuauuuauaauaauuuuuggccauucaaauagauguaaauuccacagcaauuucugugucucacaaacuuccuuuugcguuuuuuuccuguuuuuuugagacagagccuugcucugucacccaggcuggagugcaguggcgaucucugaucacugcaaccuccaccuccuggguucaagugauucuccugucucagucuccugaguagcugggauuacaggcgugaaccaccacaccuggccacaaacuuccuuuuucaguguucuacaaauacuugguuuugauuuuuuuuuuuuuuuugagauggagucucacucugucgccaggcuggagugcaguggcaugaucuugguuuacugcaaccuccaucuccuggauucaagcgauucucgugccucggccucccaaguggcugggauuacaggcacgcgccaccacgcccagcuaauuuuuguaucuuuaguaaagaugagguuucaccauguuggccaggauggucuugaucuccugaccucaugauccgcccaccucggccucccaaagugcugggauuacaggcguaaacaaccaugccuggccaagauuuuuuuuuuuaauugagacuggagucucacuauguugcccaggcuggacuugaacuucugggcucaagcaauccuccucccaaguagcugggauuccaggugugcaccaccacacccagcuaaaaaaaugugagauuuuaaaaauucuuuguuguuuuuucuuuuuggugaggugggggggggggggggggcggguacagaguuuugcucuugaugcccaggguggagugcaauggcgugauuucagcucaccgcaaccucuaccucccagguucaaugauucuccugccucagccuccugaguagcuagcauuacaggcaugugccaccaaacccagcuaauuuuguauuuuuaguagagaaggguuuucuccauguuggucagacuggucucgaacucccgaccuuaggugaucugcccgccucagccuuucaaagugcuggaauuacgugagccaccccaccuggccuuaaaaauauuuuuaaauccagucaugaaauguccagacagcaaccugaauugaggauuaccucaauuguacaaccagaacuaagauauucacauuuaaaccacuuucuaaguaugagucacagcuaaacagugagaaaaaccauccagcuuucugacugaauaguguagacagaucaccuggaucuccgccucccuccaaaagcccacugaaaugaugaaagaauauuaucguacagggcuagaaaucuagaaagagugccauuagaaaucaagaaauuuggaggguuuccaggaagucaggaagcagaucagacugagaaagaaaauacaaaggaaaaaagaguccguaucaccaucaguaaguagaaaauuccagaagguccaaccuccaauuaauaaaugcaaagaauauaaaugagucacggacaaucauggagugauuuggucaaaaaacauugucuuagugagacaauuagaacuugaaaaagaaaagguaagagcuggaaauaaaggagcacuccaaaaccaacagggaaaggggcagggaggaaggaacugcgccccaaugguucaucgugcucaacggaaaaucuuucuugcuuugucaguuggagggugccccagccugcucuuggcucacacauccuuaggaaacccugucaacccacuccacccauuccacaaaauucagucagccucccuaguugagagaguaaguuguuaacacaacagagcacccagcaggagaaaaaugccaauaccaguuugcucuaauagcaguaacagucacucacucauaaauauaaauaagcaaagaucagcagacacccaagaaaaacaaguggcgcagaagauaaagaccaaggcacacgaaaagaacugauauuugagaaaacacauauagccaauccucacuauuuagagauucugcacuuguaaacuggccuaaaauuuauuuguaaccauaaaacccaauucucucaggcuuucuuuuuuuuuuucuuuuuuuucucuuuuuugagacagucucgcucuguugcccaggcuggagugcaguggcaucaucuuggcucacugcaaccuucaucuccgaaguucaagcgauucuccugccucagccuccugaguagcugggaguacaggcgcacaccaccacgcccaucuaauuuuuguauuuuuaguagaaacaguguuucgcuguguuggccaggcuagucucaaacuccugacuucaagugauccgcccgccucagccucccaaagugcugggauaacaggcgugagccacugugcccggcccaggcuuucauggucauucaucggcaggugcagagcagcucugcaaaaaaauccaguugccugaugcaguuucccagcagaagugccuucuuccuuuggcugucauugguaaacgaauguccuuuacacaguuuagucaguucgccucacguuuuucacauuuuuguguuuuuuaaaagugauuucauaguuuaaaacccuguggaugcugcugaagugcugucugguguuccuaaacauaggaaggcugggaugugccuuauggagaaaauagguguauucaaaaugcuuuauucaggucugaguaguuuguguuguuggcuaugaguucaauguuagucaaucaacaacauauaaguugucuuuaaaaagaaagacacacaaaaagguuauacacugaucaguugacaaaaauguagugagagacuuguggaaacccuguauuuccccaaggagcaauucgguauucaguauuagcuaauucaguguucauggcaacuuuauagaacauugccagugcaaaugauaauugacuguaauucagcaaacaaaugcaaauuuuaaaaaaucuucacuagaaaccacagggaaauaguguaauacauguaacaaaaacugguauaaaaaagaaguaaucagagaaaaagaaacucugaacaauuaaaaaugauugccauucauacaaaaauucaaugaugggaaaaaauguauaccuggagaacaaaguggagaucugggagauggaguacuaaaucuccaaacaauuuuguuuuaaauggagaguaaauccuggaauaaucaaauaggagugccagaaagacagaacagagacaagagaauaaaaagaaauuaucaaaggaucauaagauauccccaauuugagacaauaacauuuauuuuuaaagggaccacugagugucaagcaggauuggccaagugcaguggcucaugccuguaaucucagcacuuugggaggccaagccaagaaaacuacuugaguccaggaguucaacaccauucugggcaacaaggcgaaaccccauauccacaaaaaauaacaaaaaauuagcaaggcaugguggugaaugccuguagucccaguuacuugggaggcuguguguggugggaggaucaccugagcccagggagguccagggagugccacugcacuccagccugggugacauagugacacgugucucgaaaacaaauacauaaaaaauaauaaauaauaaaugguggcugggugcgguggcucacgccuguaaucccaacacuuugggaggccgaggccggcaaaucaccugagcucaggaguucgagaccagccugaccaauauggagaaaccccaucucuacuaaaaauauaaaauuagacgggcaugguggcacaugccuguaaucucagcuacucaggaggcugaggcaggagaaucucuuaaacccaggaggcggagcuugcagugagccaagaucacaccacugcacuccagccugggugacagagcaagacucugucuccaaaaaaaaaaaaaaaccauaaaaauaaaaauaaaaaacaaaugguaagugauaaguaagauuaaucaacaaaggccaacacauaauaauccagguugggguuuuuccuggagaaggggaaugaggaaaguacagcagcagcuuuggguuacuguagcugggagaugaguauggaagggucugucuacuguacuucuguuacuucugguguaucugaaauuuucucuaaugaauacacuagacaaccccaagguggaaaaaacugcucaaauaaaacacaaaaagcacuccaacaauaaagccugacaaaugugauuacauuaaaacucauuuccauuggcuaucaaaauccaucauaaaaaaugucaaaauauaugugcaagagagcucagaauaauaacgcaaaauccuaaaaccuuccaaaaagaaaaagcuaccuacaaaagaaccagcaucagacugacgacagcucguuaauaaaaccuaguuaaaaauaugcaagaacuguaucuuuugaaauucuuacauucggaacucuaaaacuagccaaacuaucaauuaagcauggagucaaauuaagacauuuucagguauuugaagaguuugccauccauuccaucuccauauuggcaucucaaaugaauacuuacauaaucuagauuguaaagcuggcugccacuuaauuuuuagaaucaauuuguagucaaaagacaaaauacuuacacauguguuaaauguuuacagaauguaaauauuauaaaucuugccaguauacaagcaauauaagaauuaggaaauggacugggcgagguggcucaugccuguaaucccagcaguuugggaggccgaggugggcggaucacaaggucaggagaucgagaccauccuggcuaauacggugaaaccccgucucuacuaaaaauacaaaaaauuagccaggcgugguggcaggcaccuguagucccagcuacucagguggcugaggcaggggaaucgcuugaaccaggaggcggagcuugcagugagccuagauugcgccacugcacuccagccugggugacagagcgagacuccaccucaaaaaaaaaaaaaaaaaaaaaagaaugaggaaauggaaggggcaaugugagggggaagcaauaaacuaauucccucuuuuuuaagagaggggaagccaggcacaguggcucacaccuguaauccuagaacuuugggaggccaaggcgggcagaucaccugaggucaggaguucaagaccagccuggcuaacauggacaaaccccgucucuacuaaaaauacaaaaaaaacuagccagaugugguggcgggcaccugugauuccagcuacuugggaggcugacacaggagaaucguuugaacccaggaggcggagcuugcagugagccgagaucaugccaccacacuccagccugggcaauagggcaagacuccaucucaaaaaaaaaaaaaaaaaaaagagacgggaguaaauauauagucuaaaaauugauaaauauguguagagauauauauauuauuugaaauuauaauaauuaccaguauaacuccaacaacuaucaacaucaccacaaauaagauaucuaucuagucauaccuugggauguggaaguuguauaaaugugcucuauucaucuuuucuaucaguuuggauauucuuuaaugauaacauagcaagaacauguggaaaaauagcagaauaaaaauuuuuaaaaaaaagauaacauagcaagaaccaaagguauaaguaaauccuuuaaaaauauacuagugacuaccagaauuaaagucugaaaacagaacuauugacagcauuuguuuuuaggggguaaaggaacuuuaccuuucuuuuuguauucuuauggauuauuucaauuuuuuucuucaccaagugauucuuauaauuguuuaaaaacaguuuaauaaaaagcaacuaugguaauauucauauagucaugcucuaugcagcaguuaaaaagaaaugagguaagacuagauauauuaauauauggaaaaaugcccacaauguaucuuuaagugaaaaaagcuaauugcaaggaaggaaaauguaaggguuucuggcugggugcagcagcucacgccugucaucccagcacucuuggaggccgaggcaggcagaucaccugagguuagaaguucaagaccagucuggccaacaugguaaaaccccaugucuacuaaaaaugcaaaaauuaggcagacgugguggcgcaugccuguaauucuagcuacuugggaggcugaggcaggagaauugcuugaacucaggagguggaggcuacugugagccaagauggugccacugcacuccagccugggcaaaugagcaauacucugucucaaucaaccaaucaaucaaucaaucaaauguauggguuucaauaucugguguucugugucuacuugugcuagugaauaucugggcguguuugcauauauguguuuaugacaacauuaaauaguuauuugcauaugcauagaaaacauccaaaagguucacaugaaaauauuuacaaugccggcuuccucuguugagugaaaacagggacaaaugacaugccugggugaaaaauggagaacauauacucuauauaucuugagaagaagcaccuuugagagaauaaauuaucaaauuguuagcuuaaaaguuacuaguuuauuuuacuaggauguuaucagagguuuaauauguaaacuuaccuugaaggguuccaagaaauacaacuacagcuuagcuuacaugagaucucaugcugcaaagaccacuggcugagauucauaacaucuggugccucauagauucuuacuauaccaucugcggaacagguugcuaacauaagacccaugugcuugggagcaaacuucacaucaguaacagauguucugcuauccaccagaguuguccuuuuaaccuaaaaaaaaaauaauaacaauuuaaauuauauacaaaaagaaagcaugguagaguggaaaagacacacagacucuggaaucacacagaaacuccucuaucauucacuagguauauaagcuuggauacaucucugggccacaaguuccuacaaguacauggcaaaauaccacauauauagcugggaaucacuaacaaauuagugagcuauaauuaauuacucccuuuaaugaaaaaaaagucuaccuccaaaagccuaccuuuguuauauaaguaaucucucuuaagcaaacugaucacaaaaaaaaaagaaaauguuagaauuuucagacaagaaguuuugucacacaaagcaugcugcaagcauuagacccuuuaacuguaaaugaguugggcgugauggcuuacaccuguaaucccaaaacuuugggaagccgaggcaggcagacugcuugagcucaggaguucaagaccagccugggcuacauggcaagacaccgucucuacuaaaaacuaaaaaaaaaaaaaagccaggugugguggugcacgccuguggccccagcuauuccggaggcugaggcggguggaucgcuugagccaguggggcagaagguacagugagcaaagaucgcaccacugcacuccagccugggugacagaguaagacccucucucaaaaaaaaaaaaaaaaaaaaaaaaaagaaaggcaugcaauuucuucucucaagaauaauuuucuguuaaucccauuuggaccacuauuauuauuauuuuuuuuuuuuucuuagggacagggucuugcucugucacccaggcuggaguacaguaccaugaucauggcucaagugauccuuuugccucagccuucccaguagcugggaugacaggcaccugccaccaugcccagcuaauuuuucuuauuuuuauagagaugggggggucucacuauguugcccagaugggucucaaacuccuggccucaacugaucuucccaccucagccucccgaguugcuaggauuacaggugugagccacugcacccagcuaccaugcacuuuuaagugaaggcuuuuaacagggaccaaaagaaugguagaaagcaagcuuuaugaucacuguaaaauuccaacaucacauuuaaaaguuaucuucuggcacacagauaagaugaaacuuuacuaaaaacaucaauaagcucaggugcaguagcucacgccuguaaucccagcacuuugggagacugaggcgggugaucacuugaggucaggaguucaagaccagccuguccaacauggugaaaccccaucucuacuaaaaauauucaaauuagccagacauuguggcgggcgccugcaaucccagcuacuagagaggcuaaggcaggagaaucgcuugaguguggucggcggaggcugcacugagccgagaucaugccacugcacaccaggcuggguggcagugcaagacuuugucucaaaaaaaaacuaagucaauaaaguuuagcaaucaacagauuacugucuaugguuaccaaaauccuucuuaaagagucucaacauuaaaaggauaauauuacauaaacuucaaagauaacaucuuagcaaacuuuugucuacagacaccacugaauaauuaauacaaacacaaauguugagaaaauaaaugcauuuguuacaguagguagucagacaugagcagggcagcagaggaccccaccccaccaggaaugucaagcaaccaucaggugaugaucaggcaguuguuaaacuuucucucuaaacuaaucauugguugcagccagugccagggaaagguagucucccaacagauagaaacaccugaaacuggugaucagcagcuuccugauaagaucugaggaguuggaugacugggcucaagcaugugcacuaagaggaaaaaugguggagcuuaacugaucuaugaccuucuaggaacauucuguuaagggaaaaacgccucaagugagcaucugcgcaacuccaguaaacacacugcacacgcagccccucccaggcacuagugggccacugcacaugcggacugcccaccccaagggaagaaucagagaagagacgcaaccccugggaagcaugccaacguguaacaacccaaguccaagaucaaaccaugcauuugacucucucaagucacccacuuggcccucuuccaaauguauuuuacuucauuucugcuguaaaauuuuuuaacaaauuuccacucuggcucuaaaacuuaucuuagucucuuacucugccuuaugccccuagguggaauucuuucuuuugaagaggcaagaaaugaggcugcugcagacccauauggauuugccacugcuaauauauuaaugaaagaugacuaaacuaaauacaaauaaguaucuugaaauucaaagaaaaguccuucuuaugccaccacucccaaauccaaucuauaguauacugaacugacacaccucagacuuaacgccaaaaaaacuuuuauaauucuauaaauuucuauuccuuccuccccauaagcagcuguuuggcuuagggaagcccuagugcaaaggcaaucagacauacuccuccccugagaagagcuguaaaacagucugaauagccacucaagcuacaaagcuaccggaauuaaaacagugugcuauuaggacaaggagacauacagauaaauguccacaagagagcccagaaugcaauccuccauauauauagccauuauuuucaacaaaggugucaagaccauucaacaggggaaagaauggucuuuucaagaaauggugcugggaaaacuagauuucagcacccuaacauuuuuuaaugacugaaauaaauaauuuguaucaggcccuugcuugcuugcgcauguuaaccacucacuuuuugcugaauaucccuuguugccacaauauaaugauaaacuguugauguacugcuucuuugucaaucaagagaagauaacuucagcgucauguaaagaaaaauguugccagaagaaaugaauggcuuuaaggacacugugaccagcugcuaacaaccagacaucugguugcucaaggcguuaccugagaccaaagaaacacagacuuuuccacuggauucugugaaacucccccucccuuacuagaucuagucacauaaaaucuacccaaugcuuccuuuuguuuagauggauucgagagaucuugcccucccaucuucuugcuuuagccaaaucgaauaaaccuuucucuaucuccaaguaccggugacucaguguuugcucucagcuccacauuggggauacaagccugaauugaggauucuauaacaaucuuagaagaaaacauuggggaaagucuucaugacacuggauuuggcaaugcuuuccuggauauaacaccaaaagcaugggaaacaaaagaaaaaaauuuagauaaacuagacuucaaaauuuuaaaauuucgugcaucaaaggaaaccaucaagagugaaaaaggcaacccacagaacgggagaaaauauuugcaaaucauuuacagguugugcauaucaaauccaaaaaucugaaaucugaaaugcuccaaacuccaaaacuuuuugagcacuggcaugaugcucaaagaaaaugcuuauugaagcauaccgaauuucaaguuuuuggauuuagaaugcuuaacuggggcuggccacgguggcucacaccuguaaucccagcacucuggggggccaagguggaggaucgcuugaacccaggaguucaagaccagccugggcaacucuauuaaguaaauaaauaaguaggcgaaugcuuaacugguaaguauaaaugcaaauauugcaaaauccaaaauccaaaauccaaaacauuucuggauccuagcauuauggauaaggaauacucaaccuauaacagauaagggauuaauauccagaauauauaaagaacuccuauaacaacaaaaaacccaauuuaaaaaaaugggcaaaggauaugaauaguauuuuccccaggaagacauacaauugaccaauaagcacaugaaaauaaggucaacaucaguaauuauuagagaaaugcaaaucagaaccacaauggagaugccacuucacaacacagucacuaggauggcuacaauaaauagcaccacaacaagugcugaugaagauuuggaaaaacuggaacccuugagcauugcugguaggaauguaaaaugguguagcugcuauggaaaagucugacaguuccuaaaaacgugaaacauagaacuaccauaugagccagcaauucuacuccuagguauauuuccaaaagaaucgaaagcacggucucaaacauuuaucuguacaacaaugcucauaguagcaguauucacaauagccacgaaguagaaacaacccaaggguccaucuacaaaugaauggauaaacaaaaugugguauacacacacaauggaauauuacucagccauaaaaaggaauaaaguuaauauaugcuacaaaauggacagaccaugaaaacauuuuacuuagugaaauaagccaguugcaaauggacaaauacugugauuccacuuacaugcaguaccuagucaaauuuauagacagacaguugaauaggggguagagggaggaggaagggggaggcauucuuuaaaaauauggaguuuauguuggcagugaugaacaguuuugaguacagauaacagugauggguacacagcacugugaacguaauuaauucuacugaauuauaccauuuacaaauaguuaaaaugggccaggcaugguggcucacgccuguaaucccagcacuucaggaggccaaggcaggagaaucauuugagaucaggaguucgugaccagccugaccaacauggugaaacccugucucuucuaaaaacacaaaaaaauuagccaggcaugguggcacaugccuguagucccagcuacucaggagacugaggcaggaaaaucgcuugaaccccggaggcggagaaugcaguaagccgagaucccaccacugcacuccagccugggugacagaacaagacucugucucaaaaaaaaaaaaaaaaaaaaaaaaaaaaaaaaaaaaaguuaaaaugaggaauauuauguuauacauauuuuaccacaauaaaaaauugcaucauggcccucguaguggcucacgccuauaaucacagcacuuugggaggccgaggugagaggauugcuucaguccaggaguucaagaccagccugggcaacauggugaaaccccaucucuacaaaauaaaaaaaucagccuguggugcaugccugugaucccagcuacuuguggggcuaaggugggaggaucacuugagcccaggagguugagacugcaaugagcugugacuggcucuaacguaguaucaugccauuagggagggcaggugagggguaauagcaggacacucccacuacacacuuccuuuuguuucuuuugaauuuuacaccaugugcaugauuaucuauuacaaaaaacaaaucauaaagggggaaaaaaagcaugcagaugauaauaccuucauaugaaaaugcuggaaagagucuuaaauauaaucuaguucaauguuuucacuuuauagaugaggaacuucaacagcacacagauuauauuauguucuugcccaaauucaaacauccaauaaggcaaagacagcgauaaaagcagauguagauaaaggagaguguauuuuuuuuuuuuugagacgaagucucgcucuuguuccccaggcuggagugcaauggcacgaucucugcucaucacaaccuccgccucccggguucaagcgauucuccugccucagccuccugaguagcugggauuacaggcaugugccaccaugcucagcuaauuuuuguauuuuuaguagagggggaguuucuccauguuggucaggcuggucucaaacuccugaccucaggugaucuguccauuuuggccuccuaaagugcugggauuauaggcgugagccaccgcacccggccgaggacaguauauuuccuaagaaaacaaaaguaaccacaaaacaaaagaaacaauuuuuauagaauuuuuuuuuuuuuugagacaagucucgcuccgucgcccaggcuggagugcaguggcgugaucucggcucacugcaagcuccgccucccggguucacaccauucuccugccucagccuccagaguagcugggacuuacaggcacccaccaccaugccgggcuaauuuuuuguauuuuuaguagagacaggguuucaccauguuagccauguuauuuauuuuauuagguggguauuuucuguagaaagaauuugcaaguaaaaugguggacuuacagaaucuuuguuucaaagguugguuacgcuaaacucugaagcaacucuccaacuaucagcacuggaaguagucaaguuuaucuggcuagauuuuucuuuuauuaguaaaaugucagaagaacuggacuucagaagcauuacaauccuaaauauagaaugucuucuaaagguuaaaacauucuggaauuuaacuuuuuauuuacauguuauguugaucaguuuucuucucucauagaaguaaaacuauauucuguuuccugauguaaaaccaguguuuaugaaauaugaauaaguauuuaggaaaaaagaagcccugggauaaugaguaucuguucuuuucuuuuuuuuuuuuugauuccccagacacacaguggaucuguauggcgugugacaugggcccauccugaauuuggcccauuaaauuuauuuaaauuuaaauaaaauuuaaagaauuuuauuaacccuuggccaggcgugguggcucacgccuguaaucccagcacuuugggaggccgacaggcagaucacgaggucaggagaucgagaccauccuggcuagcacagugaaaccccgucucuacuaaaaaugcaaaaaauuagaugggcgugguggcgggcgccuguagucccagcuacucaggaggcugagguaggagaauggcgugaacccgggaggcggagcuugcagugagccaagauugugccacugcacuccagccugggugacacagugagacuccgucuaaaaaaaaaaaaaagaauuuuauuaacccuuaagaguuuaaaguuaaaaaaaaaaaagaauuuuagaguuaggcacaguggcucaugccuauaaucucagcaacucaggaggcugagguggggccaggaguuugagacugcagugagccagaauacuuuaaaaucauauauuacuaucauaaaauauacuaauagguaaaaucaaauacaaugcaaauauucuggauucaucauaaaaguuauaaacaaugcagugaugcuccuaaguauugcuucagacccaaguuaaaaugaaauaaaaaaggaagaaaaaaacauggaagaaagaacuuuagaacugguaaaacuagaggggaguggugauauuuuaccaauuaucugagguagccuucggaugaaugcuccuuggcugcucaugucuucccgguccccagaauacuaauaaaugucucacccaguggcucuguccucgcaguuuaucauuugauucuccuacuauuucuucccauacagcagcuguucggucaaaagaacaggaagccaaaaccugcccaaauucaggaugggcccaugucacacgccauacagauccacuaugugucuggggaaucaaaaaaaaaaaagaaaagaacagauacucauuaucccagggcuucuuuuuuccuaaauacuuauucauauuucauaaacacugguuuuacaucaggaaacagaauauaguuuuacuucuaugagagaagaaaacugaucaacauaacauguaaauaaaaaguuaaauuccagaauguuuuaaccuuuagaagacauucuauauuuaggauuguaaugcuucugaaguccaguucuucugacauuuuacuaauaaaagaaaaaucuagccagauaaacuugacuacuuccagugcugauaguuggagaguugcuucagaguuuagcguaaccaaccuuugaaacaaagauucuguaaguccaccauuuuacuugcaaauucuuucuacagaaaauacccaccuaauaaaauaaauaacauuagauuuauuugcuccaaaauccauacagacagaaaguagauuagugguuaccagcggcugggagcagaguaaacaagaagugacugcuaaaugagcacaggguuuccuuuagaggugguaaacaauguucugaaauuagaagugguggugguugccaauuaaaugaauauacuuaaaaucacuaaauuguacacuuuaaaugggugcacauuaugauauguaaauuauagcucaaucaaaaaaauacuuuuuuuucauuugauucaaccaggcauaguggcucacgccugucuucucagcccuuuagggggcugaggugggcagacugcuugagcccagggguucaagaccagucugggcaauauggcaaaaugccaucacuacaaaaaauacaaaaaauuagucagguguggugguaugcacuuacggucccagcugcuugggaggcugaggugggaggaucacuucagccuggaagguugaggcugcaguaagccaagauugugccacugcacuccagccugggugacagagcaagaacuugucuccaaaaaaaaauuauuugcuucaaaagucuaacaauauauagagauuauagccauagaaugcuuaaaugauuuuaacugacaauacagucuaucgauaacagacuauuguaggaagagcaaauauggggaagcccaaauccuuacaccccuccuguuggccaaggggugggaggggagguggcuggagaagggauacaaaggucuuaaagaauuucaccaucaaaagaauuugcuaggugcuucucagggaaaauacuguauaauaacaaauaacauucagaaaauguguuucacacuguauagcuaacauuuuuuacauucaacaacauaaaaauaguuuaaccaauaacuucuacaugguaacaaugucaccaacuaaagguacauuuugcacccuuuuuuuuuaaccuuguuuuguccagucuuuucuguaucaucuuuaauucuuacuuauacagggcuauaaaauuaaaaaugcacacuaaggcagauaaguuuuauuagauuuacaguaaaaugcaaucuaaagaauaagguuugcacaaagaugcucaucacaauaaaauggaaacugaaauauccacuaguuaagcaaaaugguauauuuauuggcuguuaauaaaaagccuuuaaagauauagaaaaguacauaugaaauauauuaggcuuaaaagcaagagaugggguuuccuuuuggaauaauaaaaauguuuuagaacuagaaaaaggugguaguuacacaacacuguaaaugaaguaaaugccaauuaauuguuuacucugaaauuauuaauuuuauaaguuaaccucaccuuaaaagggggggggaccuuggauagaccuuucacaaaagaagauacaugaaugguaaauaagcauaugaaaaaauaaucaacaugagguauuaaggaaauacaaaucaaaauccaaugauuuuuguggucacuucucaacuacuaaaauggcuauaauaaaaaagacagauauuaucgaguguaggugaggauguagagaaacuggaaccucacacauggcuggugggcacagccacuuuggaagaguuucgcaguuucuuagaaagcuaagugcauauagcccaucaauuccacuccuacgcaucuauccaaaagaaaugaaaauauaugucuacacagacuuacauggcacguucuuaacauuacucauaacagccaaaaacaacaacucaaauguccgucaacuggugaacagacaaacaaaacguggcaauauacauacaacggacuacucaguaucaaaggaacaaauugacacaugacacaauauggaugaaccucaaaacaugcaaagggaaaguggccagacacaaaggacuauguauuucaaaauuccauuucuaugaaauuucuagaaaggauaaaccaggccaggcaugguggcucaagccuguaaucccagcacuuuggaaggccaaggcgggcggaucacuugaggucaggaguucgagaccagccuggucaacauagugaaacccugucucuaccaaaacuacaaaaauuagccgggugugguggcaugcgccuguaaucccagcuacucaggaggcugaggcaggagaaucgcuugaacccaggaggcagagguugcaacgagccaacaucgcaccacugcacuccagccugggcgacagagcaagacgccagcucaaaaaaaaaaaaaaagaaaagaagagaagagagggugggaggggaggggagagggagggcagaggagagaagaaaccuauggagacagaaaauggaucagugguugccuggggcuuggagugggaauaggauacaaaggaauuucugaguuugagagaaaaguucuaaaacuggauuacagugaugacuacacaacuauguaaguuuacuaaaacucacugaacuguacauuuaaaauggaugacuuuuaagguaugaaaauuucuacuuggccgggcacaguggcucaugccuauaaacccagcacuuugggaggccgagggaggaucaccugaggucaggaguuugagaccagccuggccaacauggcgaaaccccaucucugcuaaaaacacaaaaauuagccgggcaucguggugcacgccuacagucccagcuacuugggaggcugaggcagaagaaucacuugaacccaacaggcggagguugcagugagccaagaucacgccacugcacucccaccugggcaagagagcaagacucuccgucucaaaaaaaaaaaaaaaagaaaauuucuacuugaguaaagguuuuguuuuuuuuuuuuaagagaaaacuauguaugaaacaucacaacaauuaaaauauguaaaggcaaaaggaauauucugaauuacuaagauaauuauguuagaaugcuacagaauuacagauuuucuuacucucaaauucugagaaacacaguuguuacuuuaauagcgaaaaacaguaaaaugucuucccaggaaaagaacuacuguauaaauguuauuuucucaaaacaauucauagauaacuauaaaauaaacaguaaauauuucuguauuuuuaauaaauguaaaaauaaauacuaaccuuccagcuagcaguacaaugccaaucaccacuuucacuuuuaucccagaccuauaagaaaauaaaaggcagauauuuuauacaaaaauuccuacaaauugauacaaaaacuauaagacugaaucaguguacaaggaaagcggugaacauauaguuaacaaaagaacacaaucagcaaguaaacauucauucauucaauuaaguauuuauugagaggcugggugcgauggcucaugccuguaaucccagcacuuugggaggccaaggcaaacggaucaccugaggucaggaguucgagaccagccuagacaacguggugaaaccccgucucuacuaaaaauacaaaaauuagccaggcauggugccgcaugccuauagucccagcuacuagggaggcugaggcaagacaaucguuugaaccccagaggcggaggucgcagugagcugacaucacgccacugcacuccagccugggagacaaagcaagacuccgucucaaaaaauuuacauugagaaccuugaaugugucaagcacugggccaagcaccaagggauucaggaagcugagcucuauuagguaacagagacaauuaguuacagucacuacgcuuggaggccauuuuaaacagcaaaaucaccaacagaaagaacaaauaaucauugcacuaaauaaaucaugaaaaacaccugcuuacaguaugagccaaaauagaguaucgccugguuucaccucaaugggaaacgucuguccugagacucaaacuuuuucaccacuccucacacaugcacaaaugacugcaaaaccagugugacuuuugggguacaaguaaauuucagaguagacaaauucaaaaaauacagaaucuacaaacaacaggcucaacuguacauguaacaaaugguaaagcaaaaauauugaaaccaggcaugguggugcacaccuguagucccagcuacucaagaggcugaggcaggagggauuacuugagcccaggaguuuaaggcuaugaucacgcccgugaauagccacugcacuccagccugggcaacauggcaagacuccaucucaaaacaaaaaaauuaaaccuuauuacccagaaaaaauauagauuacaauaagaaggugccaauuucaccuguuaaaaauguaacgagggcaauaacacuaucaaaucaauacuaucacuggcgguauaaaacgguacgaccugcaaaauagcaauuugucaauucucuucaauaguguuuaaaauauccacuaauuuaucuucuagaauuagccuaagaaaaucauucaaaauacauaaaaugcuaaacuaaugaaaaauuucaguacaacacuauuucugacaagacauauacguauauacacacacucuaccaugacaacuuaaaacguuaaaggaaaaacagaggaaaucaauaaauauuaacacauuagcaauaagucuauaauuuuuucacuuucuaaaaagaaaaauauauuacuugcucaauuaaaaauauauacaaauaaauacauggcuccuccuuuaaaaaaaaaguacucuggaauaaauggaccuaagagggcugggcaaggugacucacaccuguaaucccagcacucugggaggcugaggugagaggaucacuugagcucaggaguucgagacuagccugggcaacgcagcaagacccugccucuacaaaaaaaauguuuuaauuggccaggcgugguggcgugcacucguagucccagcuacuggagaggcuaaggugggaggauggcuugaaccugggauguugaggcugcaacaagccaagaucgcaccacugcacuccagccugggugacagagccagacucugccucaaaaaaaaaggaaaaagaaaaaagaaaaaaaaaauuauacuaagugaaauaaaccaaauauaaaagggcgaauauucuaugauucuauuuaucugagguaccuagaauaugcaaauuaauagaaagcaguagaauagagguuaccagaggaugggguggcggaacagggugcucuuggguacagaguuucaguuuaggaugaugaaaagguucuggagaugggcaggggcgacgcugcacaaaaaugugaaugcugugcucuaugccacugaauucuacacuuuaaaacgguuaacgugggccgggcgcgguggcucacgcccguaauccuagcacuuugggaggccgaggugggcggaucacgaggucaggagauagagaccauccuggcuaacauggugaaacccugucucuacuaaaaaauacaaaaaauuagccgggcgugguggcgggcgccuguagucccagcuacuugggaggcugaggcaggagaauggcgugaacccgggaggcggagcuugcagugagccaagauugcgccaccccacuccagccugggugacagagcaagacuccgucucaaaaaaaaaaaaaaaaaaaaaaaaaaaacgguuaacguaguuuauuacaacaaaaauaaacuuguuuuaaaaaagaaacuacaucuuuuaaaaauugcaacacuauuuauaaaaaguuuaucuuugagagaucacugguaucaaacucgaaugugaaaaaggauaaacuauccuucagauuuccaguuacucuggaguugucgagaaccaaauaauccgcacuccagcuuucauucauccugcaacacaucugggagguuccuaaaucucauguagcauccccacauuagaaauucugcuuguaggccgggcgcgguggcucacgccuguaaucccagcacuuugggaggccgaggcgccgaggcggguggaucacgaggucaggaguucgagaccagccuggcccacauggugaaacucugucucuacuaaaaaauacaaaaaaaaaaaaagauuagccgggggugguggcgugcaccuguaaucccugcuacuugggaggcuggggcaggauaaucgccugaaagcgggaggcggacguugcagugagccgagaucgugccauugcacuccagccugggugacagagugagacucggucucaaaaaaaaaaaaaaaaaaagaaaagaaauucugcuugucggaagugucuacagacguuuacgggaacuucaagaaacaaacccuccgauuccugggcagcaagcagggaaaucauuggauguaaaugguuuguauuuuucuuccucggcguaacaaagugagcuucugcucugaacccacggagaaaaccaugugcccuggugagagaacaccggcggggcacagaacucgacgcagcgccagccaggcaaagucucccaccaggucccacugcaggucgucgggugaacagcgcgggcaagacccacgacgccgaggcugacggugggaugccccuggguucccgcccgcagccccggcagcgcggccugggagagggcccggcguacccugcgggcgggagcgcgcacguggcaccagcugcgcaggcgcacgggagggcggcccgcgaggccgccgugaccccacaauacgcgggcggggagggcuuccgcucaguccagccagggcucgcccgccaccccacagcuuccagcggcgucacugaaccaagacacagccccguuccccgcgccgcccacccacuccccuuccuuccuuccggggucggccccgcccgcaagcgccgcgcgcaccuuaacgcucugaucgcuggagcagguugccauccgccgcccguggaagucgaaagagacaucguggaugagauccuugugguccgccgcgaugcugcgagccacaaacaugguuuccgucgggcccgcgccuccgaagaggacaguggcggcggcagcggcggcggcgcguggcccguagccuagccagaccucgcagcccgggagcgcacggcuugugcugcccacgcccccgcaccgccccugccu

SEQ ID NO: 192761 - RNA, 41089 nt, Homo sapiens
guaugccgcugauuauuuuuaaugauuuugugcuaugguuugaccacagcauuaagaacaagcagaaaaaucugauuucauaacuaacaaacagcacuuagagcaacaucuuucuuuaaaaguauugcaauuacagaccuuaggucuaagaacuacaccauugcucagguaaaagaggcagauacgugacagguggaaaucuuuuucuguauauaacugggaauuauguugaaaaguaagcacgaauguuuguuaaaaaagacuuuaaugacuuuugauuaucauagcucacaaacaacuauugaaaaguucaaauacaguuguacuuuuuuaguagauugcuuuauaauaaaaauuaaacgaacuaaaugcugugaauaguauuguacauauuuuaaaauagccuuaaacuagacaaguauacaauuagcaugauuuuugaaagcuaugaaaugaaaaauagcaacauaccaacaagcacauuaaaaugaaccaguaucauuaacaguaaaguuuaagccucaauucguccuguagaaaggaagcaaugaugugguaacaaauuuuaguaccucugagucuagaacauucucaugcucaacaguucucccacaagguugaaccuggggggugggagcuuuguuucugacaacagugagccucaguucuuaaugaugaaucccaaggggugcacccuacaguauacgauggaaacaacacgugggucuagacacgcaggauccacaacaacaaaagugucaacuuuuuacggcccuuucaaacagauacuaaaagggcugacuuuuuuaauccauucagcauuaaggguugcauuguagagucaauuucaguuuaaagauaaucugucauuuguuuccuggauguuagggguaugauuauagaaucugacauuuucaaagucagaacauacaccauggagcaaauaaaaacuuuggaauuuauuagacucuacucugguggcagaauaagcugauaauaugggucagaugggcaaaauuccacgaacugcucuuauggacaacacucgaaaggaugcccacacccaagauucaaccgugguuuuagugaacaugguguuauaaacuuuucuuguucuuuuguuuuaaaauuaggguauuugaagauaaaugcagaggucacaaucagacacuaaaaacuaagccggaagagagauguaacaauauacaauccaaaacguaauuucuaacugauggcaaaaccgaguuugcuuuuuggguccguauuaugaugggacaugaaugggaauggaugagagguccuucacuuggcuggcugacagccaagucucuucuagugcuaacccauaacuaaacacauuuucuaagaacagggucuucuuguaaguguauuuguuuuuccugagguauucuuucccuacaaucucuacuguuacuucauuggcuccacagcuucaguuuguaaaagaaaaaggcacagagagacuuggacacagacggucacagaugccucuggagcugaacaaagucuucugcugcaggcugauuuacuuauuccucugacacaguuucugcaacaacaaaaaugugcacuuuucacuguugccugacaccuucgugaugcuacagcaggagauagaugcaggagauuauaaagcaaguugaaaaacaacauuuuucugacucaaauauaacuaacacugguccagcugagcauuacuaaaaugauuaaaauaagaagcgucuaguggcaaccaaaaagcugugggauuuuuuaaaaaguauuuucuuuaaaguguuuucacagcaaagaugcaacuuuccauugcuauauauacgcuggucauaaacuguugcuuguuuguucacacuucuuucucuuguguuauaauauugauauuuaauaggaaaauaaacuacauagacuuuaaucuguaugcauccauuugcaaauuuccuuacaaaagaggacaaagcacauaggcauucacaaauucuaugccauuucuguuaaaauugguaucaucuauacauuauauuacaguauuaacaacuuuuuguucuacccauuggguaggauaugugcauaauauauucaacuuauauacagcaccuuacaaauaaaaacauaagaaaagacagacaacugaaaaaagcaccauuuuaagugaggcacaacaaaggugggagcaucaagugcaggagggggcggcuugguuccuauaucugcugaacucagaacaugaggcaccuuaguugcugaaaaacugacaugcagaucucugacaugauagggguauaucuacauauauauaaugugcacggauaguguauauauaaucucuauagcucuaacccucucccgcauuacacaaaaacaaggacacgcagagggaagaaagaaaaggaugaaggaagacauugcuuucuuagcaagacauuccuacacucagacagcagcuuccuaaugcauccaguucgagaagcagcagcagcagcagcagcagcaaaugacugucugacccuggcaguaacauaaacuugaacucugcaaaggacacagcgugccggguaauaaagaaugcugaaauauugguuccuaaaaaauguagaccacugcaaggcuaagagugcuuuccauugucuguucacaucucugugaucuguagcggugcuggcagcuggcggugguggaaauggcgaacgguaagccacgcagcugcugagaacuagcauuuaggaucugggcuggaagcaacauuuuuaaauuugugacuuuccucgcaccaagaaggggaaguucucccuuugcccaccugucauucaauuguccuuucaccucaguaggccaagcacgcggcauucuuggucagugugagcaggagagcaaagggcaggcuguggagcauguucguggcaugaaggcuuggcuccaagcacuggcuuuaaucacuuaagcaagcaacacaaaaguuaacagaaaccaaguaucuuucccaguuuuuucuuucauacacugccgagcuuuggaaaauuuuuaaaaaaugaaugguacacaaaguuaauguugccauucuaaguagcaaaauucaauaaacaagcagugcagcaagcccccgagaugggggcgcauccagucauggcugcauggggggccgggcucccugcgcccacagcagaaugucucugagccugccagugaccaacgccaugagccgguccuuugagggagggcuucggacugggugccgggugucucucuacuagcaaucaguaucuggccugaggacauauuugaagugcucugcaccagagccuuccuaaaaagaagagccgcuggauggaagauagaggauggccccugucagagaagggaacuguugguucagagaggaaggcagggauuuggauggauucuucuaggucagagaagauuucuaaaagugcuuccuuuugagccuuucucauucuuaugaagaugaaauaaaggugaaagagaucaaacggagauacgcagaaguucaagaaguccucgccuggguacaaaauuccucugcuggugucaggaggccucccccauuuacuguuggccccuauuuccugccucauaaguuugagccaaaauuagugaauggaaaugcaguccucacgauaaaucuuuuaaaaauucgcuucugcucucuugggauuucuuguggcuuggguguguguccauguguuuaugugguggggagggugaggacaugcuugucaagcuucuguauuaguaaauuuuggacacuaaaaauagaagaacuauugaaauacauaauuugcuucaugaaaucucuuuuccauuaaggauugcgucaguauuuaaagagaaugcuagaguuucugaaaaagcaaacguaugcuggaagauuguguucuuauagaugggauucaagaugccuugggucuccuacaccgggaacaagggacaaaagucagcgguaugcccaggaguguucauucccaccaaauguucuuccuaacaaugcaauccacacuuugcuggaauaaucuaagauuauaaaccuaucauugauugccuaaaucacucguuacuaaacuggacccauggguucuauaagcuaaaaaaaggguucuugaaagaacaauaggccccacuguguaaguuguaucuucccagucgcuacucuuucaacgccacacuagccaugaggcgacacgguaugaacaggucagccacaaccuucaaaagagcuacugaucuaaaucaccuuuuccuucugcugaagggaaauugaccaucaauucauguuaugaccuuggcuuuuaaacuaauucauuacagagccccagccucgaagaccuuucaaagucaugguuugauauguaugagucuuuaaauaacuauuuaacaaaggcaguucucuagggugguugaaugggaggagccucuuucuugaaagaugauuaaagguaucugaauuauguaauuaucucgccaauacuguggacaugugcaacacauucauauacucacaguuacuaaggaauucacaagucucugcucugagccccuucuugaggcagguagagaaguaaggacugugaagccauuugagagcuagagcuguggggugcaucuccugcuucaccaaaacugcaggugagaacugaaaugauggaaucacucaccucgccuccgcaucugugggcacaccugaccaagaauccacugcaagucccugccagcagggcccgaugggaacacgggcuccucaucuuugccugacagaggaagagaggcuaaucuggagagccagugaaccuucagggugucuccaggguuggggaggguccuucuggccccaagccaaucucugcccugagagcuggugucucuccagcagaggccuuccaacugucacuggaacaagacugaauccagucucagaaccuccacugugacucucaacuguauauacuuccacacagguuguaagcaugagcugacaacuggugccuguguuuuuccucucuccuuuuaagaguuggacuaguucuguggauguuacugugugcaaaggaugaauguaauggaaauuccaauccucaaaacaaacaaacaaaaaccagugaccuaucuacagagguaagaagcagaagggaacagacuaggaucagacaacucuugggguuuggaacagucucuccaguuacagcacagagccaccgcaccgacggaucaccuucgagacccacagacagacacaaacacacacacgcggauuuggcuuuaaggcugcauaggugggagucauggaaucaucauuccagcucaucuuguuaugugaagaggccacagaggcccacccuccacauggcagaguguacugcagauaagcccuucuccacgcgcagugucugcuaaacguguuggcugcugcucuuauaaaagccagugcuuacaucugcagaagaaaguuauuuuuuucauuguauauaagaaugaauauuuguaaauaucaggaauauuaaaacuaacaauauuuaaaauuaguuuucuaguugcauuuuaacugcauguugugcuuuuuacccggugcucuucagucacuugcccccuccacuguucucugacuguccaguucuugccuucaguacaaaagcuggccuggggaaggguuugguagaauccugcgggaauuuggguagguuuugagcacugcauuccuuuaagaaugcuaugcuaauacuagugacauacaauaacccacaauggcuuauuaccacgaucagcaacauggcauucuuccgucauuauuucuaggggcuuccaaagcauaagaaaccaccacccacaccacucccacacgaaguucuguguaggcuggaugugggguggcugcugggagccuccugugaacugagcagcccugcagaacugaacuaagcugucgaggaaagggggagaggcaaugggaauauacugaggagucacauauuucaacaguaugcagaauaaccaccuugcauuuuaaacaauuuauugcauaaaauaagguauguauuugaauauauuucaugcuauagugaaaaaaaucuaaauuacugaagaaauugcacugcuggaggaugagggcagcacugcaugauacuggauccauaaaugcauguguucauuuucucauaaacuaugcagccuaagaguagcagaguaacucaaaauaacaagucagaaaugcuggaacuuaaucuucccuaucuuaucuuccauccaaaagucuccaaaagcuucagcgaugcacugcuauuugaugcaaacuccugcaacaauaaugacuuuuuugauuuacguaaguugguaaaauguuaggcuacguccccaaauaucuuuucuuggaugcuucuggggaccacuccaggauauuccuugggccugauuacaauccacaggugaaaagacaacauacagaacuucacguaaaacaguucccuuguaaauauuuucaacauuaagauagugcaacuuuuaaaacacaucaucacaacacaaaggagcuccuugcacucaucuaacuucuccacuuuauaccuuggcacacaacacaggaauuuugauucauauuuuuaaaacaaaauaaaaguuccacaccuuaggagaaaaagcgaacuggcugguucuuccccacaauaauauauaauaaugcuuccuucuuuauucaguuaauuauaaaacaugccauucuggccucauuuaucugcaaagucuccuuucacaauuaaauacaucaaauaccucuguggguuuuauuucaugguaucuucaaagcaucccguucucuguuuuccccugcccacacccccaucccaaccccuguccccaaauaaacacuguuugcggucagaccagauggaaguuuguaucauuucagucuaguuugcaugcaauuccccuaaaaggaaucagaaacaaagaccguguuugcucauuugguuuuacuuauuuguaccaugugaaacugaacaacacugugcgcaggaggggcccagcggccgcuucccuucuugguuucuuucuccagcugaagugcacguuggaaggaaucagaccagguucccaggcuuccuaucuuugccuuugauggguacuauugugcucucugcauuguucugcugaaacugcagucugcugccccugugugcguugcugcgcuggugauggaggaaagaggcgccugggugguggcccaucaccucgcuguaugugggggguggccccuccauccucccguuacugcugcaggugcuugcacugaugcccgaguugcugcugggugggcauggacccccgcuauacauagcaaugucuauuaaaucacugucaaauaugguucgguuggguggggcccucacggacucucgguugaguuccaucugcuguucagggucccggagcugcagggugcagggccccugguaaggagguggcucuucaccgucggacagggagauggugggaggaagaucaaucucgugcugcacauagggguaggugggcuggaagcggcugaagcgaucccucuggaugaaggacggcgcugugaaccugucccuggaccgcggggcaugcaugaucuggaaggaaaagaggagaggcuugaagacaguuugagcgcaaugaugaccauaaaugugucagaaucaaggaaaguuacgcuugguguguguuccuaccaguuugaacaccaucucccaggaaaaaaaaaaagaaaacaggaaaauccaauuccagaaaaaaaaguguacuuuucugauuccuuaugacagaccacucaccuugccaaaucccagcgcauccaggagggcugagcaauggagagcuguggguaauggaaagcuugggcuccugggaguuucugugcgugcuacgugugcauuuuccccuuggaaacagaacacacuaggaacuccaagagucacagggcgaagagcacugcggccugcacuuggaucuggucaccagugacaucguccaguccucggcuucucuauaacuuacgaggacaggacagggcugccugcuuucucaggucccugccagcucuagaacuuagaaccuaugguucagaaaaguaaggaggggcuccgaguuuuuauuuuuauuuaauuuuuuaucuuaauuuuuuuuuuuuuugagacagggucuggcucugucaccuaggcuggagugcaguggcgccaucuuggcuuauugcaaccuuaaccuucugggcucaagugauucucccaccucaaccuccugaguagcugagacuacaggugcacaccaccaugccuagcuuuuuuuuuuuuuuuuuuuuugagaugggguuuugucauguugcauaggcuugucuugaacuccugagcuuaagugacccacccaccucagcuuccuaaagugcuaggauuacagucaugagcuacugcgccggccagaacucugaguaagcagaaguuauaacuucacacagugguacguggagcagauacaaagcauugggucgauuuauuaauuacuuagagaagaucauugccaauuacuuuuuaacaaauuccccccaaaaugacuguuuuuucuuuguggcuccuagacuuuuccaguuaucuggaaucugaauaaaaguuuccuguaguuauuuuuagucacugacaugaaaaauauuuuuuacucaaauaaauaugauuauaauaauuuauuuuuucaaaaugaauccagguaguacauuucuuacaaaaucuucucauuuguucuaccaucccaguuucuucuaggagacggcucuuuuauauacguacauacacacacacacgcauauaugcauagauguguauguguguauacauauauguguauauacaugcauuuaauauacacacauaucuacacacguacauacagauauugauuucucucacaccaauauuuuuaacuuaaaggcaaaaacauguuauuuuaaaauccacauuauuacacuuggagaugugggaaugaaucaugcuaugauauuuauaaaccaugcccacuugccaaggcacauuaguagaagcuuacgggaucauguaaagauaagugauucucaaauuguuuuugauaaggagcuuuagacuagcaggaauaaucccuggaagauucuaggggaaguccccucccgcuuuugaccaaaguucuaggcaaugccuuccuccaaaagugucagcccacguggugaggccccuccccuuccaccccacguggcagggacacgcccccuucauccccacccaccccccccgccccccgcagccaucaccuccuggggccccuuaccuccgaggcgcccagccgcggugcggcgcugucugaaggccacaggcacccuuccuggcggaggggaaggggaggagaguggggggaacaagaaacagaggaaaaucauuagccccgccgcaccuaaaaacaugaagcacaacuucuggaaacggggaucugcauaaaacguggagcgaggccgggcgccauggcucaagccuguaaucccagcacuuugggaggcagaggcggauggaucacgaggucaggaguucgagaccagccuggccaacauggugaaaccccgucucuacuaaaaauacaaacauuaguugggcgugguggcgggugccuguaaucccagcuacucgggagggugaggcaggagaaucgcuuaaaccugggacgcggagguugcagugagccgagaucuugccacugcacuccagccugggcgacagagugagacuccguaucaaaaaaacagaagaaaaaaaaaaaacaaaaaauagauaaacaaacaaacaaacaaacaaaaaacguggagcgagaaagagcccgucccuuuucagaccucuugucuacauggagggcugugaacaaaaggaaacauggaaaaguugaacuccuggccagauuagauuugaaguggaauauggcucacucucuacaccugugugcuugaaauacauucaagaugacuguccaaccgcauucaguggccgcccgaugagggcaggcuggguugaggaagcccuggcagagguggcccggggcccgcccgugcccugcccggccuccagcagaggcgcaaguccgcgcucgcagguggacggcccuuuccgagccugggcucaggauccuccagcgagugucuucuccaguccaccuauucacagggcagaugcaacuucacaucuggugaguuagcauccuuuuucaaaaacguuuggccagauugacaaggugacaggccagccacaggccucaguaaagguucuuuccaaggccccacgcgugcugggaaaaaaaguacgcgugguacccuuuucagcccagaguguggcugucagcaggguccgcggggcugucggccgucacgggagagcgcgaacucagcguguaggggcccgcguuuggggaauucucggaaacgggcgggcugggccaucacugagccuccgacggccccggcgccagcagcgagggacggcgcggaagaaacaccgagccccgcguuuguccaacacggcccuuuccuaagauacucggggacauccuggaaucaguggcaaacguauacggcgguccagcugcucggagacgaagggugggcucagggaccgccugugacgggagggaagggcccggccuggcaggcacagacgagggcggggguccggcgccagcggggcggaagcgggaagggggcggaggcccucccaccgcccagggcccaggcugggcccgcaggggcgcuccucgcuccgggagcccagucagccguagccaggaacgccgccagguccaucugcggggcacucagaggggcugagcgguuccugaaaacguagugacuguccccaguggccuuauuucccgaaaaaccagcaaacccggccaagugcccacaggagccgccguccaguccggcugcgcccccgaggcccggcccucggcugacccagcgccccgcuccccuugccgcaccccacgccgacuggcggccccgccagcccggacaggaaaccgccagaggcgcgccugcugcuccucugggccgccgccucucucccucaccccaguccucgggccccgcauuucccucgcccgccacaggccccggccucccuccuguucugcagcacugagugucugggcagaggccgcugcccuaggcggcaccugcuguggcuugccugaaugcaaggacuaucuuaaccuaucuaaucaaucgauggauccaucuaucucugucuaaucuguuucucucuauucauucauccaucuaaucuauccaucuauccuucuaaucuaucucuauccauuugucucugccuauccaacuuauccauucaucaagcaaucuaggcuaucuaucuaaauaucuguaucucucucucucucuauuuaccuauccauccaucuaauccaucuauugagauggggaucucgcuaugcugcccaagcugaucuugaacuccugggcucaagugauccugccucagccugcuaaagugcugaaaucaccaugcccagcuaaaggacucuccuccucucugggaaauucacagcacccacaacuaagaauuguugcuguugacaucucaucagacuugucucaucuuuuccucuauauguguacuuuaaaaaacuacacacguaauacauguauacauucucccuuguaccacacacaaccaaagccauuuuagagucccaaauccacccguaugcuggugcugcaccucugcacuguguguuuuuaauaaugcauuucccagaccuacaugcgugacacacauuguuuaauuuguuaaauaaguaacuaaauucuuucuuaaggccugugaacccaggugccccucuucuccguucccucucucauuggccuuauccggccugucggcaggucuucuaacgcaucccacagagaguuccugaggccaggaaaggggugcagaggguaacgcagggcaugccugcagcccuggggucuccuccccgccacaccaccuuccucagccuugcugcccgggccaagccagcccuggaccuuucccaggccagcccaccaguguaggucccaucugcuccuguugcucaaaacaagggcacaauuguuaccuauucauuuugcuugcugggguggaaaaagguguucugcccugagguucucaaagccugagaaccaagccuggagcaggagaguuggccacugguagagaggaguucaggccauuccugccuugggacaucugccagacgggauggccuggagaugggaacuuuuccugccuggcuuuuguuuuuugcaggaauguaacagcaaaauuaaaaaucuaaaaugggaggaaaugcaucuacagucccaucauccuaauacuugaacggauuucauuuuuuuuuuuuuuuuuugagauggaaucucgcucuguugcccaggcuggagugcaggggcgggaucucggcucacugcaagcuccgccucccggguucacgccauucucccgccucagccuaccgaguagaugggacuacaggcgcccgccaccacacccagcuaauuuuguuuuuuuuguacuguuaguagagacgcgguuucaccauauuagccaggauccucucgaucuccugaccuugugauucacccgccucggccucccaaagugcugggauuacaggcgugagccaccgcaccuugccaguuucuuucuuuaagugcuuuucuaaugcuuguucauuugcauauauuaaauuuauacaguuguaaccauaauguggccagaguuguguauucucuucuucacagaguauaacauaagcacuuuccucuaucaccaccaguuuuuuccagcuuuauugagguauaauaauauaacaaaaauuaugacuacauaauaauuuauuuaacuauuuacugacaauugcccccugccccaauuuauuuacuuuuauaggaaacuuuuuuucccaggccuuucacccacacaguacauggggacauuauaacuacaacaugcugugguggaagagcuugaggccaaaacccgagaaggcuggcauuccagcucugugccccaggcugcuacccagaaaacccagaugggaagacugaccggaguucuagaaaggcugaaucccaaccaccccguaccauuagcugaugcucgcuccacagccuucucuggucauuccaccaaggcugucacacgcugauuguuggcaaggucaccguccuuagcccuuaaaccucucaugcugcugaugaagccugcuggcuccugcuccaucucugucaaacgagggugugacucugugacugguguccuccaaggggcuugugccaacugagagagugcagauagcugaguacaaagaugugucucccuugucuagguugggggucucuucacucaccccacaugcuauggagaacauuuucagggagaagggggcucacuacacagcuggcugccgcucagauggcagcauucccgcauacucauuauggggccaauuuuaaucaacaaugaaggcacugauguucuuggcuaaugcuuacauuguuguaucacucaaaauaagcugugaaauaagauaauacuuaaaguaguucacagaauuuuaagcaauaggaacaaaacuuuguuaauaacuucauacaggcugaaaugcauucccugucuuguaggcuauuuccuuguaauaacaaccaaaagggaggcagccauucacccagcuguucauuaaugaccucacuauacauguacggaauacuuccuugcagcgggucucaguccucuuccauugcaacaugugagcagaugugcacauguccaacagauacuggugcugcauguccccaagggcugggagacaggggcucugcacaguucccagggcucauggagucacucuaaacccaagaaacucaagaaagcauccuggaaugccaguggguuagagggacauuacucuagggaucacuuugaaugaauucuaguuuacuuuuuaaguuacguuacucucaaaucacucauguuugaccauuauaaggaccaguuccuugagacccacaucgcacugagcaggacuuaucaggggcuguuauaccugccccaggaugcuuacgagagggcaccugcucugggggcacacaggucuggcagcagcuuucagaggccucuuguaugugcacugccuugcaagcauguuuuuauucucuuauuuucucccuggaacaaaggcaguaacaaaaaagguaacaagaauuaucugaugacaauuuaauauuauacagauggaggcuaccacuaucagcauagguauacaucuguaaggguaagaagucucugagguagguagccauugcauaggcuagaauucuggccaugcuuuucauuuuuaaauuuaaaacauuuucauuuauuauuuuuuaagagacaaagucuauguugcccaggcuggagagcagcacauuuucauaaaugugcucauagcauugaacuccuggccucaaacacauccucccaccucagccucccggauagcugggacuacaggugugugccaccgagcucagcuucugccacuuuccaaacugugaucucaggcagcucauuuaguuucucccagccucaguucccuuauuuguaaaaagagguugucaugaggcucaaauaccauuuaugagaauuccuuagcauagugccuuaaauaagcuucagcaaacagguagcucuucucaucacagguaaugguuacuugcuguuguuaugcacaguuaaagggggauaaauuuccauuaccucucucucucuuuuuuuuuuuuuuuuuguuguugagacggagucuugcucuguugcccaggcuggagugcaguggcaugaucuuggcucacugcaaccuccgccucccggguucaagcgauucuccugccucagccuccugaguagcugggacuacaggcaugugccaccaugccuggcuaauuuuuguauuuuuaguagagacgggguuucaccauguuggccagguuugucucgaacuccugaccucaagugauccacccgccucggccucccaaagugcuaggauuacaggccugagccaccacgcccagccuaauuuccauuaucucuuuuaagauauuccuuuaaagacaacaaguucauugacauuuccuuauuuuuuuaaacaguauuccaaaggugguguuuugaauggaaaggcugaggaaugggggcagcuuaagcaauguuguguuaauuccagauuucuucaggagcuuucucuuaagguugggcgcugcauuaaccaagagucuccuuacaggcaaguucuucucuggcucuggcuacuugguuucagaagaaccccaggugcuacacagaccaauggcccgccacugcauaaagacuaucugcgcuauuaaaacauuagcccagcauggcagucagcuucccaccgaggcagucaccaugacuacaaaccucagcagagauuaucugcaccaugcacuguuuucuugaugucaugaggucacauagggaggcaguggaugggguaaaaaacaacaacaacaacaaaaacaaaacaaaaaaaacuuuaggccaggcacgguggcucaugccuguaaucccagaacuuugcaaggccaaggugaguggaucaccugaggucaggaguucaagaccagucuggccaacauggugaaacucugacucuauugaaaauacaaaaauuagucggguguaguggugggugccuguaaucccagcuacuugggaggcugaggcaggagaaucacuuaaacccaggaggcagggguugcagugagccgaggucaugccacuguacuucagccugggcgacaagagcgagacuccaucucgaaaaaaaaaaaaauugcugggugcggugguuuacgcuugugaucccagcauuuuggcaggccaaggcaggcaaaucaccugaggucaggaguucaagaccagccuggccaacauggugaaaaaccgucucuacuaaaaauacaaaaaaaauuuagcugggcacgguggugcacgccuacaaucccagcuacucaggaggcugaggcaggagaauuguuugaaccugggaggccgagguuguagugagcagagaucgcgccgcugcacuccagccugggcgacagagcaagauuccaucucaaaacaaaaacaaaaacaaaaacaaaaacaacuuuauaacauucaacuuugugaaaagucuuuauuuuccuuugggcuuuuuuuuuuuuucuaaaaugaaaucuguauugugaaugaauacaguggaccguugaacaacauguguuuaaaccuggcuguuccacuaaaacgcagauuuuuuucaacccaauguguauucaugagauggaaaagccucucauacggaggggccgaccuuuuuuguccauggguucagcaggacagacugcgggacuugagcaugcugggacugugguguuauuuggagguccuagaaccaauccccugaggguaccaagggacagcugggccuugcuguuugucauucuccugugaguguagucacugucagacaaucacuccuguuugaacaucucugaguaggaugagaacauuuuucuuuggggucuauaaggcugugggcaggguuuugacagcaguaaacacgccaaaggcagaggcuuuccugagacagucccuagccgauauccacagaaggcacaaucacacacacacacacacacacacacacacacacacacagcauagcugucuucucugcugcguacacuuggaacucuaacguuagucuagagcucuggccucucuggcuuggcccuggaaguugcccccaagggcagcuccggagagcauggcugcccagacccagggaccacccugaggggcuggcuggucaaaugacucuacugaauccagacuuauuauuccuauaucuauggaaaagggacgcagaacgguuccaaaucuugcaggcuugaggacagacauuuucagacuccuuuacacuugagcaaucuguuucacauuuucuuccuucugaauggucagugaacagccacacuaacaggaaaacuccccacaaauucaaucugcuugacaccaaaacauuugcauuaaagagaaaaaauaucaccggaucuuccaaaugauugucuuuauggugcugaaaaucaagaugugcaauuugcagaucuggagcacagugacugaauuuuuuuccuuuuacaucagaccauuuggcacuuuuuuggggggagaugggaaauacuccaauguuaugguauuuggagguggaaucuuugcuagguaauuagguaaugaggguggaguccucaugaaugggaccaguacccuuauaagaagaggcuggaggcuagcaagcucuuuccacaagagaagguggcaguuugccaccgggaagaguggccucauccgaacccaaccgugcuggcacuguggucucucaugucugaccuccagaaugagaaaucaguguuugcuguuuauaagccacccggucuacgguacuuuguucuagcagucaaacuaaggcugaauuucaaaguuuuagcucuuauguuuauauuuuuguccauuugaguuaauuuuugaauauguuauaaggguccaaugucacucuucugcauguggcuauccagaucccccaucaccacucugaaaaggcuguccuuuccccauugaauggccuuggcauccuuucugaaaauuacuugaccauauauuugaggguuuaucucuggacucucuguucuauuccacuggucuauauauuugucuauaucccagcaccacacuacaaaacuuacuacagcuuuguaguaagucuugaaaucaggaauugugagaccuuuaacuuuucaaaucuuuuuuuuuuuuuuugagauuauuguggauauuuagggucccuugagauaauauauaaacguuaggauggauuauuuuuccuauuucugcaaaaagccucauugggauuucaaaagcgauuacacugaagucuguacacugcuuuuaguaguacuaacaucuuaaaaauaguuaagucuuccaauucaugaauacaagauaucuuuccauuuauuuguauuuucuuccauuucuuucagcaaugcuuucuauugcucagugcacaagucuuucaccuccuuggguaaguauauuucuaaguauucucuuuuuuugaugcuauugaaaauggaauuuucuuaauuuccuuaccgaauuguucauuguacaugaaaauaaaugcaauugauuuuugcauguugauucuguauccugcuaacuuugccaaauucauuaguucugacacuuuuuggguuauuuuuaaaauagaaucuuuagaguuuuuacacauaaggucaugucaucuucuaacagauacuuuuacuucuuccuuuccacuuggaaugucuuuuauuucuuuuucuugccuaauugcucuggcuagaaugucuaauuaauacuauguugaacagaaguagugaaagcaggcauccuugucuuguucccggucuuacaggaaaagcuuucagucuuuuaccauuaaguaugauguaagcugugggcuuuucauagauagccuuuaugauguugaaguagcuuccuuccauccuacuuuguugaggguuucuaucaugaaaguauguugaauuucaucaaacacugauggcagugguggcccaucuggagcagcugcugugaagaugcuggcugcagcaggggaggcauggccagggcugugugcuccacggagccggugagagccaggaacaggugggagcccugcccucuucugaguugguagggcaggagcccugcccuccugggugcagcugcagucacaaagcugcagcugcggacccagggcaucccugugcucucaggguccuagcgaaguccccugccccugcaggcucagaagugccugcuccugcuaccuggcuucuccccgcuccugcugccugcuccaauuuuggagcaaagcugaggcugagccugggcacugucacaauuuggccaggugugucacaauuuggccaggugugucacaauuuggggcagcgcugauaugccagcccccugccaccucagcccccuccggacuuugggugcugacgagcaucagugggaggcugaggcaggggugggcugaggguggguuggugugggccugcaggugccccuugacaccaacagccugggcaccguguacaugacugauggcagcaggaggcagacaggcuccugggcaaaaaggggcaggucccugcugaagccccaccuucaagccaggaauggccuaaagcaugggggccaagcugucaguucugaguggaguccacagaccagaguaagaacuuaggaugcuuuuucugggccugccuguggccguccauggaccaaucagcaugcacuuccucccuuuugagcucauuaaaaauccuggauucaguuugacuugaacagacaucggaucaaccugccuguggauaggagcuacucacugcaggucuccucuccacugacggcuagacacuuauuggcaugaccugccugaggaaaggagcuacccauugacagacagacauugggaugaccugucuggggaaaggagcuacccucuaugggucuccucucugcucugagcuggacagacgucaggaugaccugccuacagaaaggagcuacccauugacagacagacauugggaugaccugucuggggaaaggagcuacccacugugggucuccucucugaucugagcuggacagacagacaucaggaugaccugccuacagaaaggagcuauccagucugggucuccugagagcuguucuguugcucaaugaagcuucucuccaacuucucacccaccaguuguccauguaccucauucuucuuggaugugggacaagaacuugugacuggccgaauggugggacuaaaagagcuguaacauaaacagggcugaaacaugccccuccacucaccacacugugggggacaagaaggaaagaagagcugugacccuuagggcagcccagaccuaggguucuccuggccagggcugugacaccaucuuugggacucugcaguuccuggugucuccaagcuuccggguaccaucacauuccccucauccagacgcaagugccugcaguggaugcugcaugcaguguaucugguccagcugcagccuugcacagagcaagcaccugugccaguaccuggagcugccugcccugcugcagcaaccagcgcaccuggcugugcacaguggcuggaccuugcacucacuugcucacacaccccucaccauucugugccuggcuugcccuuggcaggugugggaucugggccaguaacgugagcugagcgcagccugccaggggaagugggcaggaugagcccagugggcaugagcaauacucaggcagaaggcaccaccagccacaaagguuucugacuggcgaagugacacccuaaggauccugugacaauacuauuucugcaucaacugagaugauugugggacaagaacuugggaccugcugaaugaaguuugggacccccaacuucauucuguuaauguaguguaugacacugacugaauuucauguauggaaccauccuugccuucugggaauaaaucccccacuuguugaugauguauaauccuuuuacuuuuuuaaauuuaauuuuuauuuaguauuauuauuauuuuugagacagagucucgcucugucuuccaggcuggaguacaguggcacgaucucaggucacugcaaccuccgccucccggggucaagugauucuccugccucagccucccgaguaguugggauugcaggugcgugcccccaugccugguuaauuuucguauuuuuaguagugacagguuucaccauguuggccaggcuggucucgaacuccugaccucaaguaaucugccucccuuagccucccaaagugcugggauuacaggugugagucacugugcgcagccaguauaacccuuuuaauauacugcugaauuuaguuugcuaguauuuuguugaggacuuuugcaucaauauuuauaagaaauauuagucuaugguuaucuuuuucugcugugucuuugucuggcuuugguaucaggaaugcuggccucaucucauaaugaguuaggaaguguucccaccucuugaaauuucuagaaguuuaagaaggauugaugucaauucuuuaaauguuugguagaauucaccacugaagccaugugguccagguuggagauuuuagaccauugguucaaucuccuuacuagcuauagaucuauuaagauuuucuauuucuucaugauucagucuugguaggcuguuucuaauaucuuuucauuucaucuagguuauccaauugguuugcauacaauuguucguagcacuauuuuauaauccuuuucauuucuguauuuauuggaucauuuuucuuccaaccaguacaucucauauuauuaaaggacagucgucugcagccaugacuuacugaggguucccuugugcugcaccaugggcugucgccugcugccaugcguccacgugugcaaggccacaccacgcccgaacccugcugggcuuaugcucucagcuacacucuccuuuccacacacacacagaggaccccaggaaugaucagauguggggacuggaaacaaccagggagagcacugaacacaguguuuuccaccaugugcuuugcagccucuuagagagcuggaaaauccauuuaagugggucacagccagcauuccaaaaacugaaacagaacagaaaugaucugagcacacuguaaguauuguuuuguaaaaccucugccuuaauugcauuauaggaggcuuuuguguugugauauaaaauguauuucuuacuguucuucauggcaagauacagauugaaggccuccgaaugaagccaguuaucccucauuuuagauggggggaaacugaggacagagggcauauuccucucuaggcaccucggucagucugcgguaaagcaagacuacugcuggguauucugauucuacccaagggcuaaccucccagugaaugaauguauuuuauggccucaaauaguuggaaaucuauuuuuccccuguuccacagugagaauuucaaagaagaggugaaauugaucuuuggauauucagcaacaccuuugccuucugauaaaaucaauuuucccuguuuucucccuuuuuucaugcagccucuccaccauccugauauuuuaucacuaccguccuuuccacucuagauggcagucacagccuggaugugaggccaguaccccuggcugucagagacugcaccucccccuuucuuccuccuggggaauccaucaucagacuucucagauucaagaucccccaacucugcucaaucuagggcacgucccuuaagagaaaagacaaaucaucuaggaaggucugcuggaagaaaaggaagggaauccuuucuauuucugggacaaugcaaugggcuagcggggaaaagcaauaugaggugccucucccagcuuggugcugggguuagugagcaaucggacuucaagaggaaucagccugggaaugagaaaguuccaggcagcaggaaaauguggaaccacacaagauccaggcaggcaucauccugauuucagcaccaguugccucgucucacaugugagaagaagucagagcucagaggggauuuucugugaccuucacccaaggucacagagcugcuggggcuuugccaagagccagaccccagccuggugagccuccccaacaggggccacccagaguuaugaucauuaagauaauuuuuaaucuucuucucuuuuuuuuuuucagaacaaaccacaccaacuuucaaggacuaagcaaaaaauaaaccaacagauuuuacuauuagauuauuaaugcuaauaccuuauauauuuaaaagauuacuauaaauuuguugauaaaaauguucauacauuuuauuuaaaauuauuauuuuagccaccauagaaaccauguucaaaugaauuacucugggagucuauagaugcccagaacauuacugccuuuagcaucaguuuacaugaucagaggauguuuuguaauugcaaagguaauacaugaauacauucuuaccauaaaaguuuuacugcacagaucaguguuccuuuguccuuacuuccuucccaggcacagcugucaguuugcuguggguccuuccugaccuuucucuacagaucaguuuguaacucggacgucagucucacuaauugagucgugcuugccuuugcaccaaaauuguaucauuugguuugaucacccauauaaugaacaagacuuaacucuaaauggauuuuggcugguaccaaaaaucaaaucuauccccaagagcaaaacuauuugcucuuugcaaaggaagauuugccauuguggagaagcuuuuaaaaaauuucccuugauuaaaaaaacaaacaaacaaauaaaaacaacccagucaggugcaguggcucaggccuguaauccuagcacuuugggaggcugaagugggaagaucguuugaggcaaggaguucaagaccagccugggcaacacagugagaucuugucucuacaaaaaauuuaaaaauuagccaggcaugguugcgcgugccuauagucacagcuacgcaggaggcugaggcagggggaucaguugagccuaaauguucgaggcugcagugaguuaugaucaugccacuauacuccagccugcgcaacaaagugagaucuugucacuuaaaaauaaccccaaaaccugaagguaauucccaaacauucugagcagugccaacaucaguagaaggacuauuugagacacugucacuuuaaagauaagcauugacucuuccaaagcucugcccacugugguucaggugggaaucugcgugcagcugggguccagcauccuuaugcaguuucugccgggccgcuuggccuccuguuucccuuaauugaagggagauguucucauuuugaggugaugugaaauugucuauccucuaaugcuucaauuagacauagcaaagggcaaaaccuuucaaaugaccaccugggcagccugauaauuggaaguccuugcucacucagacagacaugcugcggccaacccgccggacccuaagcucuuggaaaugcaguuuccgugaaaugcaguaacggagagcugucacuggacaaccgacaaacacacacaucuggucuguggugcagcagggucugccuugccugcagggaaacgguccccugcgguucauccccacaaugaugccagaggaagccuguggcucuuuucuuuagucuggagugucagaggcagaccgaguacaacugcaucaguaagcccuuuaguccacuccuucaagccuuacugaaaaucauuccuuuccaucguuuuccacaugcuuuucuaaacguaugaggugggcaggagugagagcagcagggcacagcgagccagcgcuccagccgcagugggaaugaacaguguggcgcugaaaccccugcucccugugcccuccgagggaucccaggacacugccuguggguuucucaaacaccccugagccuggggcccaccucagagccucuaucugcaggggaggguagagggacacugcccagguagagaaaggcacucgucacauauggcacacccagagguccccucacugugaguucugagccccagcacagcgggcuccuggcugucagacaccugcccaggaccgucugcccucuggccaccgcugcucccaaggccagcagagaggcugcuggugcagggccgagccucagagagcggggagcccauggccaccucugucccucuggcuauaagcuuuagucacagaggagggccuugccuggggagaugacuggacagcaguggccacgagugaccaugucaggcugggcacaggacacgcacagcacuguugacccagacacgugucucaacuccuaaccaggcaggaacaguauuuacuuccacaaggaccuucucacccauuuuucugggaaccaguggcccucucagucuaucuuggucuucagccuugcaauagaagccugagugcagaagaaaauuuucucugaaaaacaacccccacgugcaaacccacagauggcaaugcugcugcccggcacugaaggguccccagcgagagacaggugacagcccgggcagcacaggcccacuccauggcagccaccucacagccccagccucaggguguggccccauaggcugcuuuuucaagagaagauggaaacuccaauuuucaugugaaaucucacaauuuuuauuuuuuauuuuuuuauuuuugagauggcgucucccucugucggccaggcuggagugcaauggcgugaucucagcucacugcaaccucugccuccagauucucuugcuucagccucccaaguagcugggauuacaggcacgugccaccacaccuggcuaacuuuuguauuuuugaguagagacaagguuucaccauguuggcugggcuggucucaaacuccugaccucaagugaucugcccaccucggccucccaaagugcugagauuauaggcgugagccaccgcacccagccccaauuuuuaaaagcuagaucaacuuagguucgaacacccuguggggcaaaccagguacacagccaugcucuaggcuaacucuguggcuucugcagagagggacuuguggggagagcucaccccaugucagggcacuguggaucugaggagcaugaguuucugcaucaagagggcugacagccaccaagugcuuguccuccuccgcaacagccagggccccucccagugucaaccccagggagcuggaggagcccagcugugcuggguggggccuggcugcuccuccuggcuaugaagaaugggcaccuggauuuucacaaucgauuuaaucccuguaggaguugauaaugaagagaugugugaugugauuccuuuuguuaauuuuuuaaauugaaauugcuguuucuauaggucaaaauggcugaauguuaacaauuucauaugcuucaaucuggguaaaggucccugucccucuccugccucucccuccauccgcugauggccagacccuucugccugcaugccauccccuaccccugggcuguccacacaggccaggcuggacccucugggccaggcugcuggcagucagaaaaggucaccugggcucccucagcuccagcaagaaauguuccagcaacuuguucaaauagcucuccgggcugugucuagaauauucaugccccuuuacugcuuucccauuacugaauggucuaagauaaugaaaagaaaucuagacagucucaaugcucagaagucacacaaaccaggcuccaaagaaaccaagcucaggcuaccucagcaagaaugcacaaggaugcagauccggacccgccgcugcuaucugcuaugauguaagcauuugcuuugucugugauguaauucacaccugaguugcuaguuuucauuuucauccagaaaucacuacuuccaccacauucaggcccaguaacauccauuccuugggccccccugggacacacagugucuaccgcauggcgacaaagguugacuggcuuugggacacccaucacguucaugcagcaugcacugucccaggccaagggacaugggaggaaggugccagugucaggaggaugcugguagaggggaggagguugcugguggagggaggagggcucugguggggggaggagggcucuggcggggggaggagggcgccggcugaggggaggagggugcuggcggggggaggagggugguggcagggggaggagggcucugguggggggaggagggugcuggcagggggaggaggccucuggcggggggaggagggcgccggcugcggcuccucaccugcaccugcacaggagcacacccuaugggacagggaccagaacuggcugagcugggcacucccucaggaaggggccagagaaggcagcggggcagucaccacuucucagaacgggacucuccgcaagaagcagagaagccagggccacagugaugcugucugguuaagcuuggucuggcccuuccuuguggucaaaguggaaaaccuguagaggaggcgaggggccgcucauagcagggcgggaagcuuccucagccaaguaaggcugcuggccugcucauccuccuccuccaaaccaaaacucacucccauccuauugccccaagcuauguuuccaccuccacucuccaggcuuccagcagaaagacguaacaguaaguuuaaucagagugugaagccuaaucaccuagaaguugguuaauucaaugcccagcacuucucacaccagguuuaaauagaacaucauuuucuaaugugcucauggagcccuggggugggucucuacaaacaggcccucacaggaggcuccccaacaaugcacaggcuccuaaugaggcugcgcuccacagaggggacaggaggagcauccaaccccagcugcugacuggagggugcugagccgccgccagggccuggacucccagggccucgggugcugcaggagaaaggccucggacauuggugcugagaaaggaagaggugcuuaggggcuugcaggggcccugauaacuggaaagaagccaugaggauggcagcaucugcccagacacacucauccuccccagccgccuugcccuggagcacaggccugcacagcagcacagggagcccaggagacagaggacugccaggcucugccagggggcacagggcccucccugccaugcugaccagccagccgugccuucccagccccuuccaagccccuugggagggggcuuccugacacagguggucaccuagggauggggaaggcggggaacuuggaacugcccucgccaacugcacaugggccaggccaggcauggggacggaggagacacagguccucauaccugccccaaacaccuccuacagcucccacgccugacacucccccaucccaaaggcacaaucggccagccagaccccuagccuccccuaggaagauggagagaauggcagcggggucuuggccuccgccaggggacugcaggugcugcugguggcggaggcggggcauggccacuguuucccccuccuacucagugccuggcuccugcggaguguccacugaauggcuggaugagcagaggaggcaggagucacuggggaaacuguucccaaggcagagucccagaccagaccccaaacucguacugcugggaagagcucuccgcucuguggaugccucagagccagccuagagagacccccucaugguaacaggcagccucuuuuacagugaagugccccuggguccggcagugcucagcaccugguggguccggcagugcucagcaccugguggggccggcuccuccgccucagcaccgcucacauccacucagaugagucuuuguugcgggacugccugugcacuguaggacgcacuguacagaugagucuuuguugcagggccgcccgcguacuguaggacacauuguaggauucccccuuaugaugccagacacugcaaauguccccuagacauuuggcagaaucagcccugaucgagacuccugagcugaguguaaaugaaucagaucgcuccccuaauacuguauacggggaacaggcauuucuuaaaagaaguuagaaguagggaauuaggaggcaggaagccuggcugcgugggggcauuccuggguggagaggaccuggguuaggggacccucagggcagagagagggaaauggauagcauggccacacccauaguauuagcaaggccugagucuguguccaggagagaauggagguuucuuccucaucagcugccacucuuuucucuuuuggggaaccaucaacugggcuaauacaccagaucgggaaguggagcaagggccugggccgagcugccucuggucaucgugcuggaaugcaucuuguguuuuaugaaacaucacacagaguccuuugcuaagcuacgcugaagccguaggaggaacagccacaccucgaggagggacagcucccaguuccagguuacucagaaaaaaaggagaaauagcucggugcagccggaucucugcaagccccagcucagcuccagaacggagcucucagggggaacacuguaugugcacauuaacaaaacgaggcccagacagggauguggaccacuguguggacacaauucacuggcugccgaaugucuucaccugccacgcagugugcagcccugaagggaccucugaacaucgcucugucaccuuccugauuucagggaagggaggcucugcagguggggcagccagcgcuucccgggaaagggcaucacacaaaucugccgccacaugacacagaagacacuuuuuugacacuuuuugcuuuucugcugggccucuugguugguaaggguguggccagugugcugguguucaggacacaaggugcuaugaacagggacagcaagcggggcugggucugcaccaggaacagagcaaggagcugccugacccacacuagggagagagaagccaacaccagggcaagucugggaggaagacuggggagcgcccaggcaggggacagaaaacucccugugugccugcgcacagagaccccaagcguucuggagcuccuggagagaaggccaaggaaggcugugcuuguuuccaccaaguccagggguggcguucacagcccguaauacauuaaggcaaagcagcgaugucugagccuucugcgguucugaaacugcugcugugaugagauuuucucccuguccucucucaaaacacaggugaaucccauacacuguguguuuagaacuucagaagaauuaguccucccucuguccaacaaucuacaggcaucaggaugccaaaguguucagugcgucuggauggcgcagcucuguggacaccagacaaaggaccccaggaugcuguggaggcucgaggaaaguaacacaacagggccagaggggcuuguggacugaacugggcauccagagagaggacagaaggggcaagagaggaugcagggggcaagaggaggaaacggcugucaagggugcacgucuuccccuggcaucccaucuccuccccgaggcugccccgucuagcccucaccauggucugaagauagcacucgguagcacccaccccuuccuucuccccacuaccugcaggagcugcagagcagacagcaaaccucagcucugcccauauggauggcugcaccaaugauccuagugaagugugagccugcacuccugagaggggucccagggccagcggccaccccaggaaacccaccuggacagcugcaccccauacccuggacaggcucuguaagucagggugggagccggaacugcacagcccuguuccugaagagggaugcuccguaaggaccggcuccugugcucagcauaccgcagggcuccacacuguggagacucggccucgcugcccaucacggaagccaaggauuuauacgcucgcugaacucaccgcuccuaacccucuggcuggaagccaucaaaaccacagccuguaaaacaggcuugggacagcagccccuggucucucaaguuugaucauagugcaguuuggcuugaggguccaccgccgacaaccccacccuccacaaccccacccuccacaacccaccgccgacaacccuaccgccgacaagcccaccgcugacaagcccaccgccaacaaccccaccgccgauccccaggaagcucccgaggccuuaagcuccaggcguccuccagcucauggcacccaugugcugccggcacguuuagugacgaugagcgcgugauuuguccccgcagcaccuccaggacccagcucaggacaggauuuuacaacacaaugaaucucacaagugcacugccaagccagaggagccaggcacgagggaccacccagggccggucccguucgugcacagcucagaagcuggcaaagccacgucgggcagcaaagauccaggggagaccugggaggggucacgcaggcuucuggggggacugcugugucuguauguucacugggugcuggucacacugguguguucaguuuguggggacucacuaaguggaacacuuacgaggugcgcuucgccccguuuguuacaugucaacugaaagcacucccggccucugaacccugaugggcuccuaagccucuugcagcugccugacucuggagccggggcggccaggguacucaccugcggcagcccguccucccgccuccggcucugguucgggcgguugaugaaggaccgcguggagacuuuguagugguucagcaggcagacgaugaccaccaccaucaccgugaccaccacgacgaugaugaugauuugggcgaacuccagcuccgcugccauggaagaggagagugguuagccaccuggccccuccaguccccacccauucuccaggcacugucaccaccccagccaucaggcccugaaggccucucacacacgucuguuccucagaggccagcaggacacagaaacgacugucccacuuuagggaaggagacaccacggcacagucgggaggcugugcaaaccagcugcggggagcgggaagccucugccaucccccaccacagggagcugagaacgucuccacaaacugaagcuauuucuccaaugucaccgcucuagaaaaguuaaacccgucuuuaugguugaguggaguuucucaaagcaauuccccuagggacccauacuugaaaggaaaaaucaacuucagccccuugccuccaaggcuguggcucugcaggugaguuaggaaacauccacauuguuuccaggccuucaggcacagcacuuuaggaguggucaggucuccccuggguuucugacaccaccaccccaaagauuccuuaaaugccauugacacacacuucacaugugaguccagcaacacagagugacuuccagucacagcacauugggccggcagcuggaagcaggugagccagacccccguuuugggagaggaagcaggucgagggcucacgggcggccuggagccacuuucugcuccccucuuccagcccauggcucugcugccugcuucacuccuugucccccgugcuggaaggaagugacugaccgugcagugauguaaauucagagcaaggggcucggggaugcuaagaggaagacagugcaggaaucugggggaggcaggaguaagaagagagaagccaucaacugugcugcccugggcucacagcacacaugcacacacaugcaugcacguacaugugccgcagcagggcucaggccccggccaguggggaggcauaucugucaaguguauccgcucauacguggggcgaugcaggcagagaucagguggugccuccccaguggcuacgacugugugcgucugcugcccacacccugggaaccgagggugaggcuggacgagggguucucuggauccccacauguccuacccuucagcacggcccuccacuuccacccucagacccccacacccuagggacugagggugggaguggagggcagugggacacuggggccuauaggagaggcgcuggugucuugagaaugaagagcagacuguguaggaggcugguggcugagcugugcagagagcagguggaccugccaagggcccccugcccccgcaggcagggagaggccaggcuggugggaacaucacuguucccuguggacacggacaaagccaugcucagaggcucagaggccaugcccugagcagcucccgaagcuggcagucagugaggccugccggccccgccccagccaagggggugcuguugcucuuggguuccccguggccuguccgcuaaguggcagggacucuaggggccuggugcccggcccagccuugggguuugagugucuacuuccuauggggaggaaauguccauuggagcugccacacuuauaugugccacccccgcccccccccggccccacccccccacccacacacacacaaaaacgcuccccagggcuuaucaacaauuuucauguugggggcuuccuggaaaagacugaaauugcucugagucuucgagcaggggcuugggcccuuugcaauuggguuccaauagaaaaguggccuuauuucugcucacaggccaugggaaguaugacacgcuuguuuaccuaggaacacagucuucgacucugccccugcacauaaccuuccugugucugggacacucuggccuugacccuguguuucucaggacccuacccccacacaccaugugacgucucccaggcugaguccggagccccuacuuugccccucuugacacgggaggcagcuaaguggcuuaacugguacaaggugaauugaugagcgacucagcacccccaggcugagagaaggggcugggauguguggccccggugggcucugcccagcugcauggguguguucucugugaggacagccacugccaacaggauaaggcugcacuggcugcagagugcccgagugcgccuccagcagcccugagggucugugcaggggucagccaccagcccagggauaagcaugaaaggaagcagagagacuccgcucaggacaaaggcagugaacacaguggugagggcugaaccccgaagucgaagacuguguuccuagguaaacaagcaugucauacuucccauggccugugagcagaaauaaggucacauuucuauugugaccugaauaaugccuucuuuuaccaaugcuuguuuuuauuuugugguuaaauagcggaguauucacaaauuaaagcaugcccuaggauuuccaaauguuuucuuuacaagagaacuucacugcuuuauggacauggauauagaggaaaaucauggugacagggaaggaucagcacaaaguccugcaaugaaucaacucuucccuuggaggacaccuuucuaggucaucuguucuugacuauggaaagcuaugcagacaagcauuugcagcaaagcaaaucaaauuauguuuucacaagucucugggcauuuuuuacauauuuguguuucauuugaaaaggauuuuuauuauaaaaauaaugaaaacuucuugaaaauuuaaaucauauagaaggaaacagugcaguguaaagucucccaucccaacccacagcgccccugacuccaccaagccccacuccgucccgggggaaagcccaggccuccguugcauguguguguguuugcuacaaaauaaagccuuuccuuuuuucaguuauuggaaucgaugugcaaauaucuuguuugugucuuuucacuuaauacaucacagaccucuuuaaacaagaacacacgugcacuggccugucuguuacagaguacaaacauacuggcauuugccuucuccagcugguggcuguucagguggcuugcuuuuuuucuuuuuucucuuaugaccacaaaauugcauguguauaugugcaaguguguggcuggcacacguuugucaguauacuuguaggaaagacuccuaaaagugacauuucuggacccagggcauaaucacuuuucauccucauggcuacugagaaccugccuuuuguaaaggcugcauucguuuaggcugucccaggaagaaggcauguuccccaugcccucauucacccuggagacucgcccuuuuaacuggugacaaucugauggcaaaaauauguaucucauuuuaauuuguauuucuccaauuacugguaauuucagaucuuucccuaugguuaugguaauuuguguuucucuuuuucauaaucauauugguguauuuauaguuuucucauuuauuucuuauguauuuauaugaaaucuuuacauauuaugguuacacaucuuugucuguuacauguugcaacuauuuccccuagccagucauuucuugaaacuucaccaugaguuucucuauagaugcuauaaacuuuuaugccaucaaauacucucuuuuuccuuuauggccucuaaacauccuguuugauugggaagguccucuuuaauauucuaaacauauuuuuuuccuaagauuuuuggaguuugaauuuuauguuagaucuuuauuugcucuggauuuuauuccucuuuuggucugacacagcacauggaacaugugauauugacugaaaggugugcaucuucugagcuaauauaucugauuuuaaaauucaggcaaggauaagaaagaucucaguuguaugaaacagugcauggaauuacucucuguaaaacuaaacuccaggccaggcgugccuggaaucucagcacuuugggagaccaagacgggggaauuguuuaagaccaggaguucaagaucagccugggcaauauagcgagacccugucucuuaaaaaaaaaaaaaaaguaaaggccccaccaucuuucuuuuuaaggggacugcuuucuuauaaaccugccacacacagguaccgcccugcccugcugggacaccugcaccaugcuguugcccugaggcuccaaauaugagucaugcccagccguggcaggugcaucuacagcacauggaugagcgucggcccuggggguucacgggcacccuaguggcauggugccuggggcaggucaaguucaugggcaugcucagaggcugugggagcaggaacacuguccucaggagccugcaaaccgaaucgaguggccccguggggugcccugggguggcggcagccugaugaggccugagccaugaaggcacucagcccugggcacaggaggcagcucuuccugcaggcaacaaagacccagggauaccugggucccagagaccaccauccucacagccuggucaucucacugcagcagcuuggucccuggcugcaggugacgguggccggugggugcucccgaagcccuccccugagggcgucagggucuggugcggggcccacacacgcggcagagccuugcucuggggacucugggcaaaacccaucaguggaaacagaccuccuucucgucuuuaagucacaggagccagaacacuagcaacagaaaagaugagcauuguacucucuucagggccacaaagccuccccaggcagggcccaggagauccucaaagugaaaacugcagucaacagguucuuggaaacgugugugaggauucccagacccugagcccugcauugagaugcccucucccuccaugacccccuuucaagcucacgaggggguguguggcaacccccccccccccaccuguccucccacacccucucagucauuuuaaacaggagaauuccacuaaacacccacagccuguuuucacguggcagggcagggagguggcuguggugcguggagcccagcauccacagaaaggaaagacaccugggguuuggguuucguuuuuagggguuggggaggagugggcuggaaaggggaggcuaagaagaaaaugaauucuggaagaacuguuaaaacagaaaguuuagaaaaauaaaacccgcaggaauaguagcauucuuagaaaauuaauaggaugcuuuggggcuuccaagaugcuacacgccuaacacggauucugaacacagaccacugguugaguuuccuuguucaacaguaacagauguccacagaagagugcuagaaagcagggcacgcaaggaaagaaguugaggccaaagucaaacguucacaucccccuucuacggcgcuguaguucaugaugcuguaacagaugagucacugcaauggaaauaccggauacuuuuuaauacaucuagucuaaaacuuacaggaaggcauccuagcaccuucuuuuauuauuguacagcagugacagugacgacagugaugauggcaucucucuauuuuuauggaaacaucuccaggaaaucccaagcugcacaguggagaauuacaggaacagaagaaguggugugaagucugucggucucuucccugguucaaugaggagcugaacugaaucauacuagaggcaugagugucugcgcuauuuuuaaagagcucuggggaagugugguugucccaccuuaggcuccuaauauaacacucauuucuauuugugggaugguuaacaccaucuuccauuuggucuuuccuccacuaauauauuauccuucacugaagucuuauuucuacaguuuaauucuuuuuaagcuccagauguguuauguaugcccucaaagacccuaucaugggucagggggcaaggucugggccccucaugcguuccucucuuuccccaggccaaguaaacaccuuggcaggaauccagaaaacgauccacgcagaacauugcaaugucacagaaauggccgcccacuggccacgaagcccuggccccacccugcgaggucacuuccuacccuaccaacagcagcaccccaccucacuccccuacgugcuggccuuuccuggagcaccaaacccagggcuggcugaccgcagagccuuaccuccaggcagccccuuccccugcacgccuccugccccaccgcugggacagacacccacccucccacauguuggcugggccugcuuggcuacugcacagugaacuugucgcauuuccuuccugucucuguccuccucagcagagacggguguggugaugagaugacagucuuaggggugucuuacucuuuauuuauggcucugugacacuuuuaaagugcugaauguuccuaaaggcugguaaauucuuuccaagauccuccagagaccgggcggcggugguggcaggaagacgggugggggcaggaguuggaaucuacuuagacuauaauugccucaaguuugugaacuguuaguauaaaaauacucuuggagauuuuaaugguugaaugaagauucacacucauuaaacaccaugguugagggggaaaauucagccuguguuacaagaaugacuucacagcuugaaguacagaagcaaaacaauaagagcuaucaucauacugauuacauuauauauuuugaauuuuauuuuccuuggagguggguuggcuacucuacuguauaguacaacaaguagaacgaaagggaaaaaagcuacccuacagaaauacccaguuuuuggcgucaccugcuggcuuuaucuuccuuuaaaagcucuuuccuaagccccgaugauggguucacuaccuuuggggacuuccugugcagcucugaacccuguugcagcacuuaucacugucuuggugguauccauucucuggucuucuuccucuacagagugagcccugggucaacgccuuguucauccacagugucucagcagguagugugugccuggcacaaaguuggcauuccccauuuagaagcugguggagaagcccuaagaacgaagggaccccaacggccugaccugcuucaacagcauccagcacagacacguauucucccaaacacuuccugaugacuucaguggugcuggaguuuugcuaaagguuuucauauuuugcaacaauuauucaaaaauuacuacucuaagagggugugaucugucacugagaaaagagccuccugguuacucugagcugccuguuuauagccauguauuuauguacaacauuugcaugacaauaaaaugaggaaacggucccuaugaucuguagguggagagaugaacguggagggcaggugugacccaggcgcggcuaccugauaccggcccaaggccaggugccuuggacggcacgggcaggcgggcagcagcccgugaugacuggacggacuagggaaucccucgaaugcagacuccacgagcccguccagcuggaguggcaucuccucacuuuaugaaagcccaagccuucauccacuacaauuacuucucaccacgcauuuuagaaucuagaguuucaugaucucuucagaaagaaauuuaccuaaauauguucugaucaaagaugacugacaggauuuucuaaaaaaucagcagaggaguaagagcaauuauaaaccuuuuaaaagucuaucccucugccaugcuauaaauggaaaaaaauacauacauaagccauaauucccccuauaggauucauuuaaaauccacccucaccuccaccuccacauuauuaauuuaggaaagugcaucagaaaaaaaacacagcugcacauggaauggaaccuucauuuccacaggggagagugguggcuucugaggcucucaucccacagccagucugucugucucucacuuucuuuggcucucuaucucucagagucacaguucuccuuccuaauagcuccugucacuacauggaugaccuaagaaaguguucaaugaaccagccacauccugagaaauaccuuuucuuuaaaaugcaguuuucagcucaugagggugaagaaaaaggaauuauuaacaaguagcagaauuuccaggggaggucucagccuuauauacagacauuugaaaaaaacaaaacuccaaagcaacaaacuguguacucaugcauaacaccuccaacaggaacaaacuaauuccaggcuugaaagaagaugaaaaagccugacaugcaucuuccuaaagggagucccacccggaaauguucugaguugacagaccccucuuagguagaaagaaacuucuugagaaagagcuucuccucuucucagcucuguccucagaccaaacuccaagaagaaccacagcaaacccgaaagagcaugcaucauccauagcaguucuugggaaauguaccuuuuuuuaagaacaggucuuugaacugagccuccuucagugugcuguuguucagguggucacuggacauaaucagguccucugcaagugggaguccaacugugacgcagcccccccacguucaaagcaucccuucagcuuccggcaaucuccucuccaggcagcucagagcugcaguuauagcuggcauggggugugggagagugugugagcguggaggggggggggguguguuucugucugccucguucacucucucucuacuguaucagcagggcccaccccaggugcuagacucaaaugcuguggcuccgaccgcagacuguggcuaccaauuaucaacugccaucaacagaaaccaggagcucugcggcaggaagccggccgugucaccgagcagagaauaaguccggggucuccgauccugagaccagcuguacacccagggcacuacuguuuacagcaacgucuaucagugagcagucugcacuucucagguuuggccucacaccuggacgugucacacacacaggcaagcagaacgcagcuagacggcucaucuugucacacugcguucaguaaucuuuucaacaggcaaauaucaaaccaguccagacagaaaggaggaaaucugcaagucucacacaauacuccuucccuugaucucugcuggaagcuuucaguguggaaggaccggagagggcgcuuaccaaggcaggacacgcgacaggcgggacgcucacguuaggcucgcgugcuucuccccugcagauccgcucccagagcgugcucgcccggcugggagcacccacagcgucccucaggcugcgagccaggcugcgggcuguccucuucuggugcucccucuccacauccucuaacugaugggagcagcucccagcggcucuugccaccgagcucuguacuggcaaggcgugagguccuaaccgcagcaggaaacacugcgcgcuccuuuccccccggcucgcucuucccucuuggcucucccauucauucccucucccucugccucacaucauuauuccccauguaugguagcacaaaaacaccacagagacuccuucaaagucaggaugcucaauguuccu

SEQ ID NO: 192762 - RNA, 63246 nt, Homo sapiens
aacuacgagucccgacgugccgcgcgcggcaugcagaagcuucacugagcgggcacuggaggucgcgagcacguugcuagugggcgcggcuggcggggccgggggcggcagggggcuagcguccggcugagcccggcggguuccugcacgcggacccacgcuuugucgggcugcucugcugagugacaccgccguggcauccgaggagcugugguccagccugcgcggcgggaagcggcggcggcggcuccagcguccuaagagguagcaugggcccaggccucuguggggcagcgggaggggucuagagggcaccuucaacccugggcguguguccgggagcugacucgcggcgcgaacccggcaacugcuccgcgugcgccgcucuucgggcuguggcaguguacgacugccagacgggucguccacacucgccgaccccacagaccccggcggccgagagagguccccccgcccuuccgggucgagccaguguccuggcaaaucuugcuuugggacuguuuuucagccuccuuugcuguaacccuucaccguguucuccccccuucuuccgaagccaguugaagaggggcccggaagcgcccgcguucggaaugguuuuuaaaauuagcaauuucuuauuagggacuggcagacugguccuuaccgccguguuugggaagccacaagaggccauucuuaccuguuagauucugagaaaagggaccgccuauaccucuucuugacaaauaccuaaggaugcauuagucugcguuggcugaacuuggcauggugugguuugggggagacaacacacuuuuuuuggccaucaccccagauuucuacuggggagugaaagcgccuacuguacugaaacucgaaagcuccauaguugaggacuuucaaccugagaucagggucaaaacuaccuguggauagauuauugaagcgugugcauauuaacgucgugcgucaaguccccaccuuccaagguuguaaaacugaucagauuuacaauccgucuugaauuacucuuuaccaaaauugauccauuuaaaacagcuuugaaaaugugcuuuaccagccuuccuucuugucaguaggcacagguauauuaaugaauagaccuggcuuuggggaaggcagcauuugcagcguugugcuuuccaaucuaaucacuucuaaauugugggcauuagcccauuugagguuacaaacuuugaaccaagaaugaggccuauuuuucacaaauaaggaugacccaucaauuucugaugacugcuuguauuuguuauuauaugaaaugagguaaguugagaauuaaucucauuacaugaauauugacaacugcaaaaguguaggucuuacagaucgaaugcauuauaggcauauacaagcauuagaaccaggcaauuacauucccuguuccugaugcuuaaguuucuugagauaauugcuguuguaauuuuacagaaaaugaguguaauuuugacuuuuaaaaacauguuuuaauguuuuuaaacaccgggugcaguggcucacuucuguaaucccagccguugggaggccgaggcgguuggaucacgaggucaggaguuugagaccagccuggccaacauggugaaaccccgucucuacuaaaaauacaaaaauuagccaggcgugguggcgcgugccuguaaucccagcuacucaggaggcugaggcaggagaaucgcuuaaacccggaaggcggagguugcagugagccgagauugcgccguugcacucuagccugggcgacagagcgagacugucucaaaaaaaacuaaacaaaacaaaaaaaguuauuagauuaaaagccucuuaacuauguguuuaugaaaacuccacgaugaugggauauauagagauuacauuuuucaguuuuuauaaaacuuaacuagaaguuguguaaauucauuugagaauagaggggaaggauucuugaaagcaguuaauguaaguaaaugagccagauaaaaaugauuuuaaaguuaccauugguguuauuuuucccucauuauugccugaguaaucucugguuuucuggacauuaaaauaauaauagcuaauacucgaguaccuuuuaggugccaagguuagugcuuuauucauuugcacucguuuaauucuaaccgaacccagugguauaguuaugaguguuuguuuuacagaugaggguuaaguaacuuggccaagaucaugcagcuuguuaaguagugggaucaagauuuggacccaggcagucuggcugauugaccagacucugcuaauaaugaaacagugcuggcuagaagaucauacucagaacuggacguugccuagcaaauaguagauuuuucagaaaguguuuugauacuucuuaaugccuggguuaugaugucccgagagaaaauaguuagauaaggauguuaucuugcuggaaugugagcuccaccaagacaaggaaaggaccugcaggauuuauuucaacccauuuguaagaaagugagaguacuucucucagagguauaauuuuaaagugugauuucuguuguagaguugaagaucauauuuuugaaacauagagauuguuuuaaaaauguagaaacaauguuauaguuuccuaagauaguguucugugaagagaggugguucauggaagcuuuguuccuccaaauaguuuuggaugaaggacuuuuccucuguuccacucaggaaaguguuccuacugaaauuucauugucuuucuggaacaaauaaaauauuauuguuuaaaagguuuuuccuucaguugaaaauaagauuuuguugaguaauacugugugugaugauuaguuuuauuaugucagcuuagcuaggcuauaauaccuaguuauuuaaucagauacuaguuugguugaugcuaugaugguauucugaagacgugguuaacaucuauaaucaguugaccuaaacuaaaggauauuacccuaaauaauguggguggaccucauucaaucaauugaaggcuaaaaaagccaaaacugaaguguccugaagaagacaguauuuuccucaagacugcagcaucaauuccugccuaaguuuccugucuguagaucuacccuacacauuuugaaguugcuauccccuacaguugugugagccaguuccuuaaaauaccaauaucucuguaucugucuauauguagaugaagauauuuauguuuuuaucuacaucuauauauuuuuuccuaucaguucuguaucucuguagagcccugacugauucaaauuugggugcugagagugcuucuagugagcagaaucuuaaggaugaguuuucugaauugauuauaguguuucuggaauugguuuuccaaacugaucagauucaaaggcaguaaugaguauucccuguagaaaagagggcacugauagucccuggugugauauggcaacaaagauaugcaaaagaucacuauuagauacucccacucaugcuuauagacaagauucagaaugaucagguauuugauaccuuagaacauuuuaaucgaauuaaugaguacaauaagauaggcugguugcuuuuaacuguacuggguaaagugagaaaagaaaaggaugaucccagcuacucaggaggcugaggcaggagaaucgcuugaacccaggaggcggagguugcagugagccgagauugcaccacugcacuccaaccugagugacagagugagacugucucaaaaaaaaaaaaaagaaaggaaagaaaaggggagcuuaaggcuucaaauucccgauugaagcuccacauaagugaccugaaaaguuucugugucugcccuaaagaaacccguaucucuuguagcuacagagcugagguuggugaaaaccaaauccagagucuuauccuguagguggcugaauuacagugcuaacugaauucccuucucaccuuggucugcuauuaaaaugagggcauugauugggaaggaaugggaucugcacauuuggaauagggccauaugggaacauccugaugaagcuggggauguuaaacuccuaaauuugacucacucuuuuuugccaguagaagcaguucuuccaccucugaggagguuaacucugcuuugccugaagaaccuguaaugaccucccuugagguaguuaccuugcaagacauugccgguuuuccucaggaauccgugaagagcucugggguugcuuuucucuucaggucagagauugcagugggagcuguugccacugacuggggguccuuagcugcagcagggaugguuggaucuaggauggcaggggcuaugugaucaccaaagaguaaguagguguguugccaucaugggggacagcggagucaaagcaacaaucugaacagccugacuuggggguccuaauuggguagguggucauggugucccuagaagagaacucguugggcagucuacugaauucugacuugaucucuauaagcagaagaguucuaggucaagugaauggaagcuuuacuuuaauuaccaaagaaagagucauggucccucaaucaguucccagauuugagucauuuuacagacucagaacccccugacugaggggaggcuggauccuuuugaggaaggaccccauugcgcugcuaagaauuuauaccguuaauuuuuuucucagguuucccaaagggaccuauggcuuaucaggguaagugugcacuggagaagaggaaauaauuagacuucucacagauuacugaacucuuaagucugaacugacacuaauuccaggacacucaaagugucauuuuggcccgccauucagaguagggacuuguugagguuagguggucaauggaaguuuaacccagguucuccucacaguggguccccauauucauccuaugguuacuuugccaguuccaggaugcauaacugguauagacauacucagcaacuggcagaauccccacacugguuccccgacuuguggagugagggcgaucgugguaggaaaggccaaguagaagccacuagagcugccucuuccuggaauaauaguaagccaaaagcaauaccgcauuccaggaggaauugcagagaugagugcacuuaaggaugcaggggugaugauuccugacauauucgcauucaacccuccuguuuggccugugcagaaaacagauugaucuuggaaaaugacaguggauuaucauaaacuuaacugaguagugacuaauugcagcugcuguuccagaugucauuucauuacuugagaaccuauccccuaguaacuggcaugcaguuauugaucugcugagugcuuugucuuaguaucuguuaguaaagaucaccaaaagcaguuuucuuucaacuaacaaagccaaaaauacaccuucacuguccuaccucgggaaugucaacuuuccaacacuaugucauaacaagaucucugugaucuuguuaugaguugaauugugucuucuaaaaauuuauguauuggauuccuagcccuuaguaccucaggguaugaccuuauuugggaauaggguaguuaaaaauguaauuagauaagaugaggucauacuggaguaggcugggccccuaauccaacacaacugguguccuuauaaacaggaggaauuugaacacagacauucacacagggagaaugccauaugaaacugaaguagaggaacaccaagaaaugucacacauuuccagcaaaccaucaggagcaaggggguaggcaugaaacagauucuucuucacccccuuugaaggaacaaacccuacugacaccuugaucuuggacuucuaaccccagagcuggagacaguacauuucuguuuuguaagcuccucaguuugugguucucuauuacagcagcuguagcaaacaaauagagacccugauugugcuucccuuccacaaaacaucauacuggcccaucacauugaugacauuaugcugauuggaccuggugggcaagaagaaacaacuacucuagacuuacugguaugacauuugcaugucagagggugggaaauccaacaaauauucaggggccuuccaccugugaaauuucuagggguccacuggaguaguguagggcauguucccaccuauaacaaaaagagaagcaagguuuagugggccucuuuggauuuuggagaugacaaauuccucauuugggugugcuacuucagguuguuuacugagugaccuaaaauacugcuaguuuugaguggaucccagaacaaaaggcgccucuacaacagguacaggcugcugugcaaacugcucugccacucaggccauaugacccagcagaucuucuggugcuugaaaugucaguggcagauugaaaugcuguuaggaaccuuuugcaggcccuauaggagauacaguguagaaccuuaggauuuuggagcaaagccuuuccauccuuugcagguaacugcucuuuuaagaaacagcuuuugggcuugcuacugggcuuaauagaaacucuacgcuuaaccgugggccaccaaguuaugcaaccugacuagaaaaaugacuagaauauuucagcaguuaagagcacaagcagauggcauguguucaaauccugguuauguuauauuuacuaagcaugucauccuugaguaaguggccaaacuuuguguuuugauuuccucauggagcgauuuuauagaauaaaugagaugauacagugcuuagcacagaaccugcuaauuuuuagcuucucuuaacacaacugaaacugcuacugcaaugucuugugaagucauuaguccaugccuuuaaaugugauuguagaauuuuuuugccuugguacagcagaaaaaauagagugauuuuuuuuuuuuuuaauucauguaaaccagagcagaaguuugaaauagugaacagucuuguaggcauuaugugcuuucagguucugaguuuauuacuucugagaauuaaccauaguagcaguggucuaugaccucugugggugaaaggguggcugggcuuuaagcaugugcagcagugggcaaagaauggaggugagggaagaggcaucagacauuaggaagggauccucccggagaaguggaggugggugguuagauuuugugggugccaauggcaagaugaguccuauuagaaagucucauugauaagaaaaaauuguuuucaaggcagacuuaaaaauuagggcuuccccauuuuuacuuacuucuucuacauugccuuuguaacuucuuggacgugauaaauugaauuaaacgugguauuuuauuuggauuucuugauuuuuaauguaagcaugaauuauaguaacucuuccuugcuaucugaaauacugcaauucuuguucuaguuaagcugcauuguaauuugacucauuucuuaaaauuagaggaauuagauaaacagugauggguuugcaauguaguguuugccaaaugaaugucauauauaauguuaagaaaaauuuuauuuguguggcacacuuuauaaaauaaagcagaccuaugucaaguucuaaaugcaaauuuuuauuuuacuuuucuugccaucuucaucacuguaaaugcaaguuuuuaaaaagauauuuuaaaauuggacccagaauacaagagcucuuuauugcaacaauggcuucugguacucugaugaucaaaugacauuuucugaaauaugcuugauacaguaaacacugacaaaacuaguuaaccccacagagaagguuacuaguauuuuucaccaaagccaagcugaaacagguucuauugcgauuuacuugguguaaaauauauguauaauuucucauaugucuuuuuuugguuuaacaaacauaguccuuauucaucaaguaaauuccuauugcuaagcauguuuuaguuaacuaguaacaauaaauuuauguuaaaacugauuuucaugauagaagauagaaaugaaauuuauauaguuuggcucucaauccuuuauuuucagggaaaagacacaauuuauacauaugagcaauuugugaagaugugggaaauucacuagauuagcaguucuuuuuucuuuuuuuuuuggccuuuaaucagcuaugugaucaggaacaaguuaugaacuauuacauguccuugcauucuuuaucuguaaacauaaaggaugauacuaaggggccucucaguuuccuuccaacucuuaacauucuguaguucuaaugcagacaacuaugacuaaaccuaagguugcugcuuuuauacaguuguacucagguucuguguggccuuccauuuuuguagucccuguaacaaagacuuugagaagguaaaaauaauccuuacucaugcagugggaagguuucuuaaggagaguaggcuuguauuuucuguugcuguguaacaaauuacccccacauuuagcaacuuaaaacaacacagguuuauugucucacaguuuuucugggucaggaguaugggcacaucuuagcugguuugcugcuuagcaucucaaagugucaagcaggcugcauucucaucuggagguucaacuguggaagaaucuguuugcaaacucauugagguuguaggcagaguucaucuuuugugccuauaugagugagggcgcugucuucuuccuguugacugguggcuucccucagggacuagaggcuguuccccguaugcggcccuguccguaggcaguucaucauacgguaccuuguuuccuugaggccagcagaaaacucugucuccagucugcuaagaugaaguccuuuccaucuuuucuaccauuuagucuacuauaccauaagucuuuucucgagccuguuagacugcuuuuuaaaccugacauucuggugcauugggcccuugcaguuuucaugcaaguugauuaaccuuuauguuaccaaaugacucacuggaguaugcuuuuugcucucuaauccauaauucaaaauguaucuuccucuuauucacuucucuguacuuuauuuuuuuggcagacuuuugauaguagauuucuaaacauucuguauuuuuccuuucuuuucacagucugucaugcagcugaccaacguaaguccaaagugcuuuagaauucgaguaauucugcaaacccugcuuuguaguuagcggugcaguggugaaguucaaaacuuagacuugggcugggcacagugggucacaccuguaaucccagcacuuugggaggcuagggugggaagaucacuugagcccaggaguucgagacuagccugggcaacagagugacacucugucucuaaaaaacaaacaaagaacuuagacuugaauguaggugacagguggcacuaaucucgggcacuaaucucuaguucaaaaugauccuuuaucaguucaaguaugaaagacuucauauaguaaacauugcuuggggggauuaacauauaauguaagaaagggcagaugguauuuccugcauucuggagagccuuaagaggauuggaugcucucuauccaccccagccuugcuucaucaguaagcugcuuucagcugcaaguaacagaaacuggauucaaguuggcauuaacaauaaagagggacauaguaacaagaaguccgcaaacagagcacacuccagugccucaguucagagcucccgcucugccuuguccaugucagcuuuguccuuaggcgggcucccuguguuaguccauucucacacugcuguaaaaauacuaccugagacuggguaauuuauaaacaaaagagguuuaauugacucacaguucagcauggcuggagaggccucaggaaacuuccaaucauaguggaaggcaaaggggaagcaggcaccuucuucacaaggcagcaacaggaggcagggagagggcacaggggagaguaccauuuuuaaaaccaucagaucucgugagaacucccuaucaugagaucagcaagggggaaacugcccccugauccaauuacucccaccagguccaucgcuuaacacguggggauuacaauuugagaugagauuugaguggggacacagagccaaacuaugucccuuuaagguuacagaguggcugcuggaacccccagaauccauauguuuccuugcucacccccaguuuaggagagagaauuagguccccaaaccauggaauguaaguucucaaaauccuuagacuccccuaagucacaugcccaucccuggaccaauaacagucagccagccacacaaugcuaugagcccuguccuuuugaucgggauccaucauuggagcugggggcucugguagacagcuaccugagcagaacagggccucugaagagggaagaggggagaggaugcuuaguaggcagccaacacuuuccauuaccuuaucuaaccaguaauuuaguuaacacuguuuuaucuauuguucuuuuuuguaacuagacaaucuuaaaguggaagucuuucuguauacuaugaagccauguugucuaauacaguagccaucagccacuuguuacuauuguauuguaacuuaaaguaauuaaaauuaaaauagaaaaauuaguacuuaagucacacuaguuacacuucggguguugaguaggcagcuguguguaguggcuaccuuauugaacagcacagauauagaacauuuucaucauuucagaaaaaucuguugaacagagcugcucuaaauuguuucagguaaaguuuuuguguaagcauugagccacaguagaaacaaggauagcaccuacuuuacuagguuuucaucuuauguuggggauuauaggaucugaaauuuagccgaaaugggaaauaggaauucauucauguugaggugauugaauauaauguuugauacuacuuaggacuuaaaaauaucagagcuguuuuuaaaaauauacuuuuuuccauuaagaaaguacaaauuauuuuuuguuguguaauaacucugugcaaguuuggugauaucuugaaguucagaauauggaaaauguuguaaugugaacaacuuuauguggugguaacauacccaugauaaugaaucucacaguauaaugaaagugacugcccaguuugucauucuaguagaguaugcuaaacuuuucagggaauguagacgaauauguauuagugcaaucacagaugugcuugauauaauccugucuccacuauucugaggccguaucugucaaaccagaauuagggcuaaagaauuauuauauuaaguaucuuaaaaauaguuaugucccccuguagucucagcuagugggaaggugggaggaucacuugagcccaggaguucugggcuguagugugcagugcugaucaggcgucugcacuaaguucgguaucaauauggugaccucccuggagcagaggaccaccagagugccuaaagagaggugaacuagcccagucuagaaacugagcaggucaaaacuuucaucugaucaguagugggaucacacgugugaauagccacuguacucccagcuugggcaaaauagcaagacccugucucugaaaaaauaaauaaauauuuauguauaagauuauauauauauguacauuauauaacuagguuauuggacaugugcauauauauauauauccaguaaccaauauaucuucacuaaccuaguaauacuacuccuaggaauuucuugaagaacuuaaaauauggacaaaaauguuauacaugaggacgcuauucauagugcauuaaaacuggggacaaucuaagcuucuaagaguaagagaauaaccaaaucaauuaugggguguuaaaucccccaagauaaugaauuauuucuuauccagcuguucagacucauauuuuuguagcucuuuaaugguguaugcauaaggugaugguaaagaaugcaaaauuacauguaauacagaaagcaguaauccaggaucuaaauuaaguuccuguaguucucaacuggcuccuguguacaaaauccaaggucaaagaagacugaauagccagauaauuguuuugagcagauuucucuauaaaguaaaauacaguuucagaagcaacugaguucacuuuaugcaucuugcuguauauuaaccugcuuuuaucauaucacuuucuugcucaaaacuucaguuacuccuuaggaauuaaaaaauccucuagaauuccagccucauuucucauuacccugaaaaggcccaucuuuacauauugacacucugugccuuuccaaguaccauuuccacuuuaaccuagaaugacuuuccaucuucuuuuccaaugcucugaaguuuuucuuucgaagguauccugcagccuucaacugaccacuguaguucaguuagccuuuucuuuauuccccuaauacauaguauguuuauaaacuuguaacucaugucugacaugucuccuaucuuggaauauuuaauuacccguuuauaacuagauuguaaacuacuuaaagacagugaaaacacauauuauacuaauuuguucuaggugccaaaaggguuacaguucuguguaauguccacccuuugguagggggucagugaaaagcuccacuguuaaguucuuuuguaacuguuuuacguuaguagauuuuagguacucugaagauauagaagaaaauccccugguucguaccccuggaggaguuauaauuuaguugagaaaacuaagaguuaaauuuccgggaguaauguugggcaacugggagaugcuuaguaaauauuucaggccaggagcugugugguaugcuaccugagaggcagaggcaggaggaucgcuugagucaggugucagagguuuugaugagcuaugauugugccacugcacuacagccuaagugacagagcaagacccugucucuaaacguguguguguguguguguguguguguguuuuauagugacauacuuccccgcuacuaaucacggaagcaguggaagauggaaugacuguagaggaaucauuguccuuucacugugaugauaggaaagagguggagcugcuuccucuguccucagacaucguuugauggucugugcucacucaccaggcauuaccuucagaaacugcaaauauauuuuuguuaauucacauguuuaaauguauucaggauuauuuauguauguguacacauggggugauuuuaguauuggugugaauuuuaccuaguuuaagaaguacucugaagguugagagauuuuaaaucaguaguaaggaagaggaggacuaagaauagaagaaauauaucaugcuaacuuggacaaaaggccauaaaggaugagaguggcagaacauaaaaucuuaucucagguauggaaauuguaaguuauguuguuaaguuauguugaauuuguguaucaacauacaaacauacauucuagacuuaggcaagaacagcaaaaguuaauuuaugcuuuaaggagaagguaaugguuuuaacaucaaaaaaguuaaauuuuuuauugguaaaaaaaguugugcuguaaggaaagaggccuucuuauagauguauaguucaaacuuguaaguagagauaagaguaucuccaagucaucccuucaggaucugagcaucuuagcuguuaacaucuccgggguuuguaacaacgaaagauagagcugggcuggaggaaagccagggcggcaaaugagcuacuucaguaggugaccugucuguuccaaguccacaagcacuaucuguccuuuuucagguuagcacacugcuaucagucuuuguauacugcagcuuucauguuuugaaguacuuaguuuugaguccuucuaucgauggaauuucucaggaaggauauguggugucugaguccguucaggcugcuguagcaaaauacuguaaacuggguggcucauaaacaguggaaauuuauuuuucaugguucuggaggcaggaaagucuaagagcaagguacuggcagauaaagguguuuggugugggcccacuugcuggcucacagacagcccucuuuucacuguaaccucgcaugauagaggguccaugagcucucuugagucucuuuuuauaaggucgcuauucucauucaggaaugcucugcccucaugaccuaaucaccuccccgaaagcccuaccuccuaaugucauaauuuggagguuaggacuuccuauguggagggacacaaauauucagaucauagcaugugugcaggauuuaggagcuuuuaaauauuugaaaaugucuuuaacaugacugucaaauugaauuuucuuacaauuuuuaggucacaugcuuuucucuuuaaguucugcauuaauugcucuguuguuuucugguucguaauaaagcugaaaagucuaaggccagcaugauaguuaggucuaugaagacaagcuguuuuucccugugucuuaauaguauauuuuucuuauaauuuaaacaaguucauguaaggaauuuaauuugccuuaaacauauugaaccuguugauuuugcagucuggggucuuuucaccauuauuuuucuaauuguaguuuuagaaaccuaagaucucuuuugaaucuguguauuugugaacuuuuuuuugucauuuucaucuucuugaccaauuucucuuuauucuuacacagcuucucuaguuugcacaguacucuccacaguaccgauuuuaggagacuugauaaauugcugaguacaagggaauaggaagauccuuggcugaauuugauacagcuuuuugucuuggacaacuugggcuccaaaggaggcacauauuuggggagugggaggaagagguagucauugaguaccauguaggaucuuuugugucccagauacaaaagauguugagcaauccagguggaugcugagagucagaaaaaaaucuggacaggaaacauaaauugggguucaucaccuaauggauauaaaaguuauugcccagauaaaauguauagagccugcauucagauuuaagagaaaaaggagucuauuaccaagaccaggaaggaagcuccaugauaagaaaagcagaagaaaggagcuggaguuauagaaaggaaagucugaaagacuuugaacaaguaggaugcaaguagugaggguaauuauguguaacagaaugaaaggcccaaaagguaucaauagaagcuccuugcugauuuuaauaggagcauuuugguaugggagguagugaaaaagagaaggcugguuuuuuuguuuuguuuauuuuguuuuuugauuggggggguuguuuuuuguuuguuuuuguuuuauuuuugagauugagccugucuguuccccaggccggagugcaguggcacaauccuggcucacugcaacuucugccuccuggguucaagggauucuccugccucagccucccaagaagcugggauuacaggcacccaccacgaugcccggcuaauuuuuguauuuuuaguagagacaggguuucaucauguugguagacuggucucgaacuccugaccucaggugaucugccugccuuggccucccaaaguguugagauuacaggcgugagccuccgugccaggccaaggcuguuguuuuaagacacuucgcugguaacaggaagaagaaaaauugggcaaacaucacauaaagaccuacuuucuugauggcauaucuauacaacaaugaaggaaagaagccaguaguguaauugcccaguggguucuuccugcccacugcauggaaaacaguuuccugagacugugcuauuugaguacacaaagaguuuuauuaaugucaugcuggccauacaggagauagaguuauuacucaaaucauucucccugaaggcucagagguuaggguuuuucaaggauaguuuggugggcagaagacuaggggaugggugcugcugauugcuuugaggaugaaaucauaggguguggaaaacggucuuugugugcccagccugucucuggaugggggcaguaggacugguugagucaugagucacaaguccagguggagucaguauaaaaaauauuuaggaagaccaaucuuagguuguacaauaaugauguuauccauagaaaccauuagggaagucacacaucuugugaccgcuggccccgugacugcugaaccccaugacucaugaaguaagggauuauagaaacuaugccuacauuuaggccgggcacgguagcucaugccuguaaucccggcacucugagaggcugaggugagcagaucaccugagcucaggaguucaagaccagccugggcaacauggugaaacccugucucuacaaaaaauacaaaaauuagcugggcacgauggcacacaucuguagucccagcuacucgagaggcugaggcaggagaguugcuugaacaugggagguggagguugcagugagcugagaucacaccauuguacuccagccugggcaacagagugagaccuuguuucaaaaaaaaaagaaaaaagaaacuaugccaacauuuaaucagaauuuaggcccuucccauaauucuaaucuuguggccuuucauuaguuuuacaaaggcaauuucaguacccaaacaaggaggacaucaguuuuagggagggauauuaucuuggcuucaaaguuaaacugucaacuaaauuccuccccugguuagcuugcucuacacccaggaacaagugaggacagcuagcuaguaaggcuagcagcaagauggagucagccaugcuagauuucucucacugacauaaucuuugcacaggcacuuuugauggagugagcaguugaagggacaggaaagagaauggcaguagaaaaauacaaggaaaauggggucaauaacuuggguucacuuucaaagggaggagggaauaguuucaucuaauuauuuauucccucaacaaacauuuauugagugccuccugugugccagcaagccuuaguuuuaggcaccugggaugcaaugaaaaaaacagugaaaaagcucuacucuugggggaccauaaguaguaaacauaauaaauaaguaaauuguauaagaaguuagaagauaagugguguaggaaaaaugaaaccaauagagcaagguaaggaagacugggauauuggggccagaaaugaguggugcuauaguuuuaaauaagauggucaagguaggcuuuacagagcagguggcaauugaacaaaggcuuccaggaggcgaagcaguuggccauguagguaucuggagaaugacuuguuccaaggagagggaacugcaaaaagucuuaaagcaggcaccuuuucagccuaugggcagagcugcaagcccaguguggcuggagcagagugagcaagaacacugagagagaugccgucauggguagggguguguggaggggguacagauuacuuaggaccuggucuuacaguuuaaggacuucggcuguuacucaaagaaaaaugggaaaguuuuaaaaagaggagagucaugaucugaccuagaugccauauauauggucagcuuauauaugaggcuugaagagauuuggaaagguauggaauaguuucugagcagaaugugagaggaaucugaucagaaauugucauggacugucacggagcagacagagccagucugagauaugaugauguacuaucauguaugcuggcauuauuuuacucuguuguuuuguuagcagugauuaguuauugagauguggcuguggaagaaacagauaauaggacuggauuugcugaagggcaaggugguaauucaaguaaugugcuguagaaucuaggcugguuaaagauuucagcgugaaaccaggagaaacuguuagauuugaacuaggaaaaggacagggucaggcaaggcgcuaguacuaggcucuggagaaaagaagggaauggaggcugguagcuaaaagugagauaguguaguuuucagaauuucacuuguggagcaguaucagaugauuucaaggccaagggcaugaccagugaaaugaauugcugaagaagcuagguauaguauaauaugaaauauauuuggucuuuuucccccaugcuugucucagagcugcuaaaaccauugggaauuuccugagugauaggaguacguuuuauuaauaacaauccccguaacagguuaugcuaauaagcuaacuuaggguagggcuucuguagcuucagaauggggcgacucacuagaaauacagaggauuagagugguggaacuuugagacucaccccaccauccuccaggaaaggcuagggcuggagauuagucucuacaaaaacucuugaacaacagacuugauaaacuucuauguugcuaagcacauggaggugccgaaaggguggcacacccagagagggcauggacauccagacaccccccuaauaccuuacccucugcaucucuuccaucuggcuguucaucuguauccucugcaauauuuuuuauaauaauccaguaaauccuucuuagcaaauuaaucaaacccagcguuaaaggacuaccagguucuauugcccauugcaaggcgacaagcaauaugcagaaacaaugggaaccgcagcagagaaagaguucaauaacuguagggcagcaaaaugagaagaugaaaccuuguuaaaagaaaaacuucagcugaauuaaauguaaaggaguuuaacugagcaaugaacuauucgcaaauugggcagcccccagaaucccagcagauucagagagacuccugcgcagccaugugguggaagaagauuuauagacaaaaaaaaaaagggaaaugauguacaggaaucggaagugagauauagaaacagcuggauugguuacaggucggcguuugccuuauuugaacacugagcacuuagcagucuaugagugguugaaguauggccacugggauuggccaagacucagcuguuguuacaggcgcacacuccuaaguuagguuuucaaucuugucugccuauuaaguuagguuacaguucauccacaaggacucaaauguagaaguacagagucuuucucaggccauguuuaguuugcuuuaacaguuccccucuuuuggucauucuuucaauuuugagagauugaccaaaacuuuaguccuugaugucacuauuaccaucauaaauauacuuacuugguuuugaaaaccacugggaaacaguagaacugaguuuugcaaaggcaggaacaaggacugaguagaggguaccuccuuaugccagaauguccuguuuauaggagaaaaacaaaaccuggucuguucuggucuaggaucuauguguuuccuuaaaguuuuaguuugauuaugucagauuuaacaggaguggcuccacuuuuguuugguuuggucuguuggggccuagugcaugagcucaguccaaaacaauggccuccuauaauuuaaaaaauucccccuucuguucugguucucacuuaggugagagugugaccaaaacuuagggccuuagugccacucucaguuaccauuauuuuggguuucgagauucagcaugucauuuauagguuaugguguccucauggcugcacauuucuuucagcucuugucauuccaguugaagagagaccaugugacguuuuagagauggcuacaugaaaacauuuaaaaccucugagagaauacagcacaccagggagacuguuaucaugacugucgggaggauaguaccaagaguuuggaguaugcuucuuacccagggucccaguaaaucaaacgaccuaaaaucaaauagaucaaagaaugagcuaaaugaagagucuacuggcuuaacuaagugguuuuuucuguuaauccccuacaacggaauuuuuauaaucuacauuugacguauuucuucauaggccacaagugccagcagcugcacagauacuuuucuguuuagccaauucuguuuuuuagcauaaccuucacaagagaauuuaaagucuguugugcaacaauagccuuuacaguagaaacugcuauaaagccuaucaugaaggacacauuuuaaaucauucccucuuuuauuccaaaccgugaaaaaaggaccuaacaaacauugcccuucuagaagagugaaggccuccuggcaauguucucuuuaaccuauguggguuaagaggagugaaucaaugugcuguuucugacugauuaugaggcaacauauguaccauuaaaguuucuuaccuacauuggggcuucguguuuuaucuaugaagguauaagguuauccauauauaaggcuggcugcaaaaucauuuucaaauaaaaguauaccccauaaguucacacaacagacgacccccccccauuuucauuucuguuguucauagaggcauaaacaagggaaaaguauuuaaagauaagagucucaugguaguagaacucuucaucugugaucuugggaaaagcuguucacaucaaggaugccaucuuuuucuggggagaaauuucccugguuagcuuuaccuugaggguuccaguggguguacaguuccaagauuguggagggacccuucucuauugugagauuaugaagccaaaauacaagguccugaaguuuugcugcaguauggauagcaaggacaaucuuucucugauguccucagaauauucagucuuuggguucuagauugugaaaggguugauuuuccucagugaaccauaaaaauacacuguggcauaauaacuuaguguuauaacaucaguccucuugcaugggaaagcuuuuauacaaccagaaaacaugcauugaaaaugacaauugaaugaaaucccucuacaaauguuuaaaugacccaucagguagccaaauauaccugaagcuuucauggucuucucaggcacguggguuugacaaacuaaacauugguuaugaaauuauuuuagcaggcugggcacagugucucaugccuguaauccuggcacuucgagaagcugaggugggaggaucaccugaggucaggaguucgaaaccauccuggccaacauggugaaacccugucucuacuaaaaagacaaaaauuagcugggcaugguggcacacgccuguagucccagccacucgggaggcugaggcaggagaauugcuugaacccggaaggcagagguugcagugggccgagaucaugccacugcacuccagccugggugacagagugagacucugucuuaaaaagaaaaaaaaauuauuuuagcaauguauaagguaccacaccaauauauuuaauuugaauuauuuuauauuuuccgugaugagucauggaaagcauaacuuuuaguaacaaaagcuguaaggacucaggaaggacaagguggcuauccugguucuccauguguccaugcuuaauuaacguuagacuuauguccucuugaaugccaguuguuuuuccaaauuagguacauagcacugauaacugauggguuaucauaggcaauuugacuuagacuauggaguucauuuaaauuguauauuuaaacaauuucaguaccagcugauuuaacgugaaaaucuggcaaaguauuuucuugguguucaauuaauuucugucuacuuggguuagcaguuuuaugaaccagucagucuuuuuauuaaaguuccaggaauucuuacccagauuaaaugauaugauucuaagguuauuagaaaccuguauucaagagugcuuuuuaggguccuuuccauccuuucaugaaucuccuaaaagacaccauauucuaggauuuuacaugcuuaugaaguuuuuagaaaccgcauuaagcaauuaacuggaaaugacuuuaaauaguuauaguuaaagacacagaugacaaggaaaugugguuauuuccauggucuauaacaacauaauaacuguaauuauggauagcauauacacagacauauuaauuuuagaaauccaauacaauuuuggaauauauauuaacauucacuaaaauauaacuugaaagaguuaaacauaauuuuuuauuuugacaauucuucacauguaacuuaacaugucaaauaauccugugcuuaccucucuuuuggaugcuucaggggcccucuguaguaucccaaaguuagaaguuagaaaagacaauuuugaagcugaaauuugauuuucggaagccuaucaaauauguuaaagguuuaaaacacuacauuauacuuaaccaguuugaccaugaggugagauuuuuauaaaccuuauauaacccuuugcaauuuuugugaaagaguagaucaguucuuuaagaaaacccuauugugcuuuuauuucaagguuuaauuuauggaaugcugaauaacaccccuuuaaguuuagucaauauguucacaaacagaauuucuuuuugcaagauuaguuuuuauaaaccuuaugcaacuuaaaccuuuaguuuuauguuaucuaauuaaaaaaccccuucacccucuaggcaaaaacuuacacucccaugccuucuuauaaucuuuuaucaaaaacacauuucacuuuccucacacgccuugcauguaaaacuauuuuuuuuaguaguuuuaauuacauguuauuaugauaacucuuagcagcuuuuacuuuuggugcauaaauuucuuucacaacuuagaccaucuauggcaugcuuggacuuugacuuguccuaaacaugccucuuuuuaaacaacuaguuauuuuacuuugggaaaagaauuuaccauacaagauuguuucuccuauaaaaucucuuuuuuaaaagucaaagaagugguuuaugaccuuaaagcauuuaggaaaccuaauaucugaccugcacaauuuagaccaaauguuuuuauuuuaccaauaaccuuccaagcuguuuuuauuucccaaagaucacuaaaguuaugugaacuaaaagauacuacaguuuuuauuuuucuuucaaaauguuuaagugcuuguuuuucuuuaagccaauuaauuagagcuuuuuuacguaaacgcuauacacacaacacauauauaacuacacagacagauggaaaaaaauuaaguaguuguaagauuuuuuuauuuccuaguuucuaaguuucuuaauuggauuacuggcuuuaggguggagucuuuggaagaacuggcuagggaaacaugcaguuucuagugccuaacaagcaggcacagcuggaaggcaaaaacagauccccaaaauuaagggucccauuuuuauggguccccugaaagagggagauacuauuggaaaagacagugcaaugcuuuuacugugcauuuaauuguauggcaucccaaaaccaaucagcccauuuguaauuagcccacccccuauaggagucuuaucuuucagugggguuggggacaucuccauacuuccuagguuucccaaagcaugcuucucugauccaaaugugcagagcucaguguuuccccauagcuggcacuagacaucccuaaaaguguauuuccuaccuaauuauuacauaccaaagcucuuucauaaugugaaguaauugcugauacccccaaaaguaaaaaauguuagauauugcaaugcaaaacaguacagagccuuagauguugaaagaaaucuauccacuuccaauuccugggauuuaaugaggaaaacagaaguuuuucccaaaauggggucucuggugccuccuguuuuucccaaggggucccaugcuguuagagcuugaauaucugcuuguaauuaagcugacuuuuaaccacaguggucuuuuuuuuaaaaaaguccuuuuaaauuuccuauuacccaacguuagccaggccaaauggcugauauuguuggcauuuaaacuuuaucaaaaguaaccucacaggugcucuuagaaaggagaauuccgcaguuccuggaggggaagagaaucaacaaaugguaacaguuaugaagauaucaaacaggaaagaacucauucccuaagccagguauuggacccggaucaccacuaugaaagagaaaacaugagcuacugagcuacagcacugggcagccuccauugcccuuuccagaaggagucuagaguaguuaauuuugagcuugcaaaggcuuuuaacuacucaggaugauuuuuagagcuacccgugacaugaaccuuaaaauuccuguucccuggaaggcagagaccaagaguaaguguagccauguggucacaggaucaagcuccgaaggaaauaaaacacgauggagaccucguacaguuuuuuuguuugugugagggaccugcagcaaaguucguuacugaccagcuugcugggccgucuugagcagcgggcuuaugggguuucaagcccguguucuguucuaaguuagcugucuuuaugacagaaggauacaggaagacauagcaagcauaccaaauuggcugcagcuuaagacuagccucauaaauccuuuuucccauuacucaaaacuuuacaagagauagugauuuuuaccauucauucaaccaguuugcacagggagagagagguagaagucugacugguaagaaagccuuacccuuuugcuggcaugccaggcuucugaguucccuuccucugaguggcccugugaccuggcuggcugcaccacagccuugggggccaagccgccacacaaagcaaaaucaucuuuuucuguuuuguggaaccacggguaaaagucucuuaauuuugcaaguugcugcccaaccagcugcaugggggcgccaaauuaucgaacuggcaagguucaaauuugccccugauugggcccugucaucuuuaacccauuuuuuauccaagagagacuuuacugacaggagggccucuaacccaguuccauccuuuacucaaguaaaauguaccccauaacuuauccaaagucagccaauugguacugcagucuauuuccuuuggaucuggauaauaacuaagcuaaaagguuaguagauuuaauuucugagagaccucauuuuuaaaugcacuucagugcauugugguuuauucagaacauucuacuguaaguuagcuuuaguaagauuuugccauucuguaagacuuugcugcuuucucugccuaauguauaagcuggaaggaacuuagauuuccagaaauugaggauccuauuuugccuaaaauguuggcuauagucucagguucccuugauuaacuuagccaaugauuuuuuuuugccccuacuuaaacacacaagaaaaaugaaacaaagggguagaacacaaaaauccuugcaaauuuuuaaaagccaaauuuuacaaccccugcaauauuaccauuuacuaucaguuucuuucugacccagucagauguaagaggccucuaacuggauccaaaccaguuaauuaccagaucuaaucugauccugaacccaguucgauuucuguugcgauuuccaaacccaguuuggaccagaaauuugcucagagaaacucaagagcucaaaacacaaaucuguagagcuccgaaaucugagagaacuuaccaugauccccagcugcucugagggaucaaaggacacaaguggguccagcagguaccuugcuuguucauucggagcuccuggagaucauuagaagcucuauuucagaucccacuucugacaccaucuguuaaaaacuuaggcuggauuacauuuaaaggaguuuaauugagcaaugaaugauuugcaaaucaggcagcccccaggcucaaagcagauucagagagacucccauguagccacguggugggagauuuauagacaaaaaaagggaaaugauauacggaaaucagaagcaacguauagaaacagcuggauuggcuauagguuggcauuugccuuauucgaacacuuagcagucuaugagugguugaaguauggcuggccacuggaauuggucaagacucagcuauuguacaggugcauacuccuaaguuugguuuucagucuugucugccucuuaagcuagguuacaguucacaaggacucaaauauagaaguauggaguccuucuuaggccauauuuaguuugcuuuaagaacuucaaaucugccuucccgagagguuuggagaugaagauuuuaaggauucuggacaagugaugggcuaaaguguggggauugcugauuaaucgagaagugagagguaaagucuggugacagggagaugaagaaacuacauuccuuugcugaguuaguuccuuggugggggucuucagacaguuuggugucagcuguuuugcuggaauucaggaucuggaaaacaccuuaaccaauucuuagguuaaaagguccggugucagagauucugucuauaggaacagcagggaguaggugguucagcaugcuaugugacucucagcagcuauagggaagugggccagagugcaccagugcaugcauccuggucagguccuaacuauaauucugccuaaaaucuggcuuguaaaucuuauuaguuucuccaauggaaggguuaucaaauuaauugaacccaaggugggaacuugaauguauagccuguugagaaguauggguaacaacuuacuacuugugauuugcaucugaaguggggaguaggaguagucuugugggacugagcccuugaucuguggauucugacucuuaacucaaauaagacaguguuagaauuaaauugaauuauaggguacccaguugguguccucuagaguauugcuugauguguggagaaaacuccuucacauuuaguuguagaaguauucuacauugagugugagaguagagagagaaaaagaguuuuuuuacccauaguguaggauuuugcauggucacccaaauuaaauaauggcaaaaguuuagaugaaggaagaauaugagcuugguuugaccaggucauagaugagaagaugaagaagggagcuagaacuaauaauuauugguaaagcauaguaagugcuagacacuuaaccagcucauuuaucucauaaauaccacgcgauaaaaggauaacuuaauuuuacugauaaggagaaggcuaagaaaauguuagcacucaggucuuucugauggcaaagccuccauucuuccugcaaccugucagaagugaaaaggaaaggaugcaagggaacuguggauucuggguuuaugucaccauuacagauaauaaccauggcuuagauccucugaaaagauacaaagauauaaauauuuuguauaaaugaguagauuuaucuagugauuuuggaaaaaucauugauuuuuuuuuaagugguacacuugacauuuaagacugcucuggaaauuaaugaauuauuaaugaacuuccauaggaauucacuagggggggcauaauuuaaucuuuucugaaaauuaagaauuuggcaguggcuucauccuuaauucagcuuguuuaugugguucaaaugugguauuagaaagcccccaaagcagaauaggcugaaggagauggauuauauaguagaaauuaaauuggagccaucagugcauuagggaguaggaaaguaagaacccagaaaguacugucaacagacuuucacaccuuuuuacuuucucuaagcagcaaacugaauuugauuuaaaacagcagccaaaguaugauuaagaaagagauugaggccaggcgguggcucacgccuguaaucccagcacuuugggaggcugaagugggauugcgugaggucaggaguuugagaccagccugggcaacauagcgagucccuguuguuaggauuugaagggaagacgagaguuaaagacacacacacagagaaagagggcggcucuacagcaacugcaggcauuuauguccagcauaaaccugagagguuggggaccaguuuaaugccagugcucacugccgcuuacaggcuggaguacuuauagguaucggggggaggggucugggcgguaugccuugcugccccggaggauaucgauaagauguuucuguggucuggcgguuuggccaaggauguuccuugugcccuuugcccagcaagauaugauagggauguuccuucaguugggccuuuaccugacaugguaugauaaaaauguuccugugccuuuuggucagguggcuaggcaggguguuucucauggccugaaccccugcggaauguuucacucugaccaaggucugcaaaauggcgggggggcuuacaaaagcaguuuggacuaaccugucucugcaguaaauaaaaagagguggaaaggaaugaaucuuaggauauuuggauauucuuacucugaauuaauucuugauuuuaggaucuugaucuuaggauccucggauauucucaggauccuaggauauuuagauauucuuaaucugaauuaauucuuauuuuuuuuuuuuuuuuuuuuugagauggagucucacucugucacccaggcuggagugcaguggugugaucucggcucagugcaaccuccgcccccuggguucaagcaauucuuccgccucagccucccgaguagcuaggauugcagcacccgccaccaugcccagcuaauuuuuguauuuuuaguaaggacaggguuuuaccauguugggcaggcuggucucgaacuccugaccucaggugagccaccugccucagccucccaaagugcugggauuacaggcgugagccaccacgcccggccaguucuuaauucuuaagcuggaauuacagaugugagccacuguaccugaccaaaaacuguuuugguguugugugagaguauagaaaguguguuuucccagaauaaccuuuuuaagcuggcuucuuugacuuggcaauaugcauuuaagguuccucuauguguuuucauggcuuaauagcacauuacugaauaauguucuguuuguaugaaggugccacaauuuguuuauccauucacuuauugaaggacaucuugguugcuucuaaguuuuggcaauuaugaauaaagcugcuuuaaacaucuauguacaguuuuuugggggcauaaguuuucaguucaggugggugaauagaacuuaacuguuggaauuuuuuuuuuuuuuuuuuuuugagacagagucucacucugucucccaggcugcaacauccaccucccagguucaagugauucuugugccucagccucuccaguagcugggauuacaggugugugccagcaugccuggccaauuguuggauuguaugguaagaguauguuuaucuuuuuaagaaccuguuaaacucucuuccaaaguggcugcaccauuuugcauucccaccaacaauaagugagaguuccuguugcuucacauccucaccagcauuuggugguguuaauguuuuuggauuuuaggcauuguaauaaguuuguaguagugucuuaguguuuuuaauuugcaauuuucuaaugaugcggcauugaacaucuuuuucuguguuuuuugccaucuguagaucuuaaugagggcucuguucagaucuuuuucccauuuuguaaauggguuguuuucuuauuguugaguuuuaagaguucuuuguauacagucacacguugcuuaacagagauguggucugagaaaugcauaguuaggcaauuuugucauugugagaacaucauaggguauacuuacccaaaccuagaugguacagccuauuguuccuaggccacaaaccuguacagcgcauuacuguacugaauacuguaagcaauuguaacauguaaauauuuuucugucuaaacauaccuaaauggggaaaaguuacaguaaaaaugcaguauaaaaaaugauacaccuauaccagaguacuuaccaugaauuggagcuugcaguacuggaaguugcucugggugagucagugagugaaugugaaggccuaggacauaacuguauacuacuguggacuuuguaaauacuguacacuuagacuacacugaguuuauuuuuaaaaauuuauuuaguaauaaauugacuuuagcuuaccuuuauuuuuaugcuuauaagcuuuugccuauuaauauuuucauuuuuauuuuauuuuuuaaacuuuuuguuaaaaaugaaggcacaaacacacauuagccugggccuacccaggggcaggaucaucaguaucacugucuucuaccuccaccaucaucaccacaaacacgugaauaugaugucauuaagcaauaggaauuuuucugcucuuuuaucuuauggcaccgucuuucaugcuguccaucacuggcugaaacugaagcucugugauacaugacuguauuggauacaaguccuuuaucauauaaauguuuuacaauauuuucugcuuagugacuugucuuuucauuuuccuagcaguauguguugcagaguuguagauguuuuuuuagugaaguccaacuuaccaauuuuuucauucauagauccugcuuuuuggugaagucuaauaaugugagucugcuaaugaaugucaauccuuguucuucuccaguauuuuguuggcuauucuggguauuuuggcuuuccauauaaacuucagaaucagguuguugauacaagaaacaguuugcuaggauuuugauucggauauuauuguugaaucuguagaucauacugacaaaaacugcuaucuuaacaauaaugagucuaucuaugaauguagacuaucucuccauuuauuuagaccuuugauuucuuucagaguuuugagguuuuccuuauauaggucucauacauauguuguuuauacuaccuauuuugggagaguauauuauuauauaaaugguauuuuuuaacuucaaauucuuauguaucauugcuaguaucuauaaagacaguuaacuuuuauauauuugaucuuauaaaaucacuguacuugcauauuaguuccaggagucuuuuuauauauauauacuuuaaguucuaggguacaugugcacaacgugccgguuuguuacauauguauacaugugccauguuggugugcugcacccauuaacucgucauuuacauuagguauaucuccuaaugcuauccuucccccuccccccacccaccgcaggcccuggugugugauguucccuacccuguguccaaguguucucauuguucaguucccaccuaugagugagaacaugugauguuugguuuucuguccuugcaauaguuuacucagaaugaugguuuccagcuucauccaugucccuacaaaggacguuaacucauccuuuuuuauggcugcauaguauuccaugguguauaugugccacauuuucuuaauccagucuaucguugauggacauuuggguuggucccaagucuuugcuauugugaauagcgccacaauaaacauacgugugcaugugucuuuauagcagcaugauuuauaauccuuuggguauaugcccaguaaugggauggcugggucaaaugguauuuauaguccuagauccuugaggaaucgccacacugucuuccacaaugguugaacuaguuuacagucccaccaacagugucaaaguguuccuauuucuccacauccucuccagcaucuguuguuuccugacuuuuuaaugaucgccauucuaacuggcgugagaugguaucucauugugguuuugauuugcauuucucugauggccagugaugaugagcauuuuuucaugugucuguuggcugcauaaaugucuucuuuuuagaagugucuuuucauauccuuugcccacuuuuugaugggguugauuuuuucuuguaaguuuguuuaaguucuuuguagaaucuggauauuagcccuuugucagauggguagauuauaaaaguuuucucccauucuguagguugccugcucacucugaugguaguuucuuuugcugugcagaagcucuuuaguuuaauuagaucccauuuaucaauuuuggcuuuuguugccauugcuuuugguguuuuagugaugaaguccuugcccaugccuauguccugaauggcauugccuagguuuucuucuaggguuuuuaugguuuuaggucuaacauuuaagucuguaauccaucuugaauuaauuuucauauaagguguaaggaagggauccaguuucagcuuucuacauauggcuagccaguuuucccagcaccauuuauuaaauagggaauccuuuccccauuucuaguuuuugucagguuugucaaagaucaggugguuguagauaugugguauuauuuccaagggcucuauucuguuccauuggucaauaucucuguuuugguaccaguaccaugcuguuuugguuacuguagccuuguaguauaguuugaagucagguagcaugaugccucuagcuuuguucuuuuggcuuaggauugucuuagcaaugcggacucuuuuuugguuccauaugaacuuuaaaguaguuuuuuccaauucugugaagaaagucauugguagcuugauggcauugaaucuauaaauuaccuugggcaguauggccauuuucacaacgauucuuccuauccguaagcauggaauguuccuccauuuguuuguguccucuuuuauuucguuaagcagugguuuguaguucuccuugaagagguccuucacaucccuuguaaguuggauuccuagguauuuuauucucuuugaagcaauugugaauggaaguucacucaugauuuggcauucuguuugucuguuauugguguauaggaaugcuugugauuuuugcacauugauuuuguauccugcagaaguugcuuaucagguuuaaggagauuuugggcugagacgaugggguuuucuaaaucuacaaucaugucaucugcaaacagggagaauuuaacuuccucuuuuccuaauugaauacccuuuauuuauuucucuugccugacugcccuggccagaacuuccaacacuaugcugaauaggaguggugagagagggcaucccugucuugcgccacuuuucaaagggaaugcuuccaguuuuugcucauucaguagauauugucauaaauagcucuuauuauuuugagauacagcccaucaauaccuaguucauugagaguuuuuagcaugaagggcuguugaauuuugucaaaggccuuuucugcaucuauugagauaaucaugugguuuuugucuuugguucuguuuauaugauggauuauguuuauugauuugcguauguugaaccagccuugcaucccagguaugaagccaacuugauccugguggaugagcuuuuugaugugcugcuggauuugguuugccaguauuuuauugaggacuuuuccaucgauguucaucagggauauuggucuaaaauucucuuuuuugguugugucugugccaggcuuugguaucaggaugauguuggccucauaaaaugaguuagggaggauucccucuuuuucuguugauuggaauaguuucagaaggaaugguaccagcuccucuuuguaccucugguagaauuuggcugugaaucugucugguccuggacuuuuuuugguuggugggcuauuauugccucaauuucagagccuguuauuggucuauucagggauucagugucuuccugguuuagucuugggaggguguaugugucgaggaauuuauccauuucuucuagauuuucuaguuuauuuguguagagguguuuauaguauucuccgaugguaguuuguauuucugugggaucaguggugauauccccuuuaucauuuuuuauugugucuauuugaugcuucucucuuuucuucuuuauuagucuugcuagcagucuaucaauuuugcugaucuuuccaaaaaaccagcuccuggauucauugauuuuuuugaaggguuuuuugugucucuaucuccuucaguucugcucugaucuuaguuauuucuugccuucugcuagcuuuugaauguguuugcucuugcuucucuaguucuuuuaauugugauguuagggugucaauuuuagaucuuuccugcuuucucuugugggcauuuaguguauaaauuucccucuacacacugauuuaacugugucccagagauucugguauguugugucuuuguucucauugguuucaaagaacaucuuuauuucugccuucauuugguuauguauccaguagucauucaggagcaaguuguccguguaguugagcaguuuugagugaguuucuuaauccugaguucuaguuugauugcacuguggucugagagacaguuuguuauaauuucuguucuuuuacauuugcugaggagugcuuuacuuccaacuauguggucaguuuuggaauaagugugauguggugcugagaagaauguauauucuguugauuugggguggagaguucuguagaugucuauuagguccauugggugggugcagagcugaguucaaguccuggauauccuuguuaacuuucugucucauugaucugucuaauguugacagugggguguuaaaaucucccauuauuauuguguaggagucuaagucucuuuguaggucucuaaggacuugcuuuaugaaucugagugcuccuguauugggugcauauauauuuaggagaguuagcucuucuuguugaauugaucccuuuaccauuauguaaugcccuucuuugucucuuuugaucuuuguugguuuaaagucaaucagagacuaggauugcaaccccugccuuuuuuuuuguuuuccauuugcuuaguauaucuuccuccaucccuuuauuuugagucugugugugucucugcaugugagaugggucuccugaauacagcacacugaugggucuugacucuuuauccaauuugccagucuguguuuuuuaacuggagcauuuaguucauuuacauuuaagguuaauauuguuaugugugaauuugauccuguuauuaugauguuagcugguuauuuugcucauuaguugaugcaguuucuuccuagccucgauggucuuuauaauuuggcauguuuuugcaguggcugguacugguuguuccuuuccauguuuagugccuccuucaggagcucuuguaaggcaggccugguggugacaaaaucucucagcauuugcuugucuguaaaguauuuuauuucuccuucacuuaugaagcuuaguuuggcuggauaugaaauucuggguugaaaauucuuuuaagaauguugaauauugacccccacucucuucuggcuuguagaguuucugcugagagaucagcuguuagucugaugggcuucccuuuguggguaacccagucuuucucucuggcugcccuuaacguuuuuuccuucauuucaacuuuggcgaaucugacaauuaugugucucagaguugcucuucuuguggaguaucuuuguggcguucucuguauuuccugaauuugaauguuggcuugccuugcuaggcuggggaaguucuccucgauaauauccugaagaauguuuucccacuugguuucauucuccccaucacuuucagguacaccaaucagacguagauuuggucuuuucacauaguuccauauuucuuggaggauuucuucaugucuuuguauucuuuuuucucuaaacuucucuucuugcuucauuucauucauuugaucuucaaucacugauacccuuucuuccacuugaucaaauugguuacugaagcuuuugcacacgucacguaguucucgugcuaugguuuucagcuccaucgggucauuuaaggacuucucuucacuguuuauucuaguuagccauuugucuaaucuuuuuucaagguuuuuagcuucuuugcgauggguucgaacaucuuccuuuagcuuggagaaguuuguuauuaccgaucgucugaagccuucuucucaacuugucaaagucauucuccguccagcuuuguccuguugcuggugaggagcuguguucccuuggaggagaagaggugcucugaugaguauuuucagcuuuucugcucugguuucuccccuucuuuguuguuuuaucuaccuuuggucuugaugauggugauguacagaugggguuuugguguggauguccuuucuguuuguuaguuuuccuucuaacagucagaacccuuagcugcaggucuguuggaguuugcuggagguccacuccagacccuauuugccuggguaucaccagcagaggcugcagaacagcaaauauugcagaauggcagauguugcugccugauccugccucuggaagcuuugucucagaggggcagccgucuguaugaggugucagucggccccuacugggaggugucucccaguuaggcuacucgggggucagggacccacuugagaaggcagacuguccauucucagaucucaaacuccgugcugggagaaccacuacucucuucaaagcugucagauggggauguuucagucugcagaaguuucugcugccuuuuguucggcuaugccuugaccucagagguggugucuacagaggcaggcaggccuucuugagcugcaauggacuccacccaguucgagcuucccugcugcuuucuuuuccuacucaagccucagcaauggcggaugccccucccccagccucacugccaccuugcaguuugaucucagacugcugugcuagcagugagcgaggcuccgugggggugcaacccucugagccaggcacgggauauaaucuggugugcuguuugcuaaggccguuggaaaagcgcaguauuagggugggagagucccgauuuuccacguaccgucugucacggcuucccuuugcuaggaaagggaauucccugacccauugcacuucccaggugaggugaugcccugcccuguuccgugggcugcacccacugucugacaagccccagugagaugaacccgguaccucaguuggaaaugcagaaaucacccgucuucugcgucacucaugcugggagcugcagacuggagcuguuccuauuuggccgucuuggaaccacagccaauuaauuacuucuaggagucuuuuaauagauucuuuuggauauucuacaaaaacaaucauaucauaugcaauaaaaaguuuuacaucuuccuuuccaaucgguauacuuuuuaaauuuuuuuucuugccuuguugcacuagcugggaauugcaguaugauguugaaucacgguggcaguagagguugucugucaucuuugccuuguucccagccacgggggcgagcguccagccucccaccauuaaguauggaugaguuuagcaauagguuuguuguacauguucuuuaucagguugaagaaguuccccuccaaguuugcugagaaauuuguuuuuaaucaugaauagguguugggaauagguguuagauuuugucaggcuuuugcugccccaccaauucauaugaucauaugauuucuuuagccuguugauaugguggguuacauugauugugauaaccaaaaugagugacugagguaggugucacagucaguggaggcuuauugggccaucucgaaggcgugcccagaaaaaacacaaguuacagacacaucuguggcugauuuuuugguucucaggagguuuagugacaggaauacuugcauauuugugagguuuuaguuagugcccaguagauguacguuuuacacaagauaaggugaaccucugaaggaaaaggggacagaggaagcagaugccucagggagggaugaaggaagugaugcaggauauuuucuugaccccuucacaggacucgcgacaggggugcccuguuuacuuggccugccccgcucaaccccucacgggagggagcaugugagcaaaugagcaugggaacuggccagccacuuuggugccagcaggagcaaacucugcucacucaggucugcugugcuccacccaucacaggagaaagcacgcaggcaagugagugcaggaaccggcugcuuuagcaccagcuggagcgaacuccgugcaggccaugugguagcaucuaggugggggugccugcaaccccaaggcccuagaggccaugauacagugcugccuuagcuccgccaucuacagacagcagcguuauccgcucaguggacccuuuggcucgucacgugggguggcugcucuccgccagugagggcaaagagccagagugacaaccuuuuugggcacccacacuuggcaccuccugaauucuuguccagugcccaagaggaaugaggucaugcagacgauugaaggauaaugaauauggagaauuuuauugagugaugaaagcugcuuucaguggggagaggagcuggaaaggggcugagaagggcagccugaaauuaauugccucucugccucaugcagccaucgucucugaagucaaggugccucucuugauguccagcuguuuuuuccugacguccagccacuucuccccucugucagcugagucugagucuuuguaggcacaggauggggccgagcuguagguaguuuuggaaaagacaacauucgauugguaaaaagacauucagaaagaaccaauugggagagagcgggcacacacguuuggaaguucucacuuugggcuguggguuucaggcuuccugcucaaaggugggguuuugccagggaccugucccugucugccuagaauuucucugccuccugucccuaucauuguaucagaauaauuaaucucaucuugucuuuguucuguacaugggaagauaagcuaguaaucgacauuaucaguguggagucuuuuggagagccgguuucuguuuaucuccuagggaagaaagccuaauggagguuaaugagaugggguauauugaaggguuuguuacuggugggagguauccaaaaguuaccaguggccaauucaugcgggucugcagcaaucucauuucuugccuccucagaagaaagaauuugacugaugggcguaaggaagaaaaagagaccgaggcaaguuucagagaaguaguggaagauuuuucaaaaaagcuguagaacaagaaagaaaguaugcuugggaaagacccaagcgggcaugugaaggguaagugcaguguuuaaccaugauccuaggacuuuauaggcugacccacuuccagugucuugcacacuuuucccaugauucuccuuagggugggcuaccugcauguacagugcccuccuuacacuugggaagugagcacgagcaguguguuuaggaaguuguaugcacguccaucugaggcuuuuuucccuuuucuuguggagugccccuggaaggucauacucugccauuuugucucuuaaugcaugugcccggcucacucguccaauaccugagauuuuguuggaagcccuuuuugcuucucccuggugccuucauucaauuaacacuuuaguguaacaggugugggccaucaggaaauggccucucucuggccccugcugccaauuuaucacuuuuagaaagguagugugauaauugcugaaccaucaccugacaucucuagugggugggaaagagcccucuccugcccccgccauaccugucuaacuacugguaacaggcgugugaccugaacucagcuuccaagguuucaccaggguccccuuggccaagagagguccauucagucauuugggagauuacaauuucauuuuuauucccagcugauucuuaaauauaccuuuaaguugauucuuagauauaccuuugcauaucuggauuaaaucccacugggucuggguguaugauaguuuuuagacauugcuggauuugacuugcuaauauuuuguugaggauuuuuacuuucuauguugauaagaaguauuagucuguaguuuuccuuucuuggauuauauguagcugguuuugguauuagggccacuuuuggccucauggaaugaguuagucuucucugccucuguuuucugaauuguauuauuuuuuccuuaaauguuugguagaauucacuaaucaaccucagccugggaucuuuuuuuguuuguuuguuuuuggaaaggauauuaauuuuugauuccauuucuuuaaugaauaaugaauauaggguuaguaaagucuuuuauuucuccuuguguggguuuuggcaguuugucuuuuugaggacuugguccauuucaucuaaguuugauaauuugugggugucaaccugaaacaagcugaagcaaaauuauuguaaguaaagaguuuauuugggcaaagccuaaggauugcaacccaggagcauagagucaaguugcccugaauauacacacuuacuagcagcaguuauaaguaaguggauuuuuaaaggcaaaauugugggggacagggaaugaacuaauaaagaguuguuugucaggaauucucacugguuuacagacguagcauugaguuauuggcuauacguuaagcuauagauugugaauuauagcauuauuagguuaauucauaguuacuuauggcaauaacaagcaguuucaagaggugaauacacagcucagaggagguggguuggugaggggagguggggcgugauuucggucucauuuuaaugucucuuugggccugaugguuaaaaagacuugaauuccucagauaagaucuuuucucacaggcauagaguuaaaguuauucauaguauuccuuuauugcuuuuuuaauauccgugggaucaguuguuaugacuccucuuuuauuucuaauauuggucauuuguuuucucucuuaguuuaucuuggcuagagauuuaugaauuuuauucauuuuuuccccaaagaacuagguuuugguuuuguugauauuuuuuguuuucuuuuccucauguucguugcuuucugcucugauuuuuauugauucuuucugcuugcuccucuuuucuaguuucuuaaggagguaacuuagcuuauugaguuuagaucuuacuucuuuucuaauaugugcauuccuccuguaaacuguugauaaaagagucaaacucugugaaauguuuaaggagguuuauuuugaaccaaaugagugaccagggucugaggcagucucaagaaguucugagaacaagugccuaagguaguuggguuacagcuuggcuuuaaacguuuuagggaggcauaagacaucagucaguauauguaggguauacacagacauugguuccaccuagaaaagcaggacaauucaaagugggggcauaugggucauaacuggauuaaaagauuuucugauuggcaauugguuggaagaguuauuaucuaaagaccuggaaucaauagaaaagagugucugaauuaagauaagggguuguggauaccaagguucuuaauacauagaugaagucucaaagguggccguccuuagagacaauagauggcaaauguuuccuauucggaccuuuaaaaggugcuagacucucaguuaaccgcuucaggauugagaggaccuggaagcagggaucugauuauguuaauagagucuuuacaaauacaguuuuucuccaccaaaaaaaaaaaaaaauggcuuugcagggucauuucaaaauauggcagagaaacguguuuugggguaagauauuuugauuuccuucucuaucugucaugugauguuaugccagagucaaguuggaaaguagccauuuauauaggguuaaauaaaaccccucugauggaauuucaugguuugcagggugugacuccccagaccccuuagauaggaauuuggacaagaggaaaaaggucaaaguuuaguccucaaagcacugcuuugcugcaucccacagauuuuguuaaguuguauuuuuuucaauuacuucaaaauauuuuuaaauuucuuuuuagaaguuugaagauuuuuuuuuagaaguauguuguuuaaauuccacauaauugggaguggggggaguucccggcuaucuuuauguuaaugguuucuaguaucucuuuuaguuugagaacauaacuuugcaugauuuucauuuuuuagaauuuguuacaguauauuuaauggcccagcauggggucugcuuguugaauguuccaugugaacuugaguggaauguguauucugcuguuguugaauggaguauucuauaaaugucaguuagaucaaauugauuaacauuguuguuuaguuuaacucuauccuuacagacauucugccugcuggguuuaucaagguuguugaccggaguguugacgucucuaagagugaauuucuuuccuccuuucuguucuguaguuuucaccucauuuauuuugauccucucguuagguauauacguguuuaggauuguuaugucuucuuuucauucuuguuauuauacagugccccucuuuaacucuuauaaucaaagaauguuugcagucugcuuugucugaaauuaaucuccaguaucacuuuuuuuuuucuuuuuuugagacgagucucacucuguugcccaggcuggagugcaguggcgcgaccucgggucacugcagccuccaccucugggguucaaaugauucuccugccucagccucccaaauagcugggauuacaggcgugcaccaccaugcccggcuaauuuuuuuuuauauuuuuaggagagaugggguuucaccauguuggccagacuggucucgaacuccucaccaggugaugugccugccucggcaucccaaaguacugagauuacaggcgugagccaccgcucccagcccaguaucacuuuuuaaaagacuucuugggagccuauuuauuuugcaagauuugcaguuucccuuaucaacucauuuguacuguuguuggauuaucugugagagucuguuaggagcugauguuaauuauucauuugggagggaugagucaggggauuaauuuuuguagguggauaauuacuaaugaauguuuuuauaugaugacaguuuuuguuuugccagucaacuuuguacaccagauaaagaauauucguguaagauggaguaucuguauuuauugcagugcucauuuauaggggugcuaauucagaucucacugucuguuacuuaggauauaguuaaagugucuguucucaacauguuaguaguaagguagagcuggcauugggagugggaaggcaugugugguaccaccugauguugaaggaaggggacugauugacuauaugguaauggcuacuauaauuacauuuaccacugggagaaccuuugucuagagaggcuaaguaauuaucuggaagucucuauaauucuuaaaaaaaaaaaaaaaaaaggcuugcagucuugcuguauuguccaggcuggaguggaguagcuguucacaaaugcauuacagccucaaauaccugggcucaaguguccucccaucucagccucccgaguagcuggaaccacaagccgaagccacugugucucgccaucuuguaaaucuuuguucuaugcugaugccagaucaaauagugagacaucacucuacacuuuuuuucucuccaccauugauauggggguggggaagaaaauaaauaccaggcaauucuucucgccauucaauaacguaagugauuuauaacuugauaacuuaguccgaaggcauuauaguguaaauaauacuaauaucaacaauucaucagauuuuaacauuuguaaucauaaauaacauuuaugaugcucauuaguuuacaaaagugucuuuacaucagaaauuuuauguaauuccuggugacaauccuguaaagucaucuucauuuuaguaguggacaugggcuugguuccugaaagggaauuauguggaauuauauccccaaagcaucagaacccagaucuuauuuuuucccccacuauacuacacugcuucuauagaacaagaggccucaaaacauuauuccccauggugucagcuggacuaguuuaccauaucauauuuaaaugguguguuuuaugagauuuuuauuauuuuauuuuauuuuugaaacggagucuugcucugucccccaggcuggaguacaguggcaugaucucaacucacugcaaucuccaccuccuggguucaagcaauucucaugccucagccucccgaguagcuggaauuacaggcacacaccaccauucccggcuaauuuuuguauuuuuaguagagacaggguuuugccauguuggccaggcuggucucgaacuccugaccucaagcgauccgccugccucagacucccaaaauucugggauuacaggcgugggccaccucaccuggcuuauuuuauuuuauuuuucugagcuggagucuugcugugucacccagguuggagggcaguggcccgaucucagaucacugcacccuccgcuucccggguuuaagugauucuucugccucagccuccugaguagcuggaauuacaggugcccaccaccacaccuggcuaauuuuuguauuuuuaguggagaugggguuuugccauguuggccaggcuggucucggaacuccugaucucaggugauccacccgccuuggccucccaaagugcugggguuacagguaugaguaaccacaccuggccuuuaugagauuuuaaaauuacacugugcuuaaacucuauacccuaacaucaguuuuuguggauuauguagcagugucugucuuuuuacuuccuaaugguuaaugauugauuuucaaaugaauugauuuaaaauggaaaccuaaguauuaccuaauuuuuuugaaaaauugucuuuguagaagcugaaaccuaucaacacucuucaaaaugcaauggaauguaccacggacuguaucucgacuggcacgcaggacaugcuuggaaccacauaaugcuggucucuuuggacacugucaaaauguaaagggaccuuuacuuuuauacaaugcugaauccaaagugguuuugguacaaggcccucaaaaacaaugguugcauuuaucugcugcccaguguguugcaaaggaaaggaggccauuggaugcucauccaccccaaccaggaguccuucgccauaagcaagggaagcaacauguuucauucaggaggguuuuuucauccagugccacagcucagggaacuccggaaaaaaaggaagagccugauccuuugcaagacaaaucuauuagucuuuaucaacgauucaagaagacauuuagacaguauggaaaaguucugauuccagugcaucuaauaacuucugguguuugguuuggaacauuuuauuaugcagccuugaaguaaguuuuugcuuaguugaaugucuuucccugucuuaccagaauauuaaucuuuuuaauuguacuaaugauagcuuuagauuuuuaaaugcuuuaauguuuuucaucaauagaggauaacuguuuuuucacauuuuaauaauaauagcuaacauuugcuuacuguuuggagcaagcaucuggugcaguuuuuaacuguuucaucuuauuuaauccucccagcaaccauauaaagcaaguuacacaguuacacccauuuuaugaaugagaaaacagauuaggcaaggagaaguaaaaauaguucagcuuuucccaaaauaacucaguugcuaagaaguggugccuggacuaaaaacccaauuaggugcgucugaucucaaagcauacacucuccuauaugcagaucucauccuggcauucaggaaagcacagacauaaaauaaucaaauuucagaaauuuggcagcaccaugacuccauaauuauauauuucuuagaauguucauaaaugugaaaagaugucuauuuugccauauguaugguuuuggugggaaauuugcaagauuuugccaaaguccggcuaauuuguuugcauugauauuacccaaguccaguaagugucaaggaaaggucuuuuguucugaucagaaauuaaucuaguaggucuagccucccaguguuuugaaacauacaauuuaaagugcaucucucuuguuaauacuaugccuuccccuuaagguaaguuauuugcuucacacugcuuuaggcuuaggaggaccagugauuucccauuucugccacuagucggccgagugcccauuccucaguguccgggccuggugugcgugaaggacuuagacacuucaguaaacucuccuaauugguugagaauuauuuuauacuuuccagaguugagugguuuucagugcuugauuauauuuaauggcuugauaucaagacauuaacaaaauaugguuaguguuguacguaaagcucacucuuuagaagcagccuauugcagacuaagcuauaaguagcucuuccaggaugauggaauagaaacuaccuauuuuugggaacacaggaccacauagauuucuugacaaaauuucuaaaaggauuuuuuuucaccuuguguaauugaugcuguucuguuucacuuuguaucuuuacauuauguuccucuuauuuaauuauauccuucuucauugcauauccuuuucuuuaagaauuguaucuuuccuugcagaagauucuuuagguguauauuuuauggaauuguuucuugguuuauuaaugacauuuuuggacaugauuaauauuuauagaagucuucaaaacugcccuugguuuuuugacagaaaauaaaguuaccauuuugaucaaaaguuauuguaggcauucaguccugcuauguaaugaauggauuucuacauauuaaauuuucuuuuuugagucauggaggauuuuugugauucagucugugaaagaugacaugaaaaauacauauguguuucuuuugcccucgucagguugcccauguaugauaaggcaaggcauucggccuccuggcuggccuuagagggagaaauucaagcuuuuaauuaauugaauaugagauucucauuuaggcuauuaagaauaauauuuuuguuccuuuuacuuuuccuuauucucugguaaaaguucuguaacugaaaaaguagacccagaauaaucuagugaucuuaauaaugcuuaagauuucuucagugcugugggcaucugaagcagcugugggugaugcucugucauccccuguaaaaugcaacuuucuuaguuuuauuuuccucccucuuuuuugcagaaugcuuauauguaaacauggugauacaacugucuacuuuaaaauaauacccuuccccauuacaccuugcuuuggggcuauuuguuagcauaggaaucggguugcuagaccaccacuacugccccgccacgaccacugggucaauucugucauagcaucacguagagaauuuauaaugggcaggauggguugcuuuccagaacaguccuccuugggguuuuuauuagauccuucaaaauuugaaagucaauuuauucuauaugaagaucuuaaucacaaguaaugcuuaaaaaaaucaaauucaugaaugaaagaaaaaggaauucgaauauuuucacuguaggaugauuguauuuaaaaguugaaguugauuauacuaaauacagauugucaauucaccugacaagaggcuaguuauauuuuaguguuguucguuuguuuguuuuaacuggaaaaaguucuguguuauuugcuuguugccuacuuacuauuaaaagaaagggagaaaaauaguuuguagcuggaaagaugggcauuugacaucaugccucauuacugaccaguguuugucuugguuacccugauagcucgcauuacugccuuucuaggcaucguagagcaaaaugucauucuauauuuagaaugacagagugaugaaguucucagguuuuugaaauacuuuauuucagggaguucuaaauugugcaugcuaauagauuuuauuuuaaacugagcuuuguugccgcuccuaucuggcaaagccuugcagagaucuggugucuuauguccagaagugcuuuaguuugaucaaguguggcucagcaaugaugauguggucccugcauuuagaugccuuguguuugagaccucaaguuccuaaaguuacagauccacugugaggcaaaacccugauugauuucuacugcacuuuauccagacagugaaugugcuuuuguccuuguguguuucuucaucuguggaaacaguuguaaagcuggcaguuugagaagcacagauuccuggcuggcugugggcacuucagaguagaaagugacaaacaguagauguuucuguuugaaucagacccucauuaauacuucauguucaguaauuccagaggaaaugaaaguuauuuuuaagaaaagucaucaacaguuuagaaauaaguggggccgggcacaguggcucacgccuguaaucccagcacuuugggaggcugaggcaggcggaucgucugaggucaggaguucgagaccagccuaaccaacauggagaaaccccaucucuacuaaaaauacaaaaauuagccaggcaugguggugcauuacacuacagaauugcagagccuguaaucccagcuacuugggaggcugaggcaggagaaucgcuugaacccaggaggcagagguugccaugagccgagaucucaccauugcacuccagccuggagcgaaacuccaucuaaaaaaaaaaaaauauuggaacuagaugcuugcuucuuuaucugacaaaggaugcaggccagugacaauacagcuugugcuuggagucucaguccauuguuuguaugaucuuuuauuuuuuaauuuuuuauagagacaagucuugacaccacgccuggccuaaaccuuaucuuaaugagauuuaguuguuaucuagaaagagauuugaaaaagaauugaaacugaagauagaagauagaagaaaugagauuggacucguaguuuauuuuuuaauucaucucuuuaaacuucccuuaaguuguucugguuuccucugacuuuugaugauaaguaauuuuaauaguccuuucuugaggaugaucagccauaucuaccgagggugcucccugacugcuuaguauuauggugaagucacagaguaggacaucuuuucccuaauuaauauuaaaaauuaagaguuuaccgcuaccguuaucauaauagaucuaggcaaugcucuuucuuaaugacauagggaaagcugcuuuuacaguggaggucuaccgacccugccuucaccaagaggcaaacucaguaauacuaauaagggaggagaccaccccucguauugucuuaugcccaauuucugccuccaaagaaagaaguaaaaacuaaaaggcagaaaugaaguccacaagcagacagcccggcgccacacccugggccugguaguuaaagaucgaaccuaaucuguuaucuguaaauuacagacauuguauggaaaagcacugugaaaaucccuguucuguucuguuguguuguguucuguucuguucugauuacuggugcaugcagcccccagucacguacccccugcuuacucagucgaucacgacccucucacgcggacccccuuagaguuguaagcccuuaagcgggacaggggccgggcgugauggcucacgccuguaaucccagcacuuugggaggccgaggugggcggaucacaaggucaggagauccagaccauccuggcuaacauggugaaacccugucucuacuaaaaacacaaaaaauuagccgggcgugguggcgggcaccuguagucccagcuacucgggaggcugaggcaggagaauggcgugaacucgggagguggaacuugcaguaagccgagauugcgccacugcacuccagccugggcgacagagcgagacucugucucaaaaagaaaaaaaaaaaaaaaaauagagggacaggaauugcucacucagggagcucaguuuuuugagacaugagucuugccgaugcucccagccaaauagagcccuuccuucuuuaacucagugucugcgggguuuugucugcagcucguccugcugcacuaaggauggacagacuggcuuuaugugucccuuguugugaugugcugagguggacaguguccauucugucguuuuccugugcgaaaguacuuaacgugaaucuccucuugaggaaacaaucagacaaacccaaguugagagauguccuuccaaguagccagccugcaugcugcccuccuccaccauagaaugcugagaagcacuucuagagaaaagcagacuagagagacaggaaaaauagccauaaaggacauacugggacaauuuaggaaacuguaaucuagauuauauauuaacuguagacuauuguguauguuauaaaugugaugcuuauguaggugaaugucuucguucugauuuaggggcgaagggucacaguguccaaagagagcaagagccaucauggcaaaauguuaauaaucaggaaacgaaauaaagaagccagggcucaggaauguuaauaaucaggaaacuggaaauaaagaggucaggggcucaggacuguuaauaaucaggaaacuggaaauaaagaagccagggcucaggaguguuaauaaucaggaaacuggaaauaaagaggucaggggcucaggaauguuaauaaucaggaaacuggaaauaaagaagccagggcucaggaauguuaauaaucaggaaacuggaaauaaagaagccagggcucaggaauguuaauaaucaggaaacuggaaauaaagaagccggggcucaggaauguuaauaaucaggaaacuggaaaugaagucggggcucaggaauguuaauaaucaggaaacuggaaauaaagaggucaggggcucaggaauguuaauaaucaggaaacuggaaauaaagaagucaccacggcucaggaauguuaauaaucaggaaacuggaaauaaagaggucagcggcucaggaauguuaauaaucaggaaacuggaaauaaagaaguuaccacggcucaggaauguuaauaaucaggaaacuggaaauaaagaggucgggcucaggaauguuaauaaucaggaaacuggaaauaaagaagccagggcucaggaauguuaauaaucaggaaacuggaaauaaagaagccugggcucaggaauguuaauaaucaggaaacuggaaauaaugaagccagggcucaggaauguuaauaaucaggaaacuggaaauaaagaagccagggcucaggaauguuaauaaucaggaaacuggaaaugaagucggggcucaggaauguuaauaaucaggaaacuggaaauaaagaagccagggcucaggaauguuaauaaucaggaaacuggaaauaaagaggccagggcucagaaauguuaauaaucaggaaacuggaaaugaagucggggcucaggaauguuaauaaucaggaaacuggaaauaaagaggccagggcucaggaauguuaauaaucaggaagcuggaaaugaagucggggcucaggaauguuaauaaucaggaaacuggaaauaaagaagccagggcucaggaauguuaauaaucaggaaacuggaaaugaagucggggcucaggaauguuaauaaucaggaaacuggaaauaaagaagccagggcucaggaauguuaauaaucaggaaacuggaaaugaagucgggucucaggaauguuaauaaucaggaaacuggaaauaaugaagucggggcucaggaauguuaauaaucaggaaacaggaaauaaagaagccagggcucaggaauguuaauaaucaggaaacaggaaauaaagaagcuggggcucaggaauguuaauaaucaggaaacuggaaauaaagaagucacggcucaggaauguuaauaaucaggaaacuggaaauaaugaaguuggggcucaggaauguuaauaaucaggaaacaggaaauaaagaagccagggcucaggaauguuaauaaucaggaaacaggaaauaaagaagccagggcucaggaauguuaauaaucaggaaacuggaaauaagucacggcucaggaauguuaauaaucaggaaacuggaaauaaagaagucggggcucaggaauguuaauaaucaggaaacuggaaaucaagaagccagggcucaggaauguuaauaaucaggaaacuggaaaugaagucggggcucaggaauguuaauaaucagaaaacuggaaauaaagucggggcucaggaauguuaauaaucaggaaacuggaaaucaagaagcuagggcucaggaauguuaauaaucaggaaacuggaaaugaagucggggcucaggaauguuaauaaucaggaaacuggaaaucaagaagcuagggcucaggaauguuaauaaucaggaaacuggaaauaaagucggggcucaggaauguuaauaaucaggaaacaggaaauaaagaagccagggcucaggaauguuaauaaucagaaaacuggaaauaaagucggggcucaggaauguuaauaaucaggaaacuggaaaucaagaagcuagggcucaggaauguuaauaaucaggaaacuggaaauaaagucggggcucaggaauguuaauaaucaggaaacuggaaaucaagaagcuagggcucaggaauguuaauaaucagaaaacuggaaauaaagucggggcucaggaauguuaauaaucaggaaacuggaaaucaagaagcuagggcucaggaauguuaauaaucaggaaacuggaaauaaagucggggcucaggaauguuaauaaucaggaaacaggaaauaaagaagccagggcucaggaauguuaauaaucaggaaacuggaaauaaagaagccugggcucaggaauguuaauaaucaggaaacuggaaauaaagaagccagggcucaggaauuauaauaaucaggaaacuggaaauaaagaagccagggcucaggaauguuaauaaucaggaaacuggaaaugaagucggggcucaggaauguuaauagucaggaaacuggaaauaaagaagucggggcucaggaauguuaauaaucaggaaacuggaaauaaagaagccagggcucaggaauguuaauaaucagaaacuggaaauaaagaagccagggcucaggaauguuaauaaucaggaaaccggaaauaaagaagccagggcucaggaauguuaauaaucaggaaacuggaaaugaagucggggcucaggaauguuaauaaucagggaacuggaaauaagucggggcucaggaauguuaauaaucaggaaacuggaaauaagucacggcucaggaauguuaauaaucaggaaacuggaaauaaagaagucgggucucaggaauguuaauaaucaggaaacuggaaauaagucacggcucaggaauguuaauaaucaggaaacuggaaauaaagaagucggggcucaggaauguuaauaaucaggaaacuggaaaucaagaagccggggcuuaggaauguuaauaaucaggaaauuggaaauaaagaagucgggguucaggaauguuaauaaucaggaaacuggaaaugaagucggggcucaggaauguuaauaaucaggaaacuggaaaugaagucggggcucaggaauguuaauaaucaggaaacuggaaaugaagucgggguucaggaauguuaauaaucaggaaacuggaaauaaagaagucggggcucaggaauguuaauaaucaggaaacuggaaaugaagucggggcucaggaauguuaauaaucaggaaacuggaaauaaagaagucggggcucaggaauguuaauaaucaggaaacuggaaauaggucaggggcucaggaagguuaauaaggaaacuggaaauaagucauggcucaagacuuaauaaucagaaaauuggaaauaaagaagucggggcucaggaauguaacuggaaauaagccagggcucaggaauguuaauaaucaggaaacuggaaauaaaagaagucgggucucaggaauguuaauaaucaggaagcuggaaacggagaaguugcggcucaaguuggagacuuucucugccuucucuccugucuccagaaauuugucgcgguauauguuaauugcuccuucaccugccuuaagucuuuuaauagaauagaagcauccuuuuagaguaauugaaguuuucaucaaacccauagugucguuuauucuuugcauaauaacagacuaaagugauguuaaaauaucucuugcuuuuacagugcaauuuuacacauaaaauuacauguaauuggcugggcacuguggcucaugccuguaauuccagcacuuuggaaggcugcggcgggcagaucaugaggucaggagauggacaccauccuggccuacaugaugaagccccaugucuacuaaaaauacaaaaauuagcuaggcguggugguugcgugucuguaaucccagcuacucaggaggcugaggcaggagaaucgcuugaaccagggagucagagguugcagugagccaagauugcgccacugcacuccagccuggcaacagaacaagauucugucucaaaacagaacagaacaaacuaacaaaccauguaauuuuaaagguaaaaauuuuaggucuuaaaaugugaguuggagcauucuaaggaagugguauuugguugaggaaacuaagaccaggcaaaugauucugauccuuuucucauaguuuauuuaaagcuguuaauuuuauucuaauaacugccucuauuuuucuaaacauacuaggaugcccacaugaagcaaauagaaguuguaggcgauaagauaccgugugaugugauguuugugugcauguugcauauuguacaucaaguaagauguucucuuagagugaagguaaagugcuugauaauguagaaucaacuuuuaagcaaaauuuaauaaaauuauagugugguuuugguauuuucagauaauuuuugaaaauaucauuaaaaguuuguacauaugaaaauuacuuuuuuuuuuuuguagaggagugaaugucguuccuuuucuagaacucauuggguuaccugacagugugguaagcauccugaaaaacucccagaguggaaaugcccucacagcauaugccuuguuuaagguggguacuguaacaaacccauugcuccucagaacucacugguggugaccugcucacuuucccaugagauuccauguuagcuuccaauuguauuucguaacuugaaacgcuguauuucaucucugauaugucuggugaauaauguaagauaauuuuuuuuuuuuuuuuuuuggagauggaguuucgcucuuguuugccaggcuggagugcagugaugccaucucggcucacugcaaccuccgccucccagguuaaagugauucuccuaccucagccucccgaguagcugggagauaacaagauaacaaaauaaaguggaaguaaaaaugugguuuuaggaagaaaugccuuaaaaauugguagaucauucauaacuuccuguggucaaauaauuguuagacuuaugugauuuuccaugguaguagucaucuguuugacauugcucccguugauaaauggagauauaauuauuuuaaguauaauuauauuuguuuuuucuuauucagugaucugcaugccaccugauuuguuagcaaaauuuagcauuuauuuuacuguuuuuuguuuuguuuugugugugguuuuaaggagcagagaguuuaauaggcaagaaggggcaagaaggaagggagaaggaagaagcuccccuguacagagacagaaggggggggccuccaaagccaaaagaggagaucccccuauuuuacuguuuuuaauaauucaucuuuucuuagcaaguaaaauagguuuaauccaaauugucuuauaugauaaacccuuuucuguuagauuuuaaccuaacauauguuucauuuuaaaaguugauaaucuuuguaacuauucuccggauucagacaacuuuuuugagacggaguuucacucuuguuucccaggcuggaguacaauggcgcgaucucggcucaccgcaaccucugccucccggguucaagcaauucuccugcuuuagccucccaaguagcugggauuacaggcaugugccaccaugccuggcuaauuuuguauuuuuuuaguagagacgggguuucuccauguuggucaggcuggucucaaacuucugaccucaggugaucugcccgcccucggccucucaaagugcugggauuacagaugagacccacugcagccggccugacagcaucaucuugauagcuucuaugccuaugggucuuuauuuuggaagggaagacucacuguaaauuguggaguuuagccauauuaaucucauuuucuaaacugacaaauauuuaugagggucugugaaacuucuaccuaaggaaguugaaaacacagaaacuagauguuuuauuuuacuucuguuguauaagaauaucuaagaauuacaguuuuacagcauuacucaaaaguagcauuguuucauucugucauccucauuagcauccucugaaaucuugguagauuuccucuuuuauuauaauuuugaugagagggcuaacauuuaauuuuugaguuuuucuacauuaaaguguauuaaauuuaaaaauuaucaaguuucuaauuaugguggguauaauuuuaacccgaguaagucaaacuaucaugcugauguaaaccuucccuaauuuaauugcuccuuaucccacucccauagcaugacaguugauagcacagugugugcuagguguuaaguguuuguuuuauuugauuaggagcucccaggaacucagaaucaugucuucuuucuuguuuuuuuucacugcaccugguauuauguucuguaggugaauaaaaugcucagcacguguuuguggaguugggauugaaaaugaggcuguaggcgucaugguagggagaugagugccagugguguuucuucccccucacuauuccucugugaaguaggagauauggaggggauucuccuuuguauuaucuguaacccccaguuucucaaauagagcaacagacacagauuuauugcuucaacaagacaaaguccccaaaugaaguauggcauguauggucugguggcaguuggcuacgggauauauucacugacugccucauaaucucuuugaaauacacccagaguuuuagucauccucugcugugugcuagguaccauucuagguacugggaauaaacgaaucaaagaagacagugcaaaauaccugccucauagggcugauaguguagugagugguaguggguuggggagacaagguaaaguuagaaaugcaugcacacacaaaguguguguacguagaugaugguaacugcuaagaaaggaaaccagggauggggguauggauuuguuuuucaaugggagauggcacaccuugcugagaaggugagagaguugcuccuccaagagggaggagcauuccaaacagagaaaauccgaaagacaaaguucugaggcugcaggauccugggaguauuugagggaugcagggaagcuagugugaccggaaucagugaacagggcagagaauggcgugucaucagaucaggacagccuuguuggcccuuaaaaggacuuugcuuuuuacccugaggacauggaaagccacuggacaauuuuaagcauccugccucuguuccaucaaaaucacuuuggcugcucuaguaacagaccauggcgggaucaggggagaagccaagggaccuggugugaggugaggugauuacaguauuuuaguugagaggcaauaguggccagaacccaggugguagcaggaaguaguuggauucucgauacguuuuaaagacgugguugcugggguuuucugaugguuuggauauaaauuauggaaaagaaagagggguugaagcuuucuuguaaguuuuuggcccggacaacuggaagaauagaauugccauuuucugagaugaguaagacuuugagagaagcagguuugaaguaggacagucgaagauccgaaggucaguuuugaacaugcagucaugugccacccaacagcauuucgguuaaccauggacuacagacagugauggucccauaggucccauguuuuuaugaaugucauauuuuuacuguaacuuuucuacauuuagauaguuuagguauacaaauacuuacuguggucuuauaauugccuacuguguucggcacaguagugugcuguacagguuuguagccuaggagcaauaggcuauaccuuguggccugagugugcagagggcuacaccaucuagguuuguguaaguacacucugugaaguuucacacaacaauaaaaucaccuaaugacacauuucucagaccguauccccauuaagugacucaccugcauuaaguuugagaucuuauuagauaugcaaauggaggugguuguauauacuggaauucaggggaaaaguucagucuggagauuaaaguuaagaaucauccauguauaguuggcacuaaagaccagagagugagauagguagagaaaauaagagguccagggaucgaauguugucacaccacguucagaggugggugaaaggggaggaauuggcaaaaaugagaagccgccaugaacuagaaggaagcccagcaaguugagggccuggagccaagugaagggaaggugaaagcugugugggaugguuccagugguucaggggcugguuccaaauugacaacuggauuuaguuuuguagaggucacugugacuuugaaagcaguuuuggugaagagguaugggugaaagcuugcuuaacgugaguuuaggagagaaauuagagauagagcagacagcucuuucaaaguuuuguuauacaacacaccuaugcauuuuguuuuguuucguuugagacaggaucuugcuguuucccaggcuggagugcagucgugcaaucacagcucccugcagccucgaacuccuagacucgagcaguccuccugcaucagccucccaaguagcugggacuacaggcacaugccacuuacucccggcuaaguauuuuucuuuucuuuuucuucuuucuuuuucuuuguguuuuaagagauggcagggucucauuauguugcccagacuagucuugaacuucugagcucaagcagcccucccgacugagccucccaaagugcugggauuauaggcgugagccauuguaccugccaacaccuauguuuuuuguuuuguuuuguuuugagagguagcuucacucuugucgcccaggcuggagcgcaaugguacaaucucgguucgcugcaaccucugccaccggguucaagcgauucuccugccucagcuucucaaauaucugggauuacaggugccugccaccacgcccggcuaauuuuuguacuuuuauuagagacuggguuucaccauguuggccaggcuggucuugaacuccugaacucaggugacccacccaccuaagccucccaaagugcugggauuacaggcaugagccacugcacccaaccugauuuuugacuuagaauaugaugcagccuuuuuacuuguaugguucucuuugaccagucauccaucugcuauuuaguauugguccuaaaaguuccaauuaacguuaaaccugugcaugucugcagcaggugugccauuuuacuacuuuuggccuuguguaaauuaguggcuaggauuugagacucaggguagauugugaugagaagguagcauagguuuagaaaagucaaaggaaagggauuuggaagugaagcuaaccuaaaucccaacagagagugguuucaugcucugccucucaccauuugaagacauucaguucuaguuuagcuccagauagaaagcauuuggcaggauggcagggcuuuuaaggaauagaaacauguguuccucuguuauuuuuacugguacugaguccucuuucugauuuccagguugaccugucccccaaguuuacuagcaugcgauuagggacaucagugcuaugauucuguuaucugggucaggauuguguagaggacaaacauucauaaaaugaguuuacagaagaaauaucucuuguuaggagggaaaaccauauaggauauuacuacauuagcuuugugaaacaaugaggcaauuuauucugauggguuauuaccaagaauuuuaauuuuaacuuguuuuugcuuaagaugacaguaauaaccagguuuugauuugccucuguuugcuuuuugcuuaagauugcaacaccugcucgguauaccgugacuuugggaggaacaucugucacugugaaguaucugcgcagucauggcuacauguccacgccgccacccgucaaggaguaucugcaggacaggauggaagagacaaaggagcuuaucacagagaaaauggaagaaacaaaagauagacucacugaaaaguuacaagaaaccaaagaaaaaguuuccuuuaagaaaaaaguggaauaaggugccuuauauagcaguauagaaaauuccugcacuuuaacccuuuggaaacuaugggcaaagauacaugugucugauuauuuuuuugguuaguugccgaaauauacuaguucucugaggguuaaagaaguaaaauaccuuuuuaaaguuaaauaucacuagaaaaaucaguguuauuacaagggaagaaaugaacccaguuuaagaauuugccaucaguagcaguauuaagcagugguuaaugucuuagaagucagacuucuuuuucaaggucuucagaaccacacuugauuucuguuuuguugcagcuguaauugacacauacuaggcagcugacuccuugaauauccagugugacccauaaaauagucuguuaauaccggaucuuaauuuuuauguuauucauuaagauuuuaacuauauucaguacguaauuuggagacaaacuagcaucaucaaaacugccuguaaauaagguguuuagucuuucuauaaaaacagaauagagcaguuaccuaccaguuaaaauaucuuauaugaagaaaauagaauaaagauccagucauauauguaaauaagauguacugauuguacguaaaugaaaaauggacccuuuaaaaauuauuuuuaccugaagcuugucauaauuuuuuuaaagcaaauauauauauggugaugguacuuuucaaaguguguauuaguggugaucaccucaaacauaaaccucuguugugaaucauuuguguccuuuucaacugucuuucagaggaaagguaaaaaaucauuaaaccuuaaauucauuguuaaaaucaaauauuugucagcaguaacucaagcucaugguucucaagcagaaaaagguuugggagacuaaaaauggagucagguuuucauggagacugcuaacuccuugggguagacaugggccuugccucagcaaaccagugcaauuucccaaugucuuaguuucagaauucaugcugauuucauuauggaguaaaguuuuaaauuguggcugcugcuuuuugucuuacauugaagggaaauauccuuguuugagcauucuacuugauuuuuuuuuuuuuuuuuuuuuuuuuugagacggagccucccucucucucucccagacuggagugcaaugguacaaucucggcucacugcauccucugccucccagguucaagugauccucccgccucagcuuuccaaguagcugggaguauaagcgugugccaccacacucagcuaauuuuuguauuuuuaguggagguggaguuucaccauguuagccaggcuagucuccaacuccugaccucagccucccgaguagcugggacuacaggcgcccaccaccacgcccagcuaauuuuuuuguauuuuuaguagagaugggguuucaccaucuuaacaaagcuaucauuaaaucauuugcuuguaaugaaauucagccguugucagcugugagcguugcggggcuggugggguguguuugaguauguaagugucuauuuccugugcucuaacagugacuauuucaguucuaacccuucaauugcuaauuggaugagggaauggccucuuagauuguccuuguuuugacuuaucugcuaaggcgagagaaugucuggguuugccacacagucccgcagggaccccugcucuuugccaggauuuuuauaucaaguacuuaguuuggccaaauuuagaguauaguuuaaaggggaaaaaaaguuuguauuugaugagucuaauuacuauauuagaaugcuuuuuaaaugaauaugcugugauuggaaucucuucuugggggccggggagagugcugagagaugcagcugugucucugcucucugcagucuugggcaggcagcaccgcugucuccugauacagaggguugaaugcacugcuucacauugaugccacauuuucaaaucuaaacaugauuaacauguuuuuuaaguauuuaucaaauaauucacauuuuugcagguuuaagugcuguuuuuuaagauauuaaacauguuccuuguuucuuuuuucuuuuuaaccacuggagacuaugugaaaaucuuguguuauauggaauuuuucuaaaacaauuuccuuuuacuuuucauguugcauauuuuccaguggggauaaauuggagguucuuauuacuaauaauccugaaacuaaaauuugcuuuuccugcauagacaucuuuuguuaguccauuugaguuuuguugccauccaguuucaugaucauguuguguuagucuaauagacaaugaguuacugcuugaaugauaugaaauucucuaguaaaaaaugcucugaagaugugagaagcucuguuguauuacuuggcaccaggaauguuacaaaaauguuguugcuagcauauugcuaaccuaguccuuaaguuucagggauuccuguaauauguugaguuuggaguauuaauagcaggcuaacagaauacaguaccaauaugccaaguuaaauaauugagaauauauacaguauaguuugcuauguauaauagaccucauuucauuuacaguacaccucacacuugggauuaauucaccuauaaccucugugaacugcgagugcucggcagaagcagcccugugucuuacaugucuacauuuauauuuauauuuauauuuauuuuuuugagacagagucucacucugucacccaggcuagagugcaguggcaugaucauagcucacuugcgucuugaacuccuggcucaagugauccucccaccucagccugcugaguagcugggacuacaggugcacaccaccaugccuggcuaaaggcaugucugcauuuaugcgagguguguugaccggguggggagggagcuaggacugagauucgccuguguaaaaugcacaaaaaggguuugcuaagcaaauugauauuugaaaugaaagauggauuaggugagagacuuaguuuauucaggaauaagagcaaaaccaaccacaucaaaaaauguauuucacugagacagccuuuuguacauacagcagggugcuguuuacagauuucaagaaaggagaaaaagaaugcuuauacugagauuaccuaccucccaguagugaaaauaauaaauuuaucccuugaaauauaa

SEQ ID NO: 192763 - RNA, 70731 nt, Homo sapiens
accgugggccacgccuuccgggccccgcggcuggccggcuccucgcgcccuccccucucucggccgcucuucgggccgccucugcguguggggccgcccgcgccagugugagccugagcugacggcggcuccgggaggcucgcagaaggggagggccgggcggcgcgggagcugagcaucgccagggcgggcggcagggcgcggccucuccgccggguguaccaccugucgcggcgcgagaccucugguaaggcccggcgcgguggggcccgggcggggguccgggagaggagcgggcgccggccuccccuggcccggccccgagagcccagcgcugccgcgccuccggccuccgcgcgugcggcccccgccguucccggccuggcggugggggcugggggaagggaagcggucugcggaguccgggcugagggcgagggaccggcuacaucgcggcgacccagguuccagcggccgcggcucuacccggcgcgcgauuuccagguuccuccgccggcuggugccugggcgccccgcucucgcccgggagcgaggcccugggccuccaaacgccagcaucucuuucucgcucuuucugcaccccuccacaaaaggacuucuguggcuggaaacccuuuggcaagccuaucuccuuuauucagucgggccgaguuaacggcaggaguuaggcuguguguguggcuccucccuuuaaaaaaagacuugcugcgggcuggagaguucugagauuggaccgauuccgucuauuauuaaaugccaucuguggaccgggauuggcagguguuucuuucacgcuggcgauaacuaucucugcaugugguguuaccuaggugguccuagguuucgacuuucuuuuuugguuccagagauaauucuagaaaauuuacguugcuuguggugagaagcgugaucaaauuaacacgugcuuucuuacaaaacguuuuaucaucuucugucuguggauuuaccuuccugaugcuuguggcuaucaccucuaagcaaagagguuaauagcauugcuauuucuguuaguguugcaguugauaacgauaacaauaguagcauguauuaauugcuagugacaggcagagcgcuaguuucuacacggauuaucucaaaauaacccuuugagguugauacuguuacugccuccacuuuacaaaccaggaaacuaagguuuagguagguuaaguaacuugccuaagaccacaguuuuaacgugacaaagccuagauucaaacucaaguggucuaacuucauagcugcauccuccacccccacucccuuaaacguguauacuccuuaagcauugcucauguuguuaagcuaauugcgauguuguacccauaauuuugauuuucaauuuacaaauacucuguaaauuagaugagagaaacaguuguuuuuaaaaacauacauauaggccguucgcgguggcucacgcauguaauuccagcacuucugggaggccgacguggguggaucaccugagggcagcuaauuuuuguaauuuuaauagagacgggggcuucgccguauuggccaggcuggucucgaacuccugaccucaagugaucuacccaccuugaccuuccaaagugcugggauuacaggcguuagcgaccgcgccuagcuccuaauaugacuuuuaucaugcauuaauaggaaauguugggcuaugcuucuguagaaauauucucuugagaauaauauauuuaugcuuaguagcuauuucugagaacugcuuaugggugacacccuuagaggguguuuauauguuuuugucuuuuaauauauuuaugaaaacaaaauauucauaaaggaaaaaacccauuuaccauuugggaacuucuuuuguaaaauuaaaaacuuacagcuauguauguauaaucuguauauuaaguuaaaaacucuaauugauuuuggugaauuucagacaaacuagacauauuuuauucucuuuaagacggaguuuugcucuuguugcccaggcuggagugcaguguugcgaucuccacucacugcaacuucugccuuccgcguucaagcgcuucuucugccucagccuucugaguagcugggacuacaggcaugcaccaccaugcccggcuaauuuguguguguguguauuuugaguagagacaggguuucaccauguuuuucaggcuggucucgaacugcugaccucaagugcuccaccuccuucggccucccaaagugcugggauuacaggagugagccaccaugcccggugaacuagccguauuuuaaaacacaaauaacauuaaaaccuauauuuacuaaggauuaauauuacaggacaaaauucacacuaaauaaaaauuacauugacuuuauaaaaagauaacuuuuauuagaaauuaacuauuuuauuugaaaguuacgauuuugauuuuaugguggcauauuguaccuccuuugaucaauauguacaaauuucaaaagugauaaaaaauauauucuguauauacuuguuuaggaugacauuugauguugccuguauuuguauaccauccagauucucauucuugacuuugagauuugauuugaaauauuuugaauaaauguuaaucaugauuauccuuauagccucuuauauuaauuugaucauuaaaagauguugaugcagaaacaagcaggcauuuagaaggcaccuugugaccaccuuagucuacaacuacuaauaguaaugcuuaugauaacuagccuuucuagagcaccuagagggcauugugauaagcaucuuaaugaauuaucuaauuuaaaucuuaaaauagccuauuaaauaggucuuguaguuuaacguucccauuuuacugaugagaaaaugcaaauuggggagguugugauuuacucagcaucacagagcuagcaaauggcaaagccaggauuuauuuuguuuuguuuuuguuuuugagagagggucucacuuuuaccuaggcuagagugcaguggugcuguuaugguucacugcaaccucaaccucccaugcucaagccauccuccugccucagccucugaaguagccaggacugcaggugugugccacuacccccagcuaguuuuuaaauuuuuuguagagaugggguuuugucauguugcccgggcugaccuggaacucuugagcucaagcaacccacccaccuuggccucccaaagugcuggggauuacagguguucgccacgggauuuaaauccaggcaguuugacuccagaacuugcccuuugaccacucugcuagacuauuucguauggguuuuuuaaagcaaacuuugaaaucaaguagucaagcucuuuauagugaugcuauuguaaagcucuaaaggcuugacacuauuaauaauauguauauaucaacauuacuacacagaauucugcaaguuuccccucccccacuuuauugaugagaaaaaugaaacaucuaagucaauggcuuccagacuuuuggacuuugccaacaaguaaaaaacuguuaugugugggggacaauugggaccagacguaagaucuccaacuuuuauuucugucaagguugagaaucuucuuaaacacuacugcaaucuggucaggcacauugguucaugucuguaaucccagcacuuugggagccagagguggauggaucacuugaggucaggaguucgagaccagccugcccaacauggugaaaccccgucucuacuaaaaauacaaaaauuugcugggcaugguagcacacaccuauaaucccagcuacucaguaggcugaggcaggagaaucgcuugaaccuggaagucagagguugcagugagcugagaucacaccacuguacuccagccugggcgacagugauuuuugagacucuaucucaaaaaaacaaacaaaaaaacuacugcaaucuacuguccugauccuuuccuuaaaaaagggacauuuuuaccaccacaaagguaggaaggucauaguuacaacauaaaaacagaauaaauuuaauauuaugaaaaacuauauuacauuguguuaguuuuuccuccuuuggucauagaccagucaaaaacauguccuaaacuaacaccaauucagagaucauucaggaaugccugggugacacaacugauucugaacugguaauuagcugaguccaguccagauucacucuccagucugucugacagcaaagccugugcuuguugcccugucaugagcucuuucuagugaacagugucuaggguuuuggucuccugugaacagucuuucucagguguugacuauuuccuucucccuccagguagggggccagggagaauagucuccagcagccaaugucuuaacagcuuuagucccaguccaguuuguaaauaccacccagagggugaguuccacugcuucccuguuugagguaguucuuuugucugugcuuacucauggaaggggcaaggcagugaccauaccagggcaagaaaccacgggcauauuccaguauucaagaaacucuccugcugggugugguggcucacaccuguaaucccagcacuuugggaggccgaggcgggcggaucaccugagaucaggaguuugagaccagccuggccaauauggugaaaccccaucucuacuaaaaauacaaaaaaguaaacgggcaugguggugggcaccuguagugcuagcuacucgggaggcugaggcaggagaauugcuugaccuaggagguggagguugcagugagccaagauugugccauuacacuccagccugggugacagagcaagacucugucuaaaaaacaaaaaaagaaacucuccaguaaauagcuugauuuuacuuagucauucaaaauucgaauccccaccuucuuuuauuuccuguuuuuacuucacucacuccuauaguucuccuucugucaucuuuguguaacauaaggaguuagguguguguuuuccucguucugucuugucuccagcagauauuaagcccaccugucuguuucugucuguaaguguucuaaguuccaauuucggcaaagauuguuuuuuuccuuaaguuuuuuuuuaauuaugccuacuaaagacacuauuaaaauuacuuuuauauuuuauuuuacucuaucacuugcuaauaaaauuaucuaauaguuugaauaauauauguuuuaucuuuaauuauaauacucuuuugcauauauucucucauuuaaucaucacaguuuucuaugagguagauuugagaggugguguuaucuuuauauacaagccaaauucauuauuuuauuuauuuguuuauuuugagacagagccucaaucugucauaaggcuagagugcaguggcgugaucucagcucacugcaaccucugccuccugaguucaagcaauucuccugcuucagccucccgaguagcugggacuacaggcacgcaccaccaugcccggcuaauuuuuguacuuuuaguagagacuggguuucaccauguugaucaggauagcuuugaaaucuugacgucauguuccaccugccucggccucccaaagggcugggauuacaggcgugagccacugcgccaggcccaaauucauuauuugauaggagcaagauuuuaacuaggaguugaaaauagaagauuucguauaucagcaaccugaucuuaacuacugauuccaaaauguauuuuuuggggauugccuuugauucaaaauaaaauguauuccauaccauuuuagauuugccuaccuugcaguacuaaucaccaaaguuuguguguguuugugugugugugugugugugugugugucugaaacggaguuucgcucuuguugcccaggcugcagugcaguggugcaaucucggcucacugcagccgccgccucucggguucaagcaauucucccaccucagucucccgaguagcugggauugcaggcgccggucaccacacccagcuaauuuuuuguguuuuuaguagagacaggguuuugccauguuggccagucugaucccgaacuccuggucucaggugaucugccugccucagccucccaaagugcugggauuucaggcaugagccaccacgccaggcccaaaguuuuaacuguaguaaauaaugcuaucucuccuggaagagccacauaaacauaugaugaauucuuuuagaacuucuuuuuagcugggugugauggcucaugccucuaaucccagcaacucacaggcugagaucggacgauugcuugaggccaagaguucaagaccagccugggcaacauagcaaacgccagcuguacaaaauauuaaaauuagccgggcacaguggcuuguaccuguagucucaacuacuugggaggcuaaagcaggugaaucacuugagcccaggaguucaagacugcaguuagcugugauuauacaacuguauuccagccugagugacagagugagauacugucucuaaaaaaaaaaauauauaaaacuuuuuuuaaaugacaauuuauaaaauuuaaaugguuuuuuuucaucacuuagcagaguaucaaccaucccaauuuuguuaauaauacuuuugucaccauguuggggauucuggggagaaagcuacuugguauauauauauauuuuuaacacugugcugcuauaauuaacauuauuauucauaugauacugauuaauaauuuuuaaaaguguagaaacauguauauauaauuuguacuuuuagagccaacugcugguacuuucugcaguauaauaauaaauggaaauaaagugacauggagcuuuuaugcaagauaauccugaaaagauguauaaaagucaaauuugaguaacuuaaaauuuaaaaauagccugaaaaaucuugcuauuuaaagaaguccagugaagaauucucuuauauagcaaauucucucucuuaaaaauaaaaucaauggaguuugcucaaagcaggcucuaccacuguuucuucuuuuagauuguacacauuuaauagauauccauuauuagauucagauagugaagacaauucauaaguacacaaugcugguucuauauauauguguguguguguauauauuuauacuauauacccacacaaauuuaaaauuuaaaaaaaaaggaaaacuugggaagccuauacagguaugugucuauuuuuuaauuuaaaauugagaaaggguaaguuagauuuuuuuuuuuuuuugagauggagucucacuccguugcccaggcuggagugcaguggcaugaucucggcucacuguaaccuucaccucccagguucaagagauucucaugccucagccuccugaguagcugggauuacaagcacguaccacccugcccagcuaauuuuuguauuuuuaggagagaugggguuucaccauguuggcuaggcuggucuugaacuccugaccucaagugauccgcucaccucagccucccaaaguguugggauuacaggcgugagccacugcaccuggccaaguucuuuuucuugguuuuguucauguucauauuucuuuuaaaaagcacaaaggagagcuuuauuuaggacuuuauaacuuacugguaauagaacauuaagagaauacugcaugguggugauuuaauagauucuguuuaaugcuuuugauguuuaccuagagaaaaccaaaucuggcuggaugcaguggcucacaccuguaaucucagcacuuugggaggccaagacugacagaucaauugaggccaggaguuugagaccagccugggcaacauagagagaccccgucucuaccaaaaauacaaaaaauuagccgggcaugguggugcaugccuauagucccagcuacucaggaggcugaggcaggagaaucacugaauccaggagacggaggcugcagugagcugagaucgugccacugcacuccagccugugugacggcaagacucugucgcaaaaagaaaaaagaaaaccaaaucugaugguguaaguuucacagcagcuaaaaagacauggauuccuguaguguuaaguaagaauaugagagcaauacuaacccuaggccucauuccggcccugacguaggugcucaauagaugaguaaauaaguauaauauauguuuaaacugaaucaacuuccaguuuaaagugaucgauuagucacauguugaaaucucccuuucuugcucuaaaaacacagagaugguaaguaaaauugaaacaacacagagccaaguuugaaagcaagagagaaaucuccacaugcaggagugaagaaagaaccuauagcagugagcuugauugaagacaaauguuccauggguagacagggaacaaacacaguacaugaauacuacuuaggaucugaaguguuuauugcuugccaggagacggaaacugaguucccaaggccuguucaaccuucagaaucaaaacuagacauauuuugggaagcugagaauggggaaacacuuuucucuccauaaaugaagacuguauccucacugagguugagacgagaauuaaaccauccaucccacaccauaaguagaauccuaaaccucaacuuguuugaauuuggcuuuggaauucuaccugagguauguaaccaucuaacacagaaacuaauguagaaacuaguuuuagcuuguaaacucucaggaucucauauagaggcaaacuuaaaacugccuccaaggguugguuuccacaacacacaacguguaugggaccaccaucaaagauugcaaagugagcuuauagacaaaaauuaugccaugaaagagacugaaaauuuauauccaggcacuaaagacauuagaaaagaucuuuaaaauaaauauuuaaugaagccagaauuuaaaguuaugaagcaugaacuggugaccauaaaacagaaccaaauagaaauauagacauaaaauaauugaagugaaaagauggaauaucagaaauagauaacuaaagagcuauauaagaaguuaggugguggauaaauugcuuaauuaagaaaugaggccaggcucaguggcucacgccuguaaucauaacacuuugggagguugaggcuggcagaucacuugagcccagaaguuggagaccacccugugcaaaauggugaaacucuuucucuacaaaaaaaacuacaaaaauuagcugggcaugauggcacaugccugucaucccagcuacuugagaggcugaggugggaggauugcuugagcccccgaggucgaggcugcagugagcugugaucaugccacugcacucuagccuaggcaacagagcaagacccugucucaaaaaaaaaaaaaaaaaugaaaauauacgaaaugaaauuuugucuugaaaaaugggauuuagaaaggaaugggagggaauacauuuaugaaacaaaaacaacagaaccaaaggcuuagaggcugaaaauuuuggaacaggaagggaaaacaaaauaaaaacccuggacuacgacugguaagcugagugauauuggacauguccauuucuguuucugggcuuuauuuuuuuuucauuuaaauuaagauauuuaaacuaggugaugucuaagacucgugauaacuauaauugugauucaaggaaaaucuaaguguguacaucuaauuagaauaaagcacuauuuagguuuauguacuugguaauaugauacauacucuaaugcuuuaggaaggaagcucuauaaaggguaucagggucauaacaauguauuaaauagugugguauuauacuaaauauauugaucuuccugauucugucacagagcuccucaaacccuuggauuuccugaaugauaagagugucuuuaaaaaaaauuuuuuuuaaacugaugcauaauagauguacauaguuucaggguacgugugauaauuuaauauauucauauaauuuguaaagaucaagccaguguauucuggauauccaucacuuucaauauuuguauuuauacuagaaacauuccaguucuucucuuuuagcuauuuuuaaauguacaguagauuguuauaaacuauauucaccuuacugaucuaacacuaggucuuauuccuucugucaaguuguauauuuuuauccauuaauucccucccccccaugauaggaguguuuuuugucauaaugauccccuuuugaucacaccugaguguaugcuagucaccugaggugacuuaggguagagccccuaggcagccucaggguauggcugaucacuagaaagaccaagugauuagaggguuagaacuuucagcccuauccaugagcuuuggggaagggggugcuggacauuaagcucuauaaaacuuuugaacgacaagauuugcugagcuucuggguugcugaacacauggugcuggcagaguggccuguccagagagggcauggaaacccugcauccccuugcccccaaugccuugcccucuacaucucuuuaucuggcucuucaucuguauccuuuauaauaaagggggauuuuuugaagacauauuagaauaaagcaauuuauuguggauaagaagacuuaaaaaugggccaugguuaaagacuuguuaagcguuccuaauaaugauacauuugacaaggaaauuuaguuauuucugugacauauaacaauuuaacauuagaauuaugacugacaacauuuccuaagacguaucagauuucuaggaaucucaugcaguuuuggaacacauauuaaccuguucauguuaaugggauucuaggaaaugguuaaacauuauucuuauuuggcaaugcuucccauauaauuuaacaugcccaauaagccuaauauguuucgcuuggacuuccacaggcccuuuuggaauguccaagaguuaguuuaaggucaaaaagauguaauuuagaauuugaaauuugauuuggggaagccuguuaauuaugucaaagguuuaaaacacuugaucaaaaauaguaucaaaggucacugugaugaaaugaaauaauauucauuuagcugaagugauuucaaaaaucaagagauuucaaaaaucaagaauccucacucuuugauagaaaagcaaccccauuuuccaaaaaaaaaucaaaaggccuaauaaagacagcaugaugcaaacagaauguuucuucuauuuugcagcuuacucaaaaggcaaacuauaauauuuuguuauuuuuuauuaauacuacacaaaaaucuucagaagagaaaaccaaauucaauauauuauuauuauuuucuuuuuuuguacuuuuuguagagacaaggucuuacuauguugcccaggcuagucucgaacuccugagcucaagugauccacccaucucagccucccaaaguggugggauuccaggcaugcaccacugugcagggccucaauguauuauuauuaaagugaauuuuaauaaaaccuuauaaacaaauucaaucucagucagcuuugaccacacaacauaagauuuccguaaauuuuuuacaacuacuuacaaaauuauuucagguuuuuuucuuccccaacuuguuuuauccauuuaguuuuaucuauaucauuuuuuccuucauuaugaaaccuuuaaauaaccucuaaacuagacagaauuccuuuuuucaacaaaaaacacaucuuuugucuuucuuauaaccuuccucaccaaaaagcauccugccuuucuuguaaaagcauuguuuuucuuuauaucuaguuguuuuaauuacauauauuacaauuuugacucuuacuaauuuccaguauaaaaccuaguaggaagcaauuuuaauugcuauguaccagguacagaguucuggacagagcuauuacgacuacgucuggaggacccaaccccuucuagcauggccaggaggcacugcuggaccaggagggcagggccauauugagccuggcucugcccugcagcugguggcccagguacugaagauaaacguauguaccugggccucaccauggucaccuguguagacugcagaauuuaaaggcucaaaaccaaaaacauaagcucagacaaaucaaacaaauauuaaaaauaucucaggagcaauaguuugaugaccuuaaaauacguagaagaaacuguguaaaucuaaccaguagacccaaggcaaaaaugucugaauuauauuuaauauugacaauuuugagacauuccuauuuuaccaacaauuuuuaaacuagcuuauuucaaauagagagaauuuaagcuuuuucaagagggaguuugaauaugucagaggagacaccgaggaagguuaaucugaacuaccagacuacaagguggaguggccuucuuuauaaaucccacaggggauccaaagcaggcaguuugagcauacaaaggaguuuuacuuuguuuuaaaucugaauucugcuugcucuguuccuuuugugucuuuucauaggucucugaaaagaugagaggucucugcaaaauuuucucauaaauacagccaauuaauuuauuccauaagcaccuaagccaauaagccuuuuucauggaaagucccagagguagcuuugcagguuuagaauaccauagacaugaguggaauuuuuuaaauggcacagaauugguuccgcaugauccccaaaagaauucacucccacaaagaggcuaagauagcagaagacucuuguugccauagacagugaaggaugguguguauguauggugucucuaguaucacacaaauuuguggggggcauuggucacagacccauuacuccaugacaccaggacgcccaccuggaauuggacuuauaauuuuuuuuuuuuuuuuugagauggggucucacucugucauccaggcuggagugcaauggcacagucucggcucacugcagcucugccucgcagacucauccagucuucccaacuuagcuaguaccacagguguacaccaccacacccagcuaauuuuauuuuuguguguguggguuuuuuuuuuuugguagagauggaguuucaccauauugaccaugcuggucucgaacugcugaacucaaacaaucugccugccucggccucccaaagugcugggauuacaggggugagccacugcacccggccuggacuuguaauucuuuauaguugcuuuacuuuuugaaaaaauguuaauaucuuuaaucuguuugaaagguuuugcuaacuguaguggcaaauccuucuaccuauucuuuuucaaaauuucuuggauuuucucacaugugcucuuucaaauauauauuuaagcugagucuaaagcuccauaaaguucaaggcugcagugagcuaugauugugccacugcacucuagccugagcucagaaugagaucuugucucuaaaaaaauaaaaauguaagcucuguaaauauucuuggaauuuuuguuggaauugccuuagaacuguggauuguuugaggggaaacugaaauguuuacuguugacuauucccauccagaaauggguauuucuauccauauauuuaggacuucuuuaugucuguuaguuucuguguugguguauuccuagguauuuuauaauuuguauuaguauuguaaauagaaucuuuuauccuauuacauaucuuaacuuauuauugcugauauaaucagccacuuugcugaagucuucuuauuaguucuaguauuuuuuucaguugauugucucagauuuucuagguggcaguuauaucaucugcagcuuuagaccuucguuguaaaugggcccaaaauaaugcugcuuuuuuauucuaagaaaaacaauucaguggagucaugaagugaaaaguauagcaaaaaauuacucuuuaagggcaggugcaguggcucacgccuguaaucccaacacuuugggaggccgaggugggcggaucacaaggucaggaguucgagaccagccuggccaacauggugaaacccugucucuacuaaagauacaaaaaaucagcuggguaugguggcgcacaccuguaaucccagcuacucgggaggcuggggcaggagaaucacuugaaaccgggaggcagagguuguagcgagccaagaucgugccauugcacuccagccugggcaacuggguaagacucuaucucaaaaaaaaaaaaaaaaaaaaaaaaaaaacaccuuuaaauuugcuucaauacuuauuauaaaauaauaagcauaaauauacagaauaauaguaauaaagaguguauaugcaaaauuguaauuuuaugguauuuugaacuuaaagcaucaagaugguagcauaaauuaauuucuaaaaagaaaccugaacacuuacuuuucaucaugguuauuucugcuacacuauuacggcuaugauaaaaauccagcaaugaaaaaggaugaggauaaugauguagcaccugcuuaaugaauaagaccauucagaugagcaaaauacauaauuucaauauguuguguuaccuuuccccugaaaaggccaucaggaauuuguuagaguuugaugccuccccaguaguuagccuugguaacugaggaaguaauuggcuuguguuugacucaaaaaguuuguguaggcucagcuacugguuauuuuucugucuuacugucuuuugaacagcucagauauuucuuaaaagggucucaaaucuccuacgugugauuuuguaguuuuguucuacugacagaacauauucagaaauuaaaucauuuuuuuaacaauacauugaagauuuucuacugcugccuuuuccucuuacucuuucugcucuucccauuuucuacauucuuugucaguguuuucuuaaggcccacaauuaauucuuaaauuucuucuuugaagcugugaacaaaaccaucccuacuaucuuggccuggcuaccuguacaguguuuuccacuuuuuugacaaagaacaggaaaccuuuuaaaucauucagacauucuuuucauuuauguccuucaugcuuuaauuauuuacaguuuaauuacaucuaugacuauuuaauaugagugaaacauucuuggcaauguugaaggucuucuaacccugacugcgucauauuuaauaucaggcuuaccauccauacauggauguguugaugaaacucuaagccucauacaaguggucuugaaacaucaaaucacacuugauuucaaagguugauggauggaagugguaugggaggcagaaaacaacuucagcaaaguuacuugcaaacuggaguguuucaguguccaggaauaaaugaucaagcaacacauuuaaaacaucccuuuuuggccgggcgcgguggcccacgccuguaaucucagcacuuugggaggccgaggcagguggaucaccugaggucaggaguucaagaccagccuggccaacauggugaaacccugucucuacaaaaauacagaaaaaaaauuagcugggcaugauggcggguuccuguaaucccagcuacucagaaggcuaaggcaggagaauagcuugaauccgggaggcagagguugcagugagccgugaucgcgccguugcacuccagccugggugacagaaagagacuccaucucaaaaaaaaaaaucccuauuuuggccgggaacgguggcucacgccuguaaucccagcacuuugggaggccgaggcaggcagaucacaaggucaggagaucgagaccauccuggacaacacagugaaaccccuuauauacuaaaaauaaaaauacaaaaaaauuagcugggcgugguggcgggcgccuguagucccagcuacucgggaggcugaggcaggagaauggcgugaacccgggagguggagcuugcagugagcugagaucaugccacugcacuccagccugggcaacagagcgagacuccaucucaaaaaaaaaaaaaaaauuuuuuugaaaugccucugaauuguucaguuuaaaaugguuacuuuuaugauauaugagcuucaaaaaaaaaaaaaauccuuauguaaaugguuuugcugccccuucacacauaucauggauuucuccacaaauagaaauccauuuuaaaaaacuucacagcauaauaauuacaaugauuuguaauguuuaaagaaauaaauaagcauuucaaauucugauuuuuggugagauaauugguaaguagaagacuauuaucacuaaauauuuuagauuuaauguauaguuuucucuuuaaaaauguccauguuuaugauggaugcaauuauuuuauacauuauuuuauauaaaguaauuacaauuacuuuauauguuuucuagccaauuuauaugauuuguuuauauuaaauaacagguuuucuaagacaaaaaauucuaguacguuaaauuuaaacauuaaacauaguccauuaaaauucuaggucuagauuaagaaucaggauaguuuuucuuccucugugucucugcuuucuuauuauuuacuuuuccaccuucaagcuaaacucucacucauuaaaauggaacucacuuugcuauuuacuauguuaccucuuaauguguuucuguuacaagugggagaugcauaccuugccacacuugugugacuagaaagagguuaaauguuuuuugcagugucugauacauaguaggugguacuuaaagaguagcagugauuauuucccaagaacauaagaguguuaucagaaaaaguaaguuuucaccuucgccucuuguuaccuuuuuaaaacuguugcagccuguggaaacauaaauguguuuugaaaacugauacccgauggacaugaaggccuauaauaugauucucuucagugguuuauuugcuuuguuuuucucaggugaaagaaaagauguugucccgguuaagaguaguuuccaccacuuguacuuuggcaugucgacauuugcacauaaaagaaaaaggcaagccacuuaugcugaacccaagaacaaacaagguuaguaacauuaauaucaauguacauuuucucucuucuuauuaaaguuugauauauuuaagacugauaaggugugacauauuuuuguagcuuuaugcuaagguuguucagagauaguuguuuacaugaaauuuucacgcuucuccacauggcaaaaucgugguugcuuuauaccuccucaauuucauccucaugacuuuuaccaccagaaaaggauugacuuugauuccuaguucuagcuuuaaaaaauaaaaaauaaaaaaucccagaauagugcuuuggccaggacuuugggccacaugugagauauuuacauuuccccagcucauaucagguacucacccugagcuaaucaguuaggcccuuggaaaguagggucaaaauugugaaaugaaccuuuauguaaaguccacaucaccccaccuccacuuaucuuuuuggacacaaaccauugcacacaaaaaauugugcccauuaauuagaaugauuagaugacugcuucaaaauagagagacuccuggcucuuuauuguacucuugugacaaaagugacgugcaauauugagauccagucauuacuucauccuucaucuauguuugguucgguggacaagugccugccuguuuuuuaguggcaauauuaaauaguaaguaaaaguucugggaagagauuuuuuuuacaagaagauugcaagaggauacauugaguuuauugcaauauaugaaauuuaccuuuuggggaaagguaaauucaaaugaaaagugugacuuauuuuaaaagaacagucauaaaaaacuugccagucccguuuguuucccacuaucagggaaaauaguuaauuguuaauuguuauccuaugauaaguuuugagggguuucaggccuacaaaggggaauuugaccaugggucacacagagcaccucaccuuuguauucuugguacaugacacagaaugaguucagcaagcaguuaguguguuaaaugaagcuuaaugaaggauauucugaucuucucuuguuugugccugaccucuccaaaucucauuugcucuuuaagaugcaccucauuucaaauccaguucuccuguagaaccuuuuuacaccaccauggacuggaguaauuacucccuucucugaaaccccauagcaguuucuuccuguuccuguggcaaguaaucaauagguguugcuuugugcuucuuuucaugguuuaagcuguuauugaagucauugaugguaguuacauuuuccugaguuuauaucuucuugacuauauuucggguuccuuuugggcagggaccauucaaauacuucuguguaucuuuuacagugcuaugggcgcauuugauaaauauauugguuuuauauuuuauacuuauggaaauaauuuauuuaaaaccuacucuggggacuuagagauuauaagaaauuuauaaaguacauugagugucaaacaaguuugcagauggagcauagucuaagugcauuaccauacuucccuaaagaaaauaaugucggccaggcacaguggcucacuccuguaaucccagcaccuugggaggcugaggcaggcggaucaccugaggucaggaguucaagaccagccugaccaacauggagaaacuucgucucuacuaaaaauacaaaauuaggccggacaugguggcuuaugccuguaaucccagcacuuugggaggcugaggugggcggaucaccugagguugggaguucgagaccagccugaccaacacggagaaaccccaucucuacuaaaaauacauaauuagcugagugugguggagcaugccuauaaacccagcuacuugggaggcugaggcaggagaaucguuugaacccggaaguggagagugcggugagccgagaucgugccauugcaugccauccugggcaagaagagcgaaacuccaucucaaaaaaaaaaagaaaaagaaaaagaaaaaaaagaaugucuaacauucuggccuucugaaaucccuaagauugaauagcaucuauauggucacaucauugaaggaccacuucuggaaaccccuuaaacaucaggaagaguuuauuuuuguuuaaagaacauagaccagugauucccaauucauggguuauagacuccucaggaacuuaccauguaaagaaaucucauuugugcuucaaauauuguauacuuaauaacuuuucacauuuuuguaaauauuaucuuuaaggauauguugcugcuguaauuaauaaaauaguaauuaaaggcaguauugaauucugaaucuucuuaaauguaugucuguaaucacuguauacucaagguauaccugcucuuuguuuauaaaacuuuuuuauugugguaaaggaagcauaauauaaaauugacaauuuuaacuauuuaaaaguauacaauucagugacauuaaauuuauuuaguguugugcaaccaucaccacuaucuaguuccagaacuuuuuuauuaucccaaguagaaaccuaguauuauuucauuuuauuuuauuuuuuugagacagguucucacucuguugcccaggcuggagugcaaugacacuaucauggcuuacugcagccuugaccuccccgggcucaggugauuuucccaucucaccuucccgaguagcugagacuacaggcacgugccacuacaccuggcuacuuuuuguauuuuuuuguagagaugaggucuugccauguugucuaugcugguuuugaacuccugggcucaggugauccgccugccuuggccuccuaaacuguugggauuacaggcaugagccaccacaccuggccaaaauuucuuacacuuuaaaaggugggacaccauuaugcuagguuauaagcaggaguuuaggugcuaauuugggcuuuaccauuuacuagccaugaaacuuuggcaaacccuucaacuucucuaggccuuaguuuucuucauguaaauaauauagguaauagcauuuggaaacauuuaaagggcuauacaaguauaaaauuggauuucuccuuuucuccccaugcucauuuggcuaacuuuucucauaauuuucugaaauucagcucugcauccuuucccacacagcagaaggugagcagugguugagcaagugaaucuucaucuguauuuacagccacuccucauggcuugcauuaccgccugugcucugccuccugucagaggagugcaaacccuauugugaacugcgcaugcaagggaucuagguugcacacuaauuaugagaaucuaaugccugaugaucugagguggcacaguuucauccugaaaccauucccuacccccugaaauagagucaacaagauaaaaacucaugaaaauguaacuaucaucaaugacuucaauaacaacuaagacaugaaaagaaaaauugucuucagcuggcugugguggcucacaccuguagucccagcacuuugggaggcugagguggauugcuuggggucaagaguuugagaccagccuggccuggucucuaccagccugaacucgucucuaccaaaaauauaaaaaaauuagccaagcacuguggugcaugccuauaguuucagcuacucaggaggcugaggugggaggaucacuugagcccaggagguggagguugcagugagaucgugccacugcacugcagcuuggguggcagagugagccccugucucaaaaaaaauugucuuccaugaaacuggucacuggugccaaagaggauggggaccacugcucuaggaaguuuucagugacccuuuuuccuaauuccucaccacacugggugaguuacuccccuguccuuugagcauucuugugcucacuucugucaauaccauguaucauacucaguuggaauuaucucauuccuccauugaggacaaugaccauaucuuagucuguauccucauuaucuuaccccacaguacuuagcacacacagagccucaguacaugcuggguagauggaugaaugcauaaacagaugagcaaauaggaaaacaaaaucugacaugauuggugcucggaguuucacagauaauuaaacauagguuuuguuuccagaaaauaaguuuggauuagauaggaguuuuguuaccuacucuuguaaaacaaguuaggaaauaccccuauucacaccucuuuuccccauguacugauuuauguguuuucuuaucauuuuuugagcaagugaagcuucaucuguauuuacagccacuccucauggcuugcauuacaaagcccauuucaucuuacaaagucuuaaaaauugagugaugcaguuuuuuuuuuuaaauaagaauagggggaggaagaaggaaaaaaguaagaauaauuuuauuuauuuauuuauuuauuuauuuauuuauuuauuuauugagauggagucucgcucuguugcccaggcuggagugcaguggcgugaucucggcucacugcaagcucugccuucuggguucaugccaugcuccugccucagccucccuaguagcugggaguacaggcgccugccaccaugcucagcuaauuuuuuguauuuuuaguagagaugguguuucacuguggucgcgaucugcugaccucgugaucugcccaccucagccucccaaagugcugggauuacaggcgugagccacuacgcccagccaagaacaauuuuaaauuacauuaaaaaguuuucaguugagugauaugauuuggcucugcaucaccacccaaaucucaucuugaauuuuaauaauuaccacgugucaaagguaggaccagguggagguaacugaaucgugggggugguuucccccaugcuguucuugugauagugagugaguucucacaagaucugguggcuuuauaagggacuucccccuucgcucagcacucauucucucuccugccacccuggguagaggggccuucuaccauaauuguaaguuuccugaggucuccccagccauguggaacugugagucaguuaaaccucuuuucuuauaaauuacucagucuugguauuucgucauagcagcaugagaaugggcuaauacaaugaguauauuuuauuucaaauuuauguauuaacaccuaauuucuguaccaaaacaacauaagccauagaacaugugaugugaauaauuguggauuugugaugaacagagcuugccacuuaguuauaauuugcccuuuuagugcaauuucaucucaauuaacacauuuucagaagucuaaacaagcauuugagugcuagugaggcacuggcuacauagcgccuauccguauugagguuaagggaaugcauuuuaucuccugcuuauaaauguguguaaauggauucuaucuccugaaucguuugccuucuaucuuacauuucucauuacaaacguaaaucaguauuaaagagucugauuuguauuaaagaguuguuuuagucuuagauuauuucuguuacucucaggauaugucuuauauuagauuguacaaggcuuaaagauacagauaaaaugugcuuuaaaguaugaaaugaguaccagaaaauaaauauuugguugaaucagagagaugagaaaauauauaacaaaugaauuggcuauucauuuuuaguguggauuuaaagcuuuuagagguagauauaagugauacuuucuuuuacacuguaauaaugcuuccauaggguagagugcucaaacaagaaauuugggaaggauucaggcugaggucuauuaugauuacaacaguaaaaguguacaauuguuugauuacaaggugagccaacucuaaacuauguacauagccuccgacccucaauuuuguuuuucacuuuuguucuuccugccucuguguuggcugccuuagcaagagagaugccaacauuuuuauugaugacccagugggcuaaagguauaggaguccuucugaaauuuuuuuaaaaaaacaccugaacacuauugauauaaccuaguaauucucaaguaacuccugcuaucuacguuuuuuucuuuuucuaguuccucccguaauacuacuaaacaucucuuuuaaaccaaguauucuuuucaagauguaagauugugaagagauuuuacuacagauucuuaauuuauuucagccaaauucaaauauccuaauggacucuauuuagaauaaugaaccauagauugccagaacuaaaagagcuaaguacauaguaaauaccuaugcaaaccauuaacuuaauucgagaaggaguguuaaagaagagaaucaauaacuccuuuauuuuguagauuccaucccuaagauuuaaggacaugcucaagcuuuguaucuggaacucugguuuucugguuauuaguucucugaggguuuuguuaauuuauuuguuuauauuuuaacuucucccggcuaguucuuuaauaaauuuagaauuuucuucugguuauuuacacaaauaauaugacuaauaaaagauuuaaaaaucacauugcuauuauucuaucaccuuuuuuggugagacagagauuuacucuuguugcccaggcuggagugcaauagugcgauuuuggcucaccacauccuccgcucccagguucaagcgauucuccugccucagcaucccaaguagcugggauuacaggcaugugccaccacgccuggcuaauuuuguauuuuugguagagacgggguuucagcguguuguccaggcugaucucgaacuccugaccucaggugauccacucgccucagccucccaaagugcugggauuacaggcgugagccacugugccuggccucuaucaucuauuuuuauuuggccaugauucucuuaaaaguauacuuacuuuuaagauuauaacauauacuuuuauaugcaauuuuaccacugggaaaaguauacuauaaauauaucucuaaaauguuugauaagcuguauaauaaauauaugggugcauaauaguguaguagccuuuggauuuggaauuccaguggcugaugagacucccagcuuugcaccuuuacuggcccccuagcauguuuaccugaauguucaagugucuguuuaagagauuugugucaauauugacucguggagaaacugcaugugccuaaaguaaaauaguucagggucuuucaggaucagcuggaggaaguacaccucugcuauguaaauugggagggagggaauugcuguugcauagaugagaaaaagggagacuugggaaaaguggcaaagggagauggagaaaguaggagaagaguagauaagaggaugaucauuucugcuuaauacuaaacuaaccaggccauucauuuuaaacuaaugucaucaucacaggcuugcuucacuuauuaacaccagccuagcaaauuuaagaacuuaaucaacuguuaacauaaauaucuauacauaaaauuauuuaaucauuuuauuuuuuacucugcauuauaaauaaaucacuuuugagugucccuuaaaucuaaauaggaaauaggcagugcagccuuguguagucaacuccauuuaucuuuggcaauaaggauaggcaaagcguacuuuuuuuuuugagacaggaucuuacuuugucacccaggcagaaguauaguggcacagucauggcucccugcagccucgaccuuccaggcuuaggagauccucccaccucagccucugaguaccugguacuacaggcaugugccaccacaccuggcuaauuuuuguauuuuuguagagaugagguuucaccaugcugcccuagcuggucucaaacuccugggcucaagcaaucuauccgugcuggcaucccaaaaugcuuggauuacaggcaugaaccacugugccuggcccaaagcacuucuaaaugaacugcauaguucauuuaaacauacguuuuagccuuuuccuuuacccuuuugcuagaguuggaaaaaaagacgcaagagugacaguuuugguuuuaccuucuuuguauuucccagccuucaauaaaaucauacaaggagaaacaugagacacauguuuauuauugucuagcgucuccuccauuauugaaaguggguauuaaagucuccaacuuguugaauugucuuucuucaauucuguuagcucugcuucauguauucuggaccucuguuguuagguaugucuauauuuauaauaguuauaucuucauaauagauucacccuuucaucauuguaaaauguccucuguaguagcagcauucauuuuaaagucuguuuugucuauuguuaguauagccacucuagcucucuuuugguuacaauuugugugguauaucuuuuuccauccuuuuacuuuccacuuauuugugucccuuacagacagcauauaauuggauuauguuuucuuucuucuguuuuuuuuuuuuuuucugggacagagucucacucugucagccaggcuggagugcaguggugcaaucucggcucacugcaaccuccaccuccuggguugaagcuauucuccugccucagcuucccaaguagcugggacuacaggcacccaccaccacaccuggcuuauuuuuuuuuuguauuuuuaguagagaugggguuucaccauauuggccaggcuggucucagaacuccugaccuugugauccgccugccuccgccucccacaguguugggauuacaggcgugagccaccacgcccagccuaauuuuauauuuuuaguagagaugaaguuucuccauguuggucaggcuggucucaaacuccugaccucaggugauccaccugcuucagccucccaaagugcugggauuacaggcaugagccacugcgccuggccgacauuauuucuuuagagaaguaugguaaugcauuuagacuaugcuccaucugcaaacuuguuuuucucuuugucuagguguagaucucuuuugaguuuauaauacuuggaguuguugagcuuacuggauguguggauuaauguuucucauauuugggaaguuuuggggcauuaucucuugaaauauuauucugcuucuuucucuccucuccucaaacuucauuaugcauauguuggcauacuugauggugucuuacagaucucugagauucuguucaucuuuuuuuugagacggaaucucccucugucaccaggcuggagugcgguggcacgaucuuggcucacugcagccuccgccucccggguucaagcaauucuccugccucagccucucgaguagcugggacuacaggcacaugccaccacacucagcuaauuuuuguauuuuuaguagagaugggguuuuaccauguuggccaggauggucuugaucuuuugaccucaugaaccacccaccuaaggcucccaaagugcugggauuagaggcgugagccaccgcaccuggcaguucauauuucuuuauucuuuuuucuuucuaucuuagacuagauaaucuugggugaccuauuuuuaaguuugcugauucuuucccacuugcucaaaucuacuguugaaccccucugguaaauuuuucauuuucauuuauuguacuguugaugaaaagauuaaaacucuguaaaauauuugaagagauuuauucugagccaaauaugagugaccauggccugugaaacaaccccaggagauccugaaaauauguaccccagguugugggggcacagcuugguuuuguacauuuuagagacacaugagacaucaaauacauuuaagauacacauugguucaguccagaaaggugggacaacucgaagugggggcuuccagguuauaggcagguuuaaauuuuuucuuauuggcaguugguugaguuauuaucaauagaaauaaaugucuggauuaugauaggaggcuuuggagaccagaguuucuucaugcagaugaagccuccagguaacaggcuucagagagaauagauuguaaauguuucuuaucaggcuuaaggucuguguugauguuaaugcuggaggaguauagugaggcauguccgaccccccaugccaucauaaccuaaaccagccuuuucagguuaaauguuaagagugcccuggccaaggaggaaguccauucaggugguugggagaccuuagaauuuuauuuuugguuugcaguacuuucauucccagaauuuccauuuaauuucuuuguugguagucucaauuuggugggacauuauucucauacuuuccuuuaguucuuuagacauggugucuuuuaagucuuugaauguauucaaagaugugaauguaaagucuuuaucuaguaaguacaauguuuaggcuuccucaaggacaguuucaugauuuuuuguugaaaacuggacauuuuaaauaagguagcaguucaggaaaucaaauacuccucccaggguuuguuguauugcugcuacuuuugcuuguuuagugauauuuccaaacuaauucuuuucuuuuuuugagauggaguauugcucuuuugccuaggcuggaguacaggggcaugaucuuggcucacugcaacuuccaccucccagguucaagugauucuccugucucagccccccgaguagcugggaccacaggcacaugccaccacgcccggcuaauuuuuguacuuuuaguagagacaggguuucaccauguuggccaagcuggucucgaauuccugaccucaggugauccgcccaccuuggccucccaaagugcugggauuacaggcaugagccaccgugccuggccuccaaacuauucuuuauaaagucuguauucuuguacaugcccacugaagucucugauugguuaguuuuguggucagcugauaauuagacaaagacuuaaaugcuuggaacuaguaaauuucccauuuuuugccaaguggcucugugugcauguugcggcauaccuccagcacugaaccaggcaguuuacaacuacccagaagccuucacuuccuucuugcacagagccuuaagguuagccagaggugugagcuaggaucuuuucaggucuuuccuggauguguccacagcucauguaugugaccuucuagagucccgguaauaccucauggcuuuugaaagcuccaaccccauggucaucucauucuuuagcuuuuccuugugagcuuuuuguuacccuguuguuuuucucaacuguuauccacugcuuugggcagcugcuaugcuaaauuauugccucugauuguuuccaacaagcacuucuggggaaauggcuuuucagauggggugagcgccaaguuaggucaaaugaagauagccuugcaaguggggucuuccagggaaccaccagacaggucaaauaaugacauuuuccuggaauagggcuuagaagaaucuccagccccuucuuccugcccugguggcuuccaggcugcugauuuucauaguaauugugagguguuaguuuucgauuuaaaacucacaaagcuuguugcuuacugaaauccagccauuuuuccugaauaacugcucccugauugcugcauuucuuugguaaauuuccagaauguugaagaaguugcuucugguuauuuguccaguguucuuguugcuuuuauggaggaaaagauuuuccaaaggccuugcuccagcauuuucauugacauugcuuugauacgaagaauuuaacccauagucaaaugccagaaauugaaaaagauuuucuuaugacauagauuaauuuuuucuuaagcaucauuucuucuauccccuuuuaaugguauuucaugguaugaauauaccauaggaugcuuaacucuuucguaguuaaugggcuuuuuguuagcuuguaauauccaagagaacuagaaacaaugcuacaacuaaacuuuuuguauaugccuuugugugccauuaagaauguuucucuagaauggcucccuggaagucagauugcuugaugaauaauauguauauaaaaaauuuaagaauacuuuaaaacugucuuccaaaggccuaaacuaguuuauauucccagcagugguuugugagaauaacuauuuuccacacccugaccaauacugacaucagucuuacaaaguuuugaaagccugggcaaaaauaauaugucauugauuuuucaaauuugcauuuaaauuauauuuugaagaacaaugucauugcuaccccaguaaguaauaauuuuuaauccuuuuauuucuccucuuuagggaauggcauuuacuuuacaagaacgacaaaugcuuggucuucaaggacuucuaccucccaaaauagagacacaagauauucaagccuuacgauuucauagaaacuugaagaaaaugacuagcccuuuggaaaaguaagaguugcuuagauguuucuuuuuuuauugguauucugauuagaaaacuuaugagcauuaugguuauuauggcaugagaaauacacaaucuuauauaaguuuguguuuugucaguuaacuacuuuuauaaagauuguguuucuuucacuucggugaauacuucacaaguauucacuauuguaaaacuuaacaaauuaguuuuuaugcuuacagucagagcaauucagguuugaauggaauauuagaagcaaaggauaccaucuaauuugcacucauuuuauucaaaaacuuuuauugaucaccugcuuuguguuugacacuguaccagccacugaggcuauaaaguggguaauagauaggaugaccauauauuauaucaccuaaucuaggauacuuuggagaauaaaaaagagguguacccaaagcuaccccuggcaaacuuuuuuuguuucuuuuuuugagauggagucucgcucuguugcccaggcuggagugcaguggugcgaucucagcuuacugcagucuccgccucccaaguucaagcaguucuccugcuucagccuccugaguaguugggauuacaggcgcccaccaccaugccuggcuaauuuuuuuauuuguaguagagauggaguuucaccauguuggccaggcuggugucaaauuccugaccucaggugauccgcccgccucagccucccaaagugcugggauuauaggcaugagccacugcgccuggacuuuuucuuuucuuuucuuuuuuuuuuuuuuugagacagggucucacucuguugcccaggcuggagugcaguggcacaauuucagcucacugcaaccucugccucccgggcucaagcaguucuccuaccucagccucucaaguagcugggauuacaggagugcaccaccacacccggcuaauuuuuguaguuuuuaguagagacaggguuuaaccauauugcccauauugcccaggcugguuuugaacuccuggacucaagcaaucugcccgccuuggccucccaaagugcugggauuacaggcuugagccacugcaccaggcagcaaacuuaauauauaugaccaacccaguaacucauagcccugucuucuaaaagucaucaacagacaguuaugcuaugauuguuauuggucucuagaccacaauguacaguacaaugagaaaaagguacaagcagauauauucugagagcaugcagagggcaucuagcucaacuuggggaaucagauaaaagcuuccugaagggagugaugccuaagcugaauuguaaacaggauguuacagguagcaggcaaaguauucuggguagagggaucggucugcauauagaacuaagcauaucaauugaguuuguuaaguauaggagauuauuggugacugguaagagugguuucuuugaugugauagagcaaaagagauacugugauagauugaaaaaugaauggagggggaggaaauguaaacuacccuuacaagaaguucagguaaggagggaaggaagauauuaaauaauaaguaaaguaagacuugggauuaaguauguuucaagcuggaagaaaauuuaauguuucaucguaguuaggaggaaugagcccaggagaaaggauaauuguuagagcaaggucuagggaaaggaaaaaggcauagggucaaaugcggagauagaguggcuggucuugagcaagaacaaagaacagcucauucuccgaagcuggaauaaacauaaauacagauaguaaggauaaguauggagauguuugagcagaaguagugaacucucaaucuuaacugaugaucuugcuuucuuuuaugacauagaauaugaaagucaucgcucagauuuagaagggccaggguugaguagaguuggugaggagagugagaaaugcuuggaagagccauguggcuauaagauaaagcugaacaaaagcuaggcuugguggcucaugccuguaaucccagcauuuugggaggucaaggugggaggaucacuugagcccaggaguuccagaccagccugggcaacagagugggacccuguuucuacaaaaaaaaaaaaaaaaaaaaaaaagccaggcauggugucgcauaccuauaguugcagcagcucagaagacugacgcaggaggauaacuuaagcccaggaggucaaggcugcagugagccaugauugcaccacugcacuccagccugggugacagagugagacccugucucagaaaaaaaaaaaaaaaaagaaaaaggcuaaacaagagcagguuaaaggggugagagcagacccugauggccugguggcaagaucuuguuuguauuggugccauucugcacagcaauguuauuuuuccauagaaaaaaugaaauguaacacugauucaggcuuggaguuugcugggcuggcaaaggcagguguuacauaaauucauucaguuaauauucaggacugcuaaugugccuggcauuguucuaagcuuugaaacuccacaaaugaaaacacucagcccuucucuucagagaguucacuaucucugguggaaaggcagacacuguggaaggguaguacagugauaaaucauguggggauuccuaaacaguaaugacagggagagauuugcucagagugagagauuugauccugggauucagagcaggaaauaaagaggauccugaagggagcccauagaauuggaagaaaaugaagcagucaaagagcuagagaucccucugaaggaugacgaagugagggcaucauauggcuacccaaaaugguagaggauugugauccaagaguggauaagggcauucaccauugcugagcuauaaugauccuaggugagugcugcccaucacugaggcacacagaagacugacuaaagugaaauaaggauugaaagugguaacauugaggagauccaugacuuguagagcuucccucuaucacaugccucauaggucaucuguucuuuccuuaacauuacuuccaucucacaaagccauccauuccauuuuagcagcccaguuuguuuacuucccuauacugcagagaagucuucuucccuuuaauuucuaucuguugauaccauuucuuccacuauuagcuauguagaaaauaaaauugaagggaucacgucuccucauuuauucaccaaauauuugcacaccaguuauaugccacauauugcuauuaauaguuccuggaacuauagaaguauaugaggugaucauuucuaacuuaugguauugucuagacuggaggaagccagaaagucaaggaguggagugagaguuaacagagggaaguaggcuaucaugggaccugaaaacaggaaagucuaaagcguguauguauacaugauaggggaggggaguggacagaaaagggcccccagagagcacgccaccugagcugcauuuggagcgcacauguauaggacuauaccuggagagagugcaggcaaauggugcaucaaacgcagcaaguccagguugaguugugaugcauuugaggagcugaaguaagucaacaugaagaagaugaggcugaaaaguaggcagagguuuuguuaacuauuuuaggagcuugagccuuauuuuacgaugauuuauuuggaagcgacuuaaggagaacagaaaugaucacaguuagguuuuuaagagaagaaugaauuggagcguaggaggaaauuguauuuauaaagacugguaagaaggcuuuugagguaaaucagcugagaaaugaugguagcuuguacugugcaaggguggagggagcuaauggauauauuugaaagcuacuuagcagguagacucuguaggacuuggugauuuauaggauugguguuggggaggguaggagaggaauaaaucaagaauggaaucuggguuucgcauuuggucacgugauagcagaagaaacaaggucaggggaaagauaagucugcuuuagacauauuuaauucaagaugauuacugacuuucaagcuuucaagcugauauuucccuguucucuaaauuuaaaaacaaguuauuuauauauuuauugacaucaauugacaauugccuuuuuugugcugcuucugcacucuguguagaccuuauaauacuucuaacgcuccuggguuauaaacuccuugaaaauagagguaacuucuuauaucccuggagaauagugccaggcauauaguguuaagcaaauguuugaauuaaugccacuuuauuuugcuuccuuguuuauaugucagucuccuugaagacugauucuuuaagcguaaggaccucauggugaucuuugcauuuccagugccuucuacagagccugacccacaguuaggguucaguaaacauuguuucuauuguuauuucaucgucaucaucaucuacuauuuaaguacccucauauuuuuguuaauuuuuaguccuggguguuaaauaguaauaaucuaagguuuuggguuuuuuuuagaaugugaugugagaauggggcucaauuucaauuuuagacauuuagguuuaacuuucauaagccaagacuuuuaauguaaugcaggcugacuuagacauuauuuacugugcuucauuucagauauaucuacauaaugggaauacaagaaagaaaugagaaauuguuuuauagaauacugcaagaugacauugagaguuuaaugccaauuguauauacaccgacgguuggucuugccugcucccaguauggacacaucuuuagaagaccuaaguaaggcuuguuuaaaaaaaagcuuguaaaugauuauugaauaaggaaaauaucauuccauaacacccauuacauuucuauuuuauguuuguuagccaaaucacauuucccaccucagaaaaacguaauuuugauuaaaagagauuaacaaaaucccaacauauucauaacuuuuaucuuuguaaaaauagcauaauucauuucuaaucuucuuuaaauuauugugauuguuagaggaauuacauacauacuucuggaaccugcucccccaccaaaaaaagucuuaauucuggugggagauuauccagaauuaucauuaaaauuuuugucaauaaagucaaauuaagagauuuuuuuuucucauuuuuuaaucaguuuuaauuuguuuuuguuuuugagacagagucucacuuugucacccaggcuggaguggagugcagcaguaugaucuuggcucacugcaaccucugccucccagguucaaguaauucuugugccucaaccucccuaguagcuggaauuacaggugcacgccaccaugccugcuaauuuuuguauuuuuaguagagaugggauuucaccauguuggcugggcuggucuugaacuccugacuccaagugaucagccugccucagccucccaaagugcugggauuuacaggcgugagccacugcaucuggccuguucuccuuuuuuuaaugaauuuucauuccaaauaguuguagcaccuacaaacauuauaagugggaagaguacugaaauggcaaggacugacucaaguucuugaaugagucgcgugauccccaugaauguguuuccucauguguaaaaugggaauagcaggaccuaucaaagagcuauuggagaaaccaaugugacaguucuuuggaaaauuaucagcaauauuauacacacacacacacacacacacacacacacauaugcuguuuucacuuaaucugaguuuucuuauuccucuaauccauuauuauuuuucucaauccuuauaauauuuuccccaugcccaauuaacacauucuuccacguguagaaauucagucuccugucgccuugucuaguggcuuucaaacuuuaauguguguaagaaauaccugugggacuuacucaaaauguugaucucugccaacuuuccucuccuccccauccccaagauuucugaugaaaaagaaaaaaggucuggagguccggauuuuagugagcacccucagugauuguguugcagguguucccuggaagacacugagaaacagacuguucuaaccuagaugcugccaacaauuacuguaacuaaaacauuucugugacauaaccaugcuguucagcuauuuuauaguuucuuauuagaaugauuaaaagauagagagaaacuuagaaauacugaugccugagccccacccccagagauucagauucaguuagucuagacuuaggaguuucacaaaagagccugguguaauucugauguauacccagaguugagaacugacuugaaacaugaagagcauggcuuaugugugagggcaaauacuguauauuguuuaugcaaugcauugugcuauggguuuuuuuuguuguucauuuuguuuuuguagauggucauuaaaucuugauugguugguugauugaucuaaacuuuaagcuaauuaaaucagaaucuuuggaggugggacccuggcauuuuaaagcuuaucagaugauuccauuauauagccagauugagaaauugcugaacuaaacugauuugaacuguaauaguagugccaaauuuaagauaccaaugagaaaguuaaaccuaagaucaguuugacagcaaugaggauccacuggcccucaugucugccugaccuguguucuagaaccugcguuucuucuuuuuuuccuccuucucucccuuccuucuuugcuuucucuuuugaaaucuggauugauuaucugaauuagguaacaauauacugugucuaaaaugacuuuuuguuagccauuccacaauuuauacauauuucaaaacauguuguacaugauaaauacaguugacccuugaacaacacaggugugaagguccauuuauacucagauuuuccugugcuucugccaccccugagacaggaagaccaaccccuccuccuccuccuccuccuccuccucuuuaugauuuuguuaauaacauuuucuuuuuucuagauuacuuuauuguaagaauacaguauagaauucauauggcauacaaaauaguguuagucagccaggcacagugacucauaccuuuaauccuaacacuuugggaggcugaagcggguggaucacuugaggucaggaguucgagaccagccuggccaacauggcgaaacccuaucucuacuaaaaauacaaaaacuagccaggcaugguggcgggcauguaaaaucccaucuacucuggaggcugaggcaggagaauugcuugaacccucgguggaggggcagagguugcagcgagccgagaucguaccacuucacugcagcaugggugaaagagcaaaacuccaagucaaaaaagaaaaaaaauuguuagucaaucuguguguuacugguaaggcuucuggucaguaauaggccauuaguaguuaaguuuuuggaaaaucauauguaaauuuuugauuugauuuucuaacacccacauuguucaagggucaacuguauauccaauuuuugccaauuaaaaaauaauauuaaauaaguaaaaguaacuucacuuuuuccugaugcuucaggugucucaucuuuugugugauuuuacuguaauuuucuucucucccuuccugcuccuucaaauuucaaauuuucaguuucaguaagucuuaacaauaguuuaguuggccuuguacugcucuccugcauugguggcuugcuuuagauuuuuuuuuuuuuuccuggugguguauugaguuuauuugaacaugagaugugguuacauuucuucuuggguaaaaugacuguaucauuuaacaauaaucuuuguugcaucugcuaugaacaguaauuacaguuugaaguacuugaaaauguuugaaaauaaaccagugugacuuagcuaaaucugcuuggaaauuauaccaugucuugauauuuuauuaaaauaucaaaauauuucaauuaugaacaaaaacuuagaaacaaagcuguugugaaaugcaaagguguuuuuguucuguugcaggggauuauuuauuucgaucucagacagaggucauguuagaucaauuguggauaacuggccagaaaaucauguuaagguacuaauagcacaacccuccuuuucacaauguuuucucuuuucuuguaaauuaccucuaaaucuccaagaacaguuuuucauuguugcucucauuuauuuugcacuuauauacaugcagauuuagugcuuugcagcugaagugaugauaauaguaguaguuauaaaaugggcuacugguauaaaguuugacucugagaaagaaauuagagcuagaauacaaggugagcccucucgguaucagcaccacuggugucuccugccuucucaaucuccuuuucuauuucacuaauauuauucuagguaaagaaaauacauuaaaaugccauaaaaacuuuuguuuaugaaugguguuagagaaguuugguuaugccuuuuuuucuuuuaaaucuaagauuuagaaccuuagcaaauauaaaaauguuaaauauagcaaauauaagcccuggccuauuuaguuaucuuucauaaaauaaaauguaauaacuuauuucaagaucuuuggguaggcuuuuguaaauuuuauuguaggcaauaaucuuaccugccuuuauacuccuuuccaaaauaaacauugaaugaucguugguuugaauacucuagcaaaaauuuggucaaauaauuaaacucacaguaucaucuuaagaccuuccuuauaaguagguauuuuuuuuguucuagaccuuuuucuuuuucacaguugcuaagguuuuuuuuguuuggccuagguuauuguguuggaguaccaugcuguuuauuucuaaacucuuauuuuucucuuaugguaaucucuccaucagaaucuuguucaucucugccauauuuaaucuuucugaagauauuuaaguugguccucuagucagaagaauucuauuccuaaaccgaagucagagggaaaucaaaucuaguuaaugucucauaauacucagaaguccuagaauuuuaaguaugcuuuguugguuuacauuggaaauuagccaagaaacaauuuuauuuuuaagagcaaagaguaaauauauaugaagugaaucaaucuuuuaaaaaaugcuuuucuuuagugccccauuuuugacaacuuuuaauuugcauuuuuuugugauuaaggcuguuguagugacugauggagagagaauucugggucuuggagaucugggugucuauggaaugggaauuccaguaggaaaacuuuguuuguauacagcuugugcaggaauacggccugauagaugccugccaguguguauugaugugggaacugauaauaucgugaguaacaucauuuucccccuuuaucuuccuccuguauuuuuuaaaauguguacaauauuccuuuuuugaaaaugauaauuuaagaagggaaaguuuuaugauuagauuuuuuuuucuuaaacuccacuuuuaauauuuauauaaauaauaguaaauuaagucuauuaaaaguuucuugguccgggcaugguggcucauaccuguaaucccaggacauuggaaggccgaggcaggcagaucaccaaaagucaggaguucgagaccagccuggccaacauggugaaacccagacucuacuaaaaauacaaaaaaaauuagcugggcgugguggcacaugcuuguaaucccagcuacaaggcugaggcaagagaauugcuugaaugcaaaagacagagguugcagugagccgagaucacaccauugcacuccagccugggugacaagagugagacugucucaaaaaagaaaaaauaaaguuucuuguagggcaauacauuuaaaaaauuguauuaguaauuuuuuauuuugcaauuuuuauuguauguguuuaaacugauuauauaaauuauuuuauuuuuacauuugguuuauuuuguaggcacucuuaaaagacccauuuuacaugggcuuguaccagaaacgagaucgcacacaacaguaugaugaccugauugaugaguuuaugaaagcuauuacugacagguauuuuuuaaaaguuugaguauaugaaagcaccuuuaauggggugggugggguaagaaccaaaguuuuguuuuguuuuccuuuauuucuuuccuguguagauaagcaggaggcgauuaaauuuuugagaacuuuguucugccuggcuguuucugccugauuagaugugccgauaugaggugguacccauggucugccuugcuuucuugaguuaccugacauuuugagggaagucugcccucacugcuuccaucaaacgcuuacugcucaguaccuuuuucagccuugaccuucaggcucacgcccaccauuccacugaagcucuugugcagcuuuuguauuuuaaguucucugaccauuggguccucccacuucucuaccucuuugcaccgucaacucagguuuucccacuucuauguccuugaaacucucucuucucuugacugcuaaacagcuuccuccuaacuuggucuuucucccaccuuucucuuuuuuuuuuuuuuugucaucuucacagguucuugcugucucuuacuaaauguggauaacuaccuaguccucuucucuuucagccaugucaacuaugaccuuuaugcauguuacuacuaaacccauaaaaacccaucuguaguuccacugcucuugugaggccugcauuucuaauaaucagaaucuuccaucuggguauucuguuaugagugcauauucauaucccacacugaacuccuuuccuuuccaaacaaccuaucuucuguauucccagcuucuauuauuggcaguaacauucauccuguugccaaaacuuugaucuuaguguuaucuuugacucuucugccuucuccgucagucagauuucagauauuccucaaauucaguggguacuaccacuuaaaugucuccuguuuuccauugccgcaaucuugcucucuccuuaucucucuucuggaguuuucuaauucuuccuccaguuucucuccucuccaguucgucuccaccuuaauaccagauuaauuguuuugaaacgugugcuucauuuugucauucuuuugcuugaaaucucugauugguuuccuauugccauaggauaaagucaaacucuuuuaccuuaaugaucuaacccuggccuaccuuuaaaauugcuggcacguagaagauauuuaaacauuaauuccuuuucagagucaaagucaacaagucuaaagcugaacuuuacaucuucucagaaauugccaucucuccuucuuccucucacuuuccuaucuuggacaaccaaauaguaccuucuuaguuaccccauuaccuucacauuguaacagcuucuuccucauuucccaguugauccuuaucaauuucuauucauccuaauaguucauaguuacuccuuuugcuuccugcaucuucugcuucagaucucuugucuucguaucauaguagccuccuaguugcuucugccacucccgucuccccacaccaauaugagcuacguaucacuggcagguuuauccuuccuaaagggagucauaugugaauauuuuccuuucucugcagccuucacuguuucuacaugggaugcagaagaaagucccucuucucuaauuuagcauucgagauccucccuuauuugguuccaaccugcauuaaccaauuucucccuuaucucuuaauguaaaccaugaaauauauagccagacuguugaaaauucagggucacccuaauaacagccugcuuuucuuccuagcucuuuacuuuuuguucuuucagggcccaccuccuuuucaagccuucccuuacuacuugagcucaccuagacgauuaacaucuucuuuuucugaaugucagugaacucaaauagcaauuauuuuucaauuucuuauuuaauauauacuuucuuguguugcuguuuaacuauuaauguaaugagaauauacauaucaaauauauauuuuuugagguucagagucaaaggaaguguccuccuggacacuugaaaauaguuuacauagauugauagcccauggguuuaucauugugccacauucuuuuuaaacaccucauacuuuuuuuauugaauaauuucuacauuuuggaucuagucuuucacaggcucugaaauuuuucagauggccuuaauugaacuaacauaauacauuauuuuugaaugcuaucauagggaauauuagguggaaagcuguuuaauaguguuauuuucaacacaacuauuguggguuuugcuguuuuuagauauggccggaacacacucauucaguucgaagacuuuggaaaucauaaugcauucagguucuugagaaaguaccgagaaaaauauuguacuuucaaugaugauauucaagguaaagcaaaaaaacuucaggguuuugauuccuacuuuuuaaacauuuuuaaugugcccauuuuuuauuuguaaaaaucuuuguuuuucuuacagggacagcugcaguagcucuagcaggucuucuugcagcacaaaaaguuauuaguaaaccaaucuccgaacacaaaaucuuauuccuuggagcaggagagguaaguuuugaaggcuuuuugaaacuuaagccuauccucucuuauagaauuagaaaaugggcagaauauugauguuuaugaaagagcauagugagccuguaauuuuguugagguagaggauaugaaaucaagaguucugcuguaaaacauguaauuuaaaauauguuucgagagaauaucacgaagaauuuuuguuugauuuguaagggaaaaauaaaccaaauauuucuuauggcauauaaucuucauauauaaaguaauucaagcauugcaucguacucuaguauauauuaaaauuuauguuuuguugaacaggcugcucuuggaauugcaaaucuuauaguuaugucuaugguagaaaauggccugucagaacaagaggcacaaaagaaaaucuggauguuugacaaguaugguuuauuaguuaagguaagguauuuaaaauuuggagaagcaaaagaguguauuauauuuuuaguuggauuuuuaaaauauuauuccuuaaaaucuuguuucucauuggagucuccaaauuauaccaauugggaccuuccacucucuuuucaacagaugucccuagucuuguugucuuuuacaaagacuucugcuucauauugaauuaauaaucucuauguuggcaucagacuuacucuuucuugcuuuguugucuugcucuuaagagaucaaauggccauuguacaaguaugaucguguuugacacuccuaaaacuagguuuuuaguaggaacugagaacuuccuaauuaaauugcaguauugcaguaguuuugauauuugagcagaaauucuuuuaauuuuauuauuauuuauuuuuuuugagaugaagucucucucugucacccaggcuggagugcaguggugcgaugucaccucgcugcaacuucugccuccuggguucaagcaauucuccugccugagccucccgaggcuaccgugccuggccgugagcagaaauucuuaacccuuuggagaucauaauccccugaagaaaucuaauaaaaaucuguggacccuauccccaggaaaaaagcaugugcuccugaaaccaauuuauggauaauaaagagcuuaucucccagauuaacuuaguaccuuugggccugacuaccuuuguuagcauugauuaccauuuucacuagcuuaagaaugucauauaucuucuguguaacacauugaauauaaguaaacuguuccauaguuaaaccaauccaguacacaaugcuguuauauuuuuguauguacacauuaaaauauaaugguauagcugucgcuuggcauuuaugucuguggagcaagcuaucuaaauguacuuuguuccaguucuaaaaucuuuucuuguuaauuagaaccaguauucuauuaguacaaaaaauaaaaugaaaaguuaaaguaugugaaugaaaaaucuugagugcucaaacuacauguaauuuaaaauguaauaguaguuauauaccagacauuguuauaagacuuuacauguauuaucuccuuuaaucaucucaaaaaauccugugaaguuuuacaaaugaagaaacaguuuaaaaggucgagggaguuuuccaaagucaucagcuuauaagugacggagguaggauucaaaaccaaguauccugacugcgaagccugugcucugaauaauuaaacugugcugccucccaaagaggcuguaacuaccauauuuacuaguauguaaggcacaaggauaaaacaucacauauuuagaaggcuauugggggauguauguuuugacuaguacacaguuaguuugguacuucuuuuuguaauguugguuuucaucaaauauguugugauucuuuagcauauugguaggucaggucuaacacaguauugguagcuacaauguguuuacuuagcacaaagugagaacccuguccaucuccauauucaucaucagauuauauauuucuuuuccagugugcagguagcuuggccuaugggcauuaggcuuccagugucuccuggugauccuaaacacugcccuucauuuugaaacuuugaaaacaguggcuucuuaugucacuguuugcucagccugguuuucucagccgauugaugauaguguccugcuuuacuaaccccugcaguuucuuaucuggaguuaucuuggaguucugauggaaauacacuuuuucagaagucuucuuuuuuaccaaaauaagaauaugaguucucaguugguuuuugcauucaguauguuuuugucugccuuaaaucuuugagaaauucuucauuguucuagucugucagugguaucucuucuggcuuuguggcauuacuacaaauuuaacuuuuaugguuuuugaccugggauuuggaaaggaaagcauguuucuucauucagccaucuuuaaccagaauucccuguuccucuuguuucugaacucuugguagugcaaguccauggugucugucugcaauucugaaauccuaaaggcuuugaaauuccaaaauuuuuuccaaaauuuauuuuugugaccaaucugauugccuugaauuuaccuagaagcgaaaccugacucaaacuaauaagaagcucuuuguaaucuuaaccuuuuguacuugaugugacuauucauaaguuuguucaguuguggaguaucuguugggagggagaauauguaauauuugauauacgccauauuguauuucuaaaauaugaaaaauucucagccaggagugguggcucaugcaugugguggcucagcuucccacuuugggaagcugagguggacggaucacuugagcccaggaguuugagaccagccugggcaagauggcaaaaccccaucucuacaaaaaaaucauccgggcaugguggugugugcccauaguuccagcuacucuggaggcugaggugggaggaucaccugagcccggggagguagaggcugccacugcacucaagucugggcgacagagugauaccccauuucaaaauaaauaaaucaaauuaaauuaaauaugaaaauuucuuaauuccaaaacucaucuaccccagauaaaggacuguaggcuuuugugccacauuggacuuaggaagaccucauaguguaaaugcauuuuugagaggaacuagaaaguuucuaggaauaaugguagauuugauuuuuguuuuauauuugaguuuauggacaugaugaagauagaguuggaagguauggguugaagaggaaaguaaaugaaaaugaaaagacauuucuauuguagaaacaauguguaacucauaaugaugucuuuuuauuucaucuuuaauaugcauugacuaaaaaaauacuguauuuuaucucaaaauuuagggacggaaagcaaaaauagauaguuaucaggaaccauuuacucacucagccccagagagcauaccugauacuuuugaagaugcagugaauauacugaagccuucaacuauaauugguagguaaaguuuuucugauaaauaauuuuacucccuaacuguauguugccagucaucauuaccauguaggauuacuaaaaaugaauuggcaguuuuaccuagcuuucagcauguacaauguuuucugugauaacuuuuugguuaccaugcaugaaauucaguuaccagauguugcuuuauacuuuuagguccuagacacuguguagucgaucaugauuugcuuuuagaguugguaugacuguuggacucaaaacaugaaaaaaaccaaagccauuugcagauuuuaccaggaaaauucuaugcagacucaaaguuuucgugggcaacaaagcugaaaacuuugaguguguuuugaaucaggcauugcauagaugccaucagacuaugucaucauggcauuacauucucagcagaaaauguaaaaguguuuaaaagaggagcuauuuaauuugcuguauagcuguaaguuuuuuuguuuucuuguuuuuuguuuuuuuuuuugagacagagucucacucugucacucaagcuggaguuggcucacugcaacuuccaccucccggguucaagcaauucucuugccccagccucccaaguagcugggauuacagguacccgccaccacgcccagcuaauuuuuguaauuuuaguagagaugggguuucaccauguugaccaggcuggucuugaacuccugaccucaggugauccaccugccucggcgggugagacuccaucucaaaaaauaaauaaauaaaaauaaacaaccccccauuuuccccacuccccacccccuaacaaccaccauucuacuuuuugucucuaugaauuuaacuaccucauauaaauggaaugacaugguauuuuucucuuugugacuggcuaauuuuauuuagcauaaugucaaguuucauccaugugguagcaaguuuuaucuucccaauuagagugaugaagauagucauauacucuuuuuaaaaauugguugggcaugguggcucacaccuguaauuccagcacucugggaggccgaggcaggcggaucaccugaggucaggaguuugagacuagccuggccaacauggcaaaaccccaucucuacuaaaaauacaaaaauuagccgggcgugguggcacacaccuuuaaucccagcuaccugggaaggugaggcacgagaaucacuugaacccaggagggagagguugcagugagcugagauugugccacuacacuccagucugggcgacagagcgagacucugucucaaaaaacaaaaaguuaaaagaauaaaauuucccauaauuuacuauguguauaguagacaauaaauauuuaagugagaacuuucagcaucuuacuguuuuuucuuuucagauuugagauuguguucucauagauuuugcauugcugagauagugcuaucuuuguaaugagauauuaccuguguuuuuauuauuguaggccuauuguagaaaugcuauugauaagcauugcuuuuauaccuauaaugaaguugcuguuuuucccccuuacuuauuacaggaguugcaggugcuggccgucuuuucacuccugauguaaucagagccauggccucuaucaaugaaaggccuguaauauuugcauuaaguaauccuacagcacaggcagagugcacggcugaagaagcauauacacuuacagagguauuaauaaucacaugaauugauauguauauuauuuucccuccacuagcuuauuaguuauacauucuuacaccauuguucuaaugguuucccuagagauuacagcaugcaucuaugggugaucaaagucugauauuaauuauugcuuauaccaauuaugggaaacagguacuuuauaacuccacuguaaugcccucacacuguuugcacuauuguugugaauuuuaauuuucuauguauuuuaaacucaaaauacauuauuguuauauuuuacaaaaauuauucagauuuaccuacacuuuaauuuauuuaucacuauucuuccugcaagugcuucuaccuaggaucauuuuccuucuaccagaagaauuccuuuauuuaaguguaggucuaaugaauucucuugguaauuuauuuugccuucauuuugaaggauauuuucacucugcauagacguaaaaguugguaaauacuugagcauuuugaagauaucauuuuacuguuuucugacuuuuguuuucuuuuugaugauauagcauugucuuagguuuuuaacaguuugacuauggcggacauaugcgugguuuucuuuguauuuauuccacauggggauuauacugcuccugaaucuauggcuugaugucuguuuuugguuuuuguuuuuucuguuuugaaaaaauaucagccaguaucucuacuuuggccacauugucucucucaucuuaugggacucuaauuauaugguuagagauauaucucauuuaucuuuuacacuguuuucuauauuuacuaucucucuugcuuucuguguuucaaucuggugauuuccuuuggcccuauuuuccaguuugcagauucucuguucagcugugcucaucuguuguuagguucuuaauuuuaguugcuguauuuuuucauuuguagaauuuguguuuuaucuguauaguaauuuauuaauuuaguaacagacuuaaaaucauguacuguagaaauaaucaaucucuaaauacugcuuucuuguacucacauuucaugaaacuuuuuacucucuucaaaugcaucuucaccaucaguguuugucuuuucuaaggcuguuuuuuuugagucaucuggcgcuguggagaacaaauuuuuauuuacauccgaacuguuuaagauucacuacuuuuagaucuuugacacuaccacgggauuauagcccaauuacaaauaucugccuauaaaucacuugacauuuggguuuuuuuccuaccauucuguaaggauguaguuguaaucuccacaauuacuuucuauauuguugugguaagugaucuaaguggcucuaggaagugauuuuuaaaggcuuguuuacaaugaugucuagcagcuauaauugcuagacuacauccuugagaguaaguaauaaaucugauacauuuuuuuaaucuucacuccuuuaaaacaacguuuuuuauaguagaaaaguauuacaguguaucucucaaaagcuaaggauucuuuuaaaaauauaaccacagggccgggcacgguggcucacgccuguaaucccagcacuuugggaggcugaggugggcagaucacgaggucaggagaucgagaccauccuggcuaacauagugaaaccccgucucuacuaaaaauacaaaaaaaauuagccagaugugguggcgggugccuuuagucccagcugcuggggaggcugaggcaggagaauggugugaacccacgaggcggagcuugcauugagccgagaucgcaccacugcacuccagccugggugacagagcaagacuccaucucaaaaaaaaccccaaaaaaccauauauauauauauauauauauauauauauacacaccacaguacuguuauaccucauaauuugaacaauaauuauaucuugucauuuaauuuuuuuuuuuuuuuuuuuuuugagacagggucucucuugguugcccaggcuggaguguaguggcacagucauagcucacugcagacuccaauuccuggcucaaguaauccucuugccucagcuuccucaguagcugggacuacaggcaaauaccaccacacccagcuaauuuuuuaauuuuuauuuuuguagagacaaggucuugcuuuguuggccaggcuggucucaaauugcugaccucaagugauccccugccucagccucccaaagugcugggauuacagacaugagccacugugccccaccuaauuucuugaauaugugaauugcaauuaaaauuuucugaugguaacaaauaucucacucauuuuuauuaucuaucuuuuguucugucuugguuaucagguuuguuuguaaggcuaauuuguccuuuuuuuuuucuuuuuuuuuuugagaugaagcgucacuguguugcccaggcuagagugcaguggcgucaucucaccucacugcaaacucugccucccagguucacaucauucuccugccucagccucccgaguagcugggugcccgccaccaugcccggcuaauuuuuuuguauuuuuaguagauaugggguuuuaccauguuagccaggauggucucgauuuccugaccuugugauccgcccgccucggccucccaaagugcugggauuacaggcaugagccacugcgcccggacuguuuuuguuuuucuuaauugagugauggauaguguagaaaaagaacuauagcaauaauuuaaggcuguggauaaaguuauuuuuggagaaagggacuuuacuuuuucaaguagaucgccauaauccagucaggaugugguccacaugaggccugggguauuuccaguuugcccuuucuccugauauccaccccuuuggguaugaaucaucaaaaguccugagguauuuaucagcaccucucauccuuaacggucccugaacauccauuuuccucucugucaucaugagacuuuggguggcuuugcuguucagggucucagucacagcuuuugauuuggaaaucagcagucaucuugaggggaagagcuucaaaugcuaggcucauauaucuugcuucccucuucuuuugaaucuuggaaaccucucuuccccaacaccaaacucucacuaucuuguuaggucucugcuugcuuacaaaaauuuuuaaaaauguauuuuaucugguuuuuuaaauuguaaccagaggaaaauuugguaugaaacaacccagaaaaucauugccaaagcagaacucucagaacuuccugaacuuaauauucauacuuuugauauauuuggcauucuuuuuuuuuuuuuucccauuguuaaacacuguguaggccaggcacagugguucaugccuguaaucccagcacuuuggaaugccaaggugggcagaccacuugaggccaggaguucaagaucugccuggccaacuaaaaauacaggugaaacccugucucuacuaaaaauacaaaaaaauuagccaggugugguggcucacaccuguagucccagcuacucaggaggcugaggcuggagaauagucugaacccaggaggcagaggcugugugagccaagaucgugccacugcacuccagccugggcaacagagcaagacugucucaaaaaaaaaaaaaaaaccaacaaaaaaacaaccuuuauguugacacauguauucucucaaaauuccuuuuugaccuuuuugaccacuccauuagucaaaauaaauucucaugacuguuaguuuccaauugauauaauaauuauugaaaucucuucuucuaaaucaaucacaaaaucaccauacagauauuuaaaaauuagucucuuuaguauacugucuuaucuuuuuauuacuuuuagcuugauugccuguccucuucaccagguuuuacuacuuaaaacuaaugguuauuguuccccaaauuaaaucuuagucuucuacaaugacucuuggguaaauauauuaaaugcaucauggaucguugacauuuccaaaauauaaaaaauuuaaguguuucgaguaguagugguauaucaccagaagacugcucauuuaagaauuuuguuuuuuguauaaauauuauuguaauaaauguacuuuauuggaauaaauaaaaauuccccaaggagacuaguuugauauacuauauuucaucaguuuuaagaucaaggauugcuugagcccaugaguuugagaccagccuaggcaacguagcgaaacccugucuguauaaaaaauuuaaaaauuagccaagcaugguggcgcacaccuguggucuuagcuacuugggaggcugaggugggaggauugcuugagcccaggagguugaggcugcagugagcugugaucgugccacugaacuccagccugggcaacagaaugagaccccgucucaaaaauaaauaaauaaaaagagcauggugucauaguuuacuuuuacauaaauucuuucuuaguguuacaugaaauaauggcauagaauuuugacuagucgucaccuguuaaauuuuuagucccauuuuguuuucaccagggagguguuacuccaacaccguuugcugcucagcgagaaaaauacucuaaaaaaaaaucuucauaguugaauugccagcugcuuacauagaccaaguuggacuucagaauaagaauauacuauuaucauuaaaaucuggccacguuuaagccauggauuaauuauugaguuaaaugggcagggaggcagggauggugaccuggagaacgugaacugcuauagaaucuugucauuauugaagagauucccaagaucuuucuaaauuuccaaacuuacugauaccaugagaacauuuuuuccaugaugugcuauauuguauaaucuaccuuauaagacuauuaaaauuaauggugccagaaaaauaauuauguacuuauugugauaacauguaugacauuaaccaugaacuaaccuuaaucaucaaagaaacaaaauuuuuagucacaaguaauguuuagaacagauagauaauuguaauagcuauccauagaauagguagaaaaugauauaacaauauagaguugcaagucuaagauagucagcucugcccuacuagcauaguuagcuugcuucuacucuuaaaccuuguaucauuuugaaauggaaaguaugucuuguaaaaguagugguuacucugcauuauugaccuucagauuaccuggagucaaauucuugaauguuaaauccacuaaagccaagggucuacaaugcuauaaagaauaauaacacaauuaauucucuuagaaauacugaauaugccaguaacauuuauuauaugccauuauagagcauaguaucaaaauuggauagaugugacaaauuuggagaaguauucuucuuuaacaaggcaucaggccauuuguuuuccuggagugauacuguggucaugccacaugccuguguuauaaacugccuacugcuggguauuauagcaucauugaaaaccuguggcuauggaguuacaaaaaaaucuagauuaagauuuaacuacuacaguuuugaugugugacuuuugacaaaguauuugaaaauauuaaagccuuaguuuucugauuuuuuaaaauuagugaaauggagaugaugaugaaguuuucaugauggcaaaauuaacugaguuaaacacauauaaagcacuugguaauuaguuuuagcggauauauaguaaaugacagccauuuguuuugguauuuccccuucauucaucaguguuuauauuggucuuuauaauauggaaugguauuuauuggccgucuacauuuuaaauuucuuuuuuuuuucuuuuucuuuuuuuuuugagauggagucucgcucuguugcccaggcuggagugcaguggcgugcuaucggcucacugcaaccucugccuccuggguucaagugauucucccgccucaggcuccugaguagcugagauuacaggcaugggccaacacacccagcuaauuuuuuguauuuuuuguauuuuuuguagagauagggguuucacucuguuccaggccaucucaaacuccuggccuccagugaucugcccaccuuggccucccaaagugcugggacugcagguguaagcuucugugccuggccuuaaauuucuuaaaaauaagugucugguuuuuaaauuuuuaguaauaaaugauuuuuaacuuuauuauuuauuuauugaauguauacuacacaugaaacaaaccucauucuaacaaaaggauuguaacgaaaagauuguuauauaguauauuaugccuugcuuccaaguaauauauuggucuauuuuacuucaggacuugauuuuguaugaauucaccucaauuuucucauccacagaaaauaacaaaauugaaguuauuucauuuuauuaacagggcagguguuuguuugccaguggcaguccauuugggccagugaaacuuacagaugggcgagucuuuacaccaggucaaggaaacaauguuuauauuuuuccagguaaaugccaccauuauuuauguuauagagcaauaguuaauuauguaaaaauacuuaauggaauucuuuggaaugggagacugaacugagcaacaguauuacagaauuuugguauaaauguacaaggaaacucaaggaauucaucaaauucagcaugcuccacuuucucugaaaauuuauucauauuguuaauuaaauuuguuuuuauuauagaaauaauauauugcaugauuuguaaaaaugcagaggaacagaauggcacaaaauuauguaacccuuucuaucuccccuugguguaccuccuuaaucauacuucucagaaccauugucaauaauuugcugggaguucuucugaugguuaccaucgugacugauagauuuauuucccagguucaagcaguuccccugccucagccucccgaguaucugggacuacaggcaugcaccaccacacucagcuaauuuuuguauuuuuaguagagaugggguuucaccauguugaccaggcuggucucgaacuccugaccucagguguucugcccaucccaaagugcugggauuacaggugugagccaccacgcccagccagguguucuuauuuuguaagauacacccaguauacugguaucacaccaaaggaaauuaauaauaauugcuuaauaucguuuaucauuaccucaguucaacaacuuauuuuuauucccaauaccuuuuuuauucuagaauugcucuuucuaaauagcuacuuuuaaagcaaaaaugguuacaguacucauugagcuuuuucuggagaauuauuaggauuccuuucaauguuucugccuuugugcuguauuuuccauaaauuucuagugauccucaguugucucuuucuuuuaagcaagacuguguugaguaaaacaggaauuuuguaugauuuucuuuugcacuugugucuuuuuucuucugguaggucuuucccugacuagcugacagcaggcucuaauuaagauaugacaaguuuauauaggcuggcaucaggcaagcauguauaacuguugucaaaguaaagaggguauuuagucugugaauauccugguacuuuucuauauuuuucuccuuuuuuuugccccucauguuuuccuauaugucucuugagaccuaacuucuauaauagaaacuguccugucauccauaaucucuuucuagaacuugauaauguucaaaauuaauguguucuauucaguaacauuucuauggccuaaaagacaugagggcaggaaaggaaauacuuuucugcugauuuuaacaaagcuauuuuuuuaaacuuuuuuuuuuuaguuccagggguacauaugaagguuuguuauauagguaaauuguguguugcaggggguuucauguauagauuauuucaucacccggcuaauaagcaugcuacccgauagguaguuguuugauccuuacccucuucccgcccucuacccuuaaguaggccccagugucuguuguucccuucuuuguguccaugaguucuuaucacuuagcuccacuugcaagugagaacauacggcauuugguuuucuguuccuguguuaguucacuuaggauaauagccuccagcuccaugcauguuacugcaaaggacgugaucucauucauuuuuuuggcugcauaguauuuuuuuuuauuuauacacaugguguauaugugccacauuuacuuuauccaguuuaccauugaugggcauuuagauuaauucuaugucuuuacuauugugaauagugcugcagugaacauacacaugcaugugucuuuaugguagaaugauuuauauuccuuugaguauauacccaauaauaggauugcugggucgaaugguuguucuaaauucagcaaaaccauauuuuauaucauaucugaguauuaaggaauuuagcaguugauuauuuuuauauaacacuuuaaaauccuaacuuaaauaacagcuauggauaccauaaauauagacauuaaaaaugaccuggucaggcaugguggcucucgccuguaaucccaacauuuugggaggccgaggcaggaggauugcuugaggccagaaguuugacaccagccugggcaacauagugagaccuuguuucuuccaaaaauuaaaaaaauuaaccagguguaguggugcacaccccuauucccagcuagucaggaggcugagauggaaggaucgcaugagccugggagguccaggcugcagugagccaucaucaugccagugcacuccagccugggcaacaaagugagacugucucaaaaaaauaaaauaaaaugaccuggcauuugaggcagaaaugagccuaaaagcaggaggauuggcugaaagucuguuuauaaagcaacuuaaaaaaaaaacuguuaauauuugaaugaccuaguugagcaacuauaacaaccggaugaaaauuuuuuuuaagacuuuaaaagggucaaagggauaagauauugacucuaauggaauauuggagaauucuggaccaagguuagggagggaacaaaugcacagaacaagcuuuugaagccaguuuuacaguggaaauauagaccaggaagaaaguggcuaagagguacagcugugcuuuucauggaaaguggacaagaucggcaccauguccgagucuggcacuaccucccacucuggacugaaacccuaaagugcuguaccuuggauuggggguauaguuugcagcagcaaugggugauuuagaaaaccucaagccucuguucgggacugccagugcccacaagugcccagcggaagcaaacaaaaauuucucugaaauaagauaauggcauccuaguccucaaauuauuuuuauaaauuuucaaguacaaccuaaguagaaaaauaaaaaaaaagauaaugaggcacauaaagagacauaacaacagaagccaaaaccagcaaaaacaagaaaaacagacacacugaaacccuggauauaccguaaaugcuaugaaacaaauaugcuuauuauguuuauagagauaaaagccaaucuuaaaaacuuaagacaaguaccacuaaauucuagaauugaaaaauguaguagucuauaagaacugagugagcuggguguaguggcucaugccuguaaucccagcacuuugcgagaccaagguggaagaauugcuugagcccaggaguuugagaccagcccuggcaacguagugagacccccaucucuauaaaauuaaaaaaaaaaaaaaaauuagccaggcauaguggcauaugccuguaguccuagcuauucaggaggcugagaugggaagaucacucgagcuugggaggucaaggcuggagugagucaugauugggccacugcacuccagccugggugacagagcaagacccugucucaaaaaaaaaaaaaaaaaaaaagagugaaugaggcuuauggcagauuagaccagagagaauuaaucaacuggaaaauaucucagaagaagcaauccagaaugcagcacagagagaccaaaaagaaaaaaaaauagguaagggacauacauuucauugauagaucuuuaauugaaguccuagaagaaaugagaaugaagcagaggcaacaugugccggccucauggcugaguuuuuuuuuuagaacuggugauugacaaucaauauucaaaaagcucacagaaacccaugugggaugcauaaaaagaaaucuacaucuaggaacauuauugugaggcuucagaaucaccacaaagagaagaauaugaaagcagucagaacaaaaagauuuccuucaaagaagcgaccguuagacugacagcagacuccucagugacaauaagauaccaaggcagugguaaugaccuauuaaaguugcuuaugggaaauacuugccaaccuagaauucauuacacagugaaaauauccuucaagaauuaaagcaaaaugaagacauuuuucagaaaaacaaaaaaccggggauucaccaccuggcagacuguuuuuauauuaaaggaaaggaaauuuuguuccuuagggaaaaagaaaauaaucccacauagaaacccuaagguguaggaaggaaugaaaagcaaagaaaguuaugaauaaguggguggguacaacaaaaugaauguuguuuauauagagugaaacaaacaucacaugggauuuugaaaaauauauauagagagaauuaaaaugcacaacaacaauagcuccguuaaauagaguuaagcuguuaugugggacuuacauugauugacaggaagguaaauuaaaaauuauaauguggagcuggggacauuggcucacacccauaaucccagcacuuugggaugucaagaugggaggaucacuugaggccaagaguuugagacuagcccuggcaacauagggagacucugucucuacacacacaaaaaaaauuuaacuagccagguguggugacaugugccuguagucccagcuacuccagacaccgaggacagaugaucacuugagccuaggaguuugagguuacagcaagcuuuggucgugccacagcacuguagccugggcaauagagcgagacccugucucaaaaaaaaauuuaauguagaacguuggugguuaaagaugcaugauauaaauuuuaggauaaccauuaaaacacuacaaagacuuccuguuuaugguaagguaauguugggaugaaaugaaacaacaaaaauccgaaaagcaagaaaaaagaggaaaaggaacauaggcaagacaagaugagaugagagugaugagacuaaauguuugggggcuaaaucugccccaauuacuugaaaaaaaaaaaacuaaaaguaaaaguaaaaaccacauuaaaucuaaauggaccacauucucuacuuaaaaaaaugcuauuaaccaugugaucuucucagucaugagguaaucuggugacuacccuuccucaaagccaguugggauauucuuugaauagaguaaaacaguguuucuaggcugggagacaccagacauaguugaggacagaggugcuagaaaauaggaaguuuaaaagcaugugcggugaugcucagaggagguaaaccccacccucaugcucauagcuuccaaucauuuucucuaguucuuaacucuuaaaugugagaaaugcuugaagauuacuagucaucugaagaaagucucuuuauuaaagauuuucauaaaagagaccaaagcagacaaacagaaaaagacaucuuggggaaaaaaacaaggauaaugggaagagaaggaaaguuuuaaaaauuaucaauauccucagggggacaaaauauuauauccuauaaagacagauuuuuauuuuuuaaaaaaauagaaagcaaaacaagcuccuaaaaauaaaguuugauagcagaaagaagaaaaagaugaguuaagucaccuaaaaagagagcaaaggacaggagaaggaaaauaaagaaaauuagagagccaauccaagagguacaauaucagaaaauauaaaugucagggaacaagaacagaaaaauggagggaagugaauccucaagacuucaugaacauuucccaaaacugaaagacucguguuuucagauaggaagcgccuacucacugaaugcuaaacaugaugaauuaaaauaaugcacaucaaggcacaguguuaugaaauuguagaccguuagguauaaaaauaaggaucuggcugggcacaguggcucaugccuguaaucccagcacuuugggaggcugaggcaagaggauugcaugaguccagaaguuugaaaccagccugggcaacauaguaaaacccugucucuacaaaaaauaaaaaaauuagccaggugcgaugguacaugccuguaaucccagcuacucaggaagcugagguaggaggaucgcuugaguccagggagguugagguugcagugagcuugugccacuguacuccagccugagugacagagcgagacccuguugccaaaaaaauuuuuuuuuaaaagggauccuacaugcauccagagauuaaacgaaaacaaucaccugaaaaggcucugaacucagauugaugcuucucaccagcacuggaagcuagaugguauuggaauaauaccucacaguucugaaggaaaaauauuuccaagccagaauucuaaaccuagacaaacuaucaaauauaaguagaaagaaguaaacaaacacauuuucagaaaugcaagauuucaaaaaauauauaucucccaugcacuguucuucagaaagccuugggagaauguacccuaccaaaagagggaguaauaaacuaggaaaaguuguauuugggaaauggaaucaacuuagaaagaagcaaagaggccuguaaugauaaagggguuuucuaggaugacagcuccauagcuggaaugggggacaaccagaccagaauggagcuuuaguagauauauucuagagcaggaaauucgagaauauauaaaguagcuaaaauagaagaaaauguagacaauugagugagaguucaagggugaaauaacaauguuaaauacuaaaaaaucaaaguaaaggaaaaaggacaauuauuaacuucaggaaagacaaaguuaugcagaaaaggaaaaguaaccaugauauaaacauugaauauugauugaaccacaauuaugcucuaacuauauugggaagaagaaagaaagcugaaaauaugaaagagcgcuaaauauuuacuccuacaggaaagagucagugaucuccaaaacagaaaaugcaagaucagcacaauaagagaaggcaaaaaaaaaaagaaaaaaaaaaagagagagagagagaaaaaaaaaucacaagaaacauaaguuauuuaagagugagagagagaaacaaucagcuaaaaaaaauugucauugccucuguagagcaagaaguggaguguuagaggugggcugggaacuggaguuaaaacaagcguugaugaauuguauguauuugucauuuucauaaauguaaaaacuaaacugagaaaagccauuugauauuucugaaauuacuuagcgaauaagaauuauuaaagaucguuugauuuuaacucagauuucuguuucuucuuggcuguuuucuguuuggggggagcuguuugcgauguggauggauuaccauuuauuugccugaauauaggaauuuacuucuuucauaauuugaaaagugaccauacuaguaaacuuuaaaauguguucuagguguggcuuuagcuguuauucucuguaacacccggcauauuagugacaguguuuuccuagaagcugcaaagguaaauguuuuaaauguuguuuauuuuauaaaggaugaauuauaaagaugaguagaucugaaaauuaaaggcagagagagaauggguuaaaucugccuuauuaaugaaaaggaaguuacucaaauuacuuuuaugauuugccuauuuaugcauaaaauuaauuuuuuuaaucaugacuuaaauuuuuguaaacugaauccucucguuuuaauaacacuuagacuauacuugcaauuuguauaucugaauauauugugacagcauagauaacuccuugcauguuuuuaauggacaaguacugguauuauuuggagugcuggccuaugggagcuccagacuuugaaguauuucugaagaacucacauuaauacaauuaaugucuguuuucaaaguagccauugcaauuaagccaagcucuacauguguaauauaaagcagaauauaaucaauaagucuuuaaaucugguuauuuauuguuuagugaugaacaguuuuaauuucugcagugguuuaaguguauuccuucaagaaauaagaggaauuauauuaccuguuuuacucucuguuuccccaaugcuuuuuccauuuacuggguccuuauucuguuauuuaaacaaacaaaagcaaaaugcuguuuuucucuucaggcccugacaagccaauugacagaugaagagcuagcccaagggagacuuuacccaccgcuugcuaauauucaggaaguuucuauuaacauugcuauuaaaguaaguaauaacuuaaacuucuucacauuaauuuuaaugacauuuucuuauacaagaaauacagguuuauuaagauaaaucugaaacauuuagaaggcugcaaagaagaaauuuuaggcccauauucuuacuaccagaauauaacacacaugauuauuuuggguuuguugccuucuagucuuuuuucuuugcaaacacauacaugcauacacacaugcauguagucacuugugccuuuuugaaaaauuguuuuaaagaauagagauaggggucuuccuguguugcccaggcuggucucuaaccccuuggccugaagcgauccuccugccuuggacucccacagugcuuggauuacuggcaugagccacagcaccuggccugugcccauucuuauaauugguuucuuacugcacuuuuuccccuuaauauauuguaagucuuuuccauguaacuuaauaauaauucucauguaugugaucauuaaugcugcauggcauucucuuuauuauuuuuucaaaauuuguuucaucauuucucuguuuuuggacauuuaaguuuuuagcuucuuauuguuagaaauaacacuguaggcugggcgcaguggcuuacaccuguaaucccagcauuuugggaggccgaagcagguggaacaucugaggucaggaguucgagaccagcccagccaacauggugaaaccccgucucuacuaaaaauacaaaaaaaguuagccaggcaugguggugggcaccuguaaucccagcuacucuggaggcugaggcaggagaaucacuugaaccugggagaaggagguugcagugagcugagaucgugccauugcacuccagccugggccacaagagcaaaacuccaucucaaaaaaaaaaaaaaaaaaagaaagaaagaaauaacagcguaaugaacaucugucuuuacagauaaaucuuuguguguauuugugaugguuucuuuuuuuuuuuuuuuuuuuuuuuuuuuuuuugagacagagucuugcucugucacccaggcuugagugcaguggcggaaucucagcucacggcucacugcaaccucugccucccagguuuaaacaacucuccugccucagccucccaaguagcugggauuacagaugcccaccaccaugcccagcuaauuuuuuguauuuuuaguagagacgggguuucaccauguuggucaggcuggucucgaacuccugaccucaggugauccaccggcccuggccucucaaacugcugggauuacaggcgugagccaccacgcccgggcugugaugguuuuuuuuuuuuuugggauaaauucuaagcuuaagaacaaagguuuuuaagguguuuuaaggcuucugaugcauauugucaaaugagcucuucagaaaaaguacugauuuacauugcagcaauuagauaugaguguaucuuuuuccacacuuuuuccaauacuuagaauuauuuuuuuaaucuugcauauuuaauagguaaaauuguuucucauuauuaaggcauuauuagugagauugaagaauuaauauauauauauuaaguguauauauacuguuugcuguggugcagauauuuucccacuugucauuuguuuuaacuuuauagaauuguuugacaugucuuuuaaaaguuuuuuauggaauuauuuguuuauuuuguggauucucuccucaccuuuuaugaauauuaaugccuucugucacuccaaaaucauaacugucuacuugcauuuucuaaaauaaaacuuuuuuaaucucucugggauuuauuuuaauguaugauaugagaaagggaaacauuuuuuccugaguaguuaaccaguugccccagcauuauuuauugauuaaugcguccguuguuuacaguuaauugggaauugaaucuguuccugggauuucuauuccugaccauuuuuguuuacuaucugacacuguuuuaaauuuuauaauguguauaauguaacauuuaguacuuuaucuuucccaucauuaugcuuuuucaguguuuucuugacuguucuaaauuguuuucuucuggacaaguuuuuguaucugcuuuuuuaauuuuaaaaaacucugcaacuuuguaugaaauuguugcauuuauaaauuggugaaguugggucuuucaguauugaguauucuccaaucacuaucucucuuuacuuauuaagaucuuuuuuaaaaaguguuucaguauaauuuuguuuucuucaucugaauauggcauuuuuacuuuuuucuaaauauuuuuaaauuucuguuuuucuaacaaagacuuuuuuuucuuuccaaguaucuucucauugaucauuucuaauauauaggaaaagguaggaauaauacuaauuugaaaacauucauuuuuaugaauuuacuugaugaccaguuuuuugaacaaucuuauuuuaauaguuuuucauuucauuuggaauuguugaguuuuuaauugucugcaaguaauuuuuucuuuuuuuaauaugcauaguccguuuuucucuaacuauaaaucagcugaaacugcagaauagucuuaagcaauuagguugauaaggguauucuuguauuuuuuuuucaauuuagagacagagucuauguugccaagcugaucucaaacuccuaggcucaagugauccuucuaccacagccucccgaguagcuagaggcacaugccaccacaccuggcuaacaucuuuguauguuaauauuaaauaugaugcuagcuuuugauugaaauaaguauuuucuacuuuuuaaaagaaguagucuucuauuucuagauuacuaagauuuuucuuaaacauuaggauugacuguggaauuuaucagccacaauuucaacuuccauacaguugaucauaaaauuuuaucauuuugacuauuaaauuuauuuauuuauuuauuuauuuauuuugaggccgaguuuuacucugucacccagguuggagugcagcgacgugaucucagcucacugcaaccucugccucccaggcucaagcgaucuucccaccucagccucccgaguagcugggaccacaggcaugcaccaucauguccagcuaauuguuuuuugcauuuuugguacagauggggguuugcauuguugcccagacuggucucaaacuccugagcucaggagaucugcccaccuuggccucccaaagugcugggauuauagaugugagccacuguggccagcuuugacuauuaauuuuauuauuacauuauuuuggugccuguaaccuaagcaaagauugggaauugguaaaggaugguauguucagggaauaauaguugagccugggggaacagguagggaaauggcauggaagaaaauuugaaaguuauauuaaagccagcuguacaaauauacaaaugccaggcuaaggaguaugauuaccuucuacugcaaaacaguugaagauuuuagagcccagaacuaggaugauagaguccaacuuuagaauuuauagaaugauauuacaggugggagagauuuuggaagauauuagucaguuaagagauuacugggccaggcagaguggcucacuccuguaaucacagcacuuucaaaggccaaggcaggaggaugacuugaggcuguaaguuuaagaccaucccuggacaacaaagcaagaucucaucucuaccaaaaaaaaaauuagccgggcacagugauaugugccuguagucccaccuacucaggaggcuggggugggaggaucacuuaaacacaggaggccaaggcugcagugagcuaugaucauaccacugcacuccagugugggugacagagcaagacccugucucuaagaaagaaaaaagagagagaaauaauugguauauccaaaugagagguaguacaugaggucauagaaggagaccucugcuuaggauuaguauagcaacagaggcccagguucaugucucugcguuuccccagaggcaggaguagagagugugcugugucugcaguggcauaggcuuuucuuuuuaggagcaaauaaggaaguggugaguagaggaggcagagcuuugugucuguccccaccccaaauagccacugauucaccccuuuggcucuaugagcagggcugugugugcuccucugacagccaccagucaccuucugcaugccuccaggaccaaggggagcuuucuccaaucucaugccuugcccguaaucuuuuucugugguuacuaccagccugugggaaagagauuugcagugagugugagccccccuuaugucuaaagcuugcaguuguuccagaauaaaacacuagcucacauugaccuuuggcaguuccuuaaaauuuuagcugacuucuuauuguaugcaugguggccacugccucauucucccucccaugcucugccacaagugagaguuucugugucuagucugccgccuucucuccuucauucauuuauuuauaaauuuauauuuauuuauuuauguuaauuaugcugcucacuggcuucagaacaccucccacugccccucacaucaggcaggccacguguucagcucuccaaggucggaaggaaugaggaaaaauguguuuauuccauccuccuggaagcaaaaaucucugccugucuuuuuauaucauuccuguuuuuccuguuuaguacaaaaacugagaagagcaauuuggucaacaaacuguacuaaugacauguuauguuuauuuggcccuuagguuuuuuguuuguuuguuuguuuuugagauggagucucaacucugucgcccaggcuggagugaaguggugcaaucucaguucaacacaaccucugccucccaaguucaagugauucuccugccucagccuccugaguagcugggauuacaggugcccgccaccacgccugacuaauuuuuguauuuuuaguagagacaggguuucaccauguuggccagccuggucucauaaacuccugacgucaggugauccaccugccucagccucccaaagugcugggaucauaggugugagccaccacgcccagccagcccuuagguuuuuaaccucagaucuuuauugcaguuaccugccacugaggaucuagcccuucccuacuucuuuuuccuagucagugauaauaaaauauuaguaaaauauguuuucuauaauagaacagaaaacaauugaacacauuuucuaucacaaaauacacugagauugaguucuugguaccaaggauuauuuuuuaauaaccaucuuauucugagauuuuucuuuuagaaaguugaaauaugaaacuuuaauaaugguuaccauuuggaaugagaauuagaggaggagagcgacaucuuauaauuguuugaauuuuuucuaccauaugucacuacauuuuuuuaaguuaaaauaaaaccugccgggcaugguggcucaugccuguaaucuuagcacuuagguaggcugaggcaggcggaucaccugcggucaagaguucaggagcagccuagccaacauggcaaaaccccaucucuacugaacauacaaaaauuuaccaggcaugguguugcaugccuguagucccagcuacuggggaggcugaggcaggagaaucgcuugaacccaggagauggagguugcagugagcugagaucgugccacugcacuccagccugggugacagagcaaggcuucaucucaaauaaauaaauaaauaaauccauaacagagcaaggcuccaucuuaaauaaauaaauaaauaaauaaauaaauaaaaccaugacuucagaacuuuacugugugagaggugcugugcuacccugugaggaaguguuucacauuccucauuuuauaucagaacugagguucaagggcuuauucucaccaccaaucaugguguguggcuuggguggagaauuugaaauucacucaagccaccuuugguggggaguagucgagcuuacuguugagggucuaauaucuagacucagaaugcuuuggguuugaaacagcucucaaguaacuaccuugggcaaguuacuuaaacuccucucauuccucauaugcagaaugagaauaaugauagcacuuaucuccugggguucuugucgagaguaaaggagguauccuuguaaaacacauagaaagugccuggcacucagugauaguggugucaguuccccuguauagguucuagcccugacuucaccugaccuuauaguucuagugucuaaauccugauuuauaauaauuacuaugccucuuaauccaaauucuagagcagaaaccucucucucaccuuggguuagguuuucuuccuggucaaguuggcugugauuaggaaauagucucugugccccucuagaaaggccacucuuucagcaagacugggaggaaugacauaggcugggcagguuaucuaaauguauuuacuagaaugacacaguagaacuuaaauguguuugguuuuaucuuuuaaacuuuccauaguuuccaaauguuuugaaaggagucaaagcaauguuauuuuuuacugugaaaaaagaagaaugccauucuucuaaacuuauuuuccuguguuauaauaguacguugucucucuaauagguuaauacucagagccuacacaauaaccuuacuuauuuuucagguuacagaauaccuauaugcuaauaaaauggcuuuccgauacccagaaccugaagacaaggccaaauauguuaaagaaagaacauggcggagugaauaugauucccugcugccagauguguaugaauggccagaaucugcaucaagcccuccugugauaacagaauagaagcacuccccugauaaauacuuucugugcuccagggaaccccuuuuuucagacaagaagagauaaugucuucaguuuuaugguguuuucuguguuuuguucucccugaccacuuugguugauguauuuuuuccaugcgucuccacaucuguugggguagacguguugauugauugcauugcccaccagcacccuacagucagauaguugugaugcuuuaauucuaacauacagcccguaccacauccaggagauguaaaaaguguguuugugaaugucuucacuuguacucuaauucagacuugccaaaguauuugcuauuuacuauuauggguaauacucuucucuggccuaguucuuacagagcuacuaaaauagaaauuuacuuuuauggauagaaguacagaauuuugagaagaaacuaaauuuucaccaaauuuuaaggaaaaauugucauuaucuaaaaauguucuuauauaucugcuucaucuuaccuucauacucugaaauucccuauagcagacagagcuagggaaauauuaaaaauuuacccuauuuauuuucuggaacuaaaucaagccuuaacuauaacauuaugagaguaaugggaacuacugcuggcuuuaaguaaauaaaagucauuguuuucaacaguguauaaaaaucauaguguaaccuuuuuauuuaauaaauaucuuacauuuaauugcuucaguuaugcuaucuuauugcccaacuagaaauuuagauuugcuuaugaaaaacacauauuuuuguuacuucuagaugauucuaggagggaguauaagauaccuaaucauaugggaacaucacgugacuuuuuaaaucuaaauuagucaugcuucacaucaaaaugagucauauuuaacuggagaaacuaugcccuuauuccagaacugaugcucuuuauugcuugagauaauuuuggaauguuacuaugauacuguuucuuugaauaucauuaguagugacaacucuuucuccauugaaggcagacuuaauuuuuuuaaaccaccaacauuaauuuagagcuaaauggggaugaauaagguugguguucaucugggaaaugccuuuuuuaaucccaguaaaauggguaauaauggcuauccagaacaguuuucuuguguggcuugcauauugaagaauucuaaaggaaaauauaucugccuaccaugcuugcucuuagggaagaaaacuuaaaugcucauucuaggauaguaacaacaacagauaauucaucgauaauaugagcaugcacaguauuugauauugcucuguaggaaaaaagagacuucauuuuuuucaucuucugccuaugaauacaaauugauucuuuuuuuuuuuuuuuuuuuuugagacagagucucacucuguuaccaggcuggagugcaguggugugaucucagcucacugcaaccucugccucccagguucaagcaguucuccugccucagccucccaaguagcugggacuacagguacacgccaccacgcccagcuaauuuuuguauuuuuaguagagacgggauuucaccauguuggccaggagggucucgauuuccugaccucgcgauccgcccaccucagccuuccaaagugcugggauuacaggcgugagccaccgcacccagccaauuuuuuuuuuuuuuuuuuuugagacagagucucgcuuuugucgcccagucuggaguguaguggcaugaucucugcaaccucugccuccucgguucaggcgauucuucugccuuagccucccaaguagcugggauuacaggcaccggccaccacacccagcuaauuuuuguauuuuuaguagagaugggguuucaccauguuggccaggcuggucucaaaauccugacuucaggugauccacccacuuuggccucccaaagugcugggauuacaggcgugagccaccacaccugguccaauucaucauaauucugaauauaauuuaauaauuuuaaaauggucgcaauggcauugccauuuggaguaugggaaaaugcaguugguuaauucauugaacagauuaguaaagucagaagucuuuuucauaacauacggucacaauuccuuucuuuuaauuaaagacaaaagguuuauggguuuugguuuguuuguuuuagauaugggguuuugcuaugucacccuugcuggagggcgguggcuguucacaggcgugggucauagagcacugcagccuggaacuccuggguucaagcucuccuccugccucagccuccugagcagcuuggacuaaaggugugcaccaccgcaccuggcugagaggcuucuguuuuucauguucccuuuaucaaaacaaaaucacgccuaaacauacucucugugugaaaucuugauuuuaguucaaccuaagaaauauaauaaauauaaaccuguuucuugcuuaguguuuauugaaggcaggaacguaugcugaauuaaaguaauuuuacuacgaaguuugcuuauuaaguaugccugguacagucuucauggaaguuauuaaguauuuuaaggaaaaaaauaggcuaaauggcauauagccugcuuaaauaaaauaauucuauuuuuuuaa

SEQ ID NO: 192764 - RNA, 31314 nt, Homo sapiens
uugcagcgguguaacaaauuuuaauucaaaauagacacucugaaaacaauagguaaaaaaaaaaaauguucaacaagcucucuuugaauuuacaacagaguacaccaacaaucauaaaccaguuucacaacugccucaaauaugaacauuauagcaauuacaugcaaguauuauauuuuuuaaaauccacauaguaacauuauguuucucagaggcugucacauccuccaaauauuucuaccuaaagauagagugaagggguuccucugcuguguaccaccagaaauaugacuuaccaucuaaacuggcuggucuccaugacugguucuggugcuuuaaguuuuaauaucguguggggaaaaaaacgagguuuaacauccacaggacagugacgacaauggagauucuuuaacaauaugccaucccaucgacccggacacagcuuccagccuaaaccagcuagagaaaagcccguuucuccacuaaacaugaccuucagaaaauguggugaaagacuuacuguaccaaccauggagacugagaucucagucuguaaacuucgccauguccccugaaacccuaugcugaaauuuaaguuaguuuucacacucaggggcaauaaucuuauuccugaguaucauagaccuucccuuucacuaguuuaugaguaguuaaguuaggagaagaguuuugggguguauucuuucaauguuuauucuaaaggcacuaaaaauuuauuguuuuaccucugaacggagaaaugacuuagcauaucaaaagggaaaaucuacacugaaaaauauuucugcaucuacagaauaaauuuauuuguaaaauaacucuugauguaugagcuacauaccagcauaccagaugucaaauucagucuacuuuuaacaaauaaaaacauuugauuuucuaugaguuaugguuaaaaaaaaaaacagcuauuaggauaaaccuaaaaaaauacagaucuaaauuauaaucuauaagcaaagaucuuacaaagaagucagcguaaguuaaugcagugcauccucagggagccuuauacauacaucacaggguuuguacccacgucucugaacacucacuguaccaucugcugcuacagggaaagcugaaggagaucgaugcuuccacucgcaguuaaaucaaguauucugaaaaaggcugaaauguccuuaaugaaaaagcaaauuauuuauagauuucaguuucuuaucauacgauacugacacuagugggaaaacaaggcgugcaugaaauaucaaaagauuucauuuacaugacagagaaaaaaaccugaaaacaacuguucuguuacaaaucaaacugcaggaaacaauagaugugaaauaacuacuggcuuccugguaacaggggucucuccagcaccugaaguaacucugcagagcagcacagugaccacugagguugauucaccaacacagugaggacaacacugugaaauuucaacugaaaaaaaucuaccuacuacuuuagaguuacuuuuuuuuuuuuuugcaaguuuuaugguucauauucaaaguucaaucuauguuucacauuuuuaaguucagacauaucaaagccuaaaaguacagaaggcuugugauuuuuuauugcuuucaugcaaauauaccuucuuuuuccaaaaaaugaagccacaucaauuuuccacacccaaaagagugaggacaacaguucuauuuccuuuuuacuaggauaugguuucuuauggaaauaaucuuuaagaaauugcuucuuuucuucauaagaacggccuucauauuuuuuaggaucuaaugcuaaaaucugaagagccucguccuugacaauaggucccucuguucugcuuucauuccuuugucuuuuaaaaggcacaacacucgucaccuuuucuggacccggggcugcaucggcauuuaggaugggaggcugcuccuccccaugccgcuggucuucggccccuaaguggccgucaggcagcuuucucuuaacagaaaaacuggaaucaugcaucacuucaccacugacuaaaagcaguucacuguugugaauaaaacccggcugggccugcaggucugagcugcuguccuugggagcacuucugcagcgcaccaaauggacggcgauggcagccagggucauauuucccguguagaccccacagcaguggaugcacuugaaggcgggagacuucaggaccguguggacugugggcaugauguggugccucuccuucaaaugcagcucauaggccucaguugucacaaaggggccaaagcaaaaggggcagguggacacucgcuugccggugcucccgggggugcccucagccugaggccucaccuucacauacacaggcaccagugacuuggaguguaucccagccaggauugccaaguagacuucccgcuccccaagcuucuccuuuggcaauauggugaugaaaucaagguggggaaagagcagguugccauuggcaucgacaucuaauugaaaaccucuguugcuauaauccauaggcaacuucuucuuccccaggugccuauuccugcugugcucugaaagaccuuugauaucauggaaggugcauggacagaacaagcaccccaagccaugcaucagcaagugguguauaagcucuuccucagagaccaagcacuuacaagacagacaucgcaccguuuucucucucauccacuuuagaaauggugcacacgcugccaguuuuucaggcucaaguuucucaccagacuuggacucgcugugcuuaugcgcuaccuccauguggaccugguagacguuggacggaaagagcucguugcagacagggcaggucuuccacugcuuggccuguuugagcaccugguuugugucugcugcagaggaggaggccugaacaaacacgcucugagcagcauucaccagcacuggaggagagggcaugccgggcauggaaccggccauuggugcagcugcaccugacggcaggagcuggaugggcaucuggggcggagcgacagucgcaaggccuccagggggaaccggcagagugacagacacgggggccagcguguagguuggaaucccauucacuuguuucccuguagggaugagcugucugagaauagagccugaugucaggaaggugguguucugcgaagcaccaggucucacuggcugauucacaggcagaauguuggugcccacagucugguugaguugcaagaccccaggccucacuggcuggcccacaggaagaacucccgacacaacaggcugacuaagcugcagaacaccagaauucacacccugguuuacaggcacaacagcugaggaggagacugucugguugggagaaagaagcccagacgggaccaccuggccugcagagauaacccucaauggggcugucuggccugggggaagaacccgugacggagcugucuggcccacagggagaacuccugacuggaccaucuggccaguaggaagaaccccagaaguugcuguuugcccagggauaaccccugcaggagucaucuggccugcaggagucaucuggccugcaggaaggacuccagacgggaccgcccgacucacagaaagcaccccuggcgagacagccugcaggaccccaggggugacagaggggcucacaggaagaacaccaggcccaacaggucuguuuaugggucccacaggcugggugagggguaaaaccccagggcgaacagucugauuuauggggaggacacuaguuccaacagacuuauugacagguccgacuggcugacucaagggcaacacaggaggauucacagacugaugaaguggaaccccgugagaaagaaagacgggcugaggugcugggggcugcagggugaggcuguucuggcccacaggcagagggcuggagaccagagucaugugggauuggccagcagcagggggggaaugagugaggcuuccaggggcacccugggccacagucacuggcuguccugcggcugggcuuggacuguucuguggcaaagcaagauggaagcaaggaggcugcgcuggagcgcuuggagcacugccauuugcuggugcagccaaaugugcugcugguuuuggagcaaugugcguuugcuucaagaguccaguccucuuaauauguucugaaaucacagaucuaagcuuauucuccaaaucucuguguaugucugaugucaaaaugugauacauuaacgcauccuggcugcuggcauuggcguugcacuuuuuacaguaauauuugucagguggugggaucuucucuauagaaacaguaucguuaguuuucgguugcucacccauuuccucaguucuuaggccaaaguaggaguuaauuaaguagugaaaaugggcuaccagcacaugcuucuucaugcuguaguacaaaguguuugaaaaguuacauuuuagacaugugaaacuuaucacaucgcuccuagaugauuuaguuucaccuaaaauauucacuguguaguucuggacuuuccggacaggugcauggaacauucugaagugccuucccacaacuuugggcugagaugcaaauacacaguuugggcaagggaucaccagcucuuggucaauuucaucuucaugguaacgauguaaaugauucuugaaugaaguaagcaccuuuguagaguauuuacagaggccacaacaguauggcuuuguucgauaucucuguuaaaagaaaagaaagccuuaagcauaauugaauaaacugucagaugcuaaccuuccacagucccugaggacuugaucccuuuucuucuaaugugcuaggcauuuaaccugacuuaauguuuucuaacccagggguuggcaaacuuuuucugugaagggccagagagugauuauguuaggacugugggccauacaguacagucucuguggcaacuacucagcacugccauuguuguacaaaaguccccaaaauaauuuguaauuuauguuccaauaaaacuuuauuuacaaacaccaauuugaauuucauauacuuuccacaugucacaaaauaguauugucauuuuuuucuuaaacauuuaaaagccuaacaaccacuccuagcucauggcucacgggcuaauucauacaaauauaggauuuggcucacaacucauaguuugcugaccccuguucuaagucauccacuaaaaccacaaauauaauuacuuaguccuguauucugaauuauuaauaacagcaucaauuuuaaaagcuucauuaauuuucuacaaaagaaaguuauuuucucccccucaucccauuucucuuaauuccaauguuguuuuugcuccaaauucuaaaaccucuggaauuuauccauaacuaaccuagcuuucaaaauguuaaacccaucauuacuaucuuucuacuuccucuauuucuagagaagguaggagccaaauggacaguguuuggcccaugcagguacccaauaaacuaucugauaaaacaguaaagaaagugagacuaagccuaaacucacacuauggaugacccuaagauaaggguaaggccacagaacgcaacacugaccauaugggauuucuauuuaaagcacauuuugggaaauuuaacaaguucgcggccuaaaagcauauucauacaacaggaugcaaucuguucuaacaucuaguaagacuugcugguuugcaauaacuugagagcacagugaaaucuuuggucucaugacagagucuugagaacccagagcuggugaaacacaaaacaccugcuccccaguuccacaaacaaggaagcuaagaccuagcuucaucuaaagccccagagcuggcugugguacuaccacagugaucaaggguuaauucucauccuuuccuaaaucugugugcucauuaucacucucucucacacacacacacacacacacacacacacacacucuuccauucuucaguuuuuuguuuuuuuugacagagucucacucuguuacugaggcuggagugcaguggcgugaucucagcucacugcaaccuacgccaucccgguucaagcgauucuccugccucagccuccugaguaacuggaguuacauuacgagauauuuuaagaauucggaugagaaaaaucaauggggcuugcuauucaugaagucaagaucugcuaaaugaggcauccuguaguagccacaagcugugcucagguggaggagaacuaaaucacagugguuucaaggaaacuugcaacucaugguagagaggagagugucaggucagagacugaaaaaugggucucaacaaaccucuacaaaaaauaaaaauaaaaaugcuuaucugggcaugguggcaugcaccuguagucucagcuacucaggaggcugaaguggaaagacaccucgaacccaggaggucaaggcugcagugagcuuaagaccacgccacuggacuccagcccaggcaacagugagacccuguccccccaaaaaaaaaaaaaauucugacaacgacuaauuacugaaauaccuuaaagcccaaauucccaaggccagcaugacuuugaccacagaagcuggugagaggggacagccaagucaagucugggaugagcugagucugauaccgaggaaggugcuaacaacugguggcagaaaaggugucccagaaaacacuuuaaugagaauucagcaguauggcucauguuuuagccugaauuugcuuaaaaguuugagguuucuaauuacuuaaaauguuccuugauucagaggucuacauuuuuauuucaguuucugaaaccaggauguacauucacuguaugcacuuaauguaguggcauuuuguuuuacucagaacaauuauuaaaucaaacguccuucuuacagcaaugauaucuuauaaucaaggacaaacaacaguuucacugcaucacuguaucaacucugcacacagaacagagcaucaguaacccugccugaccacacacuauacuugguuucuugcuacuucucugaaagguugcauuauuccuccuccccauucacucaccagcaaccccaauacaugugauguucuuuagaccacauuuacagucacugcucacuuuugaggaaacaugaaaaacaaaugcaaaaaauacauaccacuuucuuuccagaagguucccagagagaaacaucaccccaugauguguuaugaaaguauuucucuccuggaucaaagccuuuaagguccuuuuaaaaagggagaaaaaaaagagauuauguaaauucagaagauaaagaaauauuuaauuagaaccugaugagauuauaaggccgggcauagugguucaugcuuguaaucccagcacuuugggagguugaggaggguggaucacuugaggccaggaggucgagaccagccuggccaacauggcgaaacuccaucucuaccaaaaaauacaaaaauuagcugggcaugguggcacaugccuguacuccaagcuacucgggaggcugaggcaggagaauugcuugaacccgggagguggagguugcagugagcugcacucaagccugggagacagagcaggacaccaucgaaaaagaaaagaagaaagagagagagagagacagaaagagggagaggggagaggggaggggagaggagagaggggaggaagaggggagagaggagagagugagagagagaaaaaaagagagaaagagaaaaaagaaagagaaagagaaagagaaaagagaggaaggaaggaaggaaaaagaaugaaccugaugacauuacuugguaccuaagaaaucuacaggggaaaagagaaaugaaaguauagucaucccucgguauccauaggggacugguuccagaaccaccuggaggcaccaaauccaagacugcucaagucucuuauguuaaaucgugcaguuacuugcauguaaccuaugcacaucuuccuacuuaccuuguuuagagaacagugacaagaaaacaagucuguacauguucaguacagaugcaaccaugcauuuucucucccaaauauuuucaacagacaguugguuuaaucaacagaugcagaaccccuggauacagaggacagacuauaaagcucucagcaaguuuugauggaguacccuuuaaguaugaaaucugaggaaaagguugaaauaauccaagucaaaauuacagauucauaagaaauaaacagaggagaccucccaacaaauaacuaucuacauccucuauauguacgcaaagccuaaacguaaggauucuaaaacccauguagcuucaugaguacauauaaagaaacaaaaaaguacuucaaaguaaaacaaucuucaucuggguugguuccaagucuuugcuauugugaauagugcugcaauaaacauacaugugcauguaucuucauaguagcaugauuuauaacucgucauuuacauuagguauuucuccuaaugcuaucccucccccugccccccaccccaugacaggcccgagugugugauguucccugcccuguguccaaguguucucacuguucaauucccaucugugaguaagaacaugcaguguuugguuuucuguccuugcaacaguuugcucagaaugaugguuuccagcuucauccaugucccugcaaaggacaugaacucauccuuuuuuauggcugcauaguauugguacauguauacauaugcaacaaaccugcacguugugcacauguacccuagaacuuaaaguauaauuaaaaaaaaaaaaaaaaagaaucuucaucuugaacaccgucuuuuuaaacuauaccuuaccgcuauuguucaauccauucgucuuagggaaugaaagaaaaguguauuuuuuucuuacucuuuaaauaccuuucaaagcaguuaaacaaagaucuagaacguauagaggauuuuuuucucagauggaaucaaucauuuuucacucaaaaaguuacacuugcuagagugagaaaauuaugcaaaagaccuauaguguagacaagggugucaggaaaaccucacaaucagcugaaagaggcaguagugugagaaacacacugcguauugguaacucucaggggcaggugaacauggagagaagaggagcacgcaggucccagaaagggguccagaggccagaaaugcaugagccgagaccucccacagcagcagcauccucagagcagggguucaacggcugacuuccaaagccugcuggcagcagguagggaagggaggaaacguagaaggaaggccuccaccuuacgugcagguaaaauggccuaagacaaaacaauuacaagcuccacagaacaguaaucuaccucauccuuucgcagucaucacuaauccaacccucaaauauuuccuuuuggacucugggaacccaaccauggauaagacagaugggaucccaaccucacaguuucacaacugagaaacacagauauuuuguaaaauuguuuuucacaagaaacuacugucuuucaugggugguaggugcuaugaauaaugacugugaagugguaaaggaguauaacgcagagagcuccaacugugucugccugaccugacgugggcgggggggcgggggcugggguggcuaacaugacagggagggaacaggagagagagaaacaacaaggccuggggcagaauccugaugaagugcagggcggcagaggguuuuaaauaaaacuguaucaaaaagugaaaaucagacacugagaagguguacaagaaaaacauuuuccauuucuaaaauuguaaaguccauguggcccaagauuacuuuucuucuuuuucucugaguugaaagaaguaaaaaucuacuccuguuuugcucucagcuacuucacaaagcguguagaaaguguagucauacaaaacacuuucuuuaccugugcagcauagcucacuuauuuaaaagugcagacuguauuaagaagugagcauaaagacguaucaaguccauaaucgcgugauauggacaguccugugagguaacagugcauucagaauuagcucacgaagccaacuucagaaccuacagaaaaguauaaguacaaaugcucaaagacaaaugagacaaaugcucaaagaaugggcccauccucacaggcccuuuaggggaggggucaugacaaaagcaccaggagcaccuggauguuguaacauuugagcaucagaaagacaaauggccguagagacccaaacacacgaagucacaggagauccacagaagugcucaagaaagucagaaaaaaaggcauuucacgaaucaccauugggaaagguuaacuaacuacucacuuugaaaagucacagcucaaaggaaaggauaaaacuauccugccuuucccagaggcacuauauuucagagaaaccaaacagucccaacugcugaguaaaacaagaguuuacagaagaaugucugcuaacaaucuacaugugacagaaucagaaacaccucauucacagcaagcccccaaauaaaacuaccaucuaggaccaggaucaucaacagguguuaaaugcauugcauuccaguccacagaaagaacauaaugcacacaaagaccagacugccaucuauuguauugaagcaacaaaauaugacuggggucccugaagugacacaagaagcauagaacaucauauauauucuagcccaaaauguuuaacuugaaucaacugggccuuucaguagaacuucucauuuaaaagaagcucaggggacaggggacuaagcugaaacaacacuauaagaaaguaccagacacaucuggaaggaggggcaucucugcaggacaagaggcuggucuggccaacagucagggaaagcacugcaaacccaaccacuagauguaacaggguccacaacaaauccuggcuuacauaaaccgaguguaaaaaauguucugggggucgggugugguggcucacacuuguaaucccagcacuuugggaggcugagguggcuggaucaucugaggucuggaguuugagaccagccuggccacauggugaaaccccaucucuacuaaaaauacaaaaacuagcugggcgugguggcgggugcucguaaucccagcuacaugggaggcugaggcaggagaauugcuugaaccagggaggcagagcuugcagugagccgagaucucaccacugcacugcagccuggaagacagagcgagaccccaucucaaaaaaaaaaaaaaaacaaaaaaaaaguucuggguaaaacugaagaaaucugaguauggacugcauauuaaauaaggugaauauguaauacaugacaagacagaacagagaaaagugaaaaaagcaagugguaaaauagcuaaucaauacaaucucaugguaagaacaauaaacacacagaaacagcuaacaauacgauguuaaugguggcaacuucugaaugacagaaauguggcauuuuaaauuucauuuucuaauuagaaacgguuaccugcauuuucaaacauucauagauuacaguauuauuuuuauaacaaugauuacuuuaaaaaaaaagcuacagaaaaauaguuaauacaauuaccuuuaacucuacgcuaguauguagcuuaccaagucaauucagaacuaacaagaaaaagacaaguuauuacaaauauuucuuuauuuuuauuuauuuauuucuuuuuuugagacggggucuugcucugucgcccaggcuggagugcaguggugcaaucucggcucacugccgccuccaccucccguguucaaccaauucuccugccuaagccuccccacuagcugggacuacaggcacaugccaccacgucgggcuaauuuuuguauuuuuaguagagacgggguuucaccauguuggccaggcuggucucaaucuccugaccucgugauccauccaccucggccucccaaagugcugggguuacagguaugagccaccgcaccuggccaaguuauuacaaagauuucuacugaaaauuagguuauuuucagaacuaucuuaaaagauaaaguauacaacacacagguccuuuauucugauuccaacaaagagcaaacauaucugaaacaaacagaaauaagcauaaacacuaggaaacacaaaggaacugucaguacaucuucaaaaccagcacacacaagaaucuaagcccaauuaaaagaugcugcuagagcagcagaaaugaauaaagaaggcuggaauuaacaagagccccacaguaauuaugaagucauuaucaccugauagaaagcaagaauucacuauuucaaaauagacaaaagaaguaagcuacuauuaaaaaggggcauccugccauauugaccuugugauaaauuugcacagggucuccugaagacuuuuucugagcacugaggcucucaugugugagaaaaccagugggacuuuucuacuggcucacuagugggaacuagugaaaggagaagguaaaacaacuaucaaaaugccagaguccaccgggagaggggaaugaccccuuaauacagugacauaagucaagccuucacagcaaggucugucuccacagucccaggcucuccagacccacucuagcaaugcuuaaaaauuccaagugucuuaaacauguucuagaacaaagcccaaauauauuuaaaggaaacaacaaacucuagcacccauaaacacaauguccaguguguagucaaaaacugccagucaaaaaacaaaaaacaaaaacuuccagucauacaaagcagcagaaaaauaugaccccaaaccaggagaacaacaugaacgcaacgagagaagugaaagaaagugaaagauggaugguaaauugcacuuccaugaaugaaaaaugcacuaacaugaaaaauauacugcaugggauuaagagcagauuagaugcugccgaagaaaagacugguaaaucugaagauaaagcaagagaaauacacaaaaugaaagagggaaugguuaaaaaaaaaaaaaaaaaaaaacugaaaaaaccccaacaacggcaucaaugagcuaugggacaguaucaaggagccuaauauacaggaguccccccuuaucugcaaaggacauguuccaagaccccaguggaugcugacacuguggacagugccaaacgcuacauauacuacguuuuuuccuauacagacauaccuacaauaaaauacaacuuauaaauuagauuugguacaggaaguugguacacgaagauauuaacaacaauaauaaacuagaacaauuguaacaauauacaguaauaaaaguuuugugaauguggucucucaaaguaucuuacauccugugcucacccuucuugugguggcaugcgaugacacgaugccuguguggcgccucacgugacaagaugaagacaacucagaaugccauggaacuuaaaacagaugaauuguuuauuucuggaauuuuccauauaauauuuucaaaccgugguugacuguggagagcaaaacugaggauacgggggaacuacuguguguguaauugaguaucagggacaaacgggugaggggaagaaaaacuaguugaagaaaugaugccacaaaauuuuccaaaucugaugagaacuauaaacccacaaaaucaagaagcucaccagacucuaagcaaaagacacacaaagaaaaccaaaccaaggcacauuauagucaaaguauuaaaaauacagagaggaacaaaaaugacagaaaacauauuguuggaaaaaaugccagccagaagacaagagugaaaucuuuaaaauauaaaaaggggaaaaaaauagcauuccacaccuagcaaaaaucucuuccuuccuaaaagacaacuuuuuuuuagagagaaaguauagugaguuaauuaagcacaucagcacuacaaaauaugaaguccuucaggaggcagaggaaaugacucgagauggaaauacacaucuacgcaaagggaugaagacuaucaucaaugacauguagaucaauauaauuuuuuucuuuuuuacaguuuaaaauaaaaguaacaacauauuguaagauuucuaacauguggaagaaaaaauguauaacaacaacagaacaaaggcuggaagaagaaauuaaagcauacuacucuaagguucuuauacuguagaagaaguaguaguauauuaagaaagucagagaaaaagauguauagcuaauaagccaguaauagagauaaaauggaauaaaaauauucaauccaaaagagagcagaaaaagagugaaaaauaaagaacagaugagacaaguaaaaaaacaaacaccgagaugggagauuuaaaaccaaccauaucaauaaucacauuaaauaaaaaggacuggcaaacuucuucuguaaaggacagguuaauaaacaguuuaggcuuugcugccuguagagucucucauacaacuacucaauccugccacaccgugcacaaaagcagccuuggacgauauauuaaacuaaugggaauagcuauuucaauaaacuucuuuuaauuaaaaaaauuuuuuuugagacagugucucacuuugucacccaagcuggagugcagugguguaaucauggcucauugcagccuugaacuccugggcucaagggauccucccaccucagccucccgaguaccugacacuaccagcgcacaccaccacaccuggcuauuuuuuuuuauuuuuuuuuugagacggagucucacucugucgcccaggcuggagugcaguggcacauucuaggcucacugcaagcuccaccucccagguucacgccauucuccugccucagccaccugaguagcugggacuacaggcacccgccaccaagccuggcuaauuuuuuguauuuuuaguagagaugggguugcaccauguuagccagaauggucucgaucuccugaccucgugauccgcccaccucggccucccaaagugcugggauuacaggcgugagccaccgcccccggccuauuuauuauuuuaaagacagagucuugcuauguugucccggcuggucuaaaacuccuggccucaagcaauacucccacuucagccucccaaagugcugggauuaccauugcaccuggcgccaauaaacuguauuuacaauaacagcaagcccaacuugacccaugggcuauaguuugccaaccccuggguccagauacucaaaaggcauaggcuaacacguuggguaacaaagcaagaccaauuacaugcugccuauuaaaacuuuaaauauaaagucauuauggauuaaagguuuaaaaauagaaaaauacaugccauguaugauacucugaaauauacauuuggucuucaucccuauuuccugacauacaacuccuaaaacccuuggaaucucccaagucagauuaacuuguaguugggccuauauauuaugaaauuuuugaaaauucaagcaauauagaaguuuuuauagaaaaauuagaaaauagacacagaaacaagaaaauaagacucacgcauaaaccauuacccugaaauaucuagaauuaagaguuauguuaauuuuugucuuuuugugugcuaaugagaugacuggugguuggcagccccuagguagcuucaggaugggggcuuaucaccaaggcaaguuuagagggugggggacuuucagcuaacuuccagggcagggagaagggcugaagguuaagaugauuuaaucaaucaugccugcauaaggaagccaccacaaaaacccaacaggauuggguuugguggucuucuggauagauggacucauggagguuccuggaggguugaguacccgcggagggccuggaagcucuagucccuuccccuauaccuugcccuauguaucucuuucacugugauucuuuauaacauccuuucuuugucauaaaccaguaaauauaaguaaguauuuccuugaguuugguaagccacucugacaaaguaaucaaauccaaggagggaguugugggaacaccaguuuauagccagucagucagaaacacagguaaaacaaccuggggcuagagcugccauaaagaaugauucauuccaucucaggaaaaaugagacagagagagagacagauuauuaggaacaacuguaugugaacaaacaaaauuaacuugauguaauggacaaauuccuagaaagacacuaauuaccuaaaacugauucauacccaugaagaaauagaaaaauuucaaauuucuguaacaagagacugaauucaucaaaaacuuccuaacagagaaaaguacagguacagguggcuucacuggugaauccuaaaaaauacuuaaaaggcugagcgugcuggcucaugccuguaaucccagcucuuugggacaccgagguggguaaaucauuugaggucaggagucugagaccagccuggccaacauggugaaaccccaccucuacuaaaaauacaaaaauuagcugggcauggugaugcacgccuguaaucccagcuacucgggaggcugaggcaggagaauggcuugaaccugggagguggagguugcagugagcugagaucaugccacugcacuccagccugggcgacagagcgagacucugucuccaaaaaaagaaaaaaaaaauuaaagaaagaacuaacaucaauuuuucucaaacucgccacaaaaaaauagaagaggaggggccaggcacaguggcucaggccuguaaucccagcacuuugggaggccgaggcgggcagaucaccugaggucgggaguucgagaccagccugaccaacaaggaaaaacccgucucuacuaaaaauagaaaaauuagcugggugugguggcgcaugccugaaucucagcuacucgggaggcugaggcaggauaaucgcuuggccugugaggcggagguugcggugagccaagauugcgccacugcacuccagccugggcaauaagaacgcaacucccucucaaaaaacaaaaaacaaaaaacaaaaaaaaagaggagggaacaacuucuaacucauucuugaagacagcauuucccugauacgagggccaaauaaaaacauuacaagaaaauuaaaaaccaauauuccuuaugaacacagaugaaaaauccuuaacaacauacuagcaaaccaaauucaacaguguauuaaaacaauuauacaccacgaccaagugagugcauuccaucccaagaaugcaaaggggcuucaacauaagaaaauauaucaauguaauucaccacauuaguagaaugaagcacgggggaaaaaaaucacaugguuaucacaauuggcacaaagaagggaucugauaaaauccaacagguuuucaugauuaaaaaaaaaaucacucagaaaacuaggaauugaagggacucuccucaacaagauaaagggcauuucugagaaacccauuaacaucauauucaacgguaaaagaccaaaaacucuccuccuaauaucaggaacaagacaaggacccccacuuucauugcugccacaagauauuauacuggacguucuaaacagaacaaugaggcaaaaaauaaaaggcaucguaacugaaaaauagaaguaaagccuuauuugcagaaugcaugauucuacauauagaaaaucccaaagaaucuacaagaaacuaccagagcuaaugacaaauucagcaaaguugcaugauucaagaucaauacacaaaaaucaguuguuucuauauaucugcacugaaaaaucugaacaggaaauuaugaacacaauuccacuuauaacaaaauaccuaugaguuuauuguaugaauuuaaccaaagaagugaaagccuuacacaaugaaacuacaaagcacugucgaaagaaauuaaaggccuaaagaaacagaguauguucacaaauaggaagacaauguuguuaagaugucaauaauccccaaaguaaugucaaacacaauccucaucaaaguucuaagagucuucuuugcagaaauggaaaagucuauccucauauucauaugaaauuacaaggggccccaaaaagccagaacaauacugaaauaaagaauacaguuggaagacucacacuucccaauuucaaaacuuacuauaaaacuuaccauuuguuuaaaucaaaacaguauaggugccgggcacaguggcucacaucuguaaucccagcacuucgggaggcugagguggguggaucacuugagguugggaguucaagaucagccuggccaacaucacaaaaccccgucucuacuaaaaauacaaaaauuagccagacauggugguaggcaccuguaaucucagcuacucgagaggcugaggcaagagaaucacuucuugaacccaggaggcagagguugcagugagccaagaucaugucacugcacuccaaccggggugacagagcaagacucagucucaaaaaaaaaaaccaguauaggauuguuauaaggauagacauauagaucaauggaauagaacugagaguacagaaauaaacccauauauccaggaccaacugauuuucaauaagggugccaaguccauucaauagggaacaaacagucucuagaagaaacggugcugaaacgacugaauuucuaucuacauguaagagaaugaaaccggacuccuacuuauacaauauauaagaauuaacucaaaauagaucagcgacuuaacaugagaacuacaaccauaaaacucuuaggaaaaacauaggagaaaauuuucaugaccuuggacuuggcaauggauucuuagauaugaaauaaaaaacaccaacaacaauagaaaaaauagauaaauuggacuucaucaaaauuaacaacuuuugugcaacaagauguuaucaagaaaguaaagacaaccuguagaagaaaauauaugcaaaucacguauuugauaacgguuuaauacccagaauaaggaaauuacuguauuucaacaacauaaagacaaacaacccaauuaaaaaacaggcaaagaaccugccaacaggcauuuuuccaaagaagauauacaaauggcuuauaagcacaugaaaagaugcugaaacucauuugucuacggaaaugcaaaucaaaaccaccaugagauuccacuuuacacuauuaggauggcaagugagggagggagaaaggaaaaggaagagggacagagggaaggaagcagagagggagaaaggaagggaagggaggaaggagaaaaaaguaaguguugguaaugaugugaacagauuuaauucuuguacacuucugguaggaauguaaaauggugcacuuucacugugaaaaguuuggcaguucuuugaaaaaguaaacagaauaacuauaugacccaaaaauuccacuccuagguauauacacccaaaauaacugaaaacagggacucaaacaaauacuugugcaccaauguucauugcagcauaauucacaagagacaaaaggugaaaucaauccaaguguccaccaacagaucgagacuauccuggccaacauggugaaaccccaucucuacuaaaaauacaaaaauuaguuggacuuggugguacgugccuguaaucccagcuacucaugaggcggaggcaggagaaucacuugaaccagggagucggagguugcagugagucagagaucgcagcacugcacuccagccuggugacagagugauuccaucucaaaaaaaaauaaaugaauaaaagaaaauaccagucaugggccagguguaguggcugacacauauaaucccaccacucugggaggccaagguaaguggaucgcuugagcccaggaguucaagaccagccugagcaacauggugaaaccucgacucaauaaaaaaauacaaaaaaaaauuacccagguguggugguaugcaccuauagugccagcuacucagaaagcugaguuaggaggaucaucugagcccaggaaaucaaggcugcagggagccaugauuguaccacugcacuccagccuggguaaaagagcgagacccugucucaaaaaaaaaaaaaaagaaaagaauauaccagucagggccagcuccaugggcaugcaacuagcacagcugcacaaagccugugcucaagggauuuaaugcucagugguaaccaucgugaauucuuaacaaucuaucuuugaauuuguguuuuauauuauaaaagugaacucugaugggacauggagcauaugccaagggcucggagccucagcucacacauggucugccuccuuuacccuuuccagggccaggucugauacugcucucugccuugcccucaccccaaagcccacuuggccucagccuuccucccaguccccaccccuauaaccacucucucacucacaucuuccaccugggacuguaccaaguugucaagagguccacauuccacuguagucccaaguugggggcuggcacagauuggggguugggggggaggugguugaaugcacuugcuguggcaucucagugugcagcaagguggcaaccauuccuguccugcacuggcagcaccaagguauguuuggcagguaacuugacaagggucccucgcccaucccagauccaauguuaauuucugaucagauguuaauuuuuauaaaaaacaacuccuaaagaguuucuaugugcagcaggguuuagauauaguuuagaaaauauuagauucguggaagagucuaccuuuccuagggcuuacuuuucucagccaggcuacugacaagaacagccuccuauuggagguguuaacucuugcuaagauugaagucacaugugcuguguaaaucuuacaagaaggcagagcgacauaccacucugaaaucugaaauacagagcaaggcagcagugaggacgauggacagguaguuuccuugguucuuucucucuacaggguugguucuccagucagcuuggauuuuuuuuuuuuuuuuuuuugagacggagucugucacucugucacccaggcuggaaugcaguggcgccaucucagcucacugcaagcuccgccuccuggguacaugccauucuccugccuaagccccccaagaggcuuccaauaaaucuccuuuuguguaaauuggucagauugguuucugcugcuugaaaacaaagaacucuaauugcugugguggauuaagaauaaacgcacuucacauggaaaaagguucucacuaugcgguucagugaaaaagaaacaacagcuggugcaguagcuuauacaauuugauuauauccuuuuaagaaaaaaaaugugaauauaucccguuuuuaaaaaucuauagauauauaacaacguuaauucuggauauuucaggguaaugguuuacgcgugagucuuacugucuuguuucugugucuguuuucucauuuuccuauaaaaaacuucuguauuacuugaauuuucaaaaauuucauuauaggcccaauuacaaauaaaauuuucuccccaaaauaguuuuacuaauucaacaguuaaucuaauuaacaguuuaagccauucaaaucucuuaauuuucccuugugaaguaccguaucucugcaucaguaaagucuugggaaaaaaaaguaaacagccgugaagaacuucagaagaguaaacacauucucaggcuaaggaagcaaaaguucacgagcaauguucaguuccagucaagucaaaaacaaaggacucuaggaugaaaaacuuuuguuguuacugacauguuacuuaaaaauaaaacaaauuuccuaacagaauuccaccuuaaaagauugaauugaccucaaaaggagacuaaagagacaugacaaccaaauacauaccugauccuagacuacauuuauuaaugaaggggaaagcaaggcuauaaaugauuagacgagacaaaaaugucauuaccaaugacuacaaggauauauaagaacuuuuuuuuuuuuugagacagagucucacucacucugucacccaggcuggagugcaguggugcuaucucggcucacugcaacuucugccacccagguucaagcaauucuugugucucagccuccugaguagcugcaacuacaggcgcccgccaccacacccagcuaauuuauguauuuucaguagagacaggguuucaccauguuguuggccaggcuggucucgaacuccugaccucaaaugauccauccaccucagccucccaaagugcugagauuacaggcgugagccaccaugcccggccaggauauacaacaacuuuuauuuaacauuguuuaaaacuauauaugccaacuauguauucucaauguuauaaggacagacaaaauuuuaggaaaacuuuucugagaucacauauacaacuacacaaaucaggauuaaaaaaaacccuaucauuucauuuaugcaugcccauuuguugauugcucuaacaauacugggaaauuaaguuaguuuucuuuugcuaaaauaacaaaucacauuucccucaaacaucaaaaacaauuuuuuaguaacuaaugacuagaaaaauccccuccuuaaaguagcuuaaaaaccugaacagcuuaaauagcucacuuuaugucauaaagacauaaauaaguacuaaugaggcuuucacacagccaucugaaguauaacagcaauuuccauuuugaggaaucuuacccacucuucaaaaacccgaguucaaaucucaccuccagauuccaguuggcuacuuacguccucuuaccuucaguaacuccuugcagcugucaagcccaauauccacaagaauaccuuucaccuuuuuucgcaccuuucugauguugucaagauuuuccacaggaauuugaaacauuuuugaaauuuuccuuaaaaggaaagaaaacaaaacuguaauaaguacauguauauaauacacaaaaauacauuuuuugacaggguugguaaaacacuaggaauagaguauaauuuucaacaaauuguuguagaacgagugaacauucauaugcaaaugaaugagguugaccucuuccuuacaccauauacaaaaauuaacucaaaaguggaucacacaccuguauguaagaccuaaaacuauaaaacucuuauaagaaaacguaagcauaaacauugaugaccuuagauucggcaaggaauuccuagauaggacaccaaaaagcaccaguaaugaaagaaaaaauagguauggacuucaccaaaauuaaaaauuuuuaugcuucaaaggacaccaucaaaaaagcaaaaaacccacaaaacgggagaaaauauuugcaaaccauuauuccuuucuaauaaggaacuuauaugcagaauacagauaacucuuguaucucaauaauuaaaacacagauaacccaguuuacaaaugggcaaaggaucauagacacuucuccaaagaaaaauguccacuaagguacaugaaaagaugcucaggcagggaacaguggcucacgccuguaauuccagcagcucaggaggcugagguacacagaucaggcagacuguuugagcucaggaguugaagaccagccagggcaacauggugaaacccugccucuacaaaaaauacaaaaauuagccaggcauccuggugcgcaccuguagucccagcuauccaggaggcugaggugaggggaucacccgagcccaggaggucaaggcugcagugagucugaucacgccacuauauuccagccugagcaacagagugagacccuaucuuaaaacaaaacaaaaaaaaaugcucaacaucauuagccauuuggagaaaugcaaaucaaaaccacaaagagauacugugcccaccaggauaucuauaaagaaaaaaaaaaggaaacguguuggcaaggacguggagaaauuggaacucucauacauuccuaauaguaauguauaccagugcagccagucuucaugugugccugaaaacagucuggcugucccacaaaagauuaaaaauauagguaacauaugaaccagcaauuccacucaagagaaaagcauacauccacccaaaaacuuauauaaggauguucaugacaacacuauucagucaccaaaauguguaaacaaaccaaaugccccugcauuggggcauuugauaaauaaacugaugacuggauaaauaaaauaugacauauccauacaauagauuauuuggccauaaaagaaaugaaauacauacaugcuacaauauggacaaacuuuggaaauaugcuaaguaaaagaagccagacacaaggaccacauauuguaugauucuauuuaugugaaguguccagaacaggcaaauccauagaaagcacaacagugggccgagugcaguggcucacaccuguaaucccagcacuuugggaggccaagguggguggaucaccugaggucaggaguucaagaccagccuggccaacauggugaagccccaucucuacuaaaaauacaaaaaauuagcugggcaccuguaaucucggcuacucgggaggcugaggcaagagaauugcuugacccugggagacagagguugcagugagccgaggucgcgccacugcacuccacccugaccaguaagagcaaaacuccguccccagaaaaaaaaagcacaacagugggugccagggcugggagaacugggaagugauggaagcagggcuucuucguucugaacucaacuguggugauguauacgcaaugugaaugagcccacagccauucacuguacacuucaaacuggugaauuguaugguacauaaauuauaucucaagcuguuuaaaacaauaucuaaaaaggcacaaaauuaaaauaaacccuguaguacuugaccagacuagggguuacugaagugaacucauuguuuucaacacacagauagaagaauagagauaguuugagaguguguguccacauacacacauacauuccauagcucugcccacugagagugccuggaugcaguuauacaccccaguagcagugggcacaacuagggcucaaaccugaauuccuaaauaccgcuuuccuuuaaaaagaacccuaggaaaaauggcuggagcaugguaaagacaagaugagccuagaacauccugugccggaauauaaagcaguugcucaaugaggcaugucaacagaacacagaaguaaccagcuugaaagggcucccauaggccagauacgagacaaugugggcauauaucaaguaacagauacaaccuguggcaaagugaauuuuccaaacacacaauaccuuccaacccacaugcucuuacaauacggcccuaacacuccucccaaaaguggcagcaucuaaugcccccuccugaccuuugggcagaacuuuguggcugccuugaccaaucaaguauggaggaaauaaugccaugagaauuccaagacuagaucauaaaaaugccacauaccucucucaggaugaucaugcccagaaucuagauaccacauguguagaaagugccaacuagcccacagagacaccagguagagguguuccacaucaacuaccagcaugggagugaagaugccucuugaggauuccagcccuagcugucaagucacccccugccuuugagucuucccagaugaggcccagacacuguggaccagaaacaaaccaucucccuucccugucugaauagaacugacccagagaacugaugcgcuucuuaaauaaaaugucuuacuccaguaaguuuggggugguuugguauacagugauaaucuauauaguuauauagacuauaacccgcucgaauguagugauuuccugauuuugaugguuuuguuauggauauguaggagaauguucuuguuuguaguauuuaggguaauguggcaacuuuuuuggcaacuuauucucaagugauucagggaaaaaaguuauuuguacuauacuuguaacuuuccuaaaaaucugccaacuauuccaaaauuuaaauguguaggcuauaaaagcuaaaauauauaucagucaaacucaaguggcaaauauuugguuauucaacuuuaauaauaaagaaaugccauuuaaaaugucaaauuuuuauuaucaaaacaguaacuauuaagauuacuaacaucuggugguaguaaaaguagaaaaauuuuaauuuuuaugcuuuuacaggguaauuuggcaauaccucucaagaucuuuuuuuucuuuuuuuuuuuuugagacagggucuugcuccuucacccaggcuggaguauaguggcuugauuacagcucacugcagccucaaccucccaaccucaagcaauccuccugccucaaccucaugaguagcuuggacuaccgauguaugccaccacaccuggcuaacuuuuuuuuauuuuuugguagagacagggucucccuauguuacccaggcuggucuugaacuccugagcucaagcaauccuccccgucagccucucaaaguacggggauuacaggcaugaaccaccaugcccagcucucucaugauuuuuaaggacaauuucugaguaagcaauucuacuucuacauuccucucuuguauccaccacccaaggacaggcuuagugaucccuccuaggacuuaguaccauaaccacauaccacuccacugcacucgacucaccauguugcaauuaucuacuuauauauccauuucuccuauugggcugaacuacuccagggcagaaaucauguuauauuugcuugagagggucccaucacagagcacaguacguagcaaauguucauuaaaugaacaaaagauauaaaauaaaacaggauaagaaccguaagauaugcagaaagugcuaggagguucuaaagaggacauggcuauggaaagcuggugcccaagacauacaaggugaauaaauuagcaucaaaaaauuauugagguaaagaaggaaaagucugaauuuauuuggcaaaaguaaaaccaaaaagguggacuggaaucaaacugggagaggagugggaggcagaaaggguuaacauauaauagggagaaauuuuugguggguaacaagcaaacaccaaguuuuugagaagcuguuuugaagcggauaaauuucuuuucaaaguuaucuaugugaaaaauguauccuggucucagcaaaaggagagauuuaaggaucauuagcauuguagaacugggaggauaaaaauuuaaaaauuuucuuuauaaaauuuuaaguuuaaaaauuuucuuuaauaaaaugcacugauuuggguucuagccuucaaaagcuuacacucucacacaagagcugccauaaccucauuaugcauuucuaaacacuaagcucaaggucacuuucuggcccaguccagcuucuuuggucagagcaaaacucaacgaaaauuuuguuagcugcuuuccagggacucuaucagacuugauuucauuuccuccuuaaaguuccacuauccucucuauccucugggguucuucuccaaaagcuggcugacaaacaguguugucuaaaguagggaccaucauccauauguaucugaaacagggaagcuaaauuuacugcuuccaagaaaaucucaacucacacagccagagcugaucuuaucacagaguuuugagaagccugggauacaaagacugguggacuuuuaaaagcagagugauuggggauuggcugauucauguaagcaugguuguacauacaugaaccucagaaagggguuacuaaaaugaggcucucagagauugggcaggggucugugguuacuuguucaaggcuugggacuagggccaaggaguugucacuuuuuuauuuuuuucccuugaauuugaaaaauaggaacuuuuuauucucaaaugaaagugcuuccauuccuucaucguuauuguggcccuucuaaacaaaacaaaacacaagcacacaaauaccuuuucauuuaaaaaaaggagggggaaaaguuccccccuccuuuuuuuuuuuguuuagcaguuuccuaacugcuuuagggaaaccaacaaaggauaaaaaauaaaaugcaaguaaauuacagguuucauaacuguugccaaccacuuuggggaugggaagcugacuuuuacccauaauuuauccauucuaagcuaccacaauuuauucauucuuagauccauucuuauagcauaauuuaucaauccuaagauaaaauauuccauguaaaaugcccaguggaugaauuaacuaugaaauaguucaauguuuucauauuuauagauccucuauagauacuguucuccauagaaucuuagagcucaguaaaaucuguauuuucaccauuagaaaagagcaggcuaacuggggcggccaacuauuuccacaucaugcaccaaccuaucaauuucaauucaaaauaaaucucaauuccuaauguuuaggguaggcauggaacuaccauaaaauuccacugauaugcacaagaaaauauuauuucccaaaaggguacauaaaggacuucucuggggauuuuuuaguauaaugaucucguaaggauauucuauuauagaaaaaaaaauacauucuaaaagaaaauguuggccgggugcaacggcucacaccuguaaucccagcacuuuggaaggcuaaggcgggcagaucaccugaggucaggaguuggagaccagccugaccaauauggugaaacccugucucuacuaaaaauuaccaaaaaauuggcuggguccuacucgggacgcugaggcaggagaaucgcuugaacccgggagacagagguugcagugagccgagaucacaccacugcacuccagccugggcgacagggcaaaacuccgucucaaaaaaaaaaaaaaaaaugucauucagguaauacaguaauaaacaauacuuuuuaagccacagaacuuuuuuuuaguuccugugaaaucgcacaaaacgauggucaccaaaaaggauucuggaguugugugcccggguuuacaucagcuccaccauuuaugagcuguguaaucuucaggaaaucacuuacucucuccaggccucagcuggcucuucuguaaaacagggcgaguaugaccuaauucacagaguaguuaugaggauaaaugaguuaauacaugcaaaacagcacauaagcacugaguuugcuauuaauuaacuccaaaaaacuaaaugaaaugucccaacuauuggaauacaggacuuuuuaaaaagcaacuuuaaaaacacagaauacuuggaucauauauucagcagaucuggguucaaaucacugggagauaccuguuuccaccuauguaacacauugcccuaacaggucuaggauagccagaggaugaagggcagggcagaaaccaaguuugcaauaugcuauuggugaacuuaugagggcaaucauaaauuaaccaacagcauauugcaaacuuggguucaaauuaaaaacgugucucccaaaucccagaaucucuucagcuaaaaaucuuagcauagcugucaucuucccccauaaacagugaucaacuccuuucagacauguccuaacccucacuguuccuccccucaacuagagggccgguaggacaaccucuugucucaucuucacucuuguacuuccuuucuuaacacacaucugucacuucauguuuaaggacgacgggcucaaugcugucuucgcagugaaguccuaacuccaaccgaaauuuaaccgaaauauuaauacacacucauacauggccaacucuccaagaacaucuuuaaauaaguuacacauacauuaccgacuuccaaauacagcugaacauguacuuuacacaacucuuuuuacaugugguccucucucccacuaaugcuccucacccccaaaaaugguacccagacuccaaacccccucuuuugauaaaggcucugcguggcagaugcccacaguacucuacaaacugcugccccacuugccaaucugcauugucaguuaccugcuuaccaguuucuccucccccaccccacuccuccacagccaguauauuccucaagaucccaagaggcagugauuacccgugcaaauagaguaaguuuuaagcacgcaggcaagucuucuguucaaauaaacuacuuaaaauaucuaauuauuucucauucugcaucuguacaguauuuaaaagggcaguuaaaauuaacauuccaaagucaacuguaguagaaauuuuguaaacggaaucuauuucaaugcaaccagcaacggcagaugaaaaguaauguuaaagucaacaucugcauaucaauuauugauauucgcaucaaaagcucaacgaugaagaaacagggccccguuaucagcuguucuucaaaccuuucuagggaaaaaaaaaccugggcagauuuaggugucaccgucagcuccugaccuacaucugccgucacucaaggcuccuccagagagaagcuuccaggagaacccggucucggggaugcggcgggcgggccagcgggcggggcguuucuggaguccuuacaggggucgccacagcuccuugcccccucucuucuucuccauccccguucccucucccucuacuccucgcucccuucaccagccccccucucucccucgguccccguccucgucuuuccccuauuccuacucuccccucagguccccauccccuucuccgcccucccggggcggcccccgcucccacgugaccggcggcgggcggggcgggccgcgggcgcgucgggggucgacgggcgccguucgggccgcgaacccgcgcccugagaacgucccgggauucccgaggcggccacgggcggcgcgagggcaggcggcgggcgugggugugggcuggguaccggcgggggcggggcucggaggggaccagacuggggcgggggccaggaccggggcagggggcgucgccgcgcgggcccgcgccgggccgggccguaccuaccgcuuggcgcccgaggagcaccgcgucuccgcugcugccucucgcagggcugccgcgucuuccgccgagcgcagccgcgucccguggggccgccugcgcccgcccgcgccuccgccccgcgcggcgggacccccgccucagcgcgcgcccacccccagcgcgacugguccccuccucccgcgcagccagaaagagaaaauggcgcucgauuggccucaggaagugacguuggcccucauuugcauguaggcgcagccagccaaugagagcagagugugcuugggggccccuggcacuucccacaggccccccggggccccugccuaaagcuggacuggaggcucugggguggcaguggggggccccuguuggacccccugacucccuucugucccagggaacugcccugccagcuccuuuccacaucugugcaaacucucgu

SEQ ID NO: 192765 - RNA, 16307 nt, Homo sapiens
aucgccccgcccacacgccgccugccaggcgugagucuuccucccgcucugcgccgucgccccgcccacacgccgccacccucgcgucaguugucgcuccgcgccugcgcccguugucucccugcucgcuccgggucccggcgccgcgccaugugggcugcggcgggcgggcuguggcgcucccgcgcgggucuccgggcccuguuccguagccgcgaugcugcgcuauuuccaggcugcgagcggggacuucacugcucugcugucuccugcaagaacuggcucaagaaauuugccucgaaaaccaaguaaugcggcgggggcggugucccugggcgcgguauucccuagggggcgguguccccggguugcgguguccgcucauccgcguucuugcgcccaugcggccuagcucgccaguuccugccuccuggggucugcagcaguucuagcucucacugucagcauuugcagcuuuuguguucguggacgugugucggguuaagaaaacaaagugacaauguguguuuauuuugauucuugucaccagacguauuuuucagaagauuaguuucagaaaaugaggaaaaaugaaaaaauauaagaauuuccuugcuaauguugacuuucugugugaauuugaagacuaaagcuugucaugauaauuaguguuuuuaaauuaugaaagauaaguacaauaaaauacauugacuuuucacacugcuuuuaguucuucuaaguaugguaggugguuguauguuuucuacuuuaauacacuacuuuuaaagacaguuuuagacccugcagaaaaauugcaaaaauaguaccgcguuccuguguccuggcacccagcucccccuguguuagcgucggacuuuagcuuccaacguguuccaguuaaugagccgauauugauaagaguguugcuaacugaagcucauacuuuauucacuuuuccuugguucugccugcugucccuuccugucccaggugcccacccaagguccacguuacauugaauugucuuguuuccuuaggcugggguagugucccagacugucccugguuuugauggcugugccaguuuugagggguacuggucaggugcuuugcaggaugccucucuguuggaaugugccuguuuuuuuaaugcuuagacguggauuauggcuuuuggggaggaagacuacagagguaaaggccauucucaucgcaccguauccaggguccacgcuggccgugauccccugcaugaggugcuugccagguuucucuaccguaaaguuacucuuuuugcccccuuuccuuacuguacucugggagaaagucgcugugugcagcccaugccuaaugaguggggaauuuugcucauaagugguuugcauucugcacaagggauaugucucuucaccccauguauuaauucauucauaucaccaagaacucauggguuauaaucccguguuacuuaguuuuguucgaauguuuccagcucaggcccuuaggagcucacuaagcuccuauguccuguuugcauacccugucauugugggguuuugcuggguucuguguguguuaaacacuuuccuacuuucuggcacuacaagauacuccaggcucaucuuguguguuucguaccacagcccuaaaaucagccauuucuccaagaagcccucguuccuuuuauuggagagagagauuagaaaccaugggugcuggguguguucauugcuucuggggugucugucuuuugggccaucucaucugacgaaaggauauauguguuucuacuaacccuuguguaaauaugcaccuauaaacauuuccguguauagccaucugucuccaacuccagacguacuguguggaucauucuagccuccucuccuugcugaucuguaagucgcacuccaauggugagcguggcucccaccauccauuugcuuaauuguucagucucagucuaugccuauaacaguaucugaauccuuuacuugaacuuccaugggaaacaucuuuaucaauuagcguauaguguuuaugugcaguuugguaggugucuuuuuaagauccucucucuaaccuugggacuagaaguagaauuuagguaaaaauuaugagguugaauuaaaaccaucuucagccucuuccccacaacccauguuguuaucaauuaaauucugaaauuuuuuaagauguccaguaauguaacaucuaaguuuagcccccuauaaacaguuaugguaucauaaccucuuaaauuagcuuauguaacuuuuugacuuugccaucacuaacauaaugcuuauuuucuccccaaagaaaaaagguuugguaugaaaguccuuccuuggguucucacucggugaguauaagccaugagccacuuuauaaucuugaugggagugaggguuuaaaaguuggcaaaacucuuaccuggaggucuuuccauuucuguauuggaggggauagugucuauguggaugcgacuggaugccauuggcaacauggaguuuugaucuuuucaaaaaaaaauguacugacauuaauguuuucuggaaagucauaucuuuuaucaaauuauaauaugguaauauccauucaguuuuuaguguguguguacuguaaaaguuuauacaauauauggcucccauucugaaaaauaaauacaucacguuuccaaaaaauuacugaauuauucccuuuagcacggugaacuuuaugguaugugaauuauaucucaacaaaaacuuuuuuugagaaaauauuuacuggcaguacuuuuaaucuuggaggguuaccagguaaaauuuaaaaggaucccgguuuauaaaacuuuaucuuaaugaaagcugaggcagcugagagugauagcugcuguugaucugguugcccauccagcccucccccagccccugcugugugacuuggugaguuuggaguuguaacgcugcccuuggggugugcucuucuuccugauggagacuuacaaaccauccaaguuggaauuccucaugaggagcaccucaaagaaaaccaggaaggaagaccaugcgcgccugagggcccugaacggccuccucuauaaggcacugacagaccugcuguguaccccugaagugagucaggagcuguaugaccuuaacguggagcucuccaagguaggcuguguggccaaagagaagaaauggguugagacagcaggccuggcacuuacuuuaccuggcccagucuugccugacaauuaaaaaaagacgcuuuagacugggcgcgguggcucacgccuguaauccuagcacuuugggaggcugaggcgggcggaucacgaggccaggagauugagacgauccuggcuaacacagugaaaucccaucuccacuaaaaauacaaaaacuuagccgggcaugguggcgggcgccuguagucccagcuacucgggcggcugaggcaggagaaucgcuugaacccaggaggcggagguugcagugagcugaggccgcgccucugcacuccacccugggugacagagcgagacuccaucucaaaaaaaaaaaaagccacuuuagcacuuaugaagucuuaguucuggguugcagaaauagaaaugaugcucagucuggucauuggagcccuggagacagauggugagugucugugcugugcagaggcagaugucucacugcaaggcgggaguccugugaccaaacagcaccuggcacauugucagauaguagaaggucuaagccugccgugggaagaggaugcaucugcauguaccucaguacagagguacaggagaugacuuccucugacccacucagugaguuguaaggagaaaaggcagcaucgagcauuuuugauuagugucucagggcaaguggcugugaggcaagcguggggucaggguuccgguuugguucugcaaaccaggugguuugguuugcggguccuggugaagagaggagggagguuuugguuucuggggcccuacuucaccuggggacauggugcggcagcaggagguggccuccagcagcaugccagagcccuggcuugggugggaggggcgucugcagcugucguuuucaucuccuggauguuguuugucuugaaaacccauguaagcuaaaaagugaccuguggaggggcggggucucagguuucccugacuccagacuucucagccugccgagcguacuggaagacaacgcucucugcugagcagaacgcacacauggaggcuguccugcagagaagugccgcgcacaugaggugaugaccuuugcuuucugaauguacuugcuuuuugcucauacccuaaauuucucagcuguuucacuuguagguggacuugaacuuuucauugaguauuuuugcuuuuaaagaaaauuuuggaggcauuuucuugaaguucauaguauaauuugcauuuuuguauaagcuauaauguagguuagcauuuauuaaagugugccaggaucacuagggaucuggagauccugucagggaguucauuaggguaagacguuauuucaccucuccugcuguguugacauuugcacugaggguacagaaaccaugagggaagacugcuggugccaugcugccagccagugcuguaggggcgccaugccacaugccuagaguaaaagacaauguuacuuuuacuuaagaauaucccagaugaggcuggacauggugccucucaccuguaauccccgcaacucgggaugccgaggcgggaggaucacuugaggccaggaguucaggaccagucugggcaagauggcgagacccugucucuacaaaaaauuaaaaaauuaaccaggcacaguggcagcacacgcauauagucccaccuacucaggaggcugaggugggagguauccccuggauuccuaucagcccaggaauuugagguggcagugagccguguuaauguaccugcauuccagccugggcaacggagcaagacccuguuucucaaagaaaaauuaaaaaauccgagacaguuuaucaaaaauuauuaauuguauuaaaucuugacccuugagcaugccuuuuucauauuuuuuguaaugggaaguacauguaaaucaccugcugucuggagaaugcugaacagaaaagcaucagugagcagacuguuuagguuuggguguuuggcagacauucuuucaaaaauaagcgagugaaccuaccacuccggagcaaacaacagaccauaucuguugccagugauaaaauuuaagcuuucaagugaaaaucagaauuuuaggaaacuuguauucaccacugugagcuugacaacuucuagguacuugagacucuucugaugagauuggcagcgaccuuaacaaacgugcuguuguaugauaaacugugucaaugcuuuuaaaaucugcauaacuaggugagcuguuguuuuccaaaugaccagugcaugagguuacaaaaccauacgcugagagaucaauucaaagugugagccagauggugaguuuuaauguagcagagugugacagguugguugggugugguuucagauuccucauugcaacuauuuauauguuuauuuauuugagauggagucuugcucugucgcccaggcuggagggcaguggagugauacuggcucacugcaaccucugccucccggguucaagugauucucaugccucagccuccugaguagcugggguuacagacgcccgccaccaugcccagcuaauuuuuguauuuuuaguagagaugagguuucacuauauuggccaggccgggacaacugaccuuuaauaaaguacauuuguugaauuuuugugacaaagaagauccauacuuuucucauggcuguuaaauucugucuuuuccaacacauaacugggaggccugaauuuuuuuuuuuuuuuuuuugcuuuuuuugagacaggaucucauucugucucccaggcuggagugcagagacacaaucuuggcuccugcagccucaaccucccaggcucaagugaucuuccugccucagcuucccauacagcuggaagcacaggugcaugccaccacacuuggcuaauuuuguauuuuuuguagagauaggaucucucuauguugucuaggcuggucuccaacuccugggcuuaagcgauccucuggccugagccucccaaaguguugagauuacaggcaugagcuacugcgcuggcucuucuuguauuucagugagaggaaggacagagugcagaagcagcagugagaucccagcugucuuccaugaagcuggccuuggagaauuugcaaauacauaaacaauuccaugcuuuucauugauuuugugggggggaguguauauauauauuuuuuguuaaaaaugucuauguaagcauuuaguggguuuuuaagcgacuuuaaaaagacguagcuuuuagaguucucaguuuuaguuuguaguauaguaaauauugauagauagaacccacauaaacaaaugcucuuugggaucuucaguaauuuuuaagaauguaaaggauccugggaccaacaauuuugggaauugcugagcuggaugauaauaaagaaauuauucaguuuccuccucaguuuuaaaaaaugcagaaauccaaauccagcucacuguccagcucucucagaacuggaauuccuccuuucugccucccuucucaucaugccccauguuuaggguggggacagacguagaaaagguggccgugugugggcuucguuccaggcacccugccuggcuucccugcaucauuaccacacacgaugaugcccaggggucugugaaacugcauaucagagaaugcuuauuucuuacuguuuaacaaaagcaagaaaaugagagauuauugacaaguguugaaacagcauuguuuucugauuuuuagguaucagaaaauucaguugagcugaaugucccucuucccaacuccugcggucacccaagauuuagggucaccguuuuccauagcuguguaccaaagaucuguggucacggcuuucgcugguuauaugugccgugccuacauuggcccuaggucuguauuaugugaugugcaugauacaaauaucacuucugugucuaauaucugggaaccugaggguugugucgugccagggcguguccacugggcacaggaggacaggcuguuagugcacagacccuggagcccaaggcuacggcgaugaguucagaucagguuauuuguacagaucgcacaaguugcguugagaaaagucaaggcaauugcaguuaugaugcauuuugcaucccuuuuuugaugugguaguugacuaaagaugacucuucugggcugagguuuucauuuuugaguaauacgauaaaucucacuccugccucuuuuuuuuuuuuuucuuuuuuuuugagaccgagucuuguucuuucacccaggccggaguguaguggcacuaucuuggcucacugcaaguuccgccucccggguucaggccauucuucugccucagccucccgaguagcugggacuacaggugccugccgccacgccuggcuaauuuuuuguauuuuuaguagagacgggguuucaccauguuagccaggauggucucgaucuccugaccucgugauccgcccgccucggccucccaaagugcugggauuacaggcgugagccaccgcgcccggccucucacuccugccucuugguuacaucuugaaucauauguucagcacugucacgccucuccacugagugucacggcacagcugugagggucugugcguucugucuccuaggcaccuuuugaugucccagcagacccugaggaaugugccaccgauaguguuuguucaagacaagggaaaugcagcucuagcugagguaagguuuucaaaaaaacuuuuuaaaauuuaaaaauuuuuauuuuuuuaauuagagacagagucuugcuauauuguccaggcuagucuugaacuccuggccucaagggauccuucugucucagccucccaaagugcugggauuuauaggugugagccaccgggcccagguaauaauuaacuuuuuauaacauaaacgcuuauaugaauaaaguuuuaaauuuaaguuuuaaauccugaaaagauaauguacaguuaaaaaagagaagaggccaggugcaguggcucaagccuguaaucccagcacuuugggaggccgaggcagguggaucacaaggucaggaguuagagacuagccuggccaauacggugaaacccugucucuacuaaaaauacaaaaaaauuagcuaggugugguggcgugcgcccguagucucagcugcucgggaggcugaggcagaagaaucaguugaaccgggaaggcggagguugcagugagccgagauugugccacugcacuccaggcagcagagugagagacuccgugucaaaaaaaaaaaagagaagaaaccacugagaagggaacaaaugaaaaguaaugaaagaaaggugcaaaugaaaaggcugucccuuucuccugugccccuguucccagccagguccccagaaguaguugcuguuucugguuuuaauuuuuuuaugcuuaucacuguagcucuaacuaggguaugaacucaacacggccagaguugcccucccacgccugucucccccucccaccucucgaaauggaucaguccacuuucguuucacauuauuggggcuuaugagacuuaggucuguccuguaaccuuaagugcuuuuauuaucauuuuccuugcuuuagagauggguuagcuauaaagauuaaaaacauguaaauauauacuucucuggguggugguuaccuggcaguuauuaagauauguuauaccuucaaaaagucagucaaaaaucagcgaauagcguuugcaguauuauagguaacuguuguucaguauaggaccagacagcauuuggauccacagaagaaaaagauccaguuugacauuuuugguuuucguuaaucaguguguagguaacacuaaaaacauuguacaaguaauaagcuugacagauucgugauuucccuugcuagaaaaagaaacgaaggagugaaguuauagucccugccguaaggaaucagggacaguucaggucauggcagugugcugugagggcaugagcaagguguucccuggggaggacgugccagucucucugucugagcucagcacuccaggcuccugucucuggggagggaggucccaucaggugguguggguuccagaacagucacuggacaggggagagugcaugcuaugcuuggagcaggaugaggacacccccggaggcaggggauaggcaggcaggguucggguggaaugcauuguccagcagggcuugugggccauugccaugguguggguggcaucccaugagccuggcugaggagcaguuuucuuuuguaguuuaggcucccagcauugugacuguccgcaucaucuuuuaccuugucuuguugggaggcuuuugucccccaaggcacacaaauucuguggcaaaacugaagcauuuugcaaaacuaccuuagaaaccaguuaaugguuaguuaguuaauucaacuaacgcuuaacugguuucuucauaaauuugacuaacaagucuaaaauguaguuuuuaaaaagccucacuucguuaucagagaaaauguguuauguuaaaguaacaguaagguauuugaaagcacaggcuacugaacagguccuaguauuugggaagagucgguggaaggaauugugcaaagucugaucaaaagcucugcagucaacaaugcugguguuacguggagcccggcuguaaguauggugguggggauguggcuaacggguuuacccucuguguuccucuguagcuugaucaguuacuggcagucgcagacuuuggaccccgggaugaaagagacaacuuuguacaaaaugauuucaggugacgcauguggacauauguuuugauucccugggguacauuccuggguguggaaucaccauuuuccagagcagcugcccagcgccacaucccgaguagccugcaugauccccauggcacuugccuccagggccggcaauccacauucacaggccugugcuguggccuggccacguuuacacagugagggccucaggggccaccagaggugccugccauaacuccugcagugaggagagggccucuuguccucuucguucauucaacacauuguuuauugagugcccacugugugccaagcccuggucaagcacuuaggaugcagcugucuuuggaaccugcguuucauuaggggaggccgacaggaagcaguaaacaucacagauggguguuaggaggggaguagagggagguggggcuugggagagcaggucgggggcguggaaguuuggccugugcauguacacacacauacacaucuuuuccaaacauguagugccugacagagccugcaggucuugggguguuuguggggggccccauuccaagcccacagcugcuagagcaggccuugccugggggccuuagacagcagcgucaacaucgccuggcaccugccagagucggguuuaaccagccugccaggugcaucccugagcuggaagcaaagcuccacgcuguagcaggccuggccugaccgugucagcaaggggcagugugggggcggcagggcagggagcugagcccaggguguggaaacuuuccaaaguggagccuuggaggauacaggggcugugacguggccuugacuaggugcuguucaccaagaauagacucuucaugaaggcgaaugaguggcaggucugauaggccucaccugcgauucugccaguugaacuggcccgaggcacuggccaugcuuagagaaaaaaguugcaaacgcuuuuuuuuuuuuuuuugaggcagagucucacucugucgcccagguuagagugcagcggcgugaucuuggcucacugcaaugucugccucuuggguucaggcgauccuccugccucagccuccugcguagcugggauuacaggcgagcgccaccacgcccagcuaauuuuuguauuuuuaguagagacaggguuucaccauguuggccaggcuggucuugcacuccugaccucgugauccgcccgccucagccucgcacagugcugggauuacagaugugagccaccgugcccggcgcaaaugcauuuauugcauacaggacggugcaccuggacugugcuggccgaaugcuucugacacuggagaaggcggaaaccaaagcccaccuuccuucacuccugucuccaguuacccucagauagacguuugggaggguucucaggcgaguagauguaggaagugugaugugcuguuguguuguggcgacgacacuguggacuaggggcaugguuugugcuuggugugaagccucuucuuccuucccagggacccugaugccccacaacccugcggcaccacagagccgaccacaagcuccagucugugugggaucgaucaugaggcgcucaacaagcagauuauggaguacaaaaggaggaaagauaaagggcucgggggccugguguggcaggggcagguggcugagcugacaacgcagaugaaaaagggaaggaagagggccaagccccgccuggagcaggacagcucccucaagaguuaccugucaggcgaggagguugaagaugaccuggaccugguuggugccccggaguacgaaugcuaugccccggacacagaggaguuggaggcagagagaggagguggcagaacagaggauggccacagcugcggagcaagcagggaguagauggagaggcucugcccaucccacauuugcagggaaaagcauuggcacgcaacgcagcauguggcuucauugaggcaguugauggaguuaaaccaucugcucuucugcuacuucaacauuuucuagcuuuuccguguaucuaaacacaauuugcuacacaagucacuguuuuuuuuuccaugcacuguguguaauuuaaaaauuaaauggccaucuuaucacagauucucacaaaaagaaaaugguaaaauagugucucugagaugcuggcauggccaccuccaccugcagagcccugccaggugccagugagugcuuggcccgaggggucaggccacagcaguggccgggguaagaacugaaccugcaaaccuggggagaacagaggguccccagagccucccaacccccuggagcugggcuccgucccuggggcugcugggcuggcacguggcgccgggggcuccaucccuggggcugcugggucggcacguggcgccgggggcuccgucccugacuggccucuucacagcuuugugcagcaggcuccaccuucugguucaggccaagguugggcagaaagugaguuggguuugcuggggcuuccugggcgaccccggcucugaccgugguuccaucacgccugaaguaguaacacuuuucccuuggugcccguggccagcuaguguauuuucuaauccauccaaaggugaaacagacuuggucuuugccuucugaagagugugcgacucugagucauacugaauucuuugugucaccuccgacgcaaagauucguuuugcuguuuaucagaagagaaaacacagauuccauaccuugucagcuccuauuuaguucggcuucccucuuaaugucccagccccugugagcugucagguucuaaauucagaauucucucaauucugucagguucugcacuacgagucagugucaucccuccaagcccuggcucucugccagugcagcagggcugugagaaucaagacggcacagggaaggcaucugucccagcauuugcacaugacaggugcccacggugcaggaguagaaucuguggaagcagcaguggcuuuaguugcugugcccugccaccuccuccccaaaaaggagaaguguccaagggauagcagacccguagcacugagcggccugccgugcugaccacuggauccaggccacgugcugcagacagcggcugugggcgagugaugaggccacuacccagaaagcugcaugugcacugugugggguaaggacaguaggagaugcugcugcaagaugcugacucccuuguuuuucuuuucauuugugcucugggacuaagcuguguauaagucaucaaauggcagaagcaagauuuuucuuuugagaucuaggaaauuauuuguuuauacucuacacucuuauuuccuauaucaggauggggaggccacuaccucaggccaguuaaacuaagaagaaagaauuuaaggcaauuuguaaggauagacaaaaccccacaugaugguaugaguaggagagagaaaaaaaaaagggagccagaaauuagguuacaaaguguacaccacacauaaaggcugaugccucuguuacaccgugagccaaauguuuaucucuaggguuucugguagccaguugcgggguguccagugaagggguguacaugucugugguuaaucauauaggucaggauaaugaggugauacugcagugacaaauggcaaaucucccuggcuuacaacaaccaguuugccucuuauucuucuaggggaccaucaugggcugaggucaggccaaggccuuuuguaucugguguuacuggaacauggcuaugugaauucauuuauguacaagagaccuccccauccugauguaggaaaugaauggugaugauuuacgagcgcaacauccuaaaaaacguuuuuguauuucccuagcaagauaacuucagguuacaaggcucugguacuugaccaugaugacuccaugagaaaacagcagaacgccagcuuugcagguaccuccacagcacugccgggcugggaacagggccagugcuugcaccagcgcuggagggggccacagcagaguaaagacagagucugccaugcaggagugcuucgcaggucaggcacugcucugagugcuuuguguuaaccugccccccgcccccuaacuugggaaagguguuaaagaaggagagaacgcccucaaugguguguccuuugcauacacaccuuugcaugcaucugaugugcccaggcuguguuuuauuguucuagcaauuuauuguuacaaaacagauugcugccaucaauuugucucagguccuucuagcacaucugacagggacuagugucuagagccaugaggacagagaccagaagggacaagaaggagugggcagagggaauggaagguagaguuaggcccagagagccccaggcugcugcccagaccuccacgccugugccggaugugguguuggcauccauagcagucucgcaaaguuguucucauuuuccaaauaaggaaucugaggcccagggagaggugaagugcugcaggagauccaaccaggcgccggcucagugccuccuagaaagaggagugugggcacguuugcaggggauccaaccaggcgucagcucagugccuccuagaaaguggagugugggcauguuugcaggggauccaaccaggcgucggcucagugccuccuagaaaguggagugugggcacguuugcaggggauccaaccaggcgucugcucagugccuccuagaaaguggagugugggcacguuuguaggggaucccaccaggcaucagcucagugccuccuagaaagaggagugugggcacguuucagagaaaacuggcuuaggccucccuguuucuggcguggccuucccugggagcgaguuagggacacggaagcucacccgcuucugaauggguccacuccuggggauuuccgcggccuucccugggagcggguuagggacacggaagcucacccccuucugaauggguccacuccuggggauuuccgcggccuucccugggagcggguuagggacauggaagcucacccucuucugaauggguccacuccuggggauuuccacggccuuuccugggagcagguuagggacauggaagcucacgcccuucugaauggguccacucccggggauuuccauggccuucccuggaugauccacuccuggggauuuuccgcagcucuccagaugacgugcacgcacacuaaacacccagaaguuagggaggcacugauccagugaaguccucagaucaaccuugugagcuuuuuacaaguaccugucacuguuaaacugcugaugaaaugugaaacgacuucacagguuuucagucugauaagcucuccugugucacugucccuuaccuuguuaguaaaggucaaugguucucaaaguuccgggcacauccccugggggcucauaaaaccagacugucggccacuucagccuucugguucgcuguuccuugguaaugcagauggcccaguaagcaacucuacaaacauuagaacauuuugagguagacaggggaacuuaaucaccccuuguaggcccccagaagacuggacccaacauccagcacaaugccucucagccuuggcugugcaucugaaacaccugcuguuugaagacaccugggccuggagacgggccagagccaccuugguggucugaguaugaggccagcauuagaaccucugcucuacgggugacugcccuggguugauuuuuuuccaguauuaucuuuaguacagaaucuuuuccucucuaagggccugagacccucucuuaggaauagaaguacaguuuucuuccccacuccuuuuguccagaaggaaaaccugguuuuacaucagaaacuugagguacuuugaaaauuugccagcugccuugaaggagagagggcuugaguguauuuugggggaagaaugaggggacaacagggcagggagaagggacagagcuagaggaaggacaggccugugccacccaggccaggguaaggggagcagagaccuuuugguuccugguuugugacacaggaagggagggaacuggggaggacaggucaugaucaguguuuccugauuaaaaauuuuuuauuuuuauuuuuaauuaucaugggcacagaguagguguauauauuugugggguacaugagauguuuugauacagacaugcaaugugaaaaagcacaucauggagacuggggcacccauccccucaagcauuuauccuuugugccacaaacaauccgauuauauuguuuuaguuauuuuuaaauaugcaauuaaauuguuauugacuauagucacccuucugugcugcugcucuacuguggccucaaagaucauaaaugcugugggugcuggcaagauacugaaauaaauuaauucuguauuucuaaaaau

SEQ ID NO: 192766 - RNA, 49234 nt, Homo sapiens
ggacugacgccgagacgcgcgcgggucagcggcgcggggacgcggggcgcugggcgcggggcugggggcgcagguaaggagcgcgggggcggcgcgggguccucggggggcggccuagggcggccgaggacgcagggccggggcaguuggucgcggccuucaguccccuggcuugguccugugggguccccggcccggcaccuccucccgcgagccgugcgcccccauccugggccugcgcccccuucccccgagccgugcgcccccaugcuaggcccugugacccucccccgaacagugcgccccgauccugggcccugcgcccccucccccaccccaucccggggcgcgcguggacccccgccggcuaagcgcacccgggcggugaccccaggggcuucgcccguccucgaccccggcgcugggaccccuccccagcccccuccgggagcgucucgggacccccagacacccccccgucccaggcaggggccgcuccucgcgcgccccgggccccggucgcccccgcucugccucggguccugcggcuggcgcgggucgggucggguccgugcgcgccgccccagccucccugggcggaacucgagcagcuccccgcuccccgcaggccccgaggccgcaggagcgcgcggagcggcgaugagcaggcggccgguggcccgcggggcgcggagcccgugacagccucggccaggcgggcgcugcgauggaggccgagggccuggacuggcuccuggugccacugcaccagcugguguccuggggcgcggccgcggccauggucuucggagggguggugcccuacgucccgcaguaucgggacauucgcaggacgcagaacgccgacggcuucuccaccuacgugugccuggugcugcugguggccaacauuuugcggauacucuucugguaaguugggggcuugcuuuccugggcugcacccggagaagaggguuucuccuuugggguuucugguugaggccgggggagcagcaggguccacaccucccugcugggccagcgucccacucugccguggaugggguacguggcugcaggcaagucacuucuuagggugagauuauuuuuccagaaaaacggugggguuggagcacagaaucucagagaaaaucuccagauccgccuccuugcaugauguuccacauggguacuuagcagggaccucucagcugggcacuggccuaggccugccuguggagaggagccguuccugcccuccuuuuucauguuguauaguuuuucuuuguuguuuugagagagggucuugcucugugguccaggcugaagugcaugaugacaugacagcucaccgcagucuccacguuccugggcucaggugauccucccaucucagccucccgaguagcugggaccacaggcgcaccaccacacccggcuaauuguuuuuuuuguauuuuuuguagagacaggggagugggggguugucucacuuuguugcccaggcuggucucgaacuccuggccucaagcaucccuccccacugggccucugaaagggcugggauuacaagcugagccacggcgccuggccugccuuauuuaaauaggaagucacucucucuggagacugucuuguuccucuccccaacuuccucuuuguauuuguauuaggcuaaggaaauugaaauuaauuuuaacaguuguugaaggcagacauaauugggagggugaguuuucagaggaaaugaggucucacagcugcauucuaaggccaaaaacgucugaaauuuuucuuucuucugggugaucccagccucucuguccgggcagauuggaaggugucugcugcucuuccuaugaagagggccugguggagggguggagagaaggaguccaggcagcuggugucaagaacucugcuucugacucuggucacugaguaaucacguaccugcuucuuugccuguuaguuuuguuuuguuuuuuuuugagacagagucuugcucugucgccaggcuggagugcagugguacaaucucggcucacugcagccucugacuccuggguucaagugauucuccugccucagccuccugaguagcugggacuacaggugccugccaccauacccagguaauuuuuguauuuuuaguagagaccagguuucaccauguugaccaggauggucucgaucccuugaccucaugauccacccaccuugaccucccaaaguguugggauuacaggcgugagccaccgcgccuggcccgccuguuaguuuuuaagucaaccuuauugaggugugauuugcauuccaugaaauacaccccuuucguguccauuugaugaguucugaugcugaggugucccguguucaugagccggggugcucccugcuccguggccuucaucccagcccuggccaugggcagccauugguccaugugucccuggguguuaguuuugccccugccagggauuuuuaggugagcgaguggguuggcugccucuuccccagaguugucucugaggcagggagguuuguccccugcaacgaccucggaggaggauuuuggguccgagucccgucucgagguuugucucugggccaggcugcaucugagggagguucaggggugcucauuuuggagacuccuucuuucuuucccaucgccugcuuuggagacguggcuggcggugcugcaguggccucagugagcguaagguugacuggaaguagguuucuaauugucuaaugcuguuguuuacuuugagugcauguuguggggguuggggagacgcuggucggcaggccaccugcuacagccccagcucacguguguguugugaaggagcgcugcacucgucuucaggguuauagaauaaauucucuccaaaauaauggaggaaaauugccugagaguggauaaccauacgggaaagaaguuccgcuuagagguuucccuccccaguaugcucauaguucaaaguugcuaaaagaaaauaaauuagguugggcacgguggcccgcuccuguaauuccagcacuuuuggaggccggggugggaggaucacuugaggccaggaguucaagaccaaccaacgcaacacagcaagacaccgucucuacaaaaaauugaaacauuagcuuaggugugggggcauuaccuguaguccuagcuacuugcgaggcugugaaaggaggaucacuuaagcccaggaauucgaggcugcagugagcuguccuccagucuggccaacagagagagacccugucucaaaaaaagaaagaaaagaaucuaucuaauguccaucuaaguaucgguuuggagaagucagagauuaacccaguuuccuggugccaucuugucauugccucaugaccuaacuggcacugacguagagguuugaagcuggaacugggaguucuugcuuacaggccuuggagagacacuugagcucuuucuuuguggagcacagggcagccuuccagggaauucugaacuuuguccaugggucucuucauagaaucaacauccugggcuguccuggucaugcauggcuucugugaccacugagugcacacgcagggccccaguguguuccagaagauggugggaugaaagcggggagagcagagggcgcucguuccugcugggcgucccuccagccugaggaugcgccaucccugcacuccacacagcgaagcccaccucccuaccuaccacacauccucuugugcccacccgguccccagguccugcugugcagagggggaugaugaccccuucuguuucucucuugggagccucuugugaccccccacuccuggcuuccccucuccaggcuuuguagguucacagccucuuugauuucaugguuuguagggcagaggauuugugcuuuagcagaagugacacgcgggaugcaucacacacaaccccagcuccacgcaugcgcaggcacacucgguguuuggguuggggguggugggagcaggagagcagagguggggcgggggcaggcuccggugagaaggggcuggggugggggcagagagcagagguggggcugggcugggcucuggugagaaggggcgggagacggggagagcagagguggaguucgaaucuucacgccuccaaagcuguuggggcaugguccucagagcuccagucccucugggcagcuccccguuggggauuuggggugcauggcauauggggcucugcaguccugcaggggcugcuuuaacaguacaaacccagggauucugaaacauaggucacucauguuuuuguuucuuacaguccuuacuaccauuuugcaaaaccagcauucagcagaucacacucuguggaaugccaacauucaggauuuggcagguuggugccagaagccaggagaagggcuaaaugaugccucauagcugguguuugccagcugugaguauguggaggaaaagcggagaggccaggcggggaucaggccacacugggcugcagggcccugggagccucagcuccacccacaguagcacccaggcuggagcacucuuagauggaggaaugaaaacauuguaucagagaggucauaacauuuuguuacuaaaggugauagcuuuaguggugccuaagaguagauacaaagcuacaaagcuucucuucugcuggauuuuuuuuuucuuuuagacaagagucucgcucuugcccaggcuggaguguaguggcacaaucucggcucacugcacccaccgccucccggguucaagcaguucccugccucagccuuccaaauagcugggauuacaggcgcccacugccacgcccagcuaauuuuuguauuuuuaguagagacgggguuucaccauauuggccaggcuggucuugaacuccugaccucgugauccaccugccuuggccucccaaagugcugggauuacaggugugagccacugugcccagcccugcuugaguuuuucugugagauuuuggaacauggagaaguuuuucugugggccuggucaguuauggggcacccucuauacugucucucccuguggaugggcaccugggcaugaucaccugcagaguccaccuuagacgagguaucuuggugcuucccgaggagcaggcuccugcaccacacaggugggcugccuggcaccugccgugagaagaggcaugggagucacgcccuccggcaggagaggaaaagugcucuccuaaguucauggccagcacagacuguuaucacuaaaggaagaaaaaguuaaguugagaaguaaauguggcaucuauuuuaauuagcuuuuaaaauuacuaaugcugcuggauucuguuucguuuucauuuuguuccuugugcaucuuuuguggaacacugugcuuuuugaaauuuuguguuuuucuuugucuucacccuaaaauuaguuuacuaucuccccgggcacccugucacuucauuuuaaaaggccucauucuuuacugugcauaucgaguuucucuagauuugauuuuugauguguggauuauggggaagcucaaaccuugauucacccgccuccuccuccgucucgucauucauugcuucuguuaaacauuuaaaaaaaugcagguggccuuucacacagaguggccaaaauggcucacgugcagccucauugcuggaggugaacguggugugaaguggccuccgugugucccaggggacuggccuauuuuagaugcuugcccagcgucaccuccucagccucaggucucuguggguggguugaccggcacccaggccgcuugguagccaguggagaacggcccuggaagugacugugagcuuggcuguauccuccagccuuggggguugcgaucgugcuuuauagugcagaggcugaggccuggagggggccggugugggggcuggagccagccugugggcagagugcccgugcccccugcacuccugcuccugcagugucccugcaccuccggccugugccucaggcccagaaaacccuguucaagcugccucuuugcugcuggccguccucuauccccgggcccaucacccucccuucuucuguuugccucuuagucuugccuuguguguuucucagaggcuuccucgggaagcauccagugaggcaaggggacggugguggccccugcugaccugggugauauuccuggagguacagcuugugugccugccugccuggccccuguccacccugggccauggcugcugaccugggugagaugcagcuugucugcuugccugucuggcccccugucugccccaggcccaggcuacuguuuucucugcccuucccucugcucccugagucucugugaccucaggcagcugcucccucugcugaaaagcucccaggagacagggaagggccuuggucucugaagccagcacagagggaaucagcauggccacccucugaggacugcauccuggcucccuguccucccaggagaacgucuguggcuuuuuccugguugcugugggagccucaccugcaaguggaaccuucuuaccugcugggcuggcucaccugcugagggggcuauaggguuccccuuguuccugcucugaguugauaaggcagugcugagggggcuaugggguucccccuguuccuguucuguugauaagggggugcugagggggcugugggguucccccugcuucugcucuguguugauaagggggugcugagggggcugugggguucccccugcuucugcucugagucgauaagggguugcugagggggcugcgggguucccccuucuucugcuucguguuaaggggaugcugcaugggagcuggagagaggugggggcuguggugguuguugcuaggucuuccaguuuuucagaaguugggaaaugaggcuguuauguaggaucuccugacuuugacauguuggugaccaguucaaguuuugaaaauucccuucaggccaaacugcaggcugauugagauucccgcgcuggaacagucagggguuggggcuuucuaugagugcgugccacacacagcccagccuuggaggugguggcucugcaggcaugugucccagcucugugguggcucuggggaggcagagaccgcagggaggcagagacugccagucauuggccugugguucugcccugcagaggcuccuagcugagcugaagagaugcucaacccuggucaaaagucagcaagaaggccugggagccugcagcuagaggagcucggggccagggaggcgugggggcggggguggugcagagccuuggcugucuucucuucugugggagugugugugcauguggaaauuucgcaucuggcccaccugcugcucugcacacuauccccgccuuccccaggcaggaagcagggcugcugugagcuagaaacugggcuuuuugccugguggcaacccggaggcugcagggagggccuggggcaccugggcugagcugugggaggggacucagggccacuagacccggguaccagugccugggccacugguucuggggagcgccaaaugugccgaaggguucugagucaggcuguaugggggucuuacggccccuccccggagcccuaccccaccuggagucugggagaugggcaacaggugccuggucacugugguguuugccaacuccugggcuccuuccccgggaugccgcuuggggccugggagagggggagugggugggcagucuuuccugcugcagguucaggacugggugaggcggcgugggugggccucccuucugacccgggucucucccgcugcagguucgggauugggagaggcggcaugggcgggccucccucccgacacaggaucuuuccugcugcaaguucgggaccaggagaggcggcaugggugggccucccuccugacacaggaucuuuccugcugcagguuugggaccaggagaggcggcaugggugggccucccuccugacccaggugucucccgcugcagguucgggacugggagaggcgaugugggugggccugacacagggucucuccggcugcagguucaggacugggaggggcggcgugggugggccucccuccugacccgggucucucccgcugcagguucgggacugggagaaguggcauggguggaccucccuccugacacagugucucucccgcagguuuggaaggcgcuuugaguccccgcugcuguggcagagcgccaucaugauccugaccaugcugcugaugcugaagcugugcaccgagguccguguggccaacgagcucaacgccaggcgccgcuccuuuacagguugguggccggcgcuucggaauaaagucgcagggaaucagggcguaggugacucuggugaaacaaaagccacucuaaucuguccugauccaagcagcuuucauuucaccaaguggugcuguuaucuccagcugauaguguuuucaguauguuaaaugacuucaguuaaacgguuuaugacuugaagcaauucaagauaauaguuucuucacuggaaguugggugaggccucaacacaucuucacgguuccucuuggcugugagcgccaucccagacgcuuucugugucagaacaagaagugcucaucugugccuggcccaucaggucagacgguaccaggucaggcguuucgucugugugcguggccuguacacaaaacacacccuuucaguucugcugugacucagggguaccuuagccagggucuuccucacagaccuuguuaaacagacccagaguccccccgcagggucaggcagccccuuuaugcggagcacacugcaguguugacagcugggcaggaccaaucacaugcuuagcacacauggcuccuuaaccuuuggcagcuuagaaaauagaaaauacuucuuccaguuuuugccuauugcacaguuuguuccagucugaacucuguuugaacaugcaggcuggcgggcuucuugugugcaggaggguuaaauccuuccuuuuguuuuucuucuaauuacuaaaucuaagacagcacucacuuuggcuuugagagagagagugaucucagcuaucacuuggagaagaguaucuucccagaguuuguuaaguuuggggcuucuguggauuugagcucuugccggggagcugugucccuguguuucuauuccugaccgcuacuucguccuguuggagaggauucccaccucugccuuuuugucugcuucuguuucuagacugaggugacugugugcugcuuucagccucuguagaaaccagaccagccuccagccagugugaccugggccaguuagugucguuggggccacagagaugagcuccagcgucuuuucugcgguguucuguucuuucuccccauucacgccauucuccucuccucugagucucugcucuguucccuucuauuguguuuuggguuugaaauuacaccagagaugguacugaggauaccacagaucuugccuagaaagcaggcuuuuaagaaccagccggauuccccgcaugaggagcugcgguuuuacauuucugcuuaggugacucggucuugcuccccgcaaggcuuugcuccuucucuggaccugagcuccucauggcauguucccugccccuuugaaccucaguauuuaacuuggaacaagaauguucucacugugggagggccggcuggccgagagaacgguuugugccuaagaugcccagugcguugcugggaguuucugcuguccucgggcucuggacauuugugccuaagaugcccagugcguugcuggguguuucugcuguccucgggcucuggacaugaggccagaccuugugaccuuguuggcagugggcaguggcuugaugugaggucccagagacggcagguugugaguguccaggcagagcagccagcgugggguuuaaugugaguguguguuggaacacugggauaccccuagaagcggcaucguaagcuccccaccugcauucauuuuaccagcaggugcagguucaggcuugucucagaggaccguuggauaagaagggagugggaugguggaugccuggcguucugugucacuucuuccaaaggaguacuucucuucugguuacccaggaugaguuaaaaaugugagucccaguuuccagagcuaggccuggaaucugaauuuuaaacacccucuguggguguacagaauaauggccccuggagacguccgugcccugauccugggaaccugugacgugccacuguacauggcagagagacucuugagggggcugguccuggauuauccugugguguaaccuaaucucagggguccucagacgugaacaagggccgcagaggagauggucaggugcuggagcugagggccuggcucucugccaugggucggccgucgcuuuacaggcagcagagcccccgaccacggggagcugaguucugccuguacuugaauggguaggagacacagccuugguuuuaguucaggagaccacugggccucuggccuccagaauuaagauaaucagccugcauuguggcugccacguuugugguaccuuguuauggaggcgauaggaagcuggggcacccuuuccucaggccuggaguauuugggaagcaguccagggccgccacgagggguagggggccgggcuccuggggucagccugggugaccugugccugcccucccccggggaggacugagaaccaagcugcaugacuccugggccccaaaugaccucaagugggacauccgcucuugagcucuguguccugggguguagcuguguguguuaaagaauucucaagauuuaccucugcagcacucuuaauauuggaguccgguuugaguuuauacauguccacguccccuugguggaugggccaggccuguuccugcagggcgucuugaugaaaggugugggcucauguccucucaucugccaggagaggggagggcaaggcaggaacaucacuggaguucagacugaaagcucuggcuucuggccgcccgaucgguagcuccugcagcacagccccaugccaagcaagguggccagccuugucuuccugucagcggcgucaccuuuaagggaagguuguuggcucugaacauguucuguuuuuuuuuuuaagcuuuuaaguucagguacaugugcagguuuguuauauagguaaauuguuugucacggggguuuaguguacagauuauuucucuaacuccugaacuccugaccucaagugauccacccaccuuggccucccgaagugcuggcauuacgggcgugacccacugcgcccggccagugugcagauuauuucaucacccagguauuaagccuaguacccacugguuauuuuucccgguccucucccuccuccugcucuccaccccccgacaggcucuaguggcuguuguuccccucuguguguccauguguucucaucauuuagcucccacuuacacgugagaacaugcggcauuuggucuucuguucccguguuaguuugcuaaggaugauggccuccagcuccaucugugcuccucuaaaggauacgaucuuguucucuuuuauggcugcauaguguuccgugguguauacguaccacauuugcuucauccagaagaaaaucuagaugauuuucauugaugggcauuuagguuaauuccaagucuuugcuagugugaauagugcugcagugaacauaugugugcaugugucuauaguagagcgauuuauauuccuggcguuuauacccaguaccgggauuguuggguugaaugguauuucuggucuuugaggaaucaccacaccaucuucugcaaugguugagcuaauuuacacucccaccaacaguauguaaguguuccuuuuucuucacaaccccaccagcaucuguuauuuuuuuuuauuaauagccauuccgacugguaugagacggcaucucauugugguuuugauuugcguuucucuaaugaucagugauguugagcuuuuuuucauacgcuuguuggccgcauguaugucuucuuuugaaaaguguucauguccuuugcccacuuuuuaaugggguuauucauuuuuuucuuguaaauuuaaguuccuuauaguugcuggauauuagaccuuugucaaaugcguaguuugcaaaaauuuucucccaucuguagguugucuguuugcucuguugauaguuucuuuugcuaugcagcagcucuuuaguuuaauuagauccccuuugucaauuauugcuuuugccaaguacauucuugagccucacccugagggugaggacaugccaagggggaucaugggccuugagaggcacaauucuuggcagaccgaugaggacaugaaaauaacuuaugaggaaacguuugaauagcugcauuucacugugcucauggauggucagacgaccuaaugaaauaaaagcggaaauguuuuccagcuaucuuuuauagggauuuuaaguuuugaaggucacaaauucaguuugaaaguuaauauaaaagaaacauaaaugguauuaagaaagaguagguuacuuaaaaaauuagauacauaauuuguugucugauuauaaagaacagugcaugcucaugguagacauuuggggaagacagaauauaaaguaaaacagcuucuggccggucgcagcggcucaugccuguaaucccagcacuuugggaggccgaggugggcggaucacgaggucgggaguucgagaccauccuggccaacauggugaaaccccgucucuacuaaagauacaaaaaguuagcugggcgugguggcgcaugccuguaaucccagcuacucagaaggcugaggugggagaaucacuugaacccuggagguggagguugcagugagccaagauugggccauugcauuccagccugggccacagggugagacuccaucuuaaaaaacaaaacaaagcaaaacaaaaaaacagccuccaccccacccuccagaggugacuacuuugaaccucguggcaugcuuuccaagucucuuccuuuuuucuucuacagucgccuuucacaaaauuggcauaauuuucaaaauuaugaucagacuuuaaaaagaaacccucauuccacugagauguuuucccaagcccuuuuugcugugagucagggucagagccccucacuggagggagaugucccacagggccccgagugcccagccugaggaaggcagggcuggcaucagcacggugcaaccccugggcggagcugagccucuucggccaggccauggcugacugcgguugggagugagugcacaccugucucucgugugcuggguuauuucuuuuuaccuuucacuuugcauuauggagaauuucaagcguuuaccaaguagguaggguggcauaaagucccgagggugauuggacccacaguugcauucaggucuccuuccugcagguuuuucuuuuuucuuucuuucuuuuuuuuuuuuuugagacagggucucacucuguugcccaggcuggagugcagugguguuaucaaagcucauuaucaccuugaauuccuggguucaagccaagcgauccucccaccucagccucccaaagcguugggauuacaggugugagccccugugucuggcaguauauacgauuuuguuguuuaaaaauccguggguucucccuuagcuccucucaacuuugcccguggucuguauugcggcaucagugccaccugcauuuuuaacaagauugcugaguacuccugcaggcugaguuuugggaagcccugcaguggagauggcacuccugguguuuccucgugucuuuaugucccugggauguggacaaggacaagguguucuguccuuggcucuuucugugaaagagcauuuuaaaaagauagcggacccugaggcccuaucggauccagguuugguucuuguguuucgcaggaugguugcgucguuccgucggaggugcguguggucagcggccacuguggggcucaugcugaggccgucagcucaucaggggcugcaggauguuuguugucuguuagcuggagccccucugcagagaaaugggcggguacccauuguucagcuauccacagguguaauuuauaaaggaaaugcgggucucuuuaccaguuuucaaaguugguucccuagcaucuugcaaugaugagugcauguuucugagucauucugaacaugugaguuggacguuugguguguuacuggauuauuacgcuuguuaaugcuccaguucuucccucuggccggggagccgcgucagaugcugcugggcccuuucgacccagcaugaggggucucgcuucuacacaggauccugguauaacagggugcucguguggcggcuacaucuccugccccagaccuagaauccgucguuucuccaaggagcucugguaucugggacacaguguuuggagaccacggccuaggcaugugugaggguuggccuacagguugauuuuuuggcuuuuucaguggauggagcuagggaguuuuuuuuggugaggugaaauacuucaugaguggacaccaauucuuuccauuugacuucaaaccuccaggccuggcugugucgcuuagccugagcucugccucccuucugcccucaaggaccccacaaauaauggaauguggcauccucaugccucccuuagcccucucugugcacggcagucugagggucaccaugccagcgccggccucccgguuacugaaaacguuuguuuuauuggggguggagguuuauaugcucaggauugcacauccucaggacacuucccgcugggaacggaggucaggucgcugcugcaugauacgucaccaggaaacaaacgcaccuugucaggggugcaccagcaacuggauacacggggucauuuguuucauuuuaaauauugcuuuuauaaaguuuaacuuuguuuuaucauguacuuuuuuccuuuuaaguuccucuuagggguuauuugagaaauaauugucuguggcucaaagucaggugguugaauuuacuugaaauuugucccaaaucucaacacucaguuccaggcuggaggccagggagagggaguggcugcugguuagucaaggguuucuuuuuggggugcugaagauguccugaaauuagauagugaugguguuugcacaacuguggauauccuaaaaaccauugaauuguacacuuuaaacaggugaguuaguuauaauucaagaaagcuggaaaauguguuguauguaggggucaugugccaucuugcaugcauuuucagggguuuauugagauucuuggacgucacauuaggaaucccuguaucugccuguguaccucccauugggggcucgccugggccacugugaucaugugcucuucccuggucccaggcugucuggcaccucccugucacuaucaccccugcacuccccauacacgccguaccgacaggguacagugcaaaccuuccuucaugugccaacagcaguggucuccagucgugacauggaccaaagucccaggaagcaggugauggccucuguggcccagccagccuccuuccugcuggccauguggaaccauaacuuguugugucucucuuguuccagucucuuuggcuacuccacaaguuaccccaaaucuuaggacuuggaaggacaacaauuauuuugcuugugagugcauuuugggcagagcuuggcaagaauagcuggucucugcuguccucaggagcaucuggggaggcucaaaggcuagggcugcagcccuugaagcucauucucuugcuuuuucucucucucucucucucccucacucgcucuuuggcauggcuggugcuagccaucuaucugcugggaccuccacccaggcucugcugggacacccaccaaggccuccucaugagaccugggcuuccucacaacauggcggccaggucccaagggggagcuaccugagaaagcagguggaagcuguaucuuuuuuaugaccuaagucuuggaaaucacagcauugcuucuguggacuggaguggucacaagcccacccaugaucaaggggagaagacacugacaccaccuccugaugccgaguguggaggaaaaggaaaauguugcugggcccuuuuuggauccugagugccuggucuggaggacguguucagcacagaucuguggaagugugugacuguugaaaauguuccuggcagcucucucagcaucagaacucugcauuccauccuacacaaacguggaucugaucacacugcuuuccaggcaaggagccucagguagcuugaggcugugccuaggacacagccuggugugggaugugacucugcagccugaaccaugucuucuuccccagccugccggcuggcugccucccaccauugccuguucacagucacaccuggaugugagaagggaaacaguguggacugagcaguccugccuuggguggucccucccucccaccccuugaggaucuuggucuuuagaagaggcgcccguggagagggauguugucuaaaucaaagcaacagagaggacgagcugagggacccauagaauccaagaggcagugcugggggaggcugagggaggagagaagacugcacuuuguaugcugcauugguuuauaaaacccucaaauuugguagagauauugcaguuccugccuugugaguggaacaacacccuaaguccaaguagcagagggcagaggucagaggucaccucguauuugcuuuuagcuguucacuugcaaaauuuccauuuuaagucuacauugccuggggcaggcaaacacaaccuuugauccuacuucugcuuucugaucccaggacuuauuugagucucuuguuuaucaacugucuucaaucccaaaccccauggggcuucccaggagccaccuagaggccacacuguuuuccaggaccuuggcugcugucuuguccuggggcugcgcagauaggaagguugacuuauaaccugucauugccagugcugggcccuggagggugcugggucccugucacauugucccugugucugugucugugcagaggugcuugucaagugcaugugcggaaccagcuguccuuuuacagcagaguguacucugaaaacagcuuuaucaggcagccuucugaagaguuuugaccuggggcagcuauauugcagccgcagcuugcauacagaugaguuucuaggaaaagggaagcaggaucugccuggcugcuuuccaucagcacagcacgcuugugacgggcucccaugcugccuuucucccgagagauuaaauggaaaugugguaacuuucaauuuuuggcucaauuuuucucccauucuccccauucacuuuuuuaugauauuggaagagguuagguuugcagaaaaauaguucagaaaguggguuuucuaaugcacaaaaaccaaaaucuugugaucuuucuauucugguuuguuuuuuuuuuuuuaaagaaaugcaaaaaguucugggaacacagcuguuuacccauguuaaaaccaguauguuucugucuuuuuccccuuucuguuucugucucccuuuuuaacguguagcugcagauagcaaggaugaagaagucaagguugcccccaggcgguccuuccuggguauguacccugcgcgugcacuguccgcagcacguuccuuuugcuucauuccugcagcuguacuuccuccuguuguugcuuccaucugugcaugugcgugcgucaucuuuaccaagcguggccgagucuacagcaaacuaaucaacuccuagcucugcuguuuucaagcaugaaguaguuacuagaagccuguccaugcucuucuguguguggggagaugggggcgggaaggggaagcaggagggagacaggaagggaggagaaaaauuuagaugacaaauuuuggacuuuguuaaauuuauuccaaaguauuuuauccuuuuugaugcuauuguaaauggaauuguuuucuuaauuucaguucugcugcuucauugcuacuuuauagaaauguaauugaucauugcauguugaucuuguaucaugcaauucugcugaacugguuuguucuaagaguuguuuaguagauucucuauauaugauucugucauuugcaaauauaguuuuaauucuuccuuaccaauguaguugcuuuuauuucuuuuuauugcuuauccugguuauaggcggugagaguggaugcaccuaucuuauucuucauuuuagugagaaagcauuccaucuuucaucacuaaguagauguuaguuaauggauuuuccauaguugcccuucauuagguuaaggcaguucccuuuuauucgaguuuguuggguguuuuuauaauaaaagaguuugccaaaugcuuuucgugucuguugagaugaucauguggguuuuauuuuuuauucuacuaugaugauguacuacauugauugauuuuuguguguugaaccaaccuugcauucuugggauaaauccauguggucauggugucuaacacuuuuuaucuguugcuggauuuuauuugcuaguauuguauuggggauuuuuuguaucuguauucguaagacaugauggucuguaguuuucuugugaugacuuugucuagauuuaguauuaggauaauacuggccuuauagaauaaguugggaaauguuccccuccuuuucuaucuuuuuagaguuugcaaaggguugacacuaauuucucuuuaaauauuuuuagaguuauccagugaagccaucugggcuugggcuuuucuuugugggaaguuuuaaaauuacgaauucaaucucuuguuauaagucuauucagauuuuuuguuucuuuguaagucaguuuugguaguuuguauuggaauuuuuccauuucacccaaguuaucuaauuuguugacauauaauuuuucuuaguauucccuuauaauccuuuguauuucuggaaagucauuaguaaugguuccucuuuuauuccugacuuuaguaauuugauccccuccuuuccuuucuuuuuuuggucagucuagcuaaaaauuugucaauuuuuuguucuggucaaauaaccaacuuuuuaaaagguguuucuuuuucuuuucuuucuuucuuucuuucuuuuuuuaacacaacacauccacauugccuaucagagaaccaauuuuugguuuuguucauuuucuuuauuguuuuucuauucuguguuuuauuucacuccaauauucuuucauuccuuaugcuugcuuugguuuuaauuuacucuuuuucuuaagguggagguuagaacauugauuuuuuuucuuucuuccuuuuuaauguaguuauugacagccauaauuucucucuaagcaggugcuuuaccugcauccuauacuuugguguguuguguuuuuguuuucaugcaccuaaaaguauuuuaaaauuuacuccaagauuucuucuuugacccacuuauuaggaauguguuaacuuccacauauuugugaauaucccaaaaugucuucuguuaucgauuucaaauuuauuuccauuauaauuguagaauauacucuguauuauuccaguacuuuuauuuauuuauuuuuaauauuuggagacagaaucuugcucuguuggcuguggugugaucuuggcucacugcaaccucugccuccugaguucaagcaauuccugugccucagccucccaaguagcugggacuauaggugugugccaccgucccuggccaauuuuuuuuguauuuuuuguagagacaggguuuucaccauguuuaccaggcuggucucaaacuccagagcucagggcacccacccaccacagccucccaaagagcuaggauuauaggcaugagcaaccacgcccagccagauuccaguacuuuuaaauagaggcacaucuuauggccuagcauaugaucuguccuggagaauauucaaugugcauuuugcugugguugggugaagguggaggguugucuguuaggucaagucuaugauuuauuguucuucuguguaguuguuacguccauuacuaaauguggguguggaagucuguaacuauuuuugaauuaucuuuuucucuuuucacuucugucaguuuuuguuugauguauuuuggggcacuguuguuuguuagggacguauaugcauauuuucucuuuugacaucugugucuucugacguuagugucaucacaugcaugucuccugugguugccauuugauauauucuuuccauuguuuuacuuuuaacuuuuuuaugucuuugaauuuaaaaugagucuucuguauacauacgauggaucuuuaaaaaaaauccauucuggcaauucugcccuuugauuugauuguuuauuucauucacacuuaauguuauaauauguucagauuuacaucugcuacuuuacuuucugguuucuguauauccuaugccuuuuccccuuagcuguugcuccuuuacagcuuucuuuuguauuaaguaaauauuuucuaauguaacauuuuaauuucuuuaaauaauguuuucugaauuauuuucuuaguaguuacuugaaggcuuacaauauucaucuuaacuuaucagaaucuacuucaaauuuauacuaacuuaauuccagugacaggaaccuuacuccuacaugguucgauuuccuccucccuuuuuaaaugguaugauuauuauacauauuuugucuacauauauuacaaccuaacaauauauuuuucugauuguuccuuuauauacauuuuaugucauucaagaacuugagaaaagaaaggagaacaaacauauauuauggaguuauuauauuaaccuuauuuaccauuugugguuccuuucauuucuuucugagacugaguuaccaucuacagucauuuucuuucucuaauacaguuuugaucccaucucauuugugcuauuaauauuauugucaaauauauuacauuucuuuauguuaaaggcccccaaacaauacaaugcauauuguuucaugcaguuacuuuuuaagucaacuaagagaggaaaggagaagacaugugaccgauaucaucuuuuauaauaacuuacaucauugucuuuaccuguacucuuuuuuuauguggauuugaauugcgucugauguuucuuguuuucagcaugaaaaauuuguuuucuguaaggucugccuacuagcaacagauuuucucaguucuuguuuaucugggaaucuuuguuuuccccuuauuuuuuaaaaaaaguuuuacuagauguaagaaucuugguugaugauuuuuuuuucuuuucagugcuuugaauauguuauuccacugcccucuggacuccauuguuucugaugagaagucagcuguuaaucuuauugggguuuccuuguaagugauaaauuauuuuucucuugcuacuuucaagauuuugucuuuguuuuuugacauucaucauuuagacugugaugugucaggguguggaucucuuuaucagguuugcaauuuguugagcuucuuggguauguggauuaauauuuucaucauauuugggaaguuuucaaaagucauuaucuccuugaauuuuuuuuucugcuccccucucuccucuccacaaucucacccauucugcaugugccggugcccuuuccugucaucccaccuuucucugagacuguguucuuuuuucuuaauucuguuuucuguuuguucuuuagguugcauagucuuuauugauauuucuuugaauucacugauucuucugccagcucagucuguuguugagcccuuauagugaguuuuaaaauuuuaguugugcuuugcaaugccagaauuuccacuugguucuuuuuuuuuagaauuucugucucuuuauugauaaccucuaugugaucaguuguugucaucauauuuucuuuuaauucuuuaugcauggaucccuuuaguuauuugaacauauuuauaauagcuauuuuaaagucuucuucuacugaguccaacaccugugccucuucaaaagcaguuuguguccugcuuauuauuuuuuuccugugugaaccacacuuuucuguuucuuuguauaacucauuuuguuuucuuguugcaagcuggacauuuuagguaaacuauaguagcagcuguggauacagauucccccacuugggggaaggaugacuuacuguuugcuuguuuguuuugugauuuggcuggacuagugcagucucugggccucuucucccucagauguggugguucuggcuggcugugacccucccugaucuucccguuaagcuucugguggucaaaccagcuguuggccuccacucauugauggcugcuggcugauuugaugaugcccugggggauguauuccccacagcugggcaggguggccauuggggccaguguuugguggugguucuguucccaggagugcuccucuugguuguccuuucugguucuguuugauaaacuuugagcucaucauggagcuucuagcuccucuuaguugcuggcugccgaggucucuguuguuuuuguuagcauccuuacacuugaacuuguaccugcucuaagcagggagucccucuagggagagcuacggagcucucuauccugauaccgccauccccaggacagaaccucugguccucugagggugacagcucugcucugagugcugcaugggaagugaguuguugccucuggucuucuuaguuugccccugcuuguguggaaccucucccagugagcaagcugaggcagggacaagggaugcucaguguccucugccccugcgccaugggugggggcugaguggaggaagggagccugggcagacaggagcugagcaggcgaugaagagcucgggugcccgccacugcugcaguggcacugggggagagggagccugucuucucgguugccugcugggaguagagcuuuugucacauggggauggggaagcagguuguggcccaagugucacgaaguugcuguuccugcugccacuuaggugguuuucuuggauaagcguuucuccauucgccgugugucccuaagacacguuagggacuuuaagugggugcuguuuguaauguucaccacuggcagugauguugcuggagagggucuguggagagccucacacugcuguucuggaagagccuacugccucuguuguuucugaccuggcugaaacccugauggcuggaagcaugaagaagguuucaggcuggcagagcaacgcucuugaguuucuguucaauggcuacauugaguaaacgcagcagccaagcauucuccauggggugugucauggaggaacuccuggaacuguccugaaguccucuuuagaaguagguagcccaaaacuuucauuuuaaagugacuuggggaaaacuguuuauuccagugccaucugggcuggggccuuucugggcuguuucugcuguguaugaugcuguguuuguguccugauuucgggcagaagccguucaggcuggagggccauggcucccuuggccgcggugacagcccagccccucaccucucucaccuguccaccguugggugccccacugagcagacucugagcaaaugaggggcccggagaugucaguuaggguaaaggggggaaaaggcuccugaagaugagaggaggcugagagcaggcaaggccauucucccagggccucccuggcucuagcugaggcggcugcaggaaugugucucagcagcuguuagggcagugcggcggugagcgcuugucugucugggcagccuuggguugggacgcggacaccugucucggcaguugcuugauuuguccuugccgagugggaggguguuuguuucccgggguccucuuuggaagccggcacggcuggcccucccacucuggcccuagacgugcucaguccccacucagccugucccacucacugggguuggggcgggggcucugucacuccccgagggucucugaugugggucucucugcgucguccucuggccccagcugugucgucugccugucccuguugccgccugcugcacagguggcaggauuagaggggucagcgaggccagugccggccucgaaggcuaagaagggcauuuauacucauucugcagcaggugguguggccgucuuuguuaaaauccuuuugcgucccugauccuuaggauaaaguaaaagucggcccugguggccucgggggccucuugucugugcucuccugacuguagccugugccccucaggucccuccagaugagccccugugugccugcccggggcucucccgacuguagccugugccccucaggucccuccagaugagccccugugugcccgccugggguccugcugagcccugccugcagcuccgggucugggcagugccuguuuguucccucccagguggccgggccguuuccaaggacaggcucugccugcucagcuggagugggguggagaagcagacgcagcagguagggcugggaccugcccugaagggcagcuugcaggaggucaggugagccuggaccagggauuugaaggaagugagaaguuuuuucguuuuuuuguuuuuuccuggagagucgauuuguauuuuuaaaaauacugaaacagucacagaguuaaagugggaguaugauacaguuuagcugcugggaauggccgucacuccagggagcgccaaagugcuuaaaagaacaguuucuuugccaacacuuguggucaguaaccuguaacagagcuacaacuaggaaaauuagaguggugguagucacucauuuaagaagucauucagguaagcagcugcaccgucuguaccccuuaaguagcaaagaagcuguuacagucuucugaaaacuaucacugugagugcuauaauucugaauguaauguuucuuaauuagaauucauacaagaaucaugaaaaaaaaaaaagagcaauuuccuccccugcagaaugucccugagcaguguggcccaggaggcuccguagccuggugaaaggcacccuguggcucugggguggagcuuggcguuaccgagaugccauucacguccugcgagcgcccaucgagugugcgaucugugggucccgagggugccugcaggggucugaugugcccagguucuuguugcauggcaguucuccguucaguguucgaaaccagugcugugaugcccuccagccaucccagucccaacaggaagcucucuggcauucucugucccucucauguuuauuacuggaaagggcuccccacccagaccccaggaaaggacucuugggucucgcacaagaaagaauuugaggugaauccauaaagugaaagcaaguuuauuagggaaguaaaggaauaagagaauggcuacuucauaggcagagcagccccaagggcugcugguugcccauuuuuaugguuauuucuugaugauaugcuaaacaagggguggauuauucaugccuccccuuuuuagaccauauaggguaacuuccugauguugccacagcaucuguaaacugucacggugcugguaggaguguagcagugaggacgaccagaggucacucuuguggccgucuugguuuugguggguuuuguccggcuucuuuacugcaagcuguuuuaucagcaaggucuuuaugaccuguaucuugugccgaccuccugucucauccugugauuaagaaugccugaccgucugggaacgcagcucagagggccucagccucaucuuagccagccucuauucacaauggaguugcucuugcuccaaugccuuggacacguuggccaucagauccucuuacaccaggcucucucaugugcuccuguagacaugaaaacacgaccugaugagaaaucggaucuuccuuacccauuaggagacagucuccuggugcacauuccccaagugguaaaauugcuuuuuaauccaggagcaguuggacuggagcuggucuguucccacagggcuccccauggggggugcuggaagagaucugucugugaguugagggcagccacgcccgugcgacggaagcuucugaggaucagcuguucucugcucagugcaugccagggugggccucuggugagccccccaagccuggaaacauucguuuagcauugaaugccucguuuucaagccuuaucuuuggugccgcucucuagaaacacaucucgggaagucacggcgugugagucugcacugccggcugucagcuguucuguuggcaccuugcgugaccacgggugugcauccuaauugcguucuugcccuuuuguucuuguucucagagccccuccucucccacagccaccugcccucuuggauuucugucgggcucagcagugcgggggccuggcugcuuuggaaaggggggugcccuccccucccaggucccucggaauagggccagcucuucugggaggacugccaggcgccucucucuuauuugcugauuuaaaaaacuauuaaugaaaaucuccugacacaggaaugucucagaagugcagaaaauguucuuuuccaccggacagaucaggagucaccaugcccaccaggugucccccguguccgccgacuucuccugacugaacuuagagaucucauuucccgcugucugagccaccccaggucagccucagccagcguuuuccuuacccagcuccuccccgccaccugcuccaauuccccagcacaugugagcugacagcuaaugguagauggcugcuaaauuuauuucaaauuguucuggauacaaaugacagcaccuuaauucccagacuuggaguugaaggaacuauuuucaacuucagcaucagaaaaugcuggauaaguauuuacuaauaaguaauaaguagauacuuuuuaauaaaacaaguagauaugucugcaucuuuugguauaagacaagucacauacauuaaaauuuucuauuucguuaugcauucaaauuagagagauaauuuacauaacauucaaauuagagauauaauuuacauaacauaaaauucacaauuuuaucaccauuuaaaagugcacaguucggugguuuuuaguguauuuacagaguugugcggccaucaccacugucucauuagggggccuuucaucacccccaaagaaaccccuucgaaccaguuuccuucuuuuccccaaguuccgucuucccccagccccgacggcggcucgucugcugucugugcgcucgccugugcuggacacuucaugggaacagacucauuagugugugguucccgugucuggcuucugucacuugguguccuguuucaagguccauccguguuguugcaugaaucugcccuuucuuccuuuuuguggcuaauacuccacugugcaccaggccacguucuguuuggaaaucugcccccaccugcaccacgcaucucagcugccucgccucgugccucucacccugcugucccucugccauccucgggagccucuccgccggcccggcagugguaaaugcacgaauugaggguguuuggcguguacgguuaagcucgccagugccuuuuuuuuuuuuuuuugagaccaggucccacucugucacccaggcugcagugcaguggcacagccauggcucacuacagccuugaacuccugggcucaagggauccuccugcuucggccucccaaguagcugggaucacaggugcgcaccaccacacccugcuaauuuuuuauuuuuuuuguaaagauggaaucucaugauguucaagaccuccuggacucaagugauucucccaccucaaccucccaaggugcugggaugacaggugugagccacugcgccuggccauguuuuagauuucgaugaaguccgguuuaucuuuuauucuucuuuuguugccugugcuuuugguuuuacagcuaaaaauucauugacaaauccaaugucuugaaguguuuccucauguuuucuucugagaguuuuaguuucaggucuuauuuguagguuuuugauccauuuugaguuaaauuucguaugugguauaagguaagcauccagguucauucuuuucucagaaacuguuuagugaggauuuucuguuagucauuugccaauugacuccuuccuggggaaacuaaaauaggucucccagagauggaccuuagaccuggcuuucccaagucucuuaaacccucaccuggcguccuguguccgcagcccaccgugcacagccugcccauccaccaccugcccaugcaugacccaccuguccacagccccccugccugcccguccaccauccacccauccaccacccaccuguccaccacccgccuguccauggccccccguccuccacccacccguccacggcccccccccauccacccccucaccguccacagccccccuguccauagcccauccugcucagccccccucacugcagccgggcuucuucaugaaauacacaugagcccacgccccgcuguguucugggaggugccgcguaccaugcccauccuuccucuggccuugcuuccugugcagccccuuuccagcucggaugccgagcagcgucucacucagagugagagaggguggagcaggaagagaggcacagaucuaggguccaaggggauggggagaaggugcacagccuggccaccccugcccucacugcacugccagccccacaggcagccggcccccgacaccccuggccucucugcccucugaugcccccaagccccccuaaccucaccauaccccaacccccccaaucccucuauccucaccccucagcacccccaacccccucgaccucaccgccucccaucaccccaccccugcagcccaugcccuggcccugcugcuguaaggagaggucaggugcgggccuugcaggcuucuuggcagguuugucuccguucaccuuuucccugccgcuauguccccuggacugcacauguccaccugccuccuuuaauuugcuaauuucugagagugcuuaugagugugguuucuacagaauacagcaucuagcaaaugacaucgugcaggagggaugugguacggauuuacugagcggcaccguggccgaggcguguuguagaacucaagaucaacucguugaauccccagaauguccuaggaguggucucugucucuuccugguaacaucugaggaacaggagaccgugguuaacccgaggggggcugcgccccuaacccaggcgucagauccagugcagggcacucccugcacucuacggcuucucagagauuaagauuaauuugaaggauuuuagcuuuuuuuuuuuuuuuuuucuuuucaaagagacaagugucucuguguugccuaagcuggccucaacuccugggcucaagcgauccucccuccuuggccccugaagagcugggacuguaggugcccacugcaccuggccugaugucagcgucuuuuauguugaguuauuauuuguaccaaggcuccuucaggggggcaugaucaagaacacauggcuccucccugauuugaccccucgcucaguucccaucucuccucaccgacccugaccucuuacucugcucccaaguucccgucucuccuccucugacccugcccucucccuggguucccgucucuccuccucugacccucggcugccccucacgcucuugcucgguucccaucucuugucacugaccuugaccucucccucgguucccgucucuccucacugaccuugaccucucccucgguuccugucucuccuccucugacccugaccucucccucgguuccugucucuccuccacugaccuugaccucucccucgguuccugucucuccuccucugacccugaccucucccucgguuccugucucuccccacugaccuugaccucucacucgguuccaucucuccccacugagcuugaccucucacucgguuccugucucuccucacugaccuugaccucucccucgguuccugucucuccucacugagcuugaccucucccucgguuccugucucuccuccucugacccugaccucucccucgguucccgucucuccucacugaccuugaccucucccucgguuccugucucuccuccucugacccugaccucucccucgguucccgucucuccucacugaccuugaccucucacucgguuccugucucuccucacugaccuugaccucucccucgguuccugucucuccucacugaccuugaccucucccucgguuccugucucuccuccucugacccugaccucucccucgguuccugucucuccucacugacccugaccucucccucgguucccgucucuccucacugaccuugaccucucccucgguuccugucucuccucacugaccuugaccucucccucgguucccgucucuccuccucugacccugaccucucccucgguuccugucucuccccacugaccuugaccucucacucgguuccaucucuccccacugagcuugaccucucacucgguuccugucucuccucacugaccuugaccucucccucgguuccugucucuccucacugagcuugaccucucccucgguuccugucucuccuccucugacccugaccucucccucgguucccgucucuccucacugaccuugaccucucccucgguuccugucucuccuccucugacccugaccucucccucgguucccgucucuccucacugaccuugaccucucacucgguuccugucucuccucacugaccuugaccucucccucgguuccugucucuccucacugaccuugaccucucccucgguuccugucucuccuccucugacccugaccucucccucgguuccugucucuccucacugacccugaccucucccucgguucccgucucuccucacugaccuugaccucucccucgguuccugucucuccucacugaccuugaccucucccucgguuccugucucuccuccucugacccugaccucucccucgguucccgucucuccucacugaccuugaccucucacucgguuccugucucuccucacugaccuugaccucucccucgguuccugucucuccucacugaccuugaccucucccucgguuccugucucuccccacugaccuugaccucucccucgguuccugucucuccccacugaccuugaccucucccucgguuccugucucuccuccacugaccuugaccucucccucgguucccgucucuccucacugaccuugaccucucccucgguuccugucucuccccacugaccuugaccucucccucgguuccugucucuccucacugacccugaccucucccucgguuccgucucuccucacugaccuugaccucucacucgguuccugucucuccuccacugaccuugaccucucccucgguuccugucucuccucacugacccugaccucucccucgguuccgucucuccccacugaccuugaccucucccucgguuccugucucuccuccacugaccuugaccucucacucgguuccugucucuccucacugaccuugaccucucccucgguuccugucucuccuccacugacccugaccucucccucgguuccugucucuccucacugaccuugaccucucccucgguuccugucucuccccacugaccuugaccucucacucgguuccugucucuccucacugacccugaccucucacucgguuccugucucuccuccucugacccugaccucucccucgguucccgucucuccucacugaccuugaccucucacucgguuccugucucuccucacugaccuugaccucucccucgguuccugucucuccucacugaccuugaccucucccucgguuccugucucuccccacugaccuugaccucucccucgguuccugucucuccccacugaccuugaccucucccucgguuccugucucuccuccacugaccuugaccucucccucgguucccgucucuccucacugaccuugaccucucccucgguuccugucucuccccacugaccuugaccucucccucgguuccugucucuccccacugaccuugaccucucacucgguuccgucucuccccacugaccuugacuccucaccuggacccuaagcugugcugaggcugcuucucccucucgcccuagacuucgacccccaccacuucuggcaguggagcagcuucucggacuacgugcagugcguccuggccuucacgggcguggcgggcuacaucaccuaccuguccauugacuccgcccuguuuguggagacccugggcuuccuggcugugcugaccgaagccaugcugggugugccccagcuuuaccgcaaccaccgccaccaguccacggagggcaugagguaggccggggaugccgccacggaagcaccacugcuccagaggcaccacauggcugcagauuugguaaaaaucaaacgccugugugucuggcuguguauuucccacguugaccugugaagcugccgguuaaagaauagcagguuuauaggccuuggccccucgaccucgcgcuggagcagaugagcuugugugggccgcaugaggggcagccgagacccagcacgggguugggagcugcuccuucagggccguugagacggaaccuuccagugggagggauguccgagugccuggccagacggggcaggaggagugcagggcaaccagccuggcccagggucagggcgggucugguggggcagggaagguggucugggggcugccuuggacacuguccucggucuuuccccacuggccccagcacggccuccggccucugagguaugugguagaaggcugggcaggcugacguucggaaccacagaccaugccugggcgcccugcaccagugcgugccuggacguccccgugaccgccagagguagggcacaacgcgagcagcaugaugcccacgggcucagucaagguccuggauggaaacugcauuguaauaaaaacagaucugcucgcuguggcgggggcagaaaacucuagucccucacacuuucgacccccaggcccgcuccucacuggggaccccccggugccgcuccucacuggggacccuccccggugcccgcuccucacuggggacccccccccgggcccgcuccucacuggggauccgccccccggugcccgcuccucacggagaacacccugagcccccacacguugcuugagucuggucuccaauacagaugcugaggcugugauuuggagggaauguuauucuuggauuuguuauuugugggaaacagccuggaagagaggggcugacgcguuuuuguguuggagaacgggugcccaggggccacagcacucucuugagggcuuucagagaccucugaguauuugcagguuuggcgugugggcagaggugugagggccggggguuguguguagguucaguugcccgugagagguaaagguaggagggcuugucguaggugugggguggugguagggggugagauguaggugcaggccaggguuauagguguggguugcaguuacagguguguggcguaggugugggugugggacauaggcacagaugugaaguguaggugugggcuggggugugggguauggaguuccggugugggcuguagguagagguguggggcaugggucagguguggggugcuggcauggugugagguagguacagguuggggugugguguggggugcagguggggauugggcugcccugguuggugugauuacagugaaucaagaccagggggguugcugggguuucucgggcgagggugcauggaggcccgagaggguguccauggcuggaacaggcucccucacuguuggguugggcaguggcagcccugagggcuucgguguggagcccaaaaggcagggaugcucccagagagaaagugggucucagggcgggcgucguauguaggcuccccggcuggacgugggccuuguccggcggaguguggcguccccagccaccccacagcuggagauccugugggcagugcccgcgugccgagcuugcgaccuggagaucugugggaggugccugggugccaggccugugcccuccagagcaucaccacagccucguggugagggucuagcggauccggaccccacaugccggccuccuggccccucacaaggagcuggccgugugugaccucacaggggccccaggcuuggcaggagcuguugcucucgauuccaggguagcagguuuugcuguucagcgcaggcauguuguucaaggucucagcccaggggcugccccgucagcuggggggacgugggaauccucuucaaacccgaguuuccagaugcuggccgaggcggcccugcaggcaggccugucuuaggcccugaggucugcucuucucacacacggggaaggcuccagaaacgccuguggaaggggggucuguguguggaagaaacacauuggacgugcuuuuccuguucucacucacuucaccacaagcagcacacacacuuccaugugcaggcgucuccccagcaccgagcaggcagucgguccugcggcgggcaccgccgguuguccugacccagagacagcgccagaugccacccacacuuagacacccaucgcaaaucugggccucuggaacuucugggccauguuaggguuccaugaccccuccuugggcucugucagcuugcuggagcggcucacagagcucugggaaacacgguugcugauauuuuacaaagagcauuuuaaaggacagacauaaaccgccgagugaggggauacacagagggagcuguggagggguccccaggcaggagcucggucucguggaguggggcugccgcccucacggcacacagaugagcuccuguucacucuccugccggcucccgcaaauucagcucuccccggagccucccaaagccugucuacuugggagaccucauuggauaggcgugauggacaaugguguugaaaugugauuggaccuaagggugcgacgugaacccagcagggucuguugagauucuucuguccucugugcaggcuccuuccuccaggaugucggcaggacccucucuggaaugaggguuagaguccugccugggcaggugaacagagggcaaaaggucagagagauucuguuuucugaggccuaaagcaccccaacgucaugacaagagcuacagaagcacuguggguacgggagcaccacggguacgggagcaccacggguacgggagcaccacggguacgggagcacugcggcuaugagagcaccacggguacgggagugccgcagguacaagagcgccgcggguacgggagcaccguggguaugggaggguacgggagcacugcggguacgagagcgccgcggguacgggagcaccguggguaugggaggguacgggagcacugcggguaugagagcaccguggguacgggagcgcuguggguaugggagcgccauggguacgggagcaccguggguaugggaggguacgggagcacugcggcuaugagagcaccgcggguacagaagcacugugggaguuagcacccuggaaccguggaugaaaacccgugugugugggaugcggauacacuuacacacauguaaaauaguauugggggugcugugugggcgagaugggagccggggucaugguccuuugccugcauacuucuccuuggcugcggaacuuggaacgugucucagggaucccaggaggugcagguguucuaccucugaguuugcccugcucccugggugagugccaagccccugugagaucaccugggcuaacuucugcuuuuauaaaccucagguguggcuggggacgggaugucacaggcaccccaucuccccaucgggccacaggaggcuuggccucugucccugccgggagggccgggcagaagacgggcgacccacacagcuggcacguugugagggcuuggauggaguccugaggcugagggagauggagcagucucugcggaggaaguaggcagcgaggucagccagcuucaagugcgggaccgcugagacccugugcauccucgucaggaacggggaccaggagcagcagcgucgggucggcucggagugauggagugugugguuguaguuacgguaaugagcgccccggagagucugugcacugaggcccuggccuggccccggggggauggggaggggacagggcgggcccuggggggaugcggaggggguggggcuggccccgcccgugcugccgggagcuucagcccuccccaggcccaguucauccggucugcgcuuuuaagagugaccaucgggcgguuuucccacuggaacacauaaggcguuugcugcuagaacgcacagccagccugaccccaugccugccagccaggcaaagucuggggucugcuuguggggacguugccucugcauggccugagggaagguuuugggaggguucucacuaaacgggaaagggaacaggaccacuccaggcccagccuuugugccgcacguccuuauuucugcugcucugacgccgcguuucaccuuggcccuggguuuuaguaucacccgagugugaauucuggaggcccagcagcugccuuccacaaccugagacgccaccuggcagccugggcaaggcagggccugcagggcuagggccggcgaccugggggcuguuccugaggcucccucugggcagggcugagucuggagccggcuccacuugcgcgucugaagcuccgucucuuugggccugugggcccugcccaccuuccucccuuggcacugcagccuguggggcacaggguccccaccucugccccccuugcuguguggucuucuggcuucuccgcauggguccaggccaccgcuccguggaucuucagcccuccccggccuggguuccacucgcucuccagacgcagcuugggcaagggggugucucuccccuuugccacuuccugggugcuccugugguaccugccuguuccuccggggccacggcagccuuggggugggcuggagugaccccccacuuccugcugucagaccaccccccaucuggaggcaggucagagacgucucagguuccuuugugcuccgaucugccugaugggggcgucgugguauccccagcccugucaggaguugugauucuugaagccauuguggguagugguuucugaaugcagguuugauagaucaugugugcuuccuguauaaucuccagggucguguuuaagaugacguauuuaaaaugugcacacacacguacuuaacagauacccaaaaaaccaagacuuugggcugggcgcgguggcucacgccuguaaucccagcacuuugggaggccagggcagguggaucacaagguuaggaguucaagaccagccuggccaagauggugaaacccugucucuacuaaaaaugcaaaaauuagcuagguguggcaggcgucuguaaucccagcuacucaggaagcugaggcaggagaaucacuugaaccuggggggcggagguugcagugagccaagaucgcgccacugcacuccagccugggcaacagagugagacuccauguaaaaaaacaaacaagacuuugguggcgaauggugacaugagccugaaacgugacagccugaacuucagcuccuuuucucuggggaccugcuagugccacugcccuaggugagggaggcguagaugcugccuggaaucuucccugggacccacagccucagcuccacauuaaaccgaaggucucuaggauguuugauaggaagugacucaagaauucccgaguugaucucguagcagcccugcuucuggaaaguccugugucucguguacuugcacacacgugcacaggccggcaugcacaguugccuccaugcgcgcgugcgcgcaugcacacacacacagcgaugcacacacgguuuccaccugugagcaacugccggaggcauuuuugaacagugacuucccuuuagaaaauacuacgugguuguaguuucugaaccaguaaugagaugugauaaagcuucagaaacagcuuugcuaauuaacacagcaggcuccgaagggcggauuuucugagaguguuugcauuccucuuccuccaguuuuuacuggauuugaagacuguucccugacaaggauuggagggugagguggguguagaugaugagggcagcgggggugcguugguguugacagauggggaggagccugaaaugcggaauacagacaccguggcuguggaagagccugggcaggugccuguguggaccccgacagugugugaccaccguggcugagugaggaugggugaccaggcagguguggcauggugccugcagcaggugaagcugaggcucaggccgccccgcaaggagaggauuucaacuacgucaguccucaccccuuggggcugccccuguccagccaggacaugggcuggauccagaagccgagcucuuacccaaacucuagagcaggcuguguggguccucagccucugggcauguggcaugucuccccuggggccacgucuucaugacacucagaacccccccucacccacugugccuuuccuuaugccuuugaugcagagcaggccccugugguucugaguggagugagugcugcacaggaugccuggguuaacaggaagcaagcucggugcacgcaggcuggcccaugugacaggaggguucagcggaggcucuggaacauuacaaagugugacccgccugagaugugacucacaucacagcauacucacggggcugccaagccagcaccacggucuaauuccagaacauuuuccgcaccccaggaagcaaccccgcggccacuggcagucauucccaccgccccagccuccucacccccgcugccacuccuccacuucccaucuccaugggcuugccuuucaggacacaucacaucaguggugccugaugacacguggccuggugacacguggccuggcgacacguggccuggcgauaugugaccuugugcuuggcgucuuucccugcacuucguauucucaggguucauccaugcugcagaaggggucagcguuucuuuccuuuuugugguugaaaaauguuccuuccauagauuugccacguuugcucuucguucuucguucuucagcugagggacauuugguuguuuaacguuuaugcuguuacaugugauggacacucaugaacgaguuuuuauguggacguaguuuucccuucuaccuggggguggaaucgccgguuggaugugacccuguuucauaauuugcagagcugccagccuguuuuccguccccucccugcucccauccccucgcugcugccguccccucccugcucccacucccucccugcucccgucccccccacuccuguccccuuccugcucuuguccccucccugcugccauccccuccugcuacuguuccccucccugcuccuguccccuuccugcugcuguccucucccugcugccuccccucugcucccgucuccucacugcuccuguccccucugcucccguccccucucugcugcuguccccucccugcucccgucccccccacuccuguccccuuccugcuccuguccccucccugcugccaucuccuccugcuacuguuccccucccugcuccuguccccuuccugcuccauccccucccugcugccuccccucugcuccugucuccucccugcuccugucccuucccugcugcguccccucccugcucccguccccuccccugcccucuaaaugauguagcuaggggggugggggauggcugggauuccaguccccgugccauggugguggagccaucuucucugacagagcgucccggcagcuggaauguccccgcagccagcagagcccagcccagugauggcuccgugccugcagcugccaugcugcagagcgcaccugugcgucagggccccggggacgcuaacagugagggagccgggcggugaccuggggacagggacaggugguccugggaucaggcuucagcugcacguccugccggcccccgucugaccagggcugugucccggcuggaacucuggagcccucugucuuuguuggugugugcagaccugagcucugccacugcggaauccucacggggcgugggccagccgccugccuccuggccugccuggcucccugggguucuguguguuggaggcgucagcagggaaggggacggaaagauguccaggcccccacuggccccucagggcuaaccagcccccuccuagggugggcuccgaaugggccugggcucugccugugugguuggggccucaggaguggccccgacccccgauuucccuccagacagcaaagcagcccacgcuguuccaggcucugcucuuccuuccugggggcugggcucaggcaucaccuucccacuuguccccaccugaggccguggugugggugcugcagugagccucuuagcccuuccccugccacaccuggcagccaggggcauuccaaguugcagaccacauggcuuuaccugauuuuacagugggagcuaaaagcugucucucuaggucuggguugcuugcuuugacuguuucacugaagauaguuugaaaguuguucacaguuaacuuguguggccgcugugugaggagggacguugucugucaaagcagccaaaacaaacgugcccuggccuccuccgucuacacuggaacacgcccagccauaugggaaacccugggcaaaauagacacagucagcagauucuccggggugccacguuucucuauuuuacaccugucuuugguccuuuauauaggauuugugugguucauauggucucuuuuagaaugagaaaauguuaaauuacagcuuaaacuugccuuaaauuacagcuuaguucauucaugugugaugcgaaaaaaaugcucaaauuuagaagagagugaacuagaaaaagucuugugagaugguggggaagguuggggacucuguugugagaugguggggaagguuggggacucuauggugaggguguggggaagguuggggacuccguugugagaugguagggaagccuggggacucuggugaggugguggggaagguuggggacucuggugaggugguggggaagguuggggacucuggugaggugguggggaagguuggggacucuggugaggugguggggaagguuggggacucuggugugagaugguggggaagguuggugacuauggugaggauguggggaagguuggggacucuauggugaggauguggggaagguuggggacucuauggugaggauguggggaagguuggggacucuggugaggguguggggaagguuggggacucuauggugaggguguggggaagguuggagacuggugagaugguggggaaggcuggggacucuggcgaggguguggggaagucuggggacucuggugaggguguggggaaggcuggggacucuggugagguuguagggaaggcuggggacucuggugagguuguggggaagguuggggacuguggugagaugguggggaagguuggggacucuauggugaggguguggggaagguuggggacucuguggugagaugguggggaagccuggggacucuggugaggugguggggaagguuggggacucuugugagaugguggggaagguuggggacucuauggugaggauguggggaagguuggggacucuggugaggugguggggaagguuggggacucuguugugagaugguggggaagguuggggacucuguugugagaugguggggaagguuggggacucuauggugaggauguggggaagguugcggacucuguggugagaugcuggggaagguuggagacuggugagaugguggggaaggcuggggacucuggugaggguguggggaagguuggggacucuguggugauguuguggggaaggcuggggacucuggugagguuguggggaagguuggggacucuggugagguuguggggaagguugaggacucugugguacucugauggggaagguuggguacaucguggugaggaagacuggggacacuguagugaaguuucuggacucacccuugaacuacacaugcauagaucuggcccuaaacuacaugccaacagcuuugugaacucagugucauuguggacaguugacugcucaagucccagucuugucucugaguguugcacaugaaagacagauccaaagaucaaaagggagguuuugaaauggaauuaaauugaacugcaguccaccaaaaacaagucagaccucacacccugaaucuaaccacaugaagugcuugguagcaggaaaagcaacacuguugauaggaccauggaagacucacaucucacugcauaauguucagaauguccaagauaaaaaccaaaguuauguaugaagaguugaguuucucagcugccaacggaaaugacagucaauagaaaccaacucaggcugacagaucagacuuauccaagauuuugaagucacuguuguaacugugcucuaacagguaagagcaaacguucuuggaaugaacgggaagaccgaacaucuccauagagaaauagaaguuuaaagaaaaccaaauagauaauuuuaaauugaaaaauacaauaaucuaaauaauauauuucacgacacaacuguagaauggagaugagaggaaauagugaaguugaaggcagaucauuaaaaaauguccauucugaacaggaagcaauugaaaaacaguaacaaaaacaugaauagagucagggacaaauuccaaagggucuaauauucugucaucugagcccagaggagaggagagugugacacagaggaaaaauagcugaagaaauaagggcugaaaacacccaaaauuuggugaaagacaaacauagauguaagaaguucagugaaucccaaacauaucacaucacaaucaaacugguaagaaucaaagucaaauaaaaaaugucgaaagcaguuaagaggaaaaggauccaaauuacuauggguuucucaccagaaacgagggaggucagaaggaaguggcacauuuuucagaugcugcaagaaaagaacguuugacccagaauucuauauucaggaaaaaaaaaaaaauuccuuuaggaaucaaggcaaaauaaagaccuucucgaaugaaaggaaacaaagcgaagucaugggcagcagugcuacucaacaggaaauacuaaaaaaaguucuuccgcuggaggagagcaacuugggacuccaggaaugaaggaaaaccaacagaaauggccaauaucuggguaaauauaauauauauauuuuucuucuuaaguuauuuaaaauaugugugaaaguuagcaaaaaauauaacauugucuggugggguuuuuagugaauguagcuguacgugacaaguccaauguaaaagagggagacgauagugaacuuggugcuaagacuucugcauuccacuuaaaguaauaaaauguugauccuaaggagacuuugacaaguuaaauauauuauagucccuagaauaagauuuuucaacagcagcacuauugauacuuugaacuggagaaucccuuauugugggggacuaucuugguauuauaggauguuuaacagcauccgugguccccuacacacuagauaccagcaguguuccuccaguugugacaacuaaaaaugucuccaggaauugccagauguuuccuugggcaggggugugaggauggggucauaaucacucccauuugggaaccaaugcccuagagcacuaaaagaacuauacaggccugacacgguggcucacgccuguaauccuagcacuuugggagaccgagguagguggauuggcugagcucaggaguuugagaccagccugggccacguggugaaacccaucucuacuaaaauacaaaacauuagcggagugugguggcgggcgccuguagucccagcuacuugggagacugaggcagaagaauugcuuaaacuggggaggcggagcuugcagugagcugagaucgcgccacugcacuccagccugggugacagagcgagacuccuucucaaaaaaaaaaaaaaaacaaccaaaaaaaaaaaaaacuauacaaagagauacagugaaaaaccaaauagauaaauuaaaaugggauauuuuaaaaauuucaaauaaucuaaaagaaggcaggaauaaaaccguagggacaagcugagaccaaaaaaaauuaaaauggucgaucuaaauucaaaccugucaauaauaacauucaauguaaauggccuaaucauaccaauuaaaggacagcaauguucagauuaauuuaaaaagaaacacaagacucagcuaccugcuguuuacagcaaacucaauugaagucugauuacauccauggcggaugcuggggugcaggauguauugaccaggaggccaugcagugagagaugcauauaugaaccaaagaaagcuuggagucgcuguauuaauaucaggcaaaguaaaggacauuugccuugaauaaaaaaggacauugcaucaugauaaacuggugaguucaccaagaagauacaacaguucugaguguguaugcauggaaccccagagccuggaaguccauaaggucagaacugacagaaaugcaaagacaaauccccaguugcacuuagggacuccagcuuuccucaguaacugauagaaaaagcagacaaaguuagcaaggauguagaaaaucugaacaccaucaacagccaagugaacgugcgcauucuuuucagaugcccguugggcauucaccaaacagaccauauccugggucaugagaauuuuuuuaaaaaagaacugaaauugugcaaaguauuuucuaugaauauaauauaauuaagcuagaaauuaauagcagaaauagaucuuaagucuccaaagguuuagaagcuaaacaacacaccuuuaaacaaucuguuaaagaggauauugcaaagcaaacuauugaaaauauuuugaacugaaaaauacaccaccauaucaaaauuugugggaugcaacuaaagcaaugcuuagaguuaaauguguaguauuaaauacugauuuuagaaaaaaguucucaaaucaucaaucuaagcuuaagaaacuauaaaaugaaaugcaaaggaaccccaagccagcagaaggaaggaaauaacggagcuaacaccaagcaacaaaaaugaaaacaaaacugcagcaaacauaaaaaaccaaacugaaagcugguucuuuggaacaaaucauuaacugauaaaccaguggccagaaugacaagaaagcacagauccccaguauuugguauggaagaggauauucuguagaccccacaggcaucaaaagaguacaaugaacaaccucaugcccauacauuugaaaauuuggauaaaauggaccaauuccuuuaacccaagaagaaauagcuugaguaucucuuaaguagauaacccguaucuaugaaggaaguuguagaugcauaaucuaaagucugaaaaggcucuuuuuccagagaagccagaaauugugucuguguguggguguguguguguuuacagaguuaccaacugauuagaaacaaaguguugaaacucaagugugagcugaugcugcaugccaaguaaagccacgggcuuugugugggaaguagccugucccugaagcaggcguggugguggcucucaggccuugagucuuguucgcaagcacauccugggaaaucucagccgugugugagggucaggcgagcucuguuucccauccuggugugaggggucaaccggaagcugcguggggcgaaggugaccgguggcggggucaccgcgcaaugcucgggcgccugcugugugcauggcuagcgcaggaaaggcaggcgccuuugcaccggggcuguggucccaggcccggagccccaccccaagucagcugugcagcccugccugggccuaaagcaggcaggggggaauuccgaagccugggcugacugcuggggugugugagaggccgaggggccugcaccaccuucccccggugcuacccaggcaccacccugucuuuuugucuguggaagagacuggauuuuguggagcuggagcugcauccaggggaggacacaucccagagaauaaaaaaugggaggaaaaugcccucugugggucagggccuuauaauuuagcuaaaccgacccaaguggaaacagucccaaagccuccugguuuuucccaguggguguaaugauaaagccggauuuauguucucagaggccaacaagaugcucuagagccgagcacugugggcuugggagagaggagggggugcagaugccggcugucuccugcggguuccuagcuccagcccugaacacacccggccauggcugugccugaagacucucacacagggcggcuacggcacccaggugcccacccuggcuuaugagcgggacggacgccccagggugggggagggcuguguccuguccuuucuguccaggcagcgcuccccacccaggcucugccucuggcuucaggagcuguggaagggucagcggccgcugauuuaaacauuucacacgggaaagugcagcagcacucauguucacugcuaggcaagccagggcaugaacacagcggugggggaagcguguucggacugggaugguggguggcggcugcucccuguucacuccaggaaaggaagguuugcaucuaucaccagggagggaggccggcagagacccaaaagcagcugcucugcuccacuuggcugugugccugggggcacagaucugcguccucagcacccucccaggcccggccccucccagaauugccaccgcgcaccaggggcccugacgucagcugcucgcccugcuguccccuguagccucgagcuggucucacuguucuugggcuugcagagccccagccaggcggcagcucuugcggccacagagaagucaaggguggggguugcaugggacagguggggucaggguguguccuuuggcccccuggggugucccugaccccugggucacccuguagacuggguguccccucaacccccugggugcccccugagccccaggccuccccgccgacugccuggggguccccuuagcccccugggugccccugagccccaggucuccccgcugucuaagccccaggccuccccacugacugagcccaggucgccgcccuccccaccgcugaccgccugcuugugucuccacagcaucaagauggugcucauguggaccaguggugacgccuucaagacggccuacuuccugcugaagggugccccucugcaguucuccgugugcggccugcugcaggugcugguggaccuggccauccuggggcaggccuacgccuucgcccgccacccccagaagccggcgccccacgccgugcaccccacuggcaccaaggcccucugacaguggggaggacgaggaugugggaccgccagccgcgggcacuggugggcccugaccuccccgcggggagggugggugcuguggccccugcagguguggcagagauggggcaugggcauuggggucuccaucagccucuguggggugucucagggugggcaguggggguggggcugggacgcuguuugugcucagcggggacagccaggguugaucuggccccgaggguuuuggauguuuuuaggaugacauaaaaagcaaguguuuuccccauuuccucuuaugaaacaccgucugagcccaagguacacauugggcggccugcaggaaccugcuccagguggacacacgggccagcagccgcgaaccuugaagcuggggugaccgcaggagacccuguaaggccugugagcggagcccucgaccccgugacacccuggccagacacccugcuuggacugggguggccucugcuacccaggggucuggcacgggggagggcuggggcuuucucugccugguacacacggaaaggcggcugugcggacgcagggucaccgugcuccggguuuucugacagucgguguuuccugggccuuuggaguggcugcgaggccugaacgccuuguggauccgcuguguccagcccggcugagcaucgccagggcuagcucaugcugcucuugucagccucugguucuccucgaguccuuggggacguggcagaugccagcgaccaucagacaacguggaggcccucaugggcaauggcugagggggccgggcugaggcugugcacaugcagucugcacgccacucuugggcucugcuggcggagauccccuuccuucugggugcagacugcaccuccggaugcaguuuugauguccaucuuccaggagagacggucucggguccagggaguggagggggcugccccugccgugcagguccuggccgauggcgccuuacccugcugcccugggcuuuuggccugaagcaaauuccugagugggggguacuggggccugccgcauccuguccuguccacugcccacccccgugugcuggcucccucacuucuggcugcagugggagccgccagucugacccuugucaccgcacgcucugcccccaccccguugcaagaggucacaccaugucagcagccuugcacugaccgcagccggcccccaggccucagaguucuggaugcuuccgugcggcuccaacaggcaucgucuucccuuccgcagguggaggggccgcuucccgcaggcaucugagcucugugccggggccguggccaugggaagauguuccacgcugccuccuccucgaguuuuccucggaaacacucuugaaugucugagugaggguccugcuuagcucuuuggccugugagaugcuuugaaaauuuuuauuuuuuuaagaugaagcaagaugucuguagcgguaauugccucacauuaaacugucgccgacugcaggcgcagugacugcugaauguacccuguguggcgacuuggaaucaauaaaccauuuguggauccuga

SEQ ID NO: 192767 - RNA, 133552 nt, Homo sapiens
uccagcaaaaaaauacggcuuuauuggaucuauuuccuaacuacaaagacagcugacacagacaucaaacguuuccuuuucaaugacaguccccugagaaaggcugcacgugacuccuacagugccgggugcaggguacccagccgcaggugggacgcggccacacgucuucacgguuacgugcagaccgacgggauggccuucagguuguuucuuuccgugagugagacacaagagacgcgauugugccggagcgcacgguacaggccguuccuucugcgggagcccuuucuccaucagcgacguucuguucagugacuucacagccggagccuccacccgcaggugcaauucaggcagguuccauaagggggcauuaauuccuaaggcacgaguucaggucaaccguguuucaaugaauaaaccaugcuuuuugguuauauggaacaauagaucgcugugaguaaucauacguaauaagcaacuaauuguacagagugcccagcaaggccuacacaaaccuaccuguuaacaguaacucaucugaaaacacacaacgcagggcugagcauuaaaguggcguuuuugguauugguuuucuuagaugaagcagagagugguaaggcuucugugaaacaaucaucuuauaacugaacaaauauauuacacuuagguugcauguuauuuacaaucacuuucuaauguugccgucugguaaccuacagcuacugucaaucacagcuccuggcuuucuaggguccuccucgaacugcgugagacgagaaaaugcacggccguccgaggcggcgauggacgccagcaagagcagcgacuggagccccagacgcagguuccaaaacggaugccgguuauugcugacagggaagcccuccugggcgaggacacgucggcucuguuauuauuuauacauaaauagaugccuagauauguacacacaugcaaaugcaggcuauccuguaacagguuuuucugcuuuuguccaguaaccuauugaugugcuauucaaguuacuugugcuauguucgaagccagauuaaaaacaaagaugcgagcaugcgacuaugaacaagccuacgguuucaaccgcgcagacaagggaagcauguuacaaaagagcugagaugacagacuggaagauucuaaaaugcacuguguaaggcagcaggaguguacgugacagcccaggaaacguuccaaauguuggagacucauacuagaguccucucgcagccuuccagcguucucuucauucauacagaggguaaaaccucacaaugaaauguguuugcaguuucugcuccuaaaaauacuccuacaguagcaaauucaaugcucaauucuaugaugcccugauggucugguuaaauaaggcacuuccaguauugaaccccaggggugccagaagggcugggcguggggucaaacugcgugugggccguucccaugaaaggccccugcacggugggucucccgugcucagcccggccaccucccuucuguugucaugagaugacuucuccuccaggugacacaguggucucccuuccucccugcuuuccuucuuguuggagagccaaucuuugcacauauuaauguucagcuccuggcauucagucaguuggagguucugagugguaccaggugugaguucaguuuauuuauucaaaagucuuugucugcugaagucagcauaccccugcugaacugagugcuccaauguggcaacuaggagugggugcucgugcuggagaggucauuucguauuauuucauuuacuguaagaaaagaaaaauugagaaaguauuagagaaauaccauaaacaucaaagcaacgcccccagcccugcuucuccaucagugacgcucacgccugugacaaggcaucuccccaggaacccacauuuccuccucggucccacccugguccaugagugucgugagccagugccuggcugccucggcagagagcuggggucgccagagugaccgcccucguccguagcacgguaccagcacgucucugacggccaaagugcaggugccaggugccggccgcgaugcugggaagaugcuguggcugucucuccacgaaccaagcgacccacagguccacaccagcacuucuguggugucagcaccagugucgccugagccucccucucaggcucuuccugauuuuuauuucccuuuggauggcagagucccugagucccccacaggccagugacguuccccgucaccugugacuucuggcagacgcagaggaaacgagcggcacuguuagggccuuugugagcugcaugcauccccgccccacccaccuccugcuguggccgcccugaugggcgcugagauaggggaugugccaccagcacugucgccacgucccaucucccucccagguucugguggggcgugcgcugacgucacggaacugcccgggcuucccucugccaugggcuggagcgcccagagcccagauaagccccacguguuucugcaaaggccccggccugucucagggcggcuuccuggagcaauuaguagugugcauuucaucaccccacucccuuccccaaauucccuuucaacaacccccgacuauuuuuaagaauaacaauaauaaaacacagauggagaaccaggaauugugucaugggaacugauaacaggacacacuggcacugagcuccaggaggaacccuggcugcaaacacacacccgaggcuggcucgcccaaggcucugcggggccagagacccaggcaagcaaaggugccccacaugcccggccccgccagcagcaccuccugacauggcgcccacagaaggucccgacucugucccgugugggagcucagccucuguaaagacacaggcacgcgugggcuccccgcaggcccugcucagagccacgcugauccugggcccugcccaagacgggaccuggcacucagccacaggacgcagagccaggcucucugcagagggcuccgcccccaguguggaaggcaccagaaggagcccgggcucccgccccuccgugugacucuucacaaacacuaaggaggauaacgacagggcccaggugcucgcaggcugcucccggacuggcacgcaggaccugacuugucccagagugcgcacggcagcuccucaccagaggcacuuuccgugacacucgggcggcgcugcggggccucggcacaacgcagagagaaagacggcucuguucugugugggggucgcacguccccacccaaaugcccuaggcugcugguugcucagcggccucccgcccacugugcugcugagugcagcggcccccaggagcuccgugcccugcugugcuuggcaucuguggcacgagacagggaugccccagaauucgagaccaguuaacuccuuucccacugcgcugguucagccuugcuacaaaagacgucugcaaagaggcaggaggagccaccugcccaggaggaagacacgguggggguucagguagcucagaacaggccccaccugugggggaagggaggcugcccaaugcaugaagagacugggcucagguccucauccaacccuggccagcggagcuccaaaagaaaggacuccagucagaauagugauuguggggacgaaagaggccuaaaugaucaacacaggggaaagguggggacacuacaaagaaauaaugaagccaugaguggacccugaaggguaacagcgacagggacaggagggaggccugagagguaacgacggugggacguggggaggacugagggguaacgacggugggacguggggaggccugagggguaacaacggugggacguggggaggacugagggguaacgacggugggacguggggaggacugagagguaacgacggugggacguggggaggacugagggguaacgacggugggacguggggaggccugagggguaacgacggugggacguggggaggacugagggguaacgacggugggacguggggaggacugagagguaacgacggugggacguggggaggacugagggguaacgacggugggacguggggaggacugagggguaacgacggugggacguggggaggacugagggguaacgacggugggacguggggaggacugagggguaacgacggugggacguggggaggacugagggguaacgacggugggacguggggaggccugagggguaacgacggugggacguggggaggacugagggguaacgacggugggacguggggaggccugagggguaguaaugaugggauguggggaggcgugaggggacaggaugggugauggugacagugacaggguggggacggcgucugaggucuccaucguguucgugggacaggccgccugcauggccgccgagagccgucuuguuccccgcgggcacaggagggcgcgucgcugagggugaaagggaagcggcauggccauggggcuuccccuugcugcccacgagcaccugagccucggugggagagcccgucggggggcggaaaguuccucggugugucccccggccacccagguucccgucgggggccaccacagccuccuuugcucucucugccugggucugcggcugcugagcucucgggaggggaggagggccgaccucaagagagcugucgaggccuaaggagccagcggcagccugcaccucacuccugcgggcuggcggugcgugugggccgaccccgucccagcgccgggucaaguguguuccacaaggucucagacgcugcagggacgcguggccgggaccagacacagcccaggcacccuccagggccuucccgcugccccauggcagcagcugacagagagcgggauggacaacccugacaccacucagcagaggacagcacagcaaccgaaccgcagaggaggcuguaccgcccacccauccacaccgcggacgagagccguacguggagccgugcucgccccgcagacacggccugugccguagcccugagaggaaagccacggcuuccccuuucacagguggacaacgggcccauccugggguuggucugaggccauguggcucgcuggcgcugggcugaaagacaggaccgcccccccaccccccaacuccuucccgccacgagcacuucugacccaugaggucagccacagcugcccggcccugcccuugcuauuccgggggcggcuuccuuggguaggguaugguugccgaugacaccuacgguuucccauaccagcucucucugcugauaauuuccaucuucuuauucagcuuuuccacagacacaaaggguuuuuucccuuccuagcauauuuugaauugcagguagcaugugacccucacggcgugugggagaccugaaagaggaaacuuacuuugccuaacgucagauguccccgcaacaggauguggugagcuguuauaccacaauuuaauuuaauaaggagggcuuuuuuuucccuuauauuagauuuuucucuaaaauacuccucagguggaaacuauuguuuuuuccuaaaacucgacuguggcguuuugaauccuggcugcaggcugagagccucccucgaggccacauccacacacccacacucauacccaccucucuauacacaucuggaauugagugaaggaggaaaucaguacauuuuuaaauauaaaaacuaccaaguacaagggcaggcauggcuuucacugccucaccugugaaucuuaucugugcccuugcuggggccacgcaagcucucacuagcugugcguaaacaagccguaggcgagacgccuuucucagucaaguauucguaccuucacauaaccaguuucuucuuuuugaucaucauuuugaaagaaaguugacauuuaaacuucacccuguagugagcuacccaaaguucaccucuuaaguuucacgcaggaguuuuguuucucuaugcugggaaugaugagggccagaacggagcugccagggccugaacgcuguuugauauauuuugcccccuugcugccuggcuuggaagcaacauuuuucugcauuucugaaugcccgguuucugaaagcaauuaaggaucuuacauuuuaaggaaugaacaaacuaccauuuccccagcaguuaugcagcccugccuggcccuuugugcaccugcuugcuccuugcaacagccccgggagcggcaaaggcagguacuguagucacccagucuguucacagggaccacggagggcucggagagugggaauggcugccagggaccccagagcugacagggcaggacugacccuuacuggggucugagcucagccggcucugcugggcccugaacagccaccugcccccagauccucccagauggcggccuggggccccgcugggcaagccacaguguuagauguguguuuuuucuuucaguacuuacuaggaaagucauggaaagcuggaugggccuacuggcuggugccugggggacgacucagacccugggacaggaggguucccacccugcccagccagcuccuggccccaggaguccguccucucuccuccaaaucuggcccccgucccuucccucucugguccucccuguuucaccugcagggugcucagugcccggaacuuggcguaucugaggugagggaaggcugggggcggggguguuuacugccacuuuccuuuccugcggugugcgccuuuuaacacaagcaaaacacacacaucagcagacaccccccacagacacacacaucaguggacgcaccccccccacacaaaacacaucagcagauacccuccacacacagacaucaguagacgcacccccccaacacacacacaaaacacacacaccagcagacguccccccacccagacacaauccguggacgcacccccccccacacacacagagacacaaacaucaguggacaccccccaccacacacaaaacacacacaucagcaggcgccagccccuacacccagacaucaguagacgcaccccucuacacacaaaacacacacaucagcagaugccacccccccuacacccagacacacacaucaguggacacccccccccacacacacaaaacgcaucagcagauacccccccacacacacacagacacaaacaucaguggacacccccuccccauacacaaaacaaaacacacaucagcagacggccccccccaacagacacacacaucaguggacgcccccuccccacacacaaaacacacacaucagcagacgcccccccacacaugcacagacacacauaucagcagaugcccccuccccacacacagcagacaaccucccacacacaaaacacacacaucagcagacgcccccacacacacagacauacacaucaguggaugccccccccacacacacagacacacacaucagcagacgcccccccccccacacacacagacacacacaucaggggaugcccccccccacacacauacacaucaguggaugcuccccacacacacacagacacacacaucuguggaugcaccccacacacacacagacacacacaucaguggaugcuccccacacacacacacacacaucagcagacgcccccccccccacacacacagacacacacaucagcggaugcccccccccccacacacacagacauacacaucagcggaugcuccccccacacacacagacacacacaucaguggaugcccccccacacacacauacacaucaguggaugcuccccacacacacacagacacacacaucaguggaugccccccacacacacacauacacaucaguggaugcuccccacacacacacagacacacacaucaguggaugccccccacacacacacagacacacacaucaguggaugcuccccacacacacacacaucaguggaugcucccccccuacacacacacacacagacacacacaucaggagacgcccccccccacacacacagacacacacaucagcggaugcccccacacacacauggacacacaucaguggaugcuccaccccccacacacagacacacauaucagcugaugcccccacacacacauggacacacaucaguggaugcucccccccuacacacacacacagacacacacaucagcagacgccccccacacacacacagacacacacaucagcggaugcccccacacacacauggacacacaucaguggaugcucccacccccauacacagacacacauaucaguggaugcccccccccacacacacagacacacacaucagcggaugcccccccacacacagacacacacaucaguggaugcucccucccacacacacaccaguggaugcuccccuccuacacacacacagacacacacaccaguggaugccccccccacacauacacagacacacacaucaguggaugcccccccccacacacagacacacacaucaguggaugcccccccacacacacacacaucaguggaugcuccccuccuacacacacagacacacacaucaguggaugccccccccccacacacacauaucaguggaugccccccaaccacacacagacacacacaucaguggaugccccccccgacacacagacacacacaucaguggaugccccccccacacacacacagacacacacaucagcggaugcccccacacacacggacacacauuagugguggaugcacccucccccccccacacacagagucuucugcugcuuggcuauacuuauuuuucagucauuucuccgguacuagcuuaaaugugccuuaaacuuuuuuuaugugggggugggggaggcagguggccagaggcgccagcggagcaggaugucggagcugccacucgccuuccacugugcugugagagccaccgggacacgucagcaucuccccuguucugaaaucaacaccgagacacaccgagucccuccggaggcaucugcagaggcagcaacgccacgcgagggcugccgacucuccagcuccaacauuucguccggaccucccggcagcgcagcgggggauccccucccgugaggggcccggaggggcuucgagaaggcugucgccugaugggcuccgucaaguuucccccugcagacccucauucuaccaguuuugauuccauuuuaaaucugacuuccaaguggcaccccugccgacggucaaaacgcccccucuccuggugugugcccuccauccccgcuuccugggggcagccgguuucuugcugucuggacaacagagcucugccaaugccacuuaucucgcccguccaggacuuuaucaccaacuguccuacuuccgacuccagcaaaggagcgacagcgagcacgucugugcuuggcugugacuaacagggccucugaauaaagugaaaauaaucccacuuuaagcugcaagaggaaagacccacagaaggaaaguccuucacggacggagacccaggauccugaaaugcagugcgucccuucaacguucugagaauaaaaauuuaaacaugcaagccccgggaggaaaagcaauuccuaaaacauggcagaaacaacauaaaaaaaaucuugcuguuguuuuaaaaacugaccuaagaccaggcaugguggcucacaccuguaaucccagcacuuugggaagccaaggcgggaggaucacuugaggccaaaaguucaagaccagccugggcaauguagugagaccaccccccaucucuacaaacaaauguaaaaauuagccagacaugguggugugcaccuguggucccagcuacuugggaggcugaggugggaggauggcuugagcccaggagguugaggcugcagugagcugagauuguaccacugcauuccagccugggugacagagcaagacccugucucaggaaaaaaaauaaaaaaauaaaaaauaaauagccugaucuccuguuuuccaggaaagcccgagccuuguaaggguuuuucagaugguagugaaacaacuuggaagucagcaauuccuaaggauuuuccaaaucuucucagacuaaaauucucccacuuuccugcugccuuguucaaaccaugguucggagaucugugagcagccugccagccgccggaggcucugaagccuuucugaggcgaggucuuugcaccugaacgcucugguagaacaagguuuagcaaaagggagccuggaagggcccauccucaccuucugcccaguccugcagggcucaggacacauccugggggcuaaucugugggaagagguuugacugagaccccguucugcucugugaaugggcggacucuucagcaucucacacggagaaacaacuuccuccuggaucggagcccaagucagggauaaggugccuccugccugcaccgugggcacuggccgccuuguuacagaaucaacggccguccacugagggacaccgggugccagggguccuaacaccccuccagagcacccggcacagcucuccuuggagcugggugcuacccuuagucucguuuugaagacaggacugggcggucaggucagcccauccucacacugcggugaguagcgggggcaggagcagccuugcugugggccacgcccugggcaaugagcgguggcuccuugggggaucucagauuuuuccaagucuguuuucuauauggcugaacgaugugacaaaacacuugucaaggacacccucucaggugcucugaucugcaucuuucacgagcgagagggggggugccaggcacuuccugguggaccuucaguuaccgcccaucagaacacaagcaggcagcgcgaaacaugcugggcccgggggcuccaucgcccuuuacacugccacacucagcuuccacauguucuacugugggcgugugccccuccuucauguuucugggguucauggggacauuaguguuguccuucccuuucugucucaaagaauugacugugccugucauuggacgcagcggcugccaugaaugucgaccgggaaagcgaugggaaaagcuguucagacacagcugagcugccucuaccuggucaccugcacgccaggcccaugcagucugcuccaucccugucccuggcagagcccaucugggagugguggugacugugccagcuggagacccacugagcaccagggugcagcacagacaacgacgcccucaggcugcgugcagugaagagccgggagaggcagcgcuagaauuguuuuuaggaacuggauuugggcuuaaagaauaaacaaugugguucagccacgcuaacccaaauacacuguuuaauccuugcaguuaaaaaguuuaaguagcacagaugaagacuauaacuugcauaaacgauuuuugugucaauuuuuaaaaagcauauuuguucauauagguaccacuaacuuaauugcacaaaacacauuuaaaagcaucuucccucuuuuucaaugguuauguuaguuccaaucaacaaccaauugugcuaugauuauucaagucuaagaguauuuaucuaugaccgcuaaacaaaccagacaguuuggcaaggacacaggccucagaauuaucagacaucagaacguccugcaggacugcuccuucuuuagaguugucauuuuccuuuacacuaaagcaauacaggaaacaaaaaaggccgucgugaugccacccacggccuacgggggcauguuccuauugccucuuccugucgcagcguccccauccgccucacuuuccguccagcaggcucccuucuaaggcccaccgucccacuggacacagcguaauuaaaccugcagcaggaacgcaauuguccccagcuuacuccaccauccucugagggacagaaaagugcauauucuucagaggacaagucaucaaaaauaacuuuuuaaaaagagcaaaacaaaacaggaaagacauucuccuccauuccuauaacuaagagauaauuauaaaaaguauuugcuaaccuucccagaaaauacaccuuuagcuaaaguuagucuuguaaccuaagaggguaauaauuuggguaggacacagauagaaccagaaauaucucaggccaaauccuauucuuaaauaacuaacuucuaagaugucucccaaugacauuugcuguacucagcuuugacaauaucuaauaauucuuggaguaagaacgccauuugauggugguugaaaaccuuaaugaacauauggauuuucauggcuguggcguucauuacaaaggggcaugauagauguguuuacugacuguuuuaugguuucauugaauugcugaauacacagcuuucaauuuuuccaucugacauacacauuuagacuuguauggcucucauuuaagguauuacaguagauaugagcuaaguacauaaaaauaugguuaaagccacaaauuagagaucagaaaauaggaagcgaagaggaaaacgcuuuuguuccacuguacguauaucgugucugaugcagagguggcuucggugugugcgccaagguaacugaagaggccgccucucauguggguuuuuuaauuuuuugagaagaagcaaccucuuagaaagucuaccauaaauguuuccuccuucacaagcaaauaucuggauuuuccauaaccuccuacaugaagccuccaccacggccuccucgguccacccuaaacuguccgacacugcugggcgcccggcgcucggcugagaaacgggguaagaacaagggcgguucugccacuccacagucgaggagccaccacauucugaaaacgcagggucgcagcgucucuagaacccuucuuuacgauucugcauuuuucaaagaugcuuuguaaagcaguggaaaauaacagcuucucaaguuucauuaaaaaguaaguucucaaguccaggaccuauuucagccuucacuuauuuuuaucuuuuucaucgcaauaagccaccgccacagggccugcuauuuuuggaaggagaggacgggacaacggagggacggccugacaagucacaguuuucauaaaacaagccccucaucuggacgcagcuggugguggggagcgggaccgccacucgggacgucagccauuaagacagaauaauuuuccuaccuuaacugccugcuuccuuauuuagccugaauguugcacagaaugcaaacgccguguggaaacugccaggguucaggguacaggaccacgugccugggagauuccgacaggcuguccuuccgccccccaccgagacggcaugcgggcgcguguuuccacggaucuaguccgucuuaucugcaccaaacugccauuccagucacucacugggaucauuaaaccaccacuugcaguuuuccagggcuuucuuuguucuacuaggaaguauaugcccccaaauuaugaaauuccauuucaaacagaauuaacagaauuuaaaaaauaaaaauguuaaagcuccuuuuaauaaagauaaagugaauggaccccgaggagagugaccggguugggucucgguaggucccgcuuccuccugucccucugcuacagaaacacgauucuuccucugccuguuccagggggagacgggcacuuggugugaacuggcacugaucaggcggccuccuucuuuguaggguggcagagagggucaggauagaaugucaccaugugaaguguguagcagcaggaggucaaaagcuccauuggcaacucagaagccaauacgccccugguccccggccaggcugcaggggugugagccgagcccccuccgagcccccauccaccaccaccacccgcccaccaccaccacugcagguauccugugggccagggacucccaaaggagguggcuggagaccaccacuccugugggaugggaaacuugccuuccuucuuuuuuuuuuuuuuuuuuuugagauggagucuugcucugucacccaggcaggagugcaguggcgcgaucucugcucacugcaaccuuccagguucaagcgauucuccugccucagccuccugaguagcugggauuacaggaaccugccaccacacccagcuaauuuuuguauuuuuaguagagaugggguuucgccauguuggccacgcuggucucaaacucccgagcuacagugaucugcccgccguugccucccaaagugcugggauuacaggugugagccacugugccuggccugcauuuuauuuuuagaaucagcgucuugcucugucuguugcccaggcuggugugcaguggaaugaucucagcucacugcagccucgaccucccagguucaagcaauacucccuccucagacucucaaguaggugggaccacaggugcaugcuaccaugccuggcuaauuuuuaaauuguauagagacagggucuugcuauguugcccaggcuggucuccaacuccugggcucaagugauccucuugccucagccucccaacaugcuaggauuauaggugugagccacuguacccagccccaaaccugccuuacuaaaaugugacuuucaacuaaaucuuccucuuaccagagaaucugccauuuuguuaggugugaaaguugcacuguggcuauguaagaaaacggccauuuaaaaaagacaccugcuucggaggcaugccagggugguggggguggggagugagauugguuuuuuuuuuuuuuuuuuuuuuuuuuugaggcagggucucauucugucacuggcuggagaugcagugguucgaucacagcucacugcagccuugaucucccaggcuuaugcgauccuuucuccucugccuccugagcagcuccugagcgccaacacaccuggcuaauuuuuguauuuuugguagaggugggauuucaccauguugcccaagcuggucuggaacuccugggcucgugugaucuucccacgucagccucucaaguagcugggaccacaggugugcaccaccacaccuggcuaauuucuaaaauuuuuguagagauggggucuugcuauguugccccaggguggucuccaacuccuggcucaccaauccuccugccuuggccucccaaagugcuuggaucacaggugugagccacugugcuggcugagggugugauuuuuaaacaucucagcaaugacaacuagaugggaacgccaaucccugcggccacaccuggaccggcucacagcugaaccugggcagcgccuggaggaaccugccacuccgcucacucugccccacgcacguccacgcucaccguggagaucagcacggccuucacaggagccugaagcacagugagcggccagcucagguggggacacguccccgagaagggacagaggcuagcacacagggagacaaaggauccaugggcuccacaguggcccguccuggacgugggcaugcacauggcacagccaguguacccucaggcuucaccacgccacgcaccuccccucauggugaguguccacgaaccaccgugggugucaccuggagcucggcagcacacaggccacacacccccggcagaugcagccccaguaaugucuggggagcccugggucagagggaggagaccgggagcuagcugcaagggaaaccgcccccaugccccagggacacucgccuugaagaguacuucucuagggcugcccacgaaagacgacguccacgcccccgccggcgggaaagcacgugucccucaccaccacgauguuuucgaauuaucguuugaaucuuuaagaggugcuuuuguaccaguuuuuaaagugacauuuuguuugagguuuggggacagcccagaguccucagaagccucgggggaugacgcggguaucugggaaggugggugggaggcggguggaagagcagaaaagggaaagauccucaagccugguccuugagaaagccgugugcugacccgggagccucacgcccuggccgcggaggccaaggugcccucugccacgggaagcaggucaucucccugcagacccuacaggugggggccggggacggcgucucugcagcggucccagugcccugaacccggaguccacccgcgggcaucagcugcucuacgccgacgggaguugacacagccugguggugguucuggguaucgagagaggaauuaaaauacuggcagugcuccuuuuuauugagagccgagcguucgaaagugauaccguuuuuaaagcgcucuuuaaaaacauggcagauacaacucccugcgucucuagcgaaauucucugccaggcccucucccaucuuauaggcacaugagccagguggguacggaaggcgauuugguguggguggggugcggaccuacggucaggacgucccugcaggcagcaccccacauucacacgggaaggcuauuucuuccaguggacuugguggccgucagcgcgccuccccgcagcacguggagaaggcgcccucaggaccucccugacacauacaggggcugagagcucgagugggaugagacguggcucacgugugcaggcuccacuguucaaacggcagccacagcccagagcgcagcagagggcacaggugccgcauccagguggacagaccacggcucagcaaacgggggaggcacacggggcccaccgacuggagagaccgcagcucagcaaacgggaagcacaaggggcccgccgacugcaggcaucuccuccugccacaugugugaguccacagccgcacaacugccaaggcucugaccucguggagccacagaugcugcuccggcuccgguuccuagccaggguugcuucuccuccuugggaggcugucuagaaaaauucaaggcaaagcaaaaguucgggguguguggguguggcggaguggcugccguucucauaaaaucccuaagccuuagucuaaacuccacguggugggagagguccuagugccagguggugccaggauuuugcugcagucagacgcuuuuccguuuauuuaccucccagggcagugccuguggcgcaguuucaacaaaguccaaacacucgccaguguccuggggcgaggccguguccuggggugaggccguguccuggggcgaggccguguccuggggucaggcugcguccuggggcuugucuccucaagccauccucccugaggccggcuccuccugggccucucuguccgccaugccaggggucgcuugggccggagacaaggagccauugccgggacaggcuccugugccccgcgugcucccgccaccugcgcauccugggauggcugcggacgucucagcugcgucccauccacugggcuccugagagccagcacacagcuuccugcucuccccaggcccgugccgcccucuguuccuggccucccccagaagccccgaauccugccaacucccuaggcaggucccggacccgcagcaaguccauccacaucucccagcuccacugcacguccugagcuucagcagcucuccucgggccagcucagugccucaccggcuggccccccacugagagccucgaaaccacgcaggcagcuccccaugcugcagccaggggagcaccucugggagggaaauccaggcccugacugccucaggagcucaggggcgcagacguguccuggcgggaggcacagccccucuugaaccugcccuccaccccuccacagcucaggcuacguacauccugggcacggcgaggcuucccuccacggccgccacugugccauggcccuggugcccucacagccauuaccugugccgcccuccccuggcuuaacggaagccaccguggagucacugcugucuguguuagcagcacugacccccggcagaaccugcuguuugcaaagaauagaaaagucacggagguacggagacaacgcaccaugacccaucguguggcgaggugcuggccaaacucccaacgcggaagcagcggggaggggggaggcagagucgggccuuguaaucuucaggacauauugaccccggagugaaaaaaacaccccaagauugaauuucuguauugauuauccaauuauuaaucuuguggaggcuauuccaacacugcacauaaugagcaauucaucacagcgagccgggugccacggagcggugcggcaggaaggccauuagguuccuguaauugccguugguggacucucguuagcucuaaaucgaaucagcggggcuggcccagggcacccugacagacaccgcgggcccacgccaggccucgccagcgaccacucccagccuggcugggaacacgacacuuccaccgcagcgacaagaccggcgaacgaugccccggagcaggaugccccggcggaggagcccccgguggaggaugucccggcggaggaugccccggcggaagaugccccggcagaggaugccccggcagaggaugccccggcagaggaugccccggcagaggagccccguggaggggaugccggggucugugcccagggccacacagggcagggacgccuccgcaggaaggaccugggugcccccacacccugucuucuagaagaaauucuaucaaccgaccgcucccaaacccagcagacuuggaaaccgagccuggcaacugggaaugcaucucauccucaggguuucaaaccucaugacacugcguuucccacauaaacagaaaagaccgcugaaauaaaagagagacaggcccaucccuguuccuccgaaaaguuuuuugaccucuaagccccucaaauccaaacgcaagagcccuccaccacgccuguggcaaccacgcaggugccaucagguagggccgcauucaucucaccuggaauugugauuuaaacgugaauuauuuaacuucucgcuucaacuguucucccucucccuacuccgauuuucugagggcucagggaucugauccccauaugugguuuuuuuuuagcccuaaaguaauuccuaaauacucacucauucuaugucaucuuuugaaaguggaauccgucccaucccugaguuuccgcacgggggcaugacccagcgaaccucaccacggcugcggcucccaucaggugacccugaagugacggcccgggaaccugcucgcuguccugucugaauuuccuccuuggggggggcuaugaguuaucuggaaaacuaagcacuaauuucuucuguuuuccuaaauuugguuucugaagaagccuuaaaauaugucuucagaagaaagauugaccguggagacacaggcucuuucgagaugucuguucacaauaaaggaccaaagaucaacgaggcuuuauggcugcaccaagagugguuaacuuuaaauggaagcagccugugagcucagugugguaccuggcgccgaggacacuuuccgauaagucuugguccauuuccaaacaccgaggugaggucagcccagagaaagugggagggcuuucugagcaggagcagaagcugggauuggagcucagagcuccccagcuucgcguucccucccugguccgugagcugacaguugucacagccuccugcucaggugucauggguguucagcucagacugugccggcaccuuccagaaccuucuguaacuuuagcagguccagaucuaauggagaucacugaccuaaucaaaguggucaaaacugcuuaaaagaaacccaggucucuuugagacccuccugggagcaggggugccccucuaggcaggggagcauugcaugugaggcccacggcauggcacugcgcgggcgucugaggaaacaucaccgggccggcaucugcgugcucuccucuccucccacgcccucugcauggccaacccccucgccgcccacuguccacaucccaggcccagcuccuccuacagugaagggggaccugggggaguggcugggccccagcugagcuggcagcccaggguggguggcggugaguuccggcugguggagagcuggcguccggcaggcgcgguggacaucugcauaugugggugccaaagcuccgccuugaaggcagcuagagacaggugcagaaaaggggaacaggaaguggacggcggggaaaggacacgggccacgccacugcacaggggccagcacgucccucuccccggagcccacacaccucugcggaggcugcaacacugcccagcaauggcguuuccuuccaugcgggucucuccaaugcucuaguucuccgcuuucuccguacaggacacugcaagaagcacagacaccuggcacggcaguggagaccgacaacccuguccacuccagcagagaaaaggagcugaaaagaaccagacaucacagugaacacagcaacaaaagaaaaggccgccaugagagagaaagggagggagggagggacggagagagagacagagaggcagagacagagggagagagauaagagagacagagacacacggagggagauggagagagagagagauggacggagagauggagagagggacagagaaacagagcgaggaagggagggagacggagagagauggauggagagagggacagagauucagagacggagggagacaaagaggcagagacagggaggaagggagacagagagacagacugagaaagagacagaccgagagacagagacagagagagggauagagauacagagaaagaccgagagagaggggagggaguucagacccuccgugcguuuaugagccuucgagcacauuuuugaggggcagucagacuagugcuuucaauuuuucuuuuaauccagcauaaacaccuaauuaacagauaggcucugacaaacauuucugagcucuuuucuuaaauuaaaacacauaaaaaacaccugcccaugcgcccccucacccaacccucacacgcacgccgcugcccuguggcugcuggucaggccgagcgaacugccaggugacgacgcuuccuccugcccggcacccucuguccguccaucccucccuccagccaggugaccaggcuuccucccaccaggcgcccuccguccguccgucccucccucccuccaccuuuuuucuccagccuucugccaagaggaaauaacucagcugcacugggagucugggaaucccagaaaacaaucugaaauccacaaaaauaauugaaguucacuuuuacugagcuguucaguuccauucugauuuuuauuacaaugucaacaagaguuuaauuuguuuuaaaguuuggguucuuaaaucugagugauauacgguaguuuacagcccgcuggcagcagcuacuguggaaaagggaaaguacauaacagggauccuccgccugacgcggcgacugcggcugcggggagcccggccagagcgacggcccccagcuucccgcgggacgguggccacgugacggacguguuucccuccacagccagcuccuccgaaagcucccaaaaccuaacuucucacguaaaagcacugcggaugcgaaugcgcucacuaacguuuacuauuucagagggcgagggagaagguuuuucuuuacugacucgugaggcuucuugcaacacaucacgggugggggugcagaagccugguguccuuucuagggcuccgggggacgugcgucaggaacccacacauuuguccccuggcccagggcucgucugugcgccugcugagacacugccagggaggacaucugggcccaucggugccagcugaacagacacugggcugaacugcaaacccauccacuugaggggugaggucuucauggugcugccccggagggcaggggcucccuuggcagaggcugcgccagccagcgcugcacaccgucagccccaugucuguggggagccacagccugccggccacgccugccugauuuacgcggccgcucgcauggcuccaccggccccggcacagcccucuaacccgcaguccaggcugcugugccuucucccucccugccaccagcucugagugcagccucgggaacugagcugcugccaagggcugggagccgugcgguuuccaggcccuacuuccugccauaucuaaaauaacagcagcugggagggccugauagggccugucuggggcgaagacuucaccucuggggugggacgcgggccaggggcugauaacccccuccccgcagugccuggcgacagcguccugcuccaucagcuccguuucggaacaaagagagcccagccacagcucuggggugauaacuaggggagggcuggcccggccgcuggguccauugucccaguaucaggcuuugauuauggguccggggccuggugggcggaucuuuggaaggggauacacuuucuuugucccuuacugugugugaguguccacacuguaaucuggaaggaaggaagaacccuguuucagaauuaaacugaaaaggaucaagagauucucaaaauuccacacccagaccuccaguaaugcaacacagaaccacccagaagccaggcaggaaguggcugagaaguucaugcucccgucuguguuucuaaagagauuucuuaauuaagcaacacaauaaguaacugggaagcacacacauuuuuauucccuacgagaaauucugucaugaacacugucauuuaaaaauagagcuagacuccuccuaacacucccuacaggacaugguccagggaccguguguuggacgugauggcuucaagcccaauucccccagcacugagcaucuucagaggccaaugaaccacguuaugaaaccacacucagcucucaggcccugugaagagaggcuccaagggcuguguggagggcagacggacccacaccccuggggagggcauaucagagcaggugccgggccagcacagagggucccugggagaggccuggucaccggaggugggaagauggggggacaaggcgcacagucccagugucuuugcuggggaagcucaggagcaucuguccacggagggaggggcugacacgcaggugcccacagccgcugcucggccgagaccacuguuccucuccacacugcggcugaggaggcaacugaaaccacgccacaggcucagaccccacggcgaaccgcucuuuauaaggaguccuuuuucuugcauuaacaaaaugcucaaaacucaguugaagaaaaguaaaaagcacguggcauugcuagggucucccagccccucccuaaacacacagcauucuacggaggcacguuucacacagguaaugcacccuugagaagggcacaaaauucagugauuuuugguaaaggugcccaguugugccaccaucacugcaggugucagaacacuuccaucacccaaggggcucguccaccaccucuucccacaaagcggucuccugccucuucccucauccaagggccuccagcaccaccuccucccacgcagcagucuccugccucuucccucacccaagggccuccagcaccaccuccucccacacagcagucuccugccucuucccucacccaagggucucauccaccaccuccucccacacagcagucuccugccucuucccucacccaagggccuccagcaccaccuccucccacacagcagucuccugccucuuccaucacccaagggucucguccaccaccuccucccacgcagcagucuccugccucuuccaucacccaagggucucauccaccaccuccucccacacagcagucuccugccucuucccucacccaagggccuccagcaccaccuccucccacacagcagucuccugccucuuccaucacccaagggccuccagcaucaccuccucccacgcagcagucuccugccucuucucucacccaagggccuccagcaccaccuccucccacgcagcagucuccugccucuuccaucacccaagggccuccagcaucaccuccucccacgcagcagucuccugccucuucccucacccaagggccuccagcaccaccuccucccacgcagcagucuccugccucuuccaucacccaagggucucauccaccaccuccucccacacagcagucuccugccucuucccucacccaagggccuccagcaccaccuccucccacgcagcagucuccugccucuucccucacccaagggccuccagcaccaccuccucccacgcagcagucuccugccucuuccaucacccaagggccuccagcaucaccuccucccacgcagcagucuccugccucuucccucacccaagggccuccagcaccaccuccucccacgcagcagucuccugccucuuccaucacccaagggucucauccaccaccuccucccacacagcagucuccugccucuucccucacccaagggccuccagcaccaccuccucccacgcagcagucuccugccucuucccucacccaagggccuccagcaccaccuccucccacacagcagucuccugccucuucccucacccaagggccuccagcaccaccuccucccacgcagcagucuccugucuccagagcugcgccuuuuguggaugucuugcaggcaagccucacuucacugugcuucagacacugcuuuucacaaaggggaggucuuuggcaacccugcaccaggcaugucugugggcaccacguuuccaacagcaggugcccacuucauaucucugugucacguuucaauaaugcucaugauguuccaagcuuucucauugcuaucauaucugcugcggagaucugugaucuuugggguuacuguugucauuguuuuggggugccacgaacugugcccaucuaagaugaagugaauggauaagagcugggugcguccugacugcuccacugaccagccauucucuaucucucucccugggcucaggccucccuauucccugagacacaaccauacugacauuaggccaauuaagaacccuacgacagccuccaaguuuucaaguaaaaguucaagggcaaggaaaggucacacgucucucacuucaaaacuaggaaugauuaaauuuggugaggaacacccgucgaaagccgagacaggcugacagcucagccucccgcgccaguccaacugugaaugcagcggaaaacucuagacagacagaagugaaaaccgcugcccuagugaacaacaccgaugauaagagggcggaacagccuuauugcugauacagagaaaguccgagugaucuggacagaagauugaaccagccacaacacucccuuaagccaaagccuaauccagaccaagacccucgcucucucuguccuacgaaggcugagagaugaggaagcugcagaaaaaaaaguuugaagccagcagaggcuaguucaugagguugaaggaaagaagccaucuccauaccauaaaagcaaagaugaagcagcaagugcugauggggaagcugcagcaaguucuccaggagaucuggcugagaccauuggugaagguggccacacuaaacaacagauuuucugugcagacaaaacagccuucuauuggagaugccgucugggacucccauagcuggagaggacucagugucuggcugcaaagcuuccaaggacaggcugacccccuugguaggggcuaaugcagcuggugacuuuaaguugaauccaguguccaucugccaccccgaaaaucccaaggccccuaagaaugacgcggaaucuccucugccugugcgccacccauggagcgacaaagcccggaugacggcaccucuguucacagcaugguuuaccgaagguuuuaagcccaccauugagacuuaacugcucauaaaaagagcccuuuaauaauauuacugcucacggacaaugcaccuggucaccccacgcagguacaaacacuguuuuuuuagacacauugcuggugcacacuuaacagacucaguacagugugagcgucacuuuuauaugcccuggaagccacacacuccagcggcuuucuuuugccauacuggcuguaucccaguggucugaggcugaaccugcgacgucucugaggugugcaugcaagggagccacugagucuguggucucguguguggauuuuucccagagcaugaggguuuccagguucaccugaguccuggggugcucaguacucauuccuuuuggggauggauaacacucgggugaggauaaaccccaccuuuccucucucuuccccacaugcugggcauugugguuguuucagauguuuggcuaaagaacgcugugaaggacagucauguacaagccuuuguguggaugugugcaucuguuuccuugaauacauaccuaggaguggaacugcugagucacauggcaaguuucuucuaagaaauuucuuuaagaaacugccuaaguggccggaauguaaugccauguuacacuccugccagcaaggcuucaggggcccaauuucuccucgucucuaaaauuggcuguugucuaucuuaucuccuaaagccacuugaauggauauaaaaugguaucuuauugaaauuuacaaugugcauucccuaauaacuagugauguggaguauuuuuucauguguuuauuauccauuccuaugucuugucuggagaaaugucuauucaaauccuuugcccaguuuuugauuaggcuuucugucuuauuauugagcuguaaguguucuuuguauauucuggauauaagcccuuuaucagauaguuguuuugcaaacacauuccucuagucuauugcuuaucuuuucauuuucuuaauaguacuuuugaagcauaaaaauuuuaaauuuuggugagguuccauuuaucaaguuuuuauuuuaugagcugugcuuuugaugucauaucuaagaaaccucugccuaauccaaagucuugaaagaguuccucaugugcuaucuccaaaaacguuugacuauuuuggcuccuacuaguccaagaucaaguucauuuucggugcgugguguguguuuuuuugcauguggcaaaugucccagcaccacuuguuaaaaaggcugucauuuacuccaauuaaaugggcuuugugccuuugucaaaaaaucaauuuaccgcagacauaagaauuauuuuggggcuuuuaauucugcgccacugaucuauguguccuaugccaauaccacacugucuugauuauuauagcuucacagaaaguucugaaauugcgaaguguaacuccuccaacuuuguucucugauuucaaaauuguuuuggcuauucugggucuuugaaacuccauguagauuuuaggaucauuuugugaauuuuagaagaaaaaauugcuggaguuuugauggagauugcacugauucuccagaucaaucuggagaaagcugccaucuucacaauauugauucuucuguuccauuaacaugcaauguucucccauuuauuuagaucuuaacuuucccucagcaacguucugucauuuucagaguauaaguccuuaacuucuuuaaaguuauucauauuuuauucuuuuuaaugcuauaucguagauaggaauuuuuccuugauuucauuuuuggauuauuccuugcauauagacauaauuuauuuguacccuggucucacaucugaugaccuugcugcacuuguuugguaguuuuaacaguggguuuuccuuuaccuuuuuggcggggggagggggggugggguguaggcagauuucucaggauuuucuacauauagaaucacguuuucuuccaauaaagacaauuuuacuuuuuccuguccauuccgguugccuuuuauuucuguuucuuaccuggcuacacuggcuagaaccuccaguacaaggcugaguagcagcagugaaaguggccaccucugcauccuuccucauccuaggggaaaagaagguccuccgucuuggacgauucagugugaugaucacuguuuuuuuuucuguguaugacuuugaucagguuaagaaguucccuuguguucuaaguuugucaagagauuuuaucauaaguugguguuggauuuuguuaaaugcuuuuuuucuugcauuuauugaaaugaucacgugguuucuguccuuuuucuauuaauaugguacaucacaugacuucauuuucugaugcuaaaccaaccuugcauuacugggauaaaucccacuuggucaugguguaaaaucuuuuuuuuauguuguuggauucaguuugauaauauuuuguuguggauuuuugcuccuguguucauaaagaauauuuuucuauaguuuuucuuacgauacuuuugauuuugguauuagggcuauacuggcuucaguauuagaaguguuccuucuucauuuucugaagaguuuguggaguauuggcacugguauuauucuuguaauguuuaauaaaauuaaccaguaaagcucucugggucugggcuuuucuuugugagaauauguuaaauuauuaauuucuuuuauuucccugcuauaggucuauuauacuuuucuguuucuuccugagucaguuuagguaauucgugucuaagaauguuuccauuucauccagguuguuuaaucuguuggcauaagguuauaguauucccuuauaaccuuuugauuuuugcagggucaguagcaauguccccucuuucauuccuaauuuuucuuguuagaaaaacucauuaaaguuuugucaauuuuguuguuuuuucaaauaacuaacuuugguuuuauugauuuuucucauguuucuauuucauugcuuuuucuucucauccucagcauuuccuuuuuuccacuugccuuggguuuuuucucuccuuuuucaacauuuuuaaggaaaaagcuuagauuauugauuugaaauccaucuuauuccucauauaggcauuuaaagcuauaaauuucccucuaagcacugccuuaccugcaucccacaaauuuugauauguuguguuuucauuugcauuuaguucaaaauauuuuccaauuucccuuauacuuucuaacuucacucauuaauuauuuagaaauguguuguuuaguuuccaaauauuuguggaaauaucuguuguugauuuucaauugauauccauugcaaucagaauauuuugaaauuuauuaaggcuuguuuuauggcauaguaggaagucuauccuaugugcacucuguagaguguccuacagaugucuuguaaaguugguugauagucuuaaguguuuuauauccuuuugauuuucugucuaguuguucuauccauuaagagugauauacuggucuccagcuauuauuuuucaacuauguauuucucccuuuaauucugucaguucuuguuucauguauuauggggcucuguuaugugcaaauguguuuauaucuuccuguucaauguaucagguuuaagaucaaagagaacaugacuacugacaguucauuguuucuaguaauauuuuuaucuuagaguuuaauuugucugauauuaguguagcuacuccaaauuucuacauuaacucugccuaucuuuuucauccuuucacuuucaaccuauuugugucuuuaaaucugaaguauguauuuuuuccauuaucuccauaucucuuuugauuacuauugcacaguaucucuuuaucauuuuacuuucaaccuauuugugucuuuaaaucuaaaauauguauuuuuuagacagcauaugguuguacccuguuucauucugucuuuaacauccagucugacaacaucuaccuuuuuauugggguguuuauuccacugacauuuaaugugauuauugauacgguaggauuauguuuuccauuuugcuauuuguucucuacaugucuuguguaacuuuugcuguugucauuguuucuauguuccuucauuacuggcuuauuuuguguuacacacauauuuucuaguguaucauuuaagugcauuuuuugacauuuuaugugugugugugacacacucacacacauauauauuuucuuagugguuccucuggagauuacaacaagcaucuuagucaaaacagucuauuucagaugaauacugaguucuaauaauauguaaagacuuugcuuugcuguaacuuccuuccccaccccuuccuuugugcuacugucacacaaauuguuauaagcacauuguuaucagcacagguuugcaaucgugucuuaugcaguuuccuuuuacaucaguucagagaagaaaaguuuaaaacauguuugugcugucuuuuuaauucaccuauguaauuacucucaccagugcuucuuaccucagccugaaggacucccuuuaauauguccuguaggucaggucuguuggcaacaaauucugugugucuuguuuaucugagcacagcuuuguuucuucaucucuaaagaugaguuuuacuagauauagaauucuugguugacagugguuuucuuucagcauuuugaaugcgccgucccacuguccuccgacauccacgauucacaauaagcagcuggcuguuaauccugcugagcaucccacguacugagaagcuguuuuccucucacugcuuucgggauugucucucccuuugacuuucaacaguuugguuuaugucugugugugagcugcuuuuaauuuaucccauuugaauuuugugaaccauuuggaugcacugaauaauguuuuccaucaaauuuaggaaguuuggggccauuauuucuucacguauuucuucuaaucaucucuuucuauaacucauuaugcauguguauauguguuuacagcaucucacaugcucugaggcuuuguucauuuuuauugauucuuucuucuuucuguuccucagucuaaauaaucuguugauuuuuacguuugauucuuuuucucugccagcucaaaucuguuguucagccucucuaaugcauuuuucauuuacuuuucaacuguguaauuucuauuuggcuucuuuuuuuuuuuuuuuaaaaaucucauuauggauauucucuaucugguaagauauauuugccacacuccccuguaauuuuuuaaauacaauuucuuucaguucuuugagcauauuuauugcagcugauuuaaagccuuugcuggucuaauaccugagcccucucaggggcuacagauuuuucuuccuguggaugggacauauuuucauguuuucuugcauguacuauaauuuuuugguuuacaacuggagaugacaacuaaugcauuguagcgacucugaaaugagauucccccccccccaucccccuccaaauaggacuuguuguuucucggcuuccccucuccuugguuguugcuuaugugacucaugacuuuccuggacuaauuaucuagaugcuguauuccuugcagaauguggacacugaguuuucuguucucucuguuuuuaaaucuuguuucugucuuuaagccaggcugccuagggaucacccucugguuagcagaguuuaauggucugcuguuaccagacaggaaguuuccuuaaauccuugagccacgaagccagucuccucccucuaaucacaaaaccugugugucaggaccugccucccagccacaggcagcuuuaccucucacuucugcuuggugggguuuugaggucagccagagaagaguggcuggggcccucucuguaccgaagccuucacacauccauuuucguaugugcccgggaaucuccaagguuuuucaaaguccccggggucaccuggucuggccaggcucuuguuugcuccaaugucgaucgcagccuuggggcagcucccaugaucacgacugcagccaacggugauugugccucggaacgggccuuuuccaggagcuccaugaccaguccaaaugcggacugcauccugggaugggguuuucaacagagcccagcuccuccacggucugugcugucaccggcuuuccacggcugugcgccucggggcuggagcggccccaagugaagacgcugccauccuguucuucccccuggggccgcucuuccuugagugaaugcaucuguguuuguucuguccucuuggcugacugccagauuuggugguugauuugacagugaugcuguauuuuuguugcuuugggggagagcugauucaagaugcucuccagcaguuuagaaggccugcuucucuccaguccuucuuauggaaacgugccuuagcaaacagucagaaauucucugaagaaaaacagacaccaugcuccccuucggcuugcaaagccaacucauacuuggauguuaggaguucugagcggaaaucuuugcucaucacaucucucuagugggaagaaaauacucaacgguagagcugggacccgcgagagcaugcgggccuuggcgcugggguuggggcgcuccugguucugccucauugacugacuuggagcaaguccagcggcaucucucugagccucaguuuccccccgggaaagggggguggugagcaccggcaguucugccugcccacagugccauucuaaggcugaacacgcacaggagaaaauguacaaaaggucacuauggaacguacaaaggcuacacguccaggacgagccuaggacugugaucugggucuuccguuugcuggcaaggaugugcgaccucaggagugagucucucagcauugacaggaagaaaacacuacgguuccgacuguccccucuuucuagccugggcuuggcagaaugugugagucagcuccucgcugcuccucaggaguccaugcgcagaaacgcacuuugcuaucaggaagaucaccugaacgugcccgugcucgagcucagggagagccaagcacccagcuugaguggcccggcccuggcugcccuggcaagaacauggcugucugacagacaugggcagagcccuccacugccccggccaccucucucccucugacgggcgaucggccucugggcgcugaauguggcuguuaugcuuuuuaaauaccucgcucauggcuucacgcuccgguaccccagcacaucagugcgacaugcuggcucacagaucuaagcgugucuguaaagaacacucguucucaaauaaggaagcucuuugaaaugucuacacauuaggaagagaaaacguauggcgguaggaggaagcuaggcaacuugauuugaaauggagacaaugccacuuaaaauguuucuguaaaguuugaaaucaucuguaggaggaaaacagagugcaucuacaccagaaaaacacagcguuacaaugacacacuugcgaaugccuuacuacuguucacggcuuacccgcgucacagcgacacacccgcggacgccuuacuacuguucacggcuugccugcguuacagugacacuugcggacgccuuacuacuguucacggcuugcccgcgucacagcgacacacccgcgggcgccuuacuacuguucacggcuugccuguguuacagugacacuugcggacaccuuacuacgguucacagcuugccuguguuacagugacacacccaugaacgccuuaguacuguucacggccugccuacguuacaaugacucgcgaacgccuuaccacuguucacggcuugccuacacaagaugacaaaggcaucgcacacacgccccacacugcccagacgcgcagucgcggcugaacaucagggcuuggucucucuuugcugccacuggccgugaauuuucuucggcacaaaauagaucuaaacagugcucauugcccaagcucugugaaaucucuccagcucuucccucuugcuuccuuccaccucgucccuaugucucucucuccaguuacuaauuuuagacagcucuccacuuaacgccgaaacaagcuaagacccacuuuuaaggagucaaaggcagaagaugaauagcugaaaaugauacccccaaauuucccuuccaaguacacaaaauuggacuguagacugauauuucaacuagaaacagcauagaauucaaaauauucuguguccacagugaauaucuucaggcaauuuaaaaaagugcccagaaccucacaggccccaaggagcagcccgugggcagcucacaggagcgggcaccucuccuuucucccgugcccaccucagggaaggacggaggcacuguggccucacagccugcacgccacggcgggagaccugcaacagcacccacacgggaugugcacagcccaugcagccccuauuuuuagagagccuuguucagcacccgucucagugccauccuugcccccauuuccucaaggggcagacuugccacugcagcugccccaggguucuccagccaugggcuccaugcucacccggccgcaccagguugauggggggcgugugcccgcucucgccuucccccggccguaccagguugauggggggcgugugcccgcucucgcuuucccccggcgguaccagguucauggggggcgugugcccgcucucgccuucccccggccgcaccagguucauggggggcgugugcccgcucucgccuucccccggcgguaccaggucgauggggggcaugugcccgcucucgccuucccccggcgguaccaggucgauggggggcgugugcccgcucucgccuucccccggcgguaccagguucauggggggcgugugcccgcucucgccuucccccggcgguaccaggucgauggggggcgugugcccgcucucgccuucccccggcgguaccaggucgauggggggcgugugcccgcucucgccuucccccggcgguaccagguucauggggggcgugugcccgcucucgccuucccccggccgcaccagguucauggggggcgugugcccgcucucgccuucccccggcgguaccaggucgauggggggcgugugcccgcucucgccuucccccggcgguaccaggucgauggggggcgugugcccgcucucgccuucccccggcgguaccaggucgauggggggcgugugcccgcucucgccuucccccggccguaccagguucauggggggcgugugcccgcucucgccuucccccggcgguaccagguucauggggggcgugugcccgcucucgccuucccccggccacaccagguugauggggggcgugugcccgcucucgccuuucucacugucccucgcggucgcuggcugagaccagguggcagcgaguuuucucgagaggaacugaaacgcgugagucgacgucugagccucagccacacgcugccuggcgcacagguuuggacgcggccucugguggccgccucaccucgggcacgucacagggugggcucccugaggaagcagcuccgggccuggggcuggacgggcucuuggcguuggggagcugccucuucagcggccuccggagcacccggccccgcagcccggcccgcccugccgacagcaggcuccgucuccggguggcgugcggugcgauuuuuacgccuugaaacccccacgccgcggucccacggcaccaggcacugaccccgaugaaugauuugcacggcugaguccgcugcuccauccaucacgcgguagccgccgucugcgacgguaacgacguuggauggcggcacacaggcucuuucaaucauccucagccggggggaaggccucagaccugggcgccgggccagguuaguaagacuuuccacgaagggagcuucucguccuccggagcagcuccggcucaggaggggcgggcgaggggcccguucacagcccagacugcggcggacacgcuccggccgccucgucuaccugcucguuguuuuaaugacauggagacuuuaaacccaagugcuucugagggacugaaagggccgaccguggcagaggccgugcggcggcccaggggacacggggaggcgcccguggcagaccagccccgcgccgagggacggccgcuguccucacgaggcuggaggaggggugcccacuucagcggcacagacccgcgggcaccgcagcgggccccgagcgccuccguuucggaagacacaggccccacaaacgcucucagcgcgcgagcgcguggcacggggcggcccucgcugacgcguaauccaccgcgaguccgcccccagcggagccuccucacggcccuucuccacgaugcggaaugcguggagaucacauuagaaaaggagccacacggagcucuguggcauuuuuucaaaucuacauuuaaaauaaugcaagauacagaaaaccacuguuuaaaaacugaaccucuguggcucggccaugcucgagaagucugaggggaaagcccaauauucaggagaaacaaagacgaccucauuguuggaauuuauuuaugggucaagcacuucugaaacaaaacuugggaguagaaaggacuggaaagcaaagaaauccuaaaaaaaaaaaaaaaaaaaaaaaaagcuggauucauuuuucuuuuuuuuuuuugagauggagucucgcuuugucacccaggcuggagugcaguggcgaggucucagcucacugcaaccuccaucucccagguucgagugauucuccugccucagccuuccaaguagcugggauuauaggcaugcaccaccacgcccagcuaaucuuuuuuuuuuuuuugagauggagucucgcucugucacccaggcuggagugcaguggcgcgaucucagcucucugcaagcuccgccucccagguucacgccauucuccugucucagccucccgaguggcugggacuacaggcgcccgccaccacucccggcuaauuuuuuguauuuuuaguagagaugggguuucaccauguuagucaggaugguuucgaucuucuggccucgugauccacccgccucagccuuccaaaguacagggauuacaggccugagccacugcacccagccccacgcccagcuaauuuuuguauuuuuaguagagaugggguucuaccauguugaccaggcuggucuugaacuccugaccucaggugauccacccaccuaggccucccaaagugagccaccgugcccagccucauuuuucauuuugaggcuugacuucuuugagacgcacaggaugugggcugugcgugaccuuuagguuccugcggcugagcagaggcugccacagaggaggcuccagcgugaacugcccuccucagaccccucagggaugcaaacacggacacuguggacccccuaccuagacucugcaacuggacacuauucucuuauugccuuuuaacuccacauuccuggaaaacaaaaucaaaacaaaugaaaaaccacuacgcacagaaaaaguucuauguccucacgggcaggccgucgucagcaucacugggcgugaggagccccgggcugucucuggcugccucugcacagcuguucaugugaagcagcaagaccuugaagugacucaauucauggacccacagcucugauucuggucaggcggagggaagccucucaaacauggcugggugcccaggggccggggcugaguccccggccccacgaggacaucccagacgcuggccugucucccccucuccccgcacgcagcucugcgauccaccacugcuugguucgcagagggcuggagacuaaaucugcaccccaugccaggcuuguugucccuggagguggcggccaggccagcggaacgcagaagggaagccggggaggcuggaaaguggacccggcagggcuucugucaccugccauacccacguccugccacaggcaccucacggggcucggggcuggccaggaggucccuggccuuguguccgaucggcccauuuacagauagucaggggugugucugagucuuguccccgccacacagccuuacuucucuccuguuuccuccaaccccagcuuuucgcucucucccuguuguguaaacuaucaaagacacagcgacacuuuccacccgcugaggacacuuggcacgcacggcaccgacuugaccugggguucguguuguuucugucucucgucucugcuccuucuccaggugcugggaucgucccuuguuggggcgcccugugcuuccuauucuucuccgcccccgaacuccaggucacgcuugccugcuuucuaagccagcgacugagccccaggguggcugcugaggugcccgauucucuuagggguugugaaauuagacaaaauauauauuaauacuaaacaaggacuacccacauucacccuagccugccuucccucucccgcuguccccaucaagauggcuccucgcauuuccauggagcuuguuggggucugggcucccucucccgcuguccccaucgagacgguccccagguacacccccgcauuuccauggagcuggagucucggggacucagaguuccaccuuacaauucaggucuucagccugcgugaggcuuucccgacauaacccaggcccugaccucguuuaugucacggcguuugugagccugggguguggguuccagguuccagggacccagggcaagccagaggucaucugcaggggaggggccgacccagacucaacccugacccgggacccuucccggccauguugguggaugcuccagccaucuucucacaaggacaggcagcgacccaucuacggcuccauccacccaggacgcgggaaacggcucggcccgugucauucucagugaaggcuccauccacucggcuccgacagagcaauaaacauuugaaucugcuuuucucacagggaggaacaggugucuagaguggguggaccugcccccaggugcucaggaggaaccuggaguccauggccuggugccugucucccaggguggcggcaaugucaggccuguaucagggacuaccccaccaugacugagagccugagccugcaccagggaccacccugcccuaacccagagccgggccugcaccagggaacacccccauccugacccagagccugggccugcaccagagaccaccccaccaugaccgagagccugagccugcaccagggaccacccuguccuaacccagagcggggccugcaccagggaccaccccacccuaacccagagccgggccugcaccagacacuaccccaccugcaccaccucagcccccaggacucuccccuccccuucacacacaccacgagcagaacuuccucugccaugcgccccgccugccugccugugaaggaccgagaggggcugucugcccacgggggggcgggggcgggggggagaucaggccacagcugacacugcuuccagcugccugaagcccuaacugcugugguccuggcugagcaucgagggaccucacagguggagaugaaacggacaucaccacauuaccugcacacacuugccaugucauagggaggugucugcacagguaucucaaccuccaucccaaccccgacccccgaagcggcaccgccuagcgccguacgcuaaccccgaaagcuuguguguggcugcucccagguuauggaggcagaagcacacaggacccauaaacugugaccagaacagugugcagggcuggcgcucggggucugugcucaaggucccaggaccggcccugggccugacgaagcguacguggacgagaugacugugguuggugggcugggguguggucugcucugacaacacagaaaccccugggucuuuugaacaggacgugacccauucgauccgaguuuggggaggaucaccacggcaacugagugaggaaaauggggagagaggcccgcugggaacugagcucacucugcggggagagguuguccucaagugucccgacggcagcacgccgggaaacaaacuuucuuaaaaggggugugagcgacugcuuuacagcuggcgaauccugggcuccagggucccacuggcugucaggagaggccccaaugggaacguggcauugggcauccucagaggagcugcaggccaggcccagccccauggcagaugcacucuggccucagcccuuccaugugucagggagucgucugugcacuccccuccccaagacccauccccuccauguccacgcacagucaggcaggccagggcggggucacacccacacccaugcagcuccaacaucccuagccugugcacucagcgacacaacagcccacccucuguggcccaccaggccccaaggcaaggccuggcucacuuagcuuugaccucuaggaccaaggccagaggggcccgggccaccuggugaggcuuuggcaguaacgggcuggguaaagggaugaucucaccugagcaccgugcgggucaacaguccccugccugcuguguugacgcagaacacgucccagcccccagcacugccgcugcucacccaccccaagucccaccccgaacucuacccucgccauaaagccacacgugggccacagggcagcagaaacaugaccgggaccugcuucccaccugggccugcagggcacuacccaauugugggagcccagagcuggugggucacaacugggacaaggcauggcagguggaaagagaauuucucagcaucucccagccgccuugggaccaccugguaccgcgugagacaaagcaggggugagggacuggaggcauggaugucagcguccaccucgcgcaggggcuggggaggaaggcagaguccaucugugcucaggaggcugcagagcagggacaugggccccaugcggagcuccggcuggccucgcggguggacaaggaggacagcaggcaggucagacaguaagaacuucaggacgacaucugcacaggacacggaacacuguccuggccccgccccacagucaucaugaaccuccagagaguggccagggggcagccacgggccuccaguguguggcucugagggacagcccuggggaggcagcagccuccugggcugacgggacacacuccugcaaaaacagacgaugagggcugcgggcuucaugggacacacuaccucaaguucacacacacacacacacacacacacacacacacacacaaccagggcugcgggcuccaugggacacacuaccgcaaacacacacacaccagggcugugggcucaagagcuuaauauuuugggggcuaaaauauuugcaugcauccuccuuaaaaagcuuguagccuucagucaggaaacagcaggaaggcguuuggccucacucccuucccagcagaugggaaacugagcuccugacgcccgggagucccugcccccccugggucaggaggggcuaaugccgcccccuccccagaaggccgaggcucgccuggaccccaggccacugagcagggagugggcaguggcuccaggugugucugcuggaacccgggccugggaaacgucauacacuugggaggacucacugugccuccgaggaaaugaagccaauucccacacaaaccauucgagcagaaaacacgagcggaaucgcccucuaacgcguggucaccagggccgcgggcacgccccgaucacaacgcgcacacaaaccgcagggccagaaaacacgagcggaaucacccucuaacgcguggucaccagggccacgggcacgccccgaucacagcgcgacugcaagcaagucgggcugcgccuuaaaguguaaacagucgagaagaacgccacggcgccuucggucaccacucgucacagaaaggccugagugcucagacgccccacaccacccgccuggcuacagacgugaggccacuuccuucccuaacaaccccaggugugcgguguugggugcaucuccgcgcugugcgagcccaggggcuagauggggaagacccugcaccuggggccugaaggcacagucuagggcccccggugucacggccacccugcgagcuccuggcaaggccgccacugcauuuagauguguuuacagagccgcacgggguaacgugcucgucaccucggcuaagcuguugucuacaaaccauucacgggacucaggcggcacccacgaugccccgacugcagaggccggucccucuccaagucagggcuuugagccugagccgugcggcuccauauucagcugcagaagcaaaccuggacaccaaugugagccuuagaccccgggacaggucucgcaggaggaucugcagcccaggacccgccaagggccccacacugcgaccaccggagcagaucucacggcgagcgccccagguggcgcugacgccguggcaccgcacgggcacuuuauaucaggaggacgcaccccacacccugcccggugccucggugcacuuccacacgugccacacacgcagcacgcacacggccccuccaugagcucacgccauggcgccaggcggggcacacaccugcauggcugcgggcacucaccgucauccagguacaacugguccaacucuucaggcucucgcuugaccguuacaggaauaggggccaaauuaggacuaccguccucaugcaccucuggcagcagccguggcccggcagucggagacucgucccugcggaccguggacggcaggugcugcgggcggcccguggcgggcgggcacgcugggcugcagggcugcaggcaggucggcucuuggguggcaggcgggaguggaggagaggggcugcuggggcagagcgaguguucgagaccaggggggcagcuacugcuuggaggcgcacucaccugcuguggcagcagggccggggguggcugcccgggcgagccggggugcguggccacuggccugggcacguccuggacggcgggggccucuccggccggcugcgggaguccgaggugacaguggcccgggcuggcaacgcccuugguguaggcagcgggagaaaggucguggagcuuggggcucacgccaggggccgcuggcaucagggugcuucucugcggacagggcgggaagccggccacgaggcaggagcuggggucggguggcaucgcgagcugcuggcuguaguauggucuugggagaggacuuaaccccuggcucaccgguccacagguuggagcaggcucauaaucaucaguggguucuguuuuuauaauuggaacugugagaaggaaaaaaaaaauuaaauaaacacaaguugcgaaugagugugaucaggcaggcuuguggcuggggcacccuccgcaaaaccaacagggcccugacugggucccucugucuccugccugguucucccaccccauuaaaaaaaaaaggcgugagucaucggccgagagaguagcagcugguucuaauacuggcgaggacuguuuuccuuggaaccuccugcagcacuaacgugcuauaaaaguccacuugcaaacugcagugggaguccuggacccaggggccuguggguuugcaggaaucaaagcgaaaguuucaacguggaugcacgacugcauuucugcucccgacacucgguuugauaaaugucugcacauuugguaaacucgaacacagaacaagacggcuuucaggagucaguaaaaauccaacugcaaaggugaacgacugcuccaggagagaagccguccgucacugcgaaagaaaaacacugucauggaggcuggacugccuccacggugcuccugaguccccuucuaaagggacaggcuguguggaggcugugaccgggcagccuuggauggaacagggggcucccgaguuucuagagcuuucucccacccagcccucccuaaaaguccggggcuuuggggaagagcccacagggcgggugcuggguccccaaggcugcuccgccaggcccgggccagagccgacaccggcucccagcccacgcccaccccagccuuugugccggcuucuguggggguguugggaagcaaacaggcagggugugcagucagcaggagcggcgaggcggaucccagccggcauuccugcgguugcuguuuuccuguuggucucaggccucucgugcuacuuagaggagacaucagacggcucaguggcucuaaagcucucacaauggcgcacauacauuccuaacagacgcguggugccacucugagcgaaugcuacgcagacagcaagcugugagugagucuccucagccuguuuucuccuccccgugggcugcacacugguggguuuuuggcagcagggucggccacagggagggaaacuccccuccugucaccaccugggggccuauguguggcccccaaagccaguacacaggcucccggugcaaacagucgccaccacagagagccuggcagccuccugcaguaaacaaaagcauuuccacaauucgagagaaaauauuuagccccgggcuugagcccgugaguccaugcagcuguuccccgccacggcugggugccgaggaguccaccagcagcugcgaacgauggagacggcguuuuccugcagcucgagacgccggagcaccugugccacgugcggccuccccugcagccgcccucuuccccccccgcacaggucccggcggucgugaaggcaggcgcgagucauccaugguggccaagccaccuucccgccacacuggaggcaucacagggacugacccauaugggccguucccagcuguaggaucucaccagccugaguccgcaggaagucaaccagagcuuuccacccagggauuccgaguggaguugcugcauuuuguugcuuuugugcugacuuuucaagucucuacuuucauucacucauucaaaucuuucuaucauccacccucugaguagaaagaucgagguuuaaagcguccgcccugcacacugaguggggagaucgagguuuaaagcguccgcccugcacacugaguagaaacaucgagguuuaaagcguccgcccuacacagaguagggaggcuaagguuuuagagggggugggugaccaggagguggggacguccaggaggcaggaagaaaaucacggggccauugugauuccaaggccuucccaggacgcagccugcagcucacugaccagggcccauaaagccacacucugcugagggucgugccaggccuuccuggggcucugcagcccaggcauucccagccuuuggccuggggcaaguccagccacagugaacucggggagugcagcccaagcugugaagcuuggaggaugaggccaggggcugccucugcaguggugcccagggcaggggagggagaacgggugugcuccccccgccucgucagccaccccacccugcaagugccgccgaggucacacuggaaugacaccccaggaccaggucacccuggaaugacaccccaggaaccaggucacguuggagugacaccccaggaccaggucacgcuggagugacaccucaggaccaggucacccuggagugacaccccaggaaccaggucacgcuggagugacaccccaggaaccaggucacgcuggagugacaccccaggaaccacgucacgcuggagugacaccccaggaaccacgucacgcuggaaugacaccccaggaccaggucacgcuggagugacaccucaggaacgaggucacacuggagugacaccucaggaacgaggucacgcuggagugacaccccaggaccaggucacgcuggaauuacaccccaggaacaaggucacgcuggagugacaccccaggacaaggucacgcuggaauuacaccccaggaccaggucacgccagagugacgccccaggaacgaggucacgccggagugacgccccaggaaccaggucacgccggagugacaccccaggaccaggucacgccggagugacaccccaggaccaggucacgccggagugacaccccaggaaccaggucacgccggagugacaccccaggaaccaggucacgcuggacuuacaccccaggaccaggucacgccggaaugacaccccacgaaccaggucaugccggaaugacaccccaggaaccaggucacgccggaaugacaccccaggaaccaggucaugccggaaugacaccccaggaaccaggucacgccggaaugacaccccaggaccaggucacgcuggagugacgccccaggaccaggucacgcuggagugacaccccaggaccaggucacgcuggaauuacaccccaggaaccaggucacgcuggaauuacaccccaggaaccaggucacgcuggaauuacaccccaggaaccaggucacgcuggaauuacaccccaggaaccaggucacgcuggaauuacaccccaguaccaggucacgcuggagugacaccccaggaccaggucacgcuggaauuacccaggaaccaggucacacuggagugacaccccaggaccaggucacgcuagaauuacaccccaggaaccaggucacgcuggaauuacaccccaggaacgaggucacgcuggagugacaccccaggaccaggucacgcuggaaugagaccccaggaaccaggucacgcuggaauuacaccccaggaccaggucacgcuggaauuacacccccggaccaggucacgcugaagugacaccccaggaccaggucacgcuggaauuacaccccaggaacgaggucacgcuggagugacaccucaggagcaggucacgcuggaauuacaccccaggaaccaggucaugcuggaauuacaccccaggaccaggucacgcuggaauuacaccccaggaacgaggucacgcuggaauuacaccccaggaaccaggucaugcuggaaugacaccccaggaccaggucacgcuggaauuacaccucaggaaccaggucacgcuggagugacaccccaggaccaggucacgcuggaaugacaccccaggaaacagcucaugcuggaaugacaccccaggaaccaggucacgcuggaaugacaccccaggaccaggucacgcuggaaugacaccccaggaaccaggucaugcuggagugacaccccaggaccacgucacacuggaaugacaccccaggaccaggucacgcuggaaugacaccccaggaaccaggucacgcuggaauuacaccccaggaaccaggucacacuggaauuacaccccaggaacgaggucacgcuggagugacaccucaggagcaggucacgcuggaauuacaccccaggaaccaggucaugcuggaauuacaccccaggaccaggucacgcuggaauuacaccccaggaacgaggucaugcuggagugacaccccaggaccaggucacgcuggaauuacaccucaggaaccaggucaugcuggaaugacaccccaggaaacagcucacgcuggaaugacaccccaggaaccaggucacacuggaaugacaccccaggaccaggucacgcuggaaugacaccccaggaaccaggucaugcuggagugacaccccaggaccacgucacacuggaaugacaccccaggaccaggucacgcuggaaugacaccccaggaacaaggucgcgcuggaauuauaccccaggaaccaggucacgcuggaauuacaccucaggaaccaggucacgcuggagugacaccccaggaccaggucacgcuggaauuacaccccagacgucacauucagucgucacaacagugaggcccacugggccccaucugaagacaacgcucaagccuggcucacgagggucuauggcucucagucccgcacauucuccuuaguucgggcugaagaaggugcacaggccuuggcagcgccgaggcgguuccugggaggaggacucugccuucagccaccugaauguggcugccucuggggcugcccucuucagcugaggguucacagauggggcagagccccaggacugccugugcaagucagggggcugcagaggacacggcgcccucauguugauugggaaacccuacccgccucguuuuacauuagaaaauugaauaucugggcccugggcugcaacacuuuuuugaagggguggcaggaggcgguguccguggaggguggggcucuaaccgcugucuggagacuacagagcuggagucauuuucauccagggcacgcgucuugccuuaggccauggcgcccccagcucugcggacgcagcugggccucaggaacugccccuuccugcuguuccagcuugaagcaugugguaaauccagaaaugaugaguccacgacaaagccagacgauggggagccccagaggcagggcuuggccaagugcucucugugaacucaggccugcgccuuugagaggugcaggggucacuggaaacaggcccagaugugggagugagacgccggugggcacccacaucucucccgcucagaagaugcuggugucccgaauggccaagccuccauucuaaauuaggcugguaauuuucagaguuuagaucuuaagcaaaagcacauggcuggaagguuaaauuaauacccuguugggauccucucuccgcugcucgggauuuucagccagggcccagaaacauggccaggcaugggggccagugcgccucuucugugaagugucccgagcgcuuuaaaaacucucacccaccagcucuggcggacacuagaggccccgugcacagcuguccuguaaaucagccgccccacgggccaaggccggcuaugcccgagagccgcuggggcuggggcaaccggguggcgucugcugcugcuggcuggagaacgucaagaacacggcucagacacggccccguuuaaaaccgcggugguaccggcauuaacccccgcaucucuccagccacuuggauucuuccuggggaaguccugaccuaggauggugguggcgaggggcacagggcucugggacacgcgacccaccuccccaggaugcuggcggccggcaguggcaucgggacgcacgggcugcuugcccugcggguucggagcaggcccagcacugaugcauccaccacccccaggggcaagcagaaggcccaguggacgcuucgcugggaccccgccagguuggcagcuccuguccccccacccacaggcaggcgcucccucucuuucugaagccuggggcuccaguccacagaggcuguggcaacacgcuccucucaggaauaaacucgugugccugcccacugcuucucuuccgcccagagcuauuugcagggagcugggggcagcuacuugaaaccugggaucaccgcacgugccccacccacgacggcaucuugugagucuggagagccaguccaggucccuuggcccggagcuggcagcaugagcugcgacguggucaccgugcuuggaagguggccugggcugacccugcaggugcgggcccuguuccugccacagugccccucccugggcuggggucuccacgcggcuucucccagccuugcccaugaagucuggcucaagucugggguuggccggaugguuucucagcccuggcagcggcgucuugugccaucccagcugcucugaggcugccucccaccgggaccgggccuuccccaggcgacugccccaucucccuguccuugcccuaaggggcacugccgcgaagcacagccagggacaaagggcgguggacggcagggaugcgcgaggcacccggcacccacaggggacguuucagaauggccccgccugacccgcuggccuaugaggaugcagcgggauguucucugcuaagucauguccuggagagcugcagccuucccaauacagagagaagcuggaaagugcaaacucaccuucacaagcaaaggaaagccacacggcugcuuccacaccccagcaucuaagaagcuuaaacacacgaacauacugcaccugggcuuggccuaaacugugcuuuuuguguggguuucagagaagauggaugccugcucuguaaaucagagccucguaagacgcauccuaucagugagaaagugagugagcgucugcaagagcgccugggagucucacccguggaggggggccgcacaggcccaguucacgcugucgcccguggagggggccgcacaggcccaguucaagcuguugcccguguuccgggcucacccugcaccaggcggccucuggcuaccuccugauaucagccaugaggggcugggguagagguggcgaaaggaugggcucagaaaaagggcagcucauuuucaggcuaagcaacggugcaacagaaacaccaaucaccugagggugaguuuaugaaacucguuacaaagagcagaguguggaaggcgagugcuggccucagggccggcuggcuuuacaaagcauauucccacagagcaggcuggcugcgguguccauggcagucccguuguccaugauggcugccccaucguccacggcagccccagcguccauggggacugucuguggaggcggcgcgcaguggucagcggcgugcagagcugacagguaaaccguccccgcagacccaggccucacgcuugcauccuccguggaaggcacggagggcccgucccaugccuggugcuguucuggggcccagcuucucucugaugccgcugcagagucucugccucgguagcagugacguugggagcugaguccuggaggggggcuuccgccccaggugagcacgacguuuccaggccccaugcaggugccaauucuggccacagacgcaggcagugagcugggcaagccucuccuccaggaccuccccucccaaagcccccgccacggccaucgucagccaaagagcauucggcacaauccuggccucuuaaagaacccccaagccuggaaaaugggcugccaucccuacccgguaacaggagccaggacaugagugggcuucacccaccgcagccccucgaacgguuccuguucuaaagccccagccgggucuaugcagccccagggcaggcagagccccucacccagggcagaccugggggcucaucacagcucuuaauggcccggaccacauccuccucccaacguaguccccuuggcugccuugguguggccuggcucccgggggacagcuggggucuucacggcucccagaucagggcccccuucugcuacaagacagaggugacaagaucugagaauaaaaaucggcaugagcaacacgguggcaggcacaagccugccccaccuguuggcuuccugugugguuggugcccggcagcuccuggcuccucgggggcucugucugcagcacagggagcaccugggggugggcgggggggggccugggggcaagaacgggggccuggggaugggcaggcaggggggcagggggcaggcucagcccuguggcuuuagacaaguggggucacugcuauggacggacucguguccccucaaccucauguugaagcccuaacccccguccgcgugacucuacuugagagugguguuugcaggagguaacuggggguuaaacaaugucaucaggguggggcccugauccaacgggacugccgucccacagggagggagagacaaaucgccuguccugccaugugaggauauggcaggauuuuggcugucugcaacuuggaaugguccucaccagaacccgaccguaccagucccaaccucggacuuccagcccccagagcugugagaaaucaaugucuguuguuuacaaggugcccagccgguggugcuccacuauggaagccccaaagacugagacagugccccggacccccuucuucugccaacaguacggccgguggugcuccacuauggaagccccgaagacugagacagugccccggacucccuucuuccaccaacaguacggccgguagugcuccaccauggaagccccaaagacugagacagugccccggacccccuucuuccgccaacaguaacaucugguccccagguggcauuggggguggggagaucuaacgcugagcugccugcaggcugcagcugcugugcacagcaaagaaugaucccaagacaguucccugcucccccaugcccacauuuuuaugcaaccuuguguucagcuugaauuacucuaccagggaugcacuacaguacuggacaaaagagguuuuguucaaagucuaaaccccuggaaaacaaagaucagauugucuucuguuugcuguaugacaagaaaguccaaguuuugccaucaacauaaacaaccaggaaugacaccuccggggcaugacuuuucucaaacaaugaaagaaaacagcggaugaagcugccuuaucacccaucccucgaggcugagaggcaucauuucuccuuguucagagccaagaucaguuuccagagcaggugagggauccacggcccaccaugggguaaaucugcaccaaccaggcaccgccugaugugggagacagagaaggguccuuccgaacuccauccgccuuugggaauuugugcucucucaccgacucuucacuggaguuucugcugaagcgcguuccaagguuuccaggaaggcaugaucuuccggagucacgaccacgugagucuggugaguauuccaaccaugcacgccacagaccuccaggcugaaacugcagcuccguggaggcugacaaccguggcuaacccuggccauguguccaggacgggcccagaugcuuuuguucaugaucucacuuugcccccacacccauccugugugucggucggggugagagaauucccuuucccucagguuuaucacgucgaccccgagcaacaucgguggggggcuuccuacacauacagaagcgugaaaacagacgcagagcucagguacuugaugggggucucagguggcagcgacggggccaggacagcacggcagcgaggggaagcgcaaguggggccucaggcugugugguggccccgugcugcuccagggcacagugaggugggaucuguugcccaauuaggcugaugacaaaggacgcucccacagaccacacaagccaaaacacaucggucggcuuucgccaauccucgcccgcgcugcccgccguguucuguggggcgcgugacucacgcucccaggcagcuguggagccaggcuuugccauuccggcuggagccacagagccacgguggggcagcagcauggccgacgccgcccggaggcggcugcacguggacaggcggaucccucccaggcgcgcggcuggcgucgccaagcucagggcgccccucuugccccacgcaugucccagagcgcaggcuuccuggcacccagccuccccacugacucacaccuccugguuuguuuuugguggcccguggcccuuagauuucucaacaagccccuucccgcccucucaucccaucucaggcucccggccccaccccccuucuggagccagacucgcccagccccaggugcgcccgucggaugcugagcccuguggcucuuucacagaagucuggauccugacgcugguucccuaauuuacuccccucaucucugauuucugcaggagcaaucuuccaccccaaaucccuccugcuuuaaaacacgcucugaggacacgcacggccugagcgucggguggcuaggaugccuggcgucuugcugggggugguuuuggcgagcacaucucggaccucccuuucaauuggagcccuucuucugacuuuuggggaggucuccugggaggccugguggggccagcaccccacagcaugugagagagaauuccuuucccucagguuuacaacguugacagugagcgugagaacacgcuucccucacaacgucgacagugagcaugagaacacgcuucccucgcaacgucgacagugagcgugagaacacacuucacucagguuuacagugucgacggugagcaugagaacacgcuuccaucgcaacgucgacagugagcgugaaaacacccuucccucacaacguugacagugagcgugagaacacgcuucccucggguuuacaacgucgacggugagcgugagaacacgcuucccucgcaacgucgacagugagcgugaaaacacccuucccucacaacguugacagugaacgugagaacacgcuucccucagguuuacaacguugacagugagcgugagaacacgcuucccucagguuuacaacgucgacggugagcgugagaacacacuucccucagguuuacaacgucgacggugagcgugagaacacgcuucccucagguuuacaacgucgacagugagugugagaacaugcuucccucagguuuacaaugucgacagugagcgugagaacacgcuucccucacgucgagugagugugagaacacacuucccucagguuuacaacgucgacagugagcgugagaacacgcuucccucagguuuacgucgacagcgagcgugagaacacgcuucccucagguuuacgucgacagugagcgugagaacacgcuucccucagguuuacguugacagcgagcgugagaacacgcuucccucagguuuacaacgucgacagugagcgugagaacacgcuucccucagguuuacguugacagcgagcgugagaacacgcuucccucagguuuacgucgacagugugaaaacgcuucccucgcaacgucgacagugagcgugagaacacgcuucccucagguuuacaaugucgacagugagcgugagaacacgcuucccucacaacgucgacagugagugugagaacacgcuucccucagguuuacaacguugacagugagugugagaacacacuucccucagguuuacgucaacagugagcgugagaacacgcuucccucagguuuaugucgacagcgugagaauacacuucccucacaaugucgacagugagugugagaacacgcuucccuugcaacgucgacagugagugugagaacacgcuucccucagguuuacaacgucgacagugagcgcgagaacacgcuucccuugcaaaguugacagugagagaacacgcuucccucagguuuacgucgacggugagcgugagaacacgcuucccucagguuuacaacgucgacagugagcgcgagaacacgcuucccucagguuuacaaugucgacagugagcgugagaacacgcuucccucagguuuacgucgacagugagcgcgagaacacgcuucccucagguuuacgucgacagugagcaugagaacacgcuucccucagguuuacgucgacagcgagcgugagaacacgcuucccucagguuuacaacgucgacagcgagcgugagaacacgcuucccucagguuuacaacgucgacagugagcgugagaacacgcuucccucagguuuacguugacagcgagcgugagaacacgcuucccucagguuuacgucgacagugagugugaaaacgcuucccucgcaacgucgacagugagcgcgagaacacgcuucccucagguuuacaaugucgacagugagcgugagaacacgcuucccucacaacgucgacagugagugugagaacacgcuucccucagguuuacaacguugacagugagugugagaacacacuucccucagguuuacgucaacagugagcgugagaacacgcuucccucagguuuaugucgacagcgugagaauacacuucccucacaacgucgacagugagugugagaacacgcuucccuugcaacgucgacagugagugugagaacacgcuucccucagguuuacaacgucgacagugagcgcgagaacacgcuucccuugcaacgucaacagugagugugagaacacgcuucccucagguuuacaacgucgacagugagcgcgagaacacgcuucccucagguuuacgucgacagugagcgcgagaacacgcuucccucagguuuacgucgauagugagcgugagaacacgcuucccugggguuuacgucgacaaugagcugagaacacgcuucccucagguuuacaauguugacagugagcaugagaacacgcuucccucgcaacguugacaguaagcgugagaacacgcuucucucacuugccgucugaagagcgaggcaaccgacaaaaacugaaauuuaauaaaagcugucucccucaggugguuguggggccuucaguagaacagggaugaggggcccacaggccgcuguucacagguggggccagcccagcuccaaccccagaagcacucggcagcugggcucccagaauucucaccccuguggcgaccuggagcguggcgcaggccacgcugugggcuggaaaugucagcaucauccgcucugucugaaaucagguaggacuucuaagcugcggcagagcugggcugaaacaucaguguaggggucccggcuugacccccacaagcugcagaaaggggaggccacccugguuccugugcaggacauggcauggagugugggucgucugcguuuuaggcccuuggagggcgcacgaggggugccaggagaaucucugcuuugagaaccugugaccaggcccuggugcgucaaggugcccacagccgacacauggaaagucucuuaaggcugaaacccagagcgccgcgaggccagggcugaccugacguugucaggagcuuggaggcagccgccacgguggcaggaucagaugagggaaggcgggagccaugccugggugucugaggugggcagguuuacucugcagugagagccgagcucaggcccagccccagggugucuccaaguguguggggugaggggagggggaggggaagaggccacagguguucaaggcccacccaggcugugcuuuuggccaauggcagcgaaagggugauuuggggccgcugagcaucugcagagaccucaagaacuucacuguuucaggaucaagcuuuacaugcaguggacuuggacaaagugaguuggaaaguccagggaaaaggcagaaugggaaaccccugggaaggagaggcugccgggcugagcagaagggcauggaggucgggcggcggcccagaacugcuugucugcaaucaggcggaucccuuguggggugcucugagccccucagcucacacagccccagcugagcuuacugagggccugggccacgccaccuggagggggcuuccuagaggggccgguucugcugccugggaagugccagcagagaaagcccccagcugucgacccuggguggugggaucugugcacggggaccucaguuucacagccgccccccgcccccccacggcucacacccuaagcagcucucucccgugaugaucgcugggguggacccaaggccacaggaccccggcucccucuguaccaacaccucuccgaugccacaguuauugcuggauuuaauaauccauugcaaacagggaaguaauggaaucuauuccccuuucuaccccuugaggcagaaacagauucucaagccuaggucaucguugcagggccagcagaagggcugguuaguaccgggggagggaagcgcgucuucccuucuucgugacguuugagucuccagcuggcuccugucugggcucggggcccacgcccaccccuggugaaggacccccagaucccgaggcagaucuguuccgacaccuucacacccuggaugucacguucuguggucaaagcuguuucugugccugggucaucacagcagccacuccuugucacgggaugacccucagcuggaccgcguguccccugaggaagggggcucuggccacgaaagggacccccacagaggcagggcuggcuguguguucccacagggaccuagggccgggagcagcuucuccugggcacugaugggggaagagcuccguguccccagcucaggggcccugggagcguuuccagguaaccgacuaaaacgacuucagacaaaaagaccuggcauuugucauguuuuauuuucucguuuaaaaaaauacugacuuugguagguaauuuugaguuuguaacuugguuuucuuucuccaaagugcccgcagccccccacgagacagauucccggcccugccugcuuguaucugggggcacaagugcaccccucacacaagccccaggccacgcggacgccgccuuucuaaccagaccugggcaggguucccacguuccagguucgccucucuccuuuaaugcugacgugcuggaauaaccucucggaacugccaaccuuccuggcaccagaucaucccucagcccuccuaacgcgccuuccgggagauuaaauucaggcgcaguuacacaaaaacagugacagacaagccgcucaggaagccucucugugggcauguguguuccagccucuaacugcagacaacauuuucacuuuccucaccgggcagcaccccgggaugucaggaggggcggccggcaggacuccccgagggcuaugcccacuccguucauggggcucauacauucugcugggaacuucuccccauuuaaugccugccccccgccccagggagggugaagggaacucucccucugggccccaucacagaccaucagccagaggugucagccccaccugagcccgggggcccccugcacucagaugccugauucccggaggccgaccacugcgaccuucugacucaaaaggagacgugaggcccccugaagacgggaggcggggccgggacaggggcugcggacugagcucaucuucggccgagucaucggaggaugccuuuggcacugagacgaggagugcgggcggcugguggccaaggcguguccccagcccgccccccacaagcaccggacaccucgggcaccuggauuccaaaugcuuggagcucucggaggggccucccugugcugccuguggggauggcaauuuugaaggaaaaccuacaaugagacuugacuuuacaaacauguacgugaaaugaauuccacagcuggaguguaaguggguucacuguugucaccuugugcauuucaacggcacauuucacaacccuaggaguccgccccucacugccgugacccccgggcaugcagacccgaagcucaucggcacagcggaaaccuagacugcuaacgaccccaugaugacgguguagaaaagggaaaaagccaagagcagcuuugagucagggcggugcuugcuaagcagcugucuuccacccacacccacccguccugccuccaccuccagggucggcagaagcagagcuggcaacuaucucucggaccacauggcagaagccaucugagcuggaccccaagacacagaugcacagcacggaggacgcagguccuggagcggccucggcguccucagacccagccgggguugcagaggcaggaagugcagcgggcacgcgggacggaacacggauaccugggugcugguuucuauucauuauuuauuuaacaaccacacugacaguggccucgagguaggcccagcgucaacacuggggaucucgcccugcggcagccugggggcucugccugaggggcucacagucuggugcagguugcggucgcagcccccaggaccagguggggugacagggagccggggagccccugggggcugguggggcuggucagugugcuuguggggaccugggauggucacccagggacuauggugcuacguccaggagagaagagacgacggaggcaaagagagggagaacgggcgaaggcuggugcccagggugagccuggggaaccuggccugcguugagccaugcuggagcagaugggggguggagggugcagccgagacacugggcagggggugcaggagagauguccacgcugggcacaaugcugagaggggagccggggccaaucgaggcaggaguguggcugguaggacaggacggccggcugccaggugggguguggacuggagguagcaggagcggcucagccccaccggcuucaugcuguggccacgguccugggggccgccaccucccaccugugaagggcaggcacgcuccccgcacgccccuucugccucugagauacgugaucugugcuaaagucagugcugcucaaacccacgguggggacugccgcaugcugagcaaauaagaaaaaaauuaaugcacugcucuggaaagcaauccuucucuauaaggccuagguuuucuuuaaaacauucaauuucuggucaaccaugcuugaaguuuaauuaggacucaaucauuauauuuucagaaaaagauaaaauauuuucuucuguaagauauauuguacuuuguuccaagaaugggcuggacucacuaagugugggcggcacagaccacguaaaccccagggggguccagagcgugaggcccuuccccacaaucccgggggucccagagcgugaggcucuuccccacaaucccgggggucccagagcgugaggcucuuccccacaauccugggggucccagagcgugaggcccuuccccacaaucccgggggucccagagcaugaggcucuuccccacaaucccgggggucccagagcaugaggcccuccccacaauccugggggucacagagcgugaggcucuuccccgcgagggcugggcugggggcugcacaucaccccugcagcucugucucacagacacucuuaggguacagcgacuuuacagcaaaaccccauuuuccacaucuugagaggccuuuccagagcuugccugauaaaaacaaggagucccaacaguuuggugugaacguggggauucaagggcuuccuuaggaucuggucuauuacaaaugcuguuuacauucagagaaaauggaaaccuuccaaaacacccugauuuuacuaagagaacgcagcugcuuuugcaauuagcgcccaguguguaauuucccucucagaugacaggaaucucugcaguuuuuagaaaaaaagcaauauaaaaagauuauugauguuagcuaagcuuacccaaaauacaguaaaauucaggaugaccgcuaacuguccccuccgagcuguggggaguggccuguacccacaaaauacaguaaaauucaggaugacugcuaauucuguccucuccgagcuggggggaguggccuguacccacaaaggaagccggggauggcgugggggacgccuuucucuucuacugguucagggacugaagaaacaaacuggaugguauuuucuuuaagaaaacacccuaaagguuaaaaagguaagaugauuuuuuuuuuuuuuuguaugagugaaaaggagccauucccacggcgggugaggggcaggcagguugaggagaaggugccccagccuggaugcccguggucccaggagaugaaguuaccccuggagaagugucucggggacguccgcccagcacaaagcucauucaccauccuuaaagaccacaucaggacuacaggcuuaaaagcaaaguuuauuccuaaaggugccugcaaaauagcuauaccuauuugccuuuucaccguaagcagcuuuagggugcaaaugcacaccaggacccccucaguuuuuuggagcagaagagccauguuuuccccuuggcuguuauacauucgcaagaagcaaaauaaccgugacuaucugaguaugcaacccccgccccccacccccaacagggaucaaggaaaaugcauccgaagcuucccuuuuccuuuccuuuucagggcaucgauggcucggucucacuaacgggacaucacacaguuaaaugugcaacacgccacgcugcuuuacggcgacgucguuucugcgucuuuagaaaaagcaccccacgcgcucauguucacggcuuacgguuagaaagauggcguuaccguuggcgggaagguaggugaaacgcugguacuggcuucgcuuucucuucccguugcagacguagaaacugacgugaacggggcugguuauccucugauuccgaaauggcgggaucucaaccaccagagaauucuacaggagaagggcacacaggaggcacaaucagcaccgggcaggcgauggcugccgcgccacggcggccacacggcaaccccgcguuuccacggcggccacacggcaaccccgcguuuccacggcggccacacggcaaccccgcguuuccacggcagcacaggacugccgugacgguaaacucccaagcagccaccugggcgguccagaagcagcugaugacagcccuggaugcucugugccaccugcacacgcguguggacacgcacgcucacagggaaggggcugcccuuggcuucuugcacacccaggagccgagaggcuuccucagagcagcacagcagacaagaccaaccuaagacugaaaucuugucaauauggggaaagaagccaggaaaagagaagcuguaaacagaacugggaccgggugccugaggguggagguugcccggggccaccugggcaaggggacuggcggggaugcaaaaggcucugccugcucugaugccaaaggguuggugaccuucagaaaacgacccaaggcuccgccgccagccacugugugauggaagugcucgguggcccagcaccugcucaggugacugcagcgaaacccagaggagcaggugcuuccuggagacgcggucucuggggagggccuguguuugucacauuugacgauggccgaggcccucagucagaccccaaauucacuccaacugaggaagaggaggcaggcccugacccccgcagaccccggggugggaacagccaagggcacggaggcacagacagcagagggcggcguguggaggcugccguuaccuucucauguuuuuaauguaacagccagcagcauguuuacgaaacucaugcuccuucaaguauacacaugaaacacaagccaugggacguguggcgcuguucgcagaggucggggcuggguggggggcugggacacggagaccccaaccgcgugcucaggccccagcguuacucgggccccugaugacccuaaaugacuggggugaugcaggcaucccugccgagggcggcacuugguaucuggggagaggguuggcgggagucgcaucuauaaaguuucauuuuuauaaucauaugacuuaguuuaacaagcaggagaaaaauccauuguauuacuucuuuuguuaaaauaauuaauuauagcucagcaccuaacuuagccaaauugauugaaucacauuaacaaugaaaucuuaagaguguuaaagacagaaaacugaagacaacuugagguccaggcucuuucauuuacaaauaaugaaacagcugaggcccagacacccaugcagaggggccaugcccuccccgcaccccugcuccccaccccacugggcccugugcccaggggccacacuuucuccuggcagcaggucuguguuguuuaauuaacugcaguucauugggaagaagcagaagccauggcacaugggcgucuuccugccuuugccccgcaucagagcugccccaggggagcugaagcugccgccggaggggccaugagugcugucagugggcggggccugggcugcccccagagcacugugggucugggccaucuccugggcugacccgggaagcucuggccacccggagccugucucggcauuuguacgggggauaaagagacgcuuccuccaaggcuguuuucugaauucagcagugcucagggcagcugcgauggagucagcagcuacaccaggugggucuuuagagcagaagcagcugagggaagagacaagaaggaaacgucucauggaagccgagacugaaauaguaacgggccgggaggcacucacaggcagcagcgaggaguggggaggcggggaccccacgggacaggcugggguggaggcggggacccugugggacaggcuggauggguggaggcggggaccacaugggccaggcuggcugggcagaggcggagauuccgugggccaggcuggcugggcggaggcgggaccuugugggccagacuggguggaggcggggaccccgugaggcaggcuggauggguggaggugggacccuguggggcaugcuggacggugcaugccaguuuuccuaaguccuaccugacuggaagggccuauguugaugugggcacaggccaacccacuucaacucucuaaauagacaaauuauaugacaaaaauacuaucuccgugggagcacugccacuuaaauacacacagaaggaagcgauaaagaagaaacacggaagaacaggaagggagagggaaacucgucuguaccggaaaaaauacggguuccaaauggcaccagcaccuacgcaaccugcuuuaaacuccacuguugagaugaagcucauacacuuacuuauagaaaguacaaaaaccguagacacagcacaucccauuuuguucacaaaauaugcacaggcgggcacgguggcucacaccugucaucccagcacuuugggaggcccaggugggaggauugcuugagcccaggaguucaggaccagccugggcaacaccgcgaggccccaucucuacaaaaauuuaaaaauuagcugggcagaauagggcacacuuguguccccagcuacuggcgaggcugaggcaugagaacugcuucagccugggaggucaaggcugcagugagccaugaucaagccacuggacuccagccuggaugacacagcaagacccugucucaaaaaaaaaaaaauaaauaaauaaauaaauauauauauauacacauacauauacacacacacacacacacacacaaacacauauauccacaauauaauguacucugugugugugugugugucugcgugaacauccacacacagcagcaaauggagcaggacgcaugcccaaugccagcagugguuaugucucaguuggugagacuacacuagguuuuauuuccuuuuuuauauuguccaaauguccacgaugaguaugaaguuccuuuaugaugagaaaauauauauauuaaagcaaacuccauuuaagagauuaaaaaugaaacagcaggccgggcgcgguggcucacgccuguaaucccagcacuuugggaggccacggugggcggaucaccugaggucaggaguucaagaccagccuggacaacauggugaaaucccgucucuacuaaaaaaaauacaaaaacauuagccaggcauaguggccggcgccuguaguccuagauacucgggagacugaggcaugagaaucgcuugaaccugggaggcggaggcugcaaugagcugagaucgagccacugcacuccaaucugggugacagagcgagacugucucaaaaaaacaaaaaacaaacaaaaaacaaccaguaaacuugaaguacacaauuuuucacaugugcucuuaaguuucuuuuaaaacauacagcuguuaagcuucccucgaaauaugccagugucaaaaguaaaacagaaaaucacagagaauguggaugucagcuuggcugggauuguuuucagugcagaaaggcucacggcuccuccuggcugcucucccugccuagggggacagggcaggccagcggcugggcagcccagcuccggcauccugcaucccgcaacccgcgugcaugugcggggcuggcgaagccuguggagaccccgacggagccagggcuagggaggguaggcagcacgaggccaggcaccaggguacacugccugcaggcagagggacggagagccagaugucaguguacccagcacagacgcacagcagagcaagggcagcccaguggggaggaacgaaucagacacccaguagguggggaggccuggcaaugaccccauggacgaaggcugccagcccccugggcaguugcaaacgcccggccagcggggagccacagaccuuaugggcacaggaaauggccguggggaagagaggccgguauggacacgggaacgggcuguggggaggagaggccgguauggacacgggaacaggcugcggggaggagaggccgguacagcagcuccagcugccuuugccuguggcuggccguucccaggacccuucugagcacccugacucacuggcucugcggacaacgggccguguaggccgggacuccuuccucugaacacuggccugcccuggggccuccagcuuuccucaaggggcuucucaggugaaggcaagaaaagcgacagcauugaacuggaacccugugagugccaggagcuucaggggaggccugagcaccacugaaggugcaggugagcucacuucacccagggccagggaggaaccuuuuccaucugauaaccacuuggaaaagguucugggaaggggauggguccuugggggaagggcgcugaagucgcaggguggaagacgcugcuuucugacagagccaccucuugggacagggagugaaggugccagcaccgcucuccauggaggccaccgaucgucccaccaacaggagacgaccucaagacuccuccccgguguccuguccaccugccuccagccgcccgagaugggcucuucccugagguuucugaagggaccagcuuccaacugcacacacugagugggugcacaagacuccccgacccgcagggacacacacugagugggugcacaagacuucccugacccgcagggacacacacugcugagcucagaagcauguucaugucuucaaaacucccuugugagccauguggcaucuuauguuggccuagagauuucuacugcuuuuauaggacuaaacagaacacucaaaaaauccaacguagggaucaauccaacuguaucaauaauaagugaacaucaggccgggcacgguggcucaugccuguaaucccagcacuuugggaggccgaggcgggcggaucaccugagguugggaguuccagaccugcuuggccaacauggcaaaaccccaucucuacuaaaauuacaaaauuagccgggcgugguggugcaugccuguaaucccagcuacucgggagguggagguugcagugagccgagaucacgccacugcacuccagccugggcaacaagaacgaaacucuguuucaaaaaaacaaaaacaaacaaaacuaaagaccuaaacaucaauggucuccaugugccaauuacaagacagcgucagagaggauccaagacaccacccaagaagacguugccuccaagaaaccacuuuaaacaugagcacauggaucagaagcgcagggaugggagagaugcacgcagcaaccggugccgugcaggagaugugggagcagcuacagccauccacacaaaaggucaucuccaauccgaggacggucauuauccucaggcaccggcuguaugcacgcggugccagggaagcuguggcaggugacugggggaguuggaaacggcccggugacagcagaagugugacccagccacgcgucugccacgaccccgcacacaugcaccgcccgcuaacaggcuguggccaaucgcgaguccaggagccacgcccaggcucuugugcuugggacaccaucacaggggaggucggcgcaaucaguggccucggaggacggggugaggaguccccacuggggaugccgcagagcccugcccucggugcugugagcgggucugggcaggugcugaccaccccccgggaacucagcacagcacugacucccaggagccugcucugugccaggugauggugacagcaaggggacagcaaagggcgggaggguccgugugagacgaccuucccugggcugucucagcgccagggugugugagguggcccucagccuguccagcaccguccccggccgccagggcucugacgugaccugacacguugggugacagcacauggugcuuuggcgaguacuuggugauccuguuuguuacugguucuguuacucuaugcacuauuuuuauuuguuucauucuaagaaacaggaaccccagccucccaaggccuggggacccgcaguggcuccagcagaccccagccucccaagcccuggggacccacaguagcuccagcugcgccaaaggcacucaccggcuugcacaggucccggucaguuuucgcuuccaucucccagacaugguggccaucuggaagaaaggagcaggaaacgucugugacucugugugguggggagcccccuccccagacacccccacgugauccagacccagggcccugagccaggagggcgccuugucccaggagacccacguaggcccaucccagggcuuugucgagggcagcaccucaggagccacgugcccuggcagggccccgagcucgacaccaaaguugcccugggagccuggagaagcugaggacacgcggcucagggcuuguucugaccccagcccggcguaggagggacuacagggcaggggcauccucaggaauccguccuggcccugcaucugcuggccucucacagccucaggacaggucacgggagggucucuaugcccucguccucuccagggagagcaggugugagggggagcagguaccccaucagcagagcgugugcagggcgucugugcguggaccugggacccggcucugcaguucccagcccagccucccagggaugcaggaggugugagaguagugacggggggccgggggcuccacgccagggugcgacgccugcucgugcuggggucuacucugguggaugagggccuggccgcuggcccugccugugugcaaaggaaccacuggguaaaugagaagagccuuccucugacaacuucuugcccaucaggagacagaaaugcaaaacacgagguauuuuuggcauuuccccaguggccauuugcauguuuuuaaaaaauaaaaaggcucccagagguguagugaaaggacgcguugugcucucugcuccaggccuggcagagugggggcuccaggcgcacacggacaaggcggccccaccacagccugggugugugcacggccuggccccucagaugggcugaguuuggggcaauuaucucaaauuaacagaugucaaucuccuacagagucucuuccugccuuuuaucuucuccaaaauaaagucuguucccaaaaugaacaguuacagguauacacacuuaaguuuauccuuaugcucugucuccaaagaagaaaaugugugucuguuacaaacccucaauuacugauaaaucagacaaaaucuccuuuuucucuguuacagugccgggcugcugccuggguggaggguggagaggaaaugugagucacacaggaccccagagccgcccagccaagcccuggccaugccagcccgggaggcccgagguccccacgcaaauuacccaccagaugaacccacucgauagagccuggcaucccucucuccucuaggaaaaaaauuacaggaaacuaaaaaguacacucaguugcgcuugaagccaucugaguuucaugaagcagcaaguccuccaggcccuggaaagcucaggagcugggaagaaagaggcguuuucacuccagcacaggugcugaugccacaggauucccagaagcccccagcccagaugcaccacucagaagccccuccacccccacuucauaaaaauccaaaucacucuguguguaacuaagucuucugguuguuuggcaccuuuugaaaaugacuuuugaacuuuucuuaugacaaaguccaucuuuggggugaggccccguccacaccccacaaaaggcugugguccucugaagcucccgggcgcaacaggcuauaguuugcuucccgcccagcccaggaagcucagagucacaacuucagcuucccuaggaacuucccugacgcuguggaggccuuuggcacuggcaaggggagggagguucagugacugugcugagcaggagggacacugaggcgcacacggggccaggaugucgcguuuaaugacaccccgaggggacgccauuuuugcagccgaggccaacacagccugcuccucucuuuaugucccgagaagcaagagggacuccagccgucucccccgcggccuccuccagguggcugccccgcagcggugaguccaugaaaagcaaauggaacgacggcauggaggcgucuuuucccacccgugccucgugggccuguggggaaccauccuugccggagcggccccaaggggagccacgucugcguggccagccaggcccagcucagcagcugccauggagcagccuccaccgcacaccugggagcacccgcacccugcaauuccugcgcaggugggagcagauacgcuuagacuuccccuaaaagugcggggaaccgacaaacaucccugccuuccucaaagaccccggcugagccagcgccuguggccuucccucuuggagguggggccucuccccgugguguccgacgucuguggccguuucaggucgaccagggugagggugagggcaggcuuucuguuucugcuuaaggaucauaaaguaauugucuuucaaaagcaauaguauucacggccagaaaugucuaucuagcaauugcuuccagaacaagacaaagcgccgagacugcugaaagauggaaauaaccucgcaucucaggaaaggagacgcagggccgcgucccgccggcaagagcaucgccauggcggcucccagcuccguggaggcccggacgggcagcgccggcccccgugcuguucaaaacucagccccuggcaggaaggaaggcagccgguccugaaagggccuuuguguucagccuuaucagagcuccgaguccuuaguaggaaacugcccgagugcaggaguaaaaauauuccagaucauuagggaauucccugcagucugagucaucgggaggcuucccugccacacccgcgagguuuccacacaggcaggccugcgggcccaggagccucccagaccggccaggacccgccgcccggagccgggccacccccacgccggugcugaugcugagccacuguuuccacaaagaaagccacgagggccgcugguggaagcagcagcgucccugggucccacggugcccucgagcccugcuccccacggcgucuccugcccugcuccccaaagcauccucgugcccugcuccccgcggcguccucgugccgugcaccccacagcauccucaugcccagaagcgagcgucccuggggcgucucauccauccccggcucucccccaggagucugucccagccuggcucccagaggagauucuggaggggaaacagccacccagcccugcugcacaucugccugcagggccucacacggagccacccugugacccacagcccuuucacaccgaggcaugugcucaggagacaggcaggcguccacacaggacucacgcacugagguucauggcggcuuuuccacgaucaucuccacaggguggacguggccuagugccaucgacagacaggugugggcagccacacggugggcuucccucagccacagaaagaccccacgucccgaccugugccaacgaggggaccugaggacccuacgcccugacccacaccaacgagggaacauggaggaugccacgcuccacagaagcugccaggcaccacagccggcaggaugggguuccccagcaggccagcagggagcagccagaccaggcgaggccacggcgagggggcauugggguugucggagccggggugggggaagggagagcagggguggccacucaugggcaaggguuucuuucuggggacaagaaaauguucugaaauuggugguggccgcauaauuaugugaagccaccaaaacccaccgaauuauacacuuugagugaauuaaaugguguauagaucauauuucgauaaagcugauauaaaaaagaaacuagccaacaugaccaugggugacuuugucguguaugaucccaaaaggccugagaagggagaggagggaggggagccagaagcccggccccuccuccugcaguggggacugacgugacgcguggccuccccacaccagcggggcccaggcagggggagucugagagucgccccuagcgcuauccagaaugcggcuugaugagaacuguggggucaucacucaauucuagggguccuggaccaucugggccacugagccauccucagggcaugaggaagacacgggcaggugucucuuccccgggcgcugcccuccuugccuucccuguguggucucugggagcaaacagagaagccuggggguucagcccggccaccuguccugcucccaaagacgccauguggugacaaagcagccccaacucuccucucucggagcacacggcgacagugaugucuguccacacucacaggcgcccagcaaugucaccuucucccugaaaacacaaaucugaaagaucugcauuuggccuuuaaacuguugggauggacaccucugaagguguugucauugcgaugcugccuucggggccagcauccaacaucuucaggaggugacagcugagcugcuccacacagggaggcugcccgugccgcggacgcuggagcugggaauucccagcuguguccuccuugcucacccagccccgucagagggcacaccacggagaugccacagaggcagccaucccccggguccaucucccucggccuacaucccgcacgacuaaaacagaacacagaccccaccacccaccuggacuccaccuuccuccucggcccgcuccucugccccaggccgagaccuuccacaagggacagaggagggacagcaagggccgaaaggggcagugccacuagucugccuuacaggggcccugacccucaccuccuccccgcccgcgagaaagaaccagacccuaggaaaacaaggagcaggggcagcuggaggaggagaggggcaggguggccagcgggcacugaugccucacuggggaaaucggggccugcaggggccucggggcuuccgcgacacccuggggugggugaaccucccccuggccuugaaggaaccugaaggugagcccggagggaguggcuucaggccuggggacuccucugacccggcucucugggcggacaggaggguccuugccuggcgcuuccugcaccuggaugacauggccucugccuggggacaugcaccccacacucgccgcggugaaugugugugucccggcauaggaccagcagcugccaaggccacggugguuccgugacagcccaaagccacggugguuccgugacaguuccguguccuugcaaguguccugccagcugccagcuaagcucuguggcugcuggguggagccucccaaaacaacggccaggugccugucagagcuuguggaaguccugggaaccacaccggucacggucccauggcagggcagccuuggaaaggcccgggccuuuggucccuuuauuugaaaaauaacaacauacauuuggcccagauuuggaguccuggcccucccagugaggugggaggcaggcccuccgccugcugcuguguggagaaaucuggaaaccuagccugcgucuccugcaguguggcuagugccugcccacaggccugucuucuccacgugguaacauccagggccagaggauggggcggccgugggauggggcggccgugggauggggcggccgugggauggggcggccgugagauggggggcgagcuggggucccaccauguuggguuuggggcgaaccuggcugucugggguuucucaggggagggcucuggaugugcugggcugggggccuccgggaggggcucugucuacucgcucccaccgugcaggccacccggccucccacauuucugugugucucccugcgaaccagggcagggccccuggggugguggcuggcacggcacuggguccaggccugggccuaggagcccuggcacagcccgucucugcuucccgggagccccggccgccugugagaugccaggcugccuccccagaggggccccgggaggccacguagaggggcccugauuaccuggagaaggagacgccggccguccaggccccagcuggccugccagucacggcggccacagaaacgaccacugacgagacccgugcagccccacccgcugagcccugcccgcugcgcgaucgcuggcaaacggagugggagucuucacccccggcgucguaguguggcuuccgcgcagcgacaccaaaacaggcuucgcugauguuuuuaaaaaacggcaccagaacagacgcgugacuuaagaaaaggagguuguucagcuccagcaucgagaacuggcucauguuugaugcauccacaucucagaaccuugcgccuucugucucaucucagccaggcucuagacacagcccgagcucacguuucacgcgggcguucuucgggcguuucguuuauguugaacguuagugugucccucagcagcuucaacguucacgcguguacagagaggugccucacaucggaacacagacacagugaucuuuaacaggcgggaggggugcaggugugaagguggggaggggugugggugggagaggggugugguucccacuuccugcagcugaaccccugcagccuuggaaacuggggguucuugugaugcuaccaggggcuucuaaaccaacacccggcccucggcuccccacagccaaccugccuccuggaagaacauuccucacagauuuucaucaucggaaaaugucguuuuccgaggaagcuguaaacuaaguccucagagaaaggcugacuccgcucccggccuuuugcgccgcccugagacaccugggaggaagcuccguggagcgcaggcugagacucaaacacccacccuccuccugcccugcuggagcaucccagagggacccggcacccaggcuacggcgagccaugcccuugcccggccggcuccccgcaaugcagcccugcugcggggacucccuuccucaugaggccaacaccagcuucucccagccuuccagggcaguggagccgcuccaucuaaaacuucccaaagcucagagaugcugugaacccauagcagcugaagguggccuggcugauacgcagaggcugagcuggccuggacaaugagcuuccuacguacuccagagaaggacaggguggagccgacccuggccuguguccagagccaacauucccaacagcuacaaccaucugcacccucggaaugagcaggacagucgagagacgcaggggcccuuccuggagaagccacuucaacugcccuacugacggauuuccucagcaggaaccuccccuccugagcucacacccggcccugguuccaucugcaagagcagucuaaaacagaacuuuaaacagaccagacgaucccaucagaaaacgagagggcaacuguguuuuuaauuuaaauucaguuuagugguuucucucguugccaggaugaggauguggggcuuucugcugcaccaaccugucacugcacaucagcacguguuguaagcaacggcucccgccugagaagccggaaguggaggaagaaaauuauguggacauuuguucuccacuuuugaaaacauggaaugugcuuguguguguaugaauaugcaaauuaucuuauucaacuauaaagaauaaaauuaucaacguggucuggcuucaucccugcaguauucacagcuucacgugcucucgagcacagcaccuauucauuuauggcucaccugcuguauaccagacgccggcuggugcuggcagagggucagagacccacccugaccucaugggacaagaggaggacaugggcagacaaacuggcauugcccagaaguguggcuguggcagccgagcuuaagggcagaacagguaccccuccggccugcugaccccacagcucacagugaugaugaaggcaggaggggcugccuguaggggcggccgcaugaggccagggcugguccugcauccccuuggcuccuggcccucgcaggcugguggcugcccuuacccauggcgccguggcaccaacucagcacaguaacuuggcuagggcaggagcuggggcaccucugcggacugcauucggggggaggcucugccaaggugcccaggccucucugggcagaagaaaaagcaaggaggcugcucaggucugggcuuugaaaagcagaagcugggagccacgguucuggccagucuuggcccaagcgaggcccuacacugugggcgaaguguuucuccgccaacgcguggacacacaccgaaagcucugaagggaaaauuauuucaaaauuagccuccucccgagaaggcacgggcaaugcaaaugccuucccggucacugcccuuaguugguuuucucuguaauuuaaaacauguuuuccaauuaagcccugauucuauaggaagccaaguuagagucaaagaccucuaaagccgauuuugauugaagcacuuaaguuuccggcaaacuguacaaaucaagaccccauuaucaaggcugaaugccuccgcgguuuccagggauuggaguaagugcaaaagaauuccaauugguaaguguacaaaaggaaaaaaauaucacaaaacaggccuugugggggcaugccccucaccuggcgcacccugggcagaggcccagcaaggcaccaggaacccccaaaaccagggagcucacggcaggcuuugcggagagccaggcccacucugccugaacccccuugagggcugggcuagggucccugugcccagcuacacuggugcccacucucccugcaaugccaguuucccaucagugcagcccacugucuucacacacucugcucggagccggcgaggccaccccucugggaugagagugcuggggcccggcgucugcauggaacugaccugggcugggagccacucugugagcccaauccccgcaggacagucucccgugggcagcacagaaccacaggcgugacggccccaggaggaacaucacuccgaggacaccccugcugcccuuccaaguucagccccggagccuccaggcugggccagcgcaacaccuggaggcaggggugaccugugcccuuggggcacaagagccucacacacaccacggcuguggcauuaaagaccaccccagcucccgccgucugcggcacccaccccaucccugccuccgaccccaggaaugcuggcgggaggggaaggccccggaggggagcucccuccugcccugcugcuaacugacccccgaagcguccacucucugcagauggaggaccccagcaaagccagcaaaugcgucuugcccuccucugcguccccagcccgugggcucccugaguaucagcagcgaugugagugcaguggccccggcggccccagaaauaaacauccaccucuucccuucagcagcacagcugucggcucacacaaaaacccacagccggaugcagacacgggccacgcagagccucugcuccgugccacaccccauaagccccgucccggugaccgugcacagguggguccugcuccaccgacugggaaccgguucccaccagcgccgaagcccaggccgcagauggccccuggugaagagcauaccuggggcuuucuccacgaaaaugaccuuggaguccugcaggaaguuguggccagacaggaccaucuucuucccgcccacgaccggauagcuguccgugcucugcuucuccaccagaggcagcuccugagcugagcgcugggcugcaucagaaggagaggggcagugagggccuguccugagugggcggccuggggcacacguguggcacccagcaggucacacgugagccgacccacccagagcaagcaccgccacgaccugcgggccgaccccugcggaugccacuacuucuaggggagaagccgugcacacuucauccugauggucuccaccucguucugaagaagucaucaaaauaucuuccuaagacucagccaauuucacucaaaucacagucaucgcacaaauacgcaaaggucagcgcagcgugaggggaagccccggcccacaccgcuuucccuggccaugcucagccaucagaggagccagcgccaggggcccccgggaggccacaggcaauaacucagccaugaucaacucagaccccucguggccacacacugugguggguuuggugggaaccguucagucccaagucuacacgaacgaaaagcugagagcgggugagacagugaagcgcaugugacgggacgguuuccuccccugugggcgcguggacguccacuuacagcauucgaugggguuggaggccaccugcagggacagcgugcggccgcuggguugcgggacgugaacgcggaacaccagccguacccguguguucuuccucccgauguccgucucuccuuuccgaaguucaaugucggaguuucugaguuucaggauuccggcacagucaaugcugcccaaaacaaaagcccacagcuuuucuuucaauggcugacgcgggagcguaaaggccuggccccccagacccucuggcccucaucccagccccacgagcucgugccaggcagcuggccacucuccccuuccccaaggaaaacaagaccuugaagccagcgacgugaggcccuugccuagugcaggagagaaucugacauuggcgcaggcgagggggcaagcagaggcagccccgagaaaagccacuuccaccuuccccuucccaccuuccuccagccuccagccuccacccuccaccccugaccaagcggguccagucggagcugucccaaguccuggcugccuccagggcccacgcuggccacguauacggggaugucaccagagcggcagagagcggcccaggggaggggccagaggcaccugcuguucucacuuaucuuggaguaguucccaaaaagcucaauuuauuauuaucauuuacaauaauuauauauuauauauuauuagguuaaauauuauauauuuauaauuauauaaaauauauaauaaaucauaauuagaauaaauuauucuauuauuuccacuauauuuaaaagcccucauuuuuuguguguaaaacccauuuuuucuaugguuucauauaaccucuuaacaauuucauucaaaacuagacuccaguaaaacauuccauguauacauucucaaugcacuaaaaagcaguauuuuucaguaaguuaagagaaugagaauaaacacagacuccccgaccacccacgaggcggcagccagcacagggcuggagcgcgguccuggcugcgggcgucucccggccacccuuucugccccacaucaugguggggugaacgcagccgccagcgaagccaggacguuuacuacggcuguggaacgcaccugacugugcccugucugcgggaaacuuggauuacagcucucgaggcaaacucagggauuuggaaugaauucccaggugcguacauuccucccagugcuugaaaagucaacguggagagaaagcuuucccuuuuugacuuacaggcuuugaaucacuuauuaaaauccccaacguggccccccgccgccaucuccuacacgcucucccucaccgugcgggacuccuccccacuccugcagccccaggaccucugcacccacccccggggcuccaccuggauggggcaccccacacacagcuuccccaucacacgggcucccagccugcgggucacccucgcaggacgccgucccugcccuccggccuggcuccauccugcuggucugcacguuccagccgucccagcucaaccugcacucauucacccacagaugugucuguuuucgguuccccccacaguaccacaucaaucucucgggaaccagcaguccuccuccucggcugccuucacagguuagggccagcgugcccagcacaagcuaggauuaagugaguaaggccuuauuuggaaguuacauguuucguccucaccuuacuaaaaaauucacuuuuaaacaaauuacagugucaaauuagacucagaacaucagcacaggccuauccguguugucggaaccuccuaaaggucaacgugauccagaugugcugacugcuuuaauuuuuugaugcucacguuuuaaccauccucucauuacacugcuguauucggaaagaaauagggguccuguuuagaagcuaaaugcagagggagguauuuauagcugcauaucugacauuuuaaguggcaauauacacagggcugaaacccuagagagaagcaaauccauugucaaaagcaagagugaaguuuacuuauuggcuguuaaaccaaaaguguccuggccacgcagccuggaagugcggggggcuggccagaccccccgggacugggagggaggcacgcccccuccuaccgcccccugccagaggccggaggucccccgcggcuuacacggcucgcaugcuguucuccggcaggagugggaucuccaggacuuugguguuggagaggauggccucguggcuggugguggacacggucuucccugugaugcggugcaccugguagaaggcgugcgggcgcagcaggcggucguccgccgucccaaugaaaagcugcagcaucagcggcucauucuccaaguagccaugcagcuggcgagagaacagaaaacaccugcucagcacccagagcacagaccgccgggagucaccggaacgcagagaaaaccugcggcggguucgaggccugugucccccugcccugcccccuuuuuauuucucugccaugucauacuggugucuuuguaaaucagauuagaaaaugccuuguuaucccaauggaccugggcacugaguuuuaggcuuugaaacgggccuugcacguaugcauccacacuugcugugugugcccauucugaggccacagugaagcuggcagggggcgugugcaggaaagcggagcccucgcugagccaugugcaaggcucgcuucaccaauaaauccagaugaggccccgcaggacaugacccaccuuccuguguuccauuaaccuggaaccgggcagcgcgcagcucccacuccugaucaggggacgccacacugcguuugcacacacacagcacgacgggccccaggccccagcacccuuccugauggcucccugccccucuccuccugcagaggcaggggagcgcucaacgccguccugguggcugagcagcuaguguccagaggcagacgcuggcggcagacacugccuagggcaaccaugcauggaggugucuauaguccgcaccacccugcagagccgcucauggcuucucggccggcgccgugugggugagacucaaaacccacaccacugggacaggacuccagacaaauggagcagccccggugcuuccgccaggacacuaguggccgggccccacucacgccucugggaaggugugcgccucacggcagggcacacacauguucaggaccagcuguucugugggaugaguugcucaucagcgucuugagagguaaacacagaguguggugccguucccucucacccuccuucucugcaccacgcgugguuccgccuucagcagugagucauuuuuagaacuguuuguuuuuaucuuuaacgcuaccauuuacaaucacuauagucugauuccauaugcaagaggcaaguuugguuuggaacaggaacguuugauucucaaagcaagcacaaaggccuugagggaggccgcaggagucaaacccuuugcgcaguggggccucccacagggccccucguucagagugccuucccuucugcaucccccaaguggggcccgaugagcgccagccucagagcccugagauucaucagcaaaauccaugcaaggcccguggcaacgcccagccccgggaaccacucauccugggacgcgucgaccccucugaucacguuuggagucgauuuucucacuaaacuaacuuuaaaaucuuugaccacagacggcaacugcagcacgaugaccacgugcagaguccaggccugggcuccugcaggcacguuccagccacaggaaaaugcgacgccugccccugaccacgcagaugccugcugcccacucagggccagcgaggcgagggagaaggcgggggagcccgggccaggggacggcggauucucagaugucagugggcagagggaagauggggcuagaggggcccgggcaggcgaagaggcggcccuugcuccguggcuccagcuuagccucagccgccguguggucaccacaguaaagaacaaaccaaucucaccgguggcugaacucagagccccgccagggaggaggccacagugaagcgacggcugaacucagagcccuccagggacgaggccacagugaagcgacggcugcugucacugagggccugaccgugaggcccagacugaugggcagggacugggacgccgcgugaggcugagccgggacccaggucccagcugagacaucgaaggggcguuuggggucugaaacacaaagccagaggcugaacgaaggcaucacgugggaacacgguggggaagccacagacagggaugaggacacagcccccaugugcgcagaugcccacaggagucucugcacccaaggccaccagcagcccacuccaaagugauuacugcuaagaccacguaacucugcagaacaaaaagcccuucccuuuccaauagagccccccuucccauaugaauacaugagugucuccacacaaacagucaggacgggggacgcugggaccugccuguccagcccucagcuccucggaagagagacuccagccguuugccaaguuaaugaacuucccgagauaccuuaacucucugugggacucaaacaucuuuaugaugggaaauguaaaaagaaaagcagauuaagaggcggauucugccacgcaguauuccauuuuccgagauuuaauaccuaaaaauuuaauuuacauagaaaaaaauguaaaugagucgcugaccaaaaccaccucggggggugggggaggggcaccggggcagcuccagggucacguggucuuaaaacuacaauuuaaaauucccccaggaucccuguggcaguucucugaugguguguggaaugcugugaauuugggguaugacuguauccuuuaaaaaacaugccauuucagugaaaaugggaauauuuaagguuucaccugggagguaaacaucuauuauuuaaaacaugaaguucauuuuaagaaaagucauuuaaauacgucacgggccccacugcaugggcuuucugccucuggcacaguacagaaccugucagaauccuauuuauaaaauucccugucacaacaaugaccucccucugccucaaccuuaacuaaacaaaauguauuauucuuauuccacugccgagguauaagagcuacugagucuccuacacguuacaauguuuguuuuuagcuccugugcugaccucagcacuuacacggugacaugguggguaguggaugauugaggccaaauuuauucaacguggaacucagcugcgugcacccaggggagggaggugugggguggacagaggcagcucacgggugggaaugucucacccuccaccccauagucugagcugcugcacagaaacggagccaaggcgaccuggagucaggcuucucuccaggcagggcacaggagcagccgucagccuaaagggaaauuauccauuuagggccuacgaguaaaaucugcauuuuucaaauugccccaaggaaguacacagggacagaaaauccggcucacaaaccgguuucaaccccgauuccccccaugcuggauuaauuugagagauugccacgcugugugaacagcgucuaggguccucuucucagcccuggaauccucaucacccacaacagcagccagaggugacacuuccaggugaaggccguggugcgucucucagggcugggcccggggccagggaaccaggcaggagagugcaucugucaugggaggacguccagccacauucuccaccaaagcacgagaaggaaggcaucagagaccccguggcuccacccucgguacaggggccuggccaggaugauacggcagccacugcugcagagccagguguuccugcaggaacgaggcccaccuuacccacagcccaggcccacgugacccacggcacaccaaagcagaugagucaacagcacacgguacuuguaagaaaaauccaauuugaugcuccagggagacuuuacucaagauaccaggaaaaaucgaaacaaaaguaaaagacaucaaaaauggagccaguagucgaagggagcaccccaaacccgaaacggguggaggaccaggacacacccccgcauccucccucuccuucccccuuuucucagccaggccucaccugcccgaagugggacaggcugccggugugauuucugugcuugccggggcuucgggcucugggguccacggugacauuccaggugaagccaccaagagacagccacgcagcguccacuuccucaccugcuggcuguguggugugcagaagccuccgugagugugggcgugugcaccagaagugugcgugugcaggcauguguguggccacgggggugccugugugugcagcgccgguguggucuguggggucgggcacgugugugcccacgggggugccugugugugcagugccgguguggucugcggggucgggcacgugggugcccacaggggugccugugugugcggcgcugguguggucugccagguuguacgugagcagugcuucccuguaaaccggcccagaccuggcuuuaaggggcagcuucaucugccggacgcccugcccuggccccuucagaugcgggaaagggccugaggggccuggggucucccuccagagcagcgagggcucgggguaggcgggggaagcuggggucucccuccagagcagcgugggcucggggugggugggggaaggacacagccugacgccgcacaccucuuguccugguucccagugugcagugcagagaaggaacgggaggaacggggacgccauggcuggagacucaggccugagccaggagucggggcaaagccugguguucugugaacacacgugggcacacacacacgcacagccacacugggaaaugugcacacccccccagagcgugcacacacacacgcacacacacacaccacaugugacaagccucugacccacuggcaccagcucacugcucucugggaaguucuagaaaaaaguuuuuuucucauuucagguuuuauuucuaccuguuuggccacaguugccagccuccugacagacccagagugcaugagagaggccuccaggaacccuacagccaacacucccucaacccuccaagggaacagaucucggccuugcaggagcagggccaggcccuccugacccccaaaucccacaaaccuggcacuguuggcaucaugagcccuggcaggcagggacaccagguaccaggacccacagcagcuuucgccauguggcacagcccuucccagagagggugggcggaccagcaccucggggcuggggucucugggcagccuggggaaggggccuugugccuggaggugccgggacacccgcccagggcuagggggacaggaccaggaucgaucguaccugcccucccacagaugccgucggcagaaggauucaagggaagcguccaugugcccggcaggaaccgaggcagaggcugggcagacgggaccccacgggcuugcugcaugcugaggccugaacggcggagguuacauagcaagccugcugaguggauucucagaccggugaaugcacgggcgccgacugggaaacuagcuccuccccaccccccgagggacggcuccaggccccuucccaugacaggaacaggacgacguguccaugcaguuuccugcacgagaggcccugggugaguagugggcgcugcccucacuaccaugccuggugaaggaagcugucugcagaauccgugugacugaccgauucgucuuccuagcucucagggcggugugugugggggcccgaggcaagugugugugacagugcgugcagguguguguccauacgcgcggugcacaagcugacaauacugaguucacaccacggagugucagcucaauucugagaauccuucccgugaacacaguugcuuuccuagugauucauagaucguguucagauccacagauaaaacugaauuuguggcuguaaagcaaaucuagagggacucgccgccccgcacagggaccuuccagccgcgacugaaaaacugcacucagccacaggcucaguccugaccgggaagggcuguuucaacauaagucucuugggauuuuugguuuucaaaagggggcaggcggagcugcaggacugccaggcuccagcugagcgugccucacuugcuacaagggaagcucugguguguccccuuccaaacacagcugcugcuguccgggugggaguggggagcuguccgggugggaguggggagcugucugggugggaguggggagaaacucggguuucuugaugcucagagcugagcuccgggcuggggccccagaccucccccagacaccaaccagaugaccugcaggcuacagcaaggcguggcccgccggagcagaagcuccccaggagggacccagcgugagcacguggcgccaacaaccgcacacugcugccaccacccgccgccgccaccgcacgucugugaaccaacauuguauccccacuccagagaagcagcgcugagcugccagggccuguuucccggaccccggcuccaaggugucugggcuuucuucccaggucccuacuuuucuagccccuuccgccgacuuuggagaaagaucauucaaaccggaagcccagagaaggugcuggaaggauguugaguggcaaccccagaacaggcacgcggcaggagccccucuucuuggagacauggcgcccgugaauggcacgugcgcugucaccugcacgaaggcagcagaggcugcucagcaggaccgacgccucggcgaggguggacagagguggggaggagaaaggccgcccggccacaccugugggccccucacacgugccagucuccacacgugcacgcgggucuccacgucucuccggaagagcagccccagaggccgugcuugccguggagaacuggugcccucccccaccgccucggcccgcugcccucccggcugcucucccaaccugugccaugcagggaccaccuugccccaccagcgcgcuucccaccucgaccuggaggcaauggcgcucggcacgaaccccagacucaccagagcaccgacagggccacggagccagggcacugacguggagggugcaggggccccaacgcaccuggaagcgcccagagaagagacggccacgcucacuuuggcugaagaagauucugcccggaaacaccacguuuagauuuaauuaaaucuaaucaauuaauccaugcugagaaaccucgaccuucuauggagagagaaucaucuagaaugcaacuccugaaacaggcaagugggaaacgccgcaaccccgugaccccagggccagaagcacacagaauccacagcccacggccacgaagggagaaacggcaaccuucuagagacauccgugccacugagagucgcgucgccugacaccaagcggcaggagcgcuugucauuugucagaagugaggugguuuccgcucagcacuucuccccagucuaccccagcagggccugacgggcucaggucacagcccacccacagccgggaugcccuggcugaucucagggagacacaucaaggagcuggcaggguggccugaggaccggcaagcagccccuguucauccugccucccccacaagcccucccagcuccagaauggccccuaagccugcuggucaguggcucaaacacaucaaaaccgaaaucacgggggagagaggcccaggagcgcugcccgcccagcagccaugugcaccuccagagcccgacagcuacagcgauacccaguccagacacacaggggugaagggcccgaggaauccugggguggaagagccaccauccagcagcaccccugccccuccuucagggcccgcacccugcagcgccacagcccugcacuccccaaucuccgggugaaaccuucuauuucccuaggacauggccucagggagccucgcagggugagaccuggucagucuaugugcuccaaguguguaugauggugcgucucggcuccgcagggcccaggggccaucugugcuguucccagcaaagcgccucuguccacagacaaggcccgguguccugccuggaggagggagguguggcuugaggcagguccacggacacgagcccagcccagacgggcacacgcccaugggugcucccagccgccacucccacgucuggccugggcagggccugggcaaggaacagccaccaacgucacagacaaagaaagcaagcagccgucccgcccagcagcuccucagagaagaggagugucucugaaaccacaucucguuccucuuagaaccggcacugacacagagacccugcacuccggagcuguucagacacagcagggcacaaaccugggaggcuucagaaauggcugccacccucagcacuggacagugcagacaguggccgcuccuucccgggagaacccagcugggucacagccccagguccucggagaaacgggcagggaccugccauggccaacaccacccucggucacuggacaccugcuggguguggcccaggggcaccacggugucugcggggaagcagggcccauugcucaggcagcgaggaaggaccaggccccacaugagagcugccagggcgccgccuccccacggggugauugcugcugcagauggccgcuucucauguggucuccaggugacguguccacuccuccugucccaccugcaccaaauguggguuuucugaggcugggauagagcauguuccagugggcgugcagaccccucucuaccuaggaaagccuccugggaggcccuucugcgcuauuaggagaggucacuagcaacggccgugccagagcccacgcgucaucuuaaauuuucccaaagcaccaagaagccaaagcucugaaauuacuaauagaagauuuuggaggcugaggaucugggcuuggggacacucaugcgccucguauuuccugucucagcugcacacccccacuccaauggccaggccugucaggagacccaggccacauuuuugccaguuuuuccaggcaguggagcuguggaacagguaguuagaaaucagugucgcagaccugccagaggccacacgccuuccccgugccaguaaaucuccacaaaauuccacccauuuucucaaauauugucauuacuguuuuuaagcagugacuggcugggccgaccucauuccacguuggucuccugacacagcgaaucugccccgugaacaccuucccagcagcaccgagcaucuguccccaucgcucaaaacagagcccgugggcuuugcuuuaggggagaaauaaauggugaauccucguucaucauaaaagcugacacggggaaggcucgggcuucaacacugcacuucugagaguucuugcuccugggaaaacagacacagcccgacggcaaccaugugugcucucccagcugcaugggcugcgggaacaacggcguauguggaacuaggaaauucccugugcguuuaugcgcuuagcaguccagggaagugacggucauucgcccugaaauugugcugaaagaggagagggcuguugucuagguuccaaggcagacucauaaaaaauuaauccgugccuccugcaggccuccggcauuuggcagcagcggugccguggcgugugguuuuguggucagaccugcacuuuaguuuccaccccacggcguccuccccgugcgugggccucugcguggcuccuggggcggggccggagcggcugcuguuugagguucugcaauagcacagcuccugguggggccucggagcucugaucagauaacaaugugucccagcgacgucccuccccggcuuuccaguuuaacagcccugccuggcaggggacauggagaaccaggagcuccuguguguggcaaaccacuuaagaaagcguggaugaggcccugcguggaacagugcgugcugugguaaucuguccacgguauucacgggcucucaggaaccugcuccucacgguacugaacacuccccgagccccugccagcugaagguaccacacaaagugagaauuagucagaaccacuggcccgacgcgcauuuuaacaaccggaaaagaagagcugccucacgggaggcuccacuccuuggucuucagcugucaaguuucuuacaugacagaaaaaacgucuguuacggaucuguggaggcaaaguugaccuacaagcugggcaauggaaggagaggcccaccaaggccacugugggcaccagcgggcccgccccacccugcguccugagcuugggguauggccaggagcccucccuggggccagucuggccuccugacucugagucuucgccugacccgcccgccccucucacccgcgcggcugaggcaggaucccagaccacccgcccucaccucuuugcagacucaguuggcccuucuccuaacugacaauauuauaagcugcaaaccuaaaaugcuguuucagaacgggccgaggcuucucguuucacauuccagugaccuauuaauuauucacacgagcccggccucccgugugaugggugagaugcuaucgggcagguuauuuuggugacuugguaaacagaccugaguuauuugaccccugggucagaggucaggcuauaucccacagagguccacgugcccccgugggauggugggugccauggagguggaggccgagggccggggacgugcugcaaagacaucuucucaaggcccugggcccuucccggccaccuccgggagaguguagcugccacgagcaguggaggacgcaggccaaggacggguugacucaugugaggaacacaucuggcgagggggcugcaguccacggcaaagagagcaggagggaaggaaggaggcacaaccagaaacagagaggaggaaagcaaggcagagugaccagggcgggcacugcucacgccgcucagcuccuccucggacggagcggggagccggacuccaggucuccuccgggaccacagucccccagauggagaacacgcagguggaggaccagccuccaccuucacgcccagaaaggcaaugaguugcacgaaaaggccucaauggcugugcccgggugcuucuccacccucccuggccagagaaggggaagaacacugccugucucaccccagaccauccugaugccggcugccuacauaccgaggugagcagcgcugagggcagaggcugugugcggaugaggaggugagacaaggagaaaagccagcagccacccagagcacucgcgaacuccugguuccagcuccguugagagcagagcaggcccuccagggugaggagacuguguguacagagagacccucccccucaggcagagccugccgucagggcagaggguggagggcagaggguggcggcugcccgaggugccaccaucaggacacucagugugagcugggauuugggggaaagcugaggccagagggaaacauccgccacgcaucacuuucaugccucacuggaaaugcuggugagaagcagacagcaggcggacgcccccucagccuccccugcaaccagcggccuggcgaggucccggcaucggcagauccagaccggcccaccgagaacugguggccaaggugcuggagcaggggcaggaggagccggugacaagggggcugugugggcaggagcugaggcuggcugcgcugcuggucacucccugccuggccagaagccucugggaggcucugucugagucacuuguucuaccagggcaaggugaguccuaagcaggcgucuucaucuuugguuucccaggagcagugaggcccacgccagaccccucucuccacuauccccucacacgcacagggggcgggacuguccuuacccgcaggccccacccugcagagggggcgcacccaucaccauggccgaggucccgccagaccccgcagggaccacguccaccaggggcugccggccauccugaaccacccagacccccucgcagacggcuccagggccccgcucuuccaggcuaaaccacggcccuguugcuuugaugcugguguuuuuagcgccguggcagccguaauggggguggccucagggugcggacggugugaucauggcaauguggccagaagaauaggggcuggccugggguggucucuccccggcgugggaacaaugacauccccacagagacggcagggggcacgcucagugcucacuggagggggcuggccuccuucccucugaaggaaaggcccuaaaugggagaagccccggaugccggacccccucacgccccucagcgcccacagguacccggaugccggacccccucacgccccucagcacccacaaguaagagcgagcaccuauccagaggagcaaacacccuuuccuaacccagaguccaugcuccgaaugcuuccuggagagaaggugcugcguucugcucacgugcuucacuucccaacugcgaaacacauggggauggggaggacggagacagcgggcgugggaggacgcggacgccgggugcgggaggacggggauaccgggcgcgggggcacagcgugccccuggccgcgagagcugacacccacaucccccggccccccgccacccuccagggcucagcugcacugcaggagacagcgggcuuuaauuuucuggacaagcuuuuugagaugcagcggacagacgauucacaacgaagagaacagcauuucucaaaugcaggaaacucccgcgccaguuguucccaacggcucccaguggcucugaccagccgcccgcagcgcccacuacccacggccucguccucgcgcccccaggccagugcgaugagccucguuucugaaaagcgggaaaggggccgcgucaaaggauguacuaaaauaacccgacggcaccgagggcacgucugcgguuacgaggagcuuccacggcaacugagagcuuucuauucucguuuguuuuuaaauuaugcacaaauucuauuuuuauccaauuugugguccaccaacugaaagagaaaacuaacccccaaaacccccucuuuuuagcugcuuuuaccucacacuugcagagacagaaauccacucugccacagauacaucacaaaacucuuuaaauuacuaauuucuacaaaugagauaugcugacagcuccugacauucuccgugcaggggaccguuuucucccgcguuucaauggaaagggcuccuucuguggaaacgcagagccagccucucccgugucgcugcugcgcacacacgggccacuugauuuggaauaauuguugaggguacauuuuaaagauauuuuuaauuacuguuucaaguuuccugaguccuccagaacaccuggauccucucaguggcaucuguauugauagauuucugcacccucagcccaagacacccagauggcagaaccagagacgggauuccagaagauuccagaagacgcagggagaguacccaagcacugagcuguguccgcagagacgggcggcaccaggcaccggcgcuacucacaggcaggugaaaauacauccauuaaaacccagggcugccuguagucccagcuacucgggaggcugaggcaggagaaucacuugaacccaggagacagagguugcagugagcugagaucacaccacugcacuccagcccgggugagagcgagacuccgucucaaaaaaaaaaaaaaaacaaacaaaccaaaaaacaaaacaaacagaaaccucagagcucucuccacacucaugguccugcuuuacccuccaaguaacagccucgauuccuacacccgccccucauccagauacagugaaaagggcgacgucagugccccucaccgacauaauuuacagcaaauaggguggacugggccauuauuucucuauugcuuuauuuccacuccuccuuucacagccucguuucuuguccuaucuaauauccuucccacugagcaauaacaagcuuucggucaguaaaaaccgaggcagggauggggaggugcaggccugcagugacggagcguggugcagcgcugucugaccuuucccaccugggaggguggagacuuuaaaugucaaacgggccacugugcgcucaggugucucccgcauuuccuugcuucaagcaccaacgagggagguacuaauuggcaucaagcacacaggccacaaacaucacauuaacaucaucugcaagugcuggcgaaaacgccucaccccagcgcccugcccgcuaauucccugccgccggcugcugcguuggcaaacagccauuugucccugcggccaccuucucuccacuauuuaucuaaauggaagaaaauaaaaauacgaggcacucugcugaacaccccuuccggcuugcaucauucccuaaauaacggggcuggggcacccgguuuuuugcuguuggggugugcucggaaaacauccucugugcugccgcguagccuggagcccuggggcuggacacacuugcugcucuguggcugccaaagcagcagaucuagggccuggggccuauagcugacgagguaacagguggaacgaagaaaaugccaacacccacggcuacccgggauccacaucaacaccuggggugcagagggagcauggcucugugcagacgcugcccgucccuggcgcggucauuacaccccucccucgacagccuaacuccacguggcuuucccgcaaggugugaggaaggugaggaagccacaccacagcccgggggagucaggcccaccccagcagggacgcggcugcaggguugccaggcccaggccuaccccggcagggauguggcugccaggcccaggcccgcucuggaagccacuccuccucuccucggggagcaccuugagcccuggugccccccagcacccaagcccagaguaugggauccugcaagccugggugggccacagaaccugcauuucugagggucccccaccaggcgaggcuggugcugcuggugagaacuccugccuccaaguucagaggcuuuagagaggggagaaucaacccccaaaacauccacaccacaggcagcauccacggauacgagagcugcuucgggcaaaucugaaaacaacgagagagggccugcacguguggaagcaggaggagcuguggcaugcucccauuccagcucagaggcggugagcagccgcccgggacuaaccacgacagagcauucagcuggccuggcugggagagucuaagcacaguuagcuguggcuccaaaguuacuuuuugaccacaaaagcaccaagugacgugcgagucuggccgcagugccuaccugcacgaugggguguccuccggccgacgccuucacggccccccggcugcccuccgucucguagugggcucgguggugggacuugggcugcaccucaauccgaagcucauacgggccugagugggacggcagcugccaguccagggcgggcagggucgggcuggaagggaacagagcagaggaggcguucagcaccacacagaccucgcccgggccacacgugcccgugcucacccgucgccaucuuggguggacacuucaucggcgagugcacguccugacauggagauggagaagccugugucaaugcagugcuuacucaucgugaccuguggccacggcccggccaguucucuaagauggaaacauuuuccaagcacaaccuuaacacgcuucucuuccuucaugacaggcuucuaucaguuacuuaacccuccaguaagacagguuuuagaacucauugaaaaucuguuuuaaaaucuaagagggaugggcuguggccuaagaaccaggaagcucaaaccucuccucgcuaugaaccagcuguguggcugccaugagacaggugacugacugggcccuuuauaaaauaguggguuuggaaguugugaugugcgcagcgccgccagcccccaaauuccaugauugcugcaagacaaacagaaggcccugacugagggccaggaggagggacacggcguccauggagggcggugggagcaaacgcagcagggcgggguacgacggugagggcugugggaggcuguucgguuacuuugcacagagggacacgagcugcaugaccuggcgggugacaggugcuggggcuguccucagagccuacagcccagcugggggccccacggccccugucuuuucaggagaugaauguuuggugugaaaggcuaaggugagguccugcccgugcccucggcgugucuucccaacuguguucuguaggaggcccaggcagacugucucaacacuccugggggccacacggugcacccaagggguucuugcaucuaggggguggccugccccggugcaccaccauccacgcaggcaccaccuuccacccugugcaagaggccggcgccucugccaucagaguccguuucugggagggccaaggcucuguggccgcugcagccccggcccagccuccucucccgcucagucugucuccccagcacugccuacugcaggggccaaggcaggcggaggaugcggugggacccucccuggaccagcacugcucaucagaucaggugcaagacccugcgugggcagaggcaguccagggcccaacggcuguccucaccgcuauguggccagagacccagggcccgccgaccguccucaccuccgugugggcagagacccagggcccgccgacuguccucaccacacaggcucaccccgagcaccgugggccggggcuccugaggucacccuccacacagggccugugacucccccaucuucagaaccagccccucuggccaggacucaauuauugccuagagcugcugaccaucauucuacgucaguuuuaaguacaagccccagagacaugggacaugcggggcagcuucucgagaagggcagguuccaugcgaugcagucgcagagcaggggcaucugcaaguuaaaggaaacugccucccgagccccccgaaggcccccacaccucaggacacacugugaacccaaagugacuuaaaaacaaaacaagggccgggcaugguggcucacgccuguaaccccagcacucggggaggccgaggcggguggaucacaaggucaggagauugagaccauccuggccaacauggugaaacccugucucuacuaaaaauacaaaaauuagccgggcgugguggcggaggccuguagucccagcuacucgagaggcugagggaggagaauugcuuauaccgaagaggaggagguugcagugagccgagaucgcgccacugcacuccagccuuggcgacagagcgagacuccaucuaaaaaaaaacaacaaacaacaacaaaaacaaggccagucgcaguggcucaugccuguaaucccaaaacuuugggaggccaaggggaacagaucacuugagcucaggaguucgagaccagccugggcaacauggagagaccccaucucuacgaaacaaaaaauaaaaacaugagcaggacgugguggugcacaucugugaucccagccacacaggaggcugaguggggaggaucccagccacacaggaggcugagcggggaggaucgccugagccaggggagguugagauggcagugagccaagaucgcaugugcuucagccugggcgacagggcaagacucugucucaaaacaaacaaacuaaaaacgaugggcagaauagaagacucguuuaaagaggaaaaagcccaggaggcagcuugaauggaaucaacuacguaauuuuuaaaaauacaaacaccuaaaauguuccuuagcaagaacaagacuacauauuuugugacauuggaagcuucauaguaauuugaaaacucagaaauggauuuauccaaagaugcaccuggcaggcucaccacccaccuccgcucugugggguuuugggcccugcgggugccugcuggaccccaacucagccacgacagcuucccugacagaggaaucuccaagacgcagcuucaugggcuguacugucagagcuguuucccacgugaggugaucagcauggacacccaguaucagcuaacgcugccaggcagaaggaaaggcggcuggacccaggccuccacacaggaaggacaagagccuccagagaaagacuucucugcacagagcucgcggccagcugugaguuucuggggaagggagagggggcagcugcagggcugggcaaugaagggccccucugcaguggccacaccugcuccuggacaggcaggcaccaaacaaagucgcagaugaugcgaggcggugcccgucucaggcaccuugcaccuaucuuuugcuaugaauugaaaaagaaacaaaugaaaaacaaaauucauggccgggcgugguggcucaugccuguaaucccagcacuuugggaggccgaggcagacagaucaccugaggucaggagaccaagaccauccuggccaacagggugaaaccccgucuccacuaaaaauacaaaaauuagcugggcaugguggcgagugccuguaauccuagccacuugggagggugaagcaggagaauugcuugaaccugggaggcggaggcugcagugagccgaaauugcaccacugcaauccagccugggcaacagagugagacuccaucucaaaacaaacaaaccaaaaacaaaauucacagugaaaaaacugggcucacuggauucccaggaaaguuaagagacagagaagagacagcgagagagaggagagaggaggaaagaagaaaagaaaagccgccuccccccaccgcuggucugguuaaaggcagacacauuuccuaaagauaaggcagucuaaaccacucugcagcugacuauuacauaagaauaaguuuguguaaacgcagccacgugucacuuuaugacaaggacacauucugaaaaacgcguccuuaggccauuuugucgucgugggaacucgugugaaccgacucgguguguccagugcacacccuagccacguggcguggcccacggcuccccaguacacgucugcacggcauguggcugcacugaacaccgugggugacugccccacagcggucacaguuugugaaucuaaacacauuuaaacauggaaaagaugcaguaaaacuacgcucucacgaucucacgagaacccucauaggugaaguccgccguugacccgacgccgcggugcaggacugcauuuggcucuggaaucauuugcagauuuagugacacagugugugcauggcuuacagcaagaaugguuuacaaaauaaauaucauaauccagacaauuaagaugauugguuuugguuagaaauuuucagcaugaauuuggcagcucuacaaaucugugucucugguucagacaaaagagcccaaaugagcgggaaaggagccugcacugcugcggagacgggaccgcugcugccugcucuccaccccacuccacuccgcgugcuuccuucugggggacgacgccuggggcagccucgggcaggcgugcuucagucgggggucucugaccagcccaucccccggaacggcaacucgcuugcugaagcccuaagcucaggacugagauaauuccaacaacuucaaacucaucuucaacauaagucaauuuuuuaaaaaagugacacucaacacaacugaaaaaauaaaaaaaaaagcucgggugaaauuugcauccaacauccaccuggucuggauggugaccgacgaacguccacccggucuggacggugaccgacgcccacagagccaaaggguguuuuucucuguuucucucucucuccauuuuuuuuuuuuuuuuuuuugagacggagucccgcucuguggcccaggcuggagugcaguggagccaucucggcucacugcagccuccgccucccagguucaagcaaugcuccugccucagccuccagaguagcugggaguacaggugcccaccaccacaccggcuaauuuuuuguauuuuuaguagagacacaguuucaccauguuggccaggcuggucucgaacuccugaccucaggugauccgcccgcuucagccucccaaagugcugggauuacaggcgugagccacugugcccagcccacuggguguauuucuauaaacauuuuuacaaaaugauacaucuuaagaaaaugagacacauaauuugguacuuugucuuuucuuuuucucuuuuuauuucuuagaacaaggucucgcucugcugccuaggcuagagggugugaucacagcucacugcauucuccaacuccugggcucaagggauccucccaccucagccucccaaagugcugggguuacaggcacguaucaccauaccuggccuuuuuauaaaagaaagaucacauuuugagcauuuuagcuuauucagaaacaaucuaaucacagcaucccauuuaucacaaggaccauccucauuguacugcugggcugugggcuguuccccucuguuguuguaaacgcuggcaacgcaaacauccacacaaccaacucccagaccacaucuccggucaugcccugagcgcagaaccacuggucagaggcgugagcaucgugaggcucccuggaggcaccacaaaggccacugccaauggguccggcucacccacuaggguccggggugcgcuuggucuuugccaaugugauauaucaaggcaguuuucuggccugcuguuugcaucuuuacacgauaguuaaaaacaccagugcaagacugaaaacaacacauuauauacaaauaauaaaaacaaacacuucuaaaccagcagcgguaaaacuucuacaacauccccuugauuuauuuccuguuucucacuaaagacaccacagggccuggcugaccuuccagccugcccaccggcccgaggccggcccccgcaccgcacagaagccagacguccaggcccccccaacccaccgcacagaggccagcuguccaggccccccgacccacugcauagaggccagucauccagcgccugcccccacugcacagaggccagucauccagccuccccgacuacauagaggccagccguccagcacccccccgccacccacugcacagaggccagcuguccagcccugccaccacacagaggccagcugucuagccaccccccuccccgacucacugcacagaggccagccguccagcucccccuacacccaccccacagaggccagccauccagcuccccccgaccccugcacagagggcaguuguccagcccccucacugcacaaagaccagccguccagcacccccccacccacugcacagaggccagccguccagcacccccccaaccccacccacugcacagaggccagccauccagcccccacaccacacagaggccagccguccagccuccaccgcacagaggccagcuguccagcucucccccacccgcugcacagaggccagccauccagcuccccccgacccacugcacagaggccagccguccagcuccccccacccacugcacagaggccagccguccagcuucccccgacccaccgcacagaggccagugguacagcccccacccaccgcacagaggccagccguccagcucccccccacccaccgcacagaggccagccauccagcuccccccaacccacugcacagaggccagccguacagcacccacugccacaccaaggccagcuguccagggaaguucacuguugcacaugcuggcaaauugggcauauacuggucccccuucccuggguccauuccacacaguccauaaaguaaaaccuugugauuucacagacaaugggacgugggucuugaaaacuuuacgugaaggacaacgucacggcauggcacagagacaucggacacguggguacacgaagggcugcagccccgggccccccugccaagacgcacuuaaccuaagaacccgggacaugcucccuccucaauggccacagccgcacccagagcccagcucauguggccacagcuucugccguggcugcugcagacauggagcccccaccauucccaacccaugccggcaggcuucaagccaaggaccuguuuauccugagcuccugcagagcuucccugaugagucuggagaguuaagaagguccuaggcaaaaugcaaggcgcucccggcaggauccuccuccuggggccuggggccagggcaugguggcugcuauggggcagccccgggggccggguggggcauugccuccccccagcuucccgcgaaucugcaguggcugcagaaucaaguuuaaaaaugcuucucacugagccagaugcaaccuccacacccgcagcaacacccagagaggcugcagcugagucacagggggguccgggcuucccgccccggcaacacuccccaggacuccuguguuugccgccccucuggggguccggggacggugcucccauggagguggacaccagggggcccagaacugccgagugugagcccacaggucaaauggaaacaccugccaggcccugcgagucccgacacgggucccacagcaguguggcucguggcucagguccugcuguccucacgcugcgguggaagcggcaugggacguggcauggaggacaguggcccccguggccuggggagccggccacacaguccuuuccacgggaggagccguucaugccccugaaccugugucucccucgccugggaagggcgugagggauuuuuuuucagccgaaagcucgcgacagagaugccgucugcgcugggacagagggggaggaaaaaaaaaaaaagacauauccugaaaugaucacugucugauucucaaucgcaggauuaucgaauucuuuuuucugagacagggucucgcucugucacccaggcuagagugcaguggccucacgggauccucccaccucagccucccgagcagcugggaccacaggcgcaccaccacaccuggcuaauuguuauauuuuguguagagauggggucucuccauguugcccagggcggucucaaacuccugggcuccagcgauccuggugccucggccucccaaagcgcugggauuccaggugugagcugccacgcuggugcaggacucauuuaucgugguuuaucuguguuuaaaagucuucuacagugaacgguguuuguuauuuguacaaccaaaaaaaugagaaacuuugcucugcucucaggucuugugucucaaccucugcccagcuccucccccgcccaccuggugaaugggcuucaguuuccaaagagcugagccugaggcccugccaugucccucucccuuagaaaggccacguccccagcaucugaaaacacucuccucaugagucgccccgacuccgccggugaacgaugagaaucccggaaucgcgcccucggcagcagaagcccagagcagaggcaguuccuuuguuuaagugguuuggguaaaauccuuuaauucugauuuuccgaggguuaaagcccgcacgugcucauugcuuaggugaaaaccgugaaggcugcucaugacuccugcaguuuccagacagacgaagcgacagacucugaacucggcagggccacacccgcccacaggacuccacaggagcagcuucaggagggcgaggguuucaggguccucccgcagcccuccucagccggcagccgcgggccucauggccauuugguugugugacggcuuuucccuuaguuaaaagagaaagagaguaagaaagaaagacagacagagagagagacagagacagggagagaaacagagagacagagacagggagagaaacagagagacagagacagggagagaaacagagagacagagacagagagacagauggagagacagagacggagagagacacagagaggcagagacagagagagacagagcgacagagacagagagauggagagacagagauggagagacagagagagaaacagagagagaaacagagacggagagagagauggagagagauggagacagagagagagacagacacagagauagacacagagagacagagagacagagacggagagacagacacagagaggcagagacagagagagacacagagagacagagcgacagagaaauggagaaacagagauggagaaagagacagagauggagagacagagagagacagagaaacagagacagagauggagagagacagagagacagagacagacagacacagagagucagagacagagagacagagagagacagagaaacagagacagggacagacacagacagagacggagagagacagagacagacacagagaaacacagagagacagagacagggacagagacagagauggagagacagagacggaaagagagacagagagacagacggagagacagagagacagacggagagacagagagagacagagaaagagauggagagacagagacagagagagacagagacagagagagagacagggagacagagauggagagacagacagagacggagagagacagagauggagagacaaagagagagagagacgaucagcgcauuucuccgacgugaggcagccucugggucuucugggcuugugugucuggagcugccccaagaccacacaguggccagcggucagaggcuccucggaggccagcuuugcccccugaccugugccggcagaacucggcccugagaaaguuuugcccgcccaggagaggucggccuuccuggagggcagcccggagcccggccuaaagaggccaggugggcccgcacacgccgcguuucucggugauagugcggcggcaucugugcgucacccccgacaugauucccgaccucuggcugggccuggccgcuggacgcagccuucacccucccacagccugccccagggaugaccccacagaccacgugguuuucuuccacgacccaagacaaggccuuucacaaaauccugcccagcaggccggggaguggagggagggcucggcggcccgggcaaccuuaggauuucaggagucagaggggggccugggaccacugcugucccacccuggagggucacccagaggccccgggcuacuguccaaugggcuggcucccguccaacccucccugaagccaaggccgccugacucugaggcugcgggcagggccuccucuccacgugggacccaagcucugugcccaugggagggaaggcggcccagaggagggcacgggccucacaagccagcaggaaagauggaaucgguggaugagaagcaggugacuggggccagggugggaacagaaagauggggacacccagcccggcccuccugcccgccgggugaggcucaggaugcaggggcagccccugcagccaucugugccuuggccucuugucccaggcagucccagguccagccccuuccaccaggacaguggugcaggcaccagcggcccauggccuacccacaguucccaggaccgauguggccacgggcaaugacccuggggcaggaucugcuguccccaucuguccuccccaaggcugggcaaguggaucccggguccgcaugggagggagcccaggacgccgccuuugggaagaagguggacagccgggugcaugggcagccuccguccccagacagggagugccacagcugcggcccugccagccagguaagcccagcccaggaacucaaaccaaagucaaagccacagaccgggagcgcgcgggaucugggcugugaggccggagugcagagguuuuguuuuaaaggacacauuuggggauuucauaaaaacugauggcgucccguggcuccaccacacgggauuggaguacgaccaggacacagacccuucccuguucuuuggaaaaaucgaagucauccccucuguacgcgccccaacccucccagguccaccccuguaucucgugagccucacaacagcuuuggacacaggcccugccaucccaggcccagcagcccccaacacuguccccaccccucuaucugcccugcccugccccggaugggugagaagcugagcucaagacccugaacccccgcccccgaggcagcccccagcccucgcccagagccgacagcucccuguaggccuccucccaaauguuaacgugugggccagagcacgcuuucuacaaagcccccgaugucagccuuucucccucccagaaaaacuacagaugggagaaagcaccuuccauggcucugaaacauuccuugcagcucaagggugggagagggugcuugggaagcaaaaggagcccguugggaacccaagcucagugggaaccgggccucccugugggaucucagugccccugggcagugggaacagggccucgcugugggaucccagcgccccaggcagcaggccccaugccguacacccucccucucccucacuccccugcccuccgggacaguagcugcugcagccgggggccgcugcaucuucucguggcuggagagcaacagugugguccggagggcggggaagugccccaggcccccaccacccccgucacccacucauccccaaguucacaccagggacagguuccagucacugcacacgcggacucuucucggaccccaaacaccuucucagacgucuccagggucagggcccaucugucauuauuacucacaggaaguuuuggcaguggggggccuccgacugcacuugccauggauggcuuauaaaacaaaaaccaaaaccagaaaugucauauugcacaaguuaaugugggguggggcacagaucagucauggaacugauuccguuucuaguggugccaagacggcccggcucagcucucagaguucacucaaucuucucagcuuggaccuacgggaaacuuggggguuucacaagaacugacggcauucuggauguucacugaagagcagccuaggugauucacggguaauacuuggagcuacaacaaauacagcgguuucucaaaucaccuaaagggaucuuucaaaauaaggauguguuacucuccaaagacuccuguccuggauguugccaaaacaaaggaugcucagacucugacgccuggagcuacagagcacccuuggcccucggggucggagaagacccagcaccaagacgugcccaagcuuccagcuucgcgcucagcugugaugucgccacggggacaggacacagcccaugguggcggcacugccaagagcugcugcuucagcccaguaaacacagaguugcuucacagcccucuccuggucucugugccugcaacgcagcuuguggacagggacuccgccuugcagcugacuccuggaggccgcugggccacguggaccucagagcccaaagugcuccaauaccugccccgcaccuguccagaaccgaaaccuggaggcuugacagcuucuuaccagaaguuuccacgugucuccauuuccucauccacaaaaagaggcugaucccugcucuccaccuccacaggcccgacacugcacucccagaccccugggguggcccuugcccggcaccgccccuugcagccagggcuccaggcgaaagcagacgucauccaggcgcuacugccccacggacggcccggucucuggaaacacacucgaccugucugcccgugggaggaggacgggcauuuccucgugauuccaggucugugccacaugucaucuuggugucagggaacccucgaguucugggaacaguggccugugcagagggagaggagcuggggugccccacaagccucagaacugccgugaugggggucagaggggacaaaggcacaauacugauuuugcacaccaacaucagaacacguuccugacacacaucacggcuuccagcguagaagugugugugggcuccauguuuccagugagaaaacacuccucccauaaacuagaaccucuggcccugaggagcagaaucaagcugcagguggguucggggguuccuggaauaugacuccacgcggggcaaagcaaacaucuagguggcccugcuggaggggccucccucuuccccucuucagcgacgucuccuggaaaugcgucccacccucuuccucucugcagcaacgucgccuggaaaagcaucuuccucuuccucucugcagcaaugucaccuggaaacgcauccgccucuuccccucugcagcgacgucaccuggaaacgcguuccccucuugcccucugcaacgacaucgccuggaaacgcguccuccucuuccucucugcagcaacgucgccuggaaacacguccuccucuuccucucugcagccaugcugccuggaaaugcgacccccucuuccucucugcagcgaccuugccuggaaacgcauccaccucuuccccucugcagcgacgucucccggaaacgcaucccccucuuccugucuguagcgaugucaccuggaaacgcaucccccucuuccucuuugcagugaccucgccuggaaaugcgucugccucuuccucucugcagcgaagucaccuggaaaggcgucccccucuuccucucugcagcgaagucaccuggaaaggcgucccccucuuccccucugcagcgaccucgccuggaaacgcgacccuccuuccucucugcagcgacgucaccuggaaacgugucccccucuuccucucugcagcgacgucgccuggaaacgcgucccccucuuccucucugcagcgacgucgccuggaaacgugucccccucuuccucucugcagcgacgucaccuggaaacgcgucccccucuuccucucugcagcgacgucgccuggaaacacgucccccucuuccccucugcagcaaccucgccuggaaacacaucugucgcacagcccagugcugauggaacgcagcaugcaggccacauggucucacaugggaaaccuugggaggugcacacggcguccgguguggccuuuacaacuacugucucuccccaaagccgacuaagcccugugcgucuaacccagcuuccagagauguucuagaagcacuuauaaaaaagaaaaucccaucauaauguagaaaacauuuugcucaagaauccaaaaaacguuaauuugcacuuaagaucugguuuugaaugugaauaacuguugcccuccaacucccgacucagguuuaaucccgagggaggaagucccugcggcugcccggcugccgaagcaccuaccaccaggcccaccuaucccgcugcucaaaagccaacguuggcgcaggagcaaauccuguuuugucuguggucaccgacgcacaucaggaccagacacuuccucccagcuggaccacaggcagcuuaggaaaucucaaaauugggaaccugggaagguuuccagcucccugccgcccucacgcugucuccacgggggcaucugagcuaaccaggcagguucugacccuccuaggggggcucccgggcaggcaggugccggcccuccuaggggggcucccgggcaggcaggugccggcccuccuaggggggcucccgggcaggcaggugccggcccuccuaggggggcucccgggcagguucugacccuccuagggggcucccgggcagguucugacccuccuaggggggcucccgggcacucggucuucggugagauggggcaacauuucagaucuccaugaucugacuguaaaacucuggcucacaccugcaaugccagcacuuugagaggacaggucgggaggacugcuucaggccaggaguuccagaucagcccuggacaacacggcaagacucugucuccacaaaacuuaaacaauuagccagguguggugccgcacgucuguggucccagcuacucggcaggcugaggugggagggucaccugagcccaggaggucgaggcugcaguaagcugugaugacacccugcacuccagccuggacaacagagcaagacccuggcucaaaaaaaaauaucugagcaaaaagccacguuguuuucuccuuuccaggaacagagugccuucuccuccucauggcuaacaacagacauggacagaguaacauugagaaggaccagggagaagaugccccagcccuuccacacacgccugggagaacgcacaggcccucggccuccgcagccuccucacacccucacaccaguccuucccaucagaaacugguguugcaaaccccgcccuccaagugucagcugugaacuccauaacagcagaaacaaacuaaacaacgcaggcagaaaaccgugggcugccaaaugcuaccgaagcggcucaagaaggagcaaaugagccaagaccagggugcucgugcaaucaggaggcaugaucuucucaacucugagccccucaccagcggaggcuggcagacgcagugccuucuccagggagcuguggcuccaaggacaccacaggcugcguaaagccccucgacugggcucugaccccagaaggcuccacaucuuggugacgagagcagaaggccagucugggccgaggguccccgugacacgugcccccaccccguacaggccuugugacaagagggcugagcucgccaggucuccugggagucggggucccagcaccgguggagucuggaguguagguugcggggucugcucaucauggcagaguccaguucuguugguugugacuaggccacccuggacaaauggccucagcugcguccacagucggguggccguuaagcgccugacugugacccgacagcucccuaccacagagcgucgcaaggcaugguggggcagcacgcggauucuuccugccaucacacaacgaaacugcuggcucccccgacccccacagucuccaucaacaccccgagcccugcagacccacaggaaggggaggaagaaggcagggugcugggggcuccacccaccccaugguggcagggaccaaggacagauuccaacaucgcaaugaaacuugguaggcagcuccugaauaggacgcauccacagcaccacagaggacaggcccagccauagcccaucucccgccacagcccaucuccugguauagcccaucucccaucucccaccacagcccaucucccaucucccaccacagcccaucuccugcccagcccaucucccaucucccaccacagccgaucucccaucucccaccacagcccaucucccaucucccaccacagcccaucucccaccacagcccaucucccaucucccaccacagcccaucucccaccacagcccaucucccaucucccaccacagcccaucucccaucucccaccacagcccaucuccugcccagcccaucucccaucucccaccacagccgaucucccaucucccaccacagcccaucucccaucucccaccacagcccaucucccaccacagcccaucucccaucucccaccacagcccaucucccaccacagcccaucucccaucucccaccacagcccaucuccugcccagcccaucucccaucucccaccacagccgaucucccaucucccaccacagcccaucucccaucucccaccacagcccaucucccaucucccaccacagcccaucucccaccacagcccaucucccaucucccaccacagcccaucuccugcccagcccaucucccaucucccaccacagccgaucucccaucucccaccacagcccaucucccaucucccaccacagcccaucucccaccacagcccaucucccaucucccaccacagcccaucucccaccacagcccaucucccaucucccaccacagcccaucucccaucucccaccacagcccaucucccgccacagcccaucucccgccacagcccaucucccgccacagcccaucucccaccauagcccaucucccaucucccaccacagcugagggcuuccuggggaccgucuggcuugcgcgagucaccugcuggccugcucagccaaacgcaagcuccagagccaccaccgcgaaugccagggaggcacacagccacguucuucaagacccuucagagccagcccagcccaguacccacaggagggacuggagacuccccagggccugacacccaugccgggagccaggaggccagcugaggcuugucuagcuccagaaacagcaggaaacagcaggacagguugugcgggggacuccccagcaaggguuagcgggaaccagagccagggcgacguggcuucgaggcuggcuguggguuguuggggggcuucccuccccagaaagggaggggcuuacagggagacgcaguggcagucaguccugagccguuccagcccaugccaguguuuuacaaaccauggggcaacucgacacccucggcuucuuugcuauccgucuucccaggaggugauggcagcgggaagcucggggaagaccccacggcuaccaccuuacacgucucgcuaugcugggguucgguacaacgccuuagagacuauguucaccaucaccccaaagggcccaccagcgcccgcggacagucuggcuccagagcccagagauggccccacuacaggaccugggagcugucaaaagccugcacuguucccccaacacugccggggcccgaaccccucagguaccagagccacaagagcaaagggcauucaaacgcaggaggaaucgcuacugagccuggcagaggacucgugucugcgaaagagaagacagaguccaccuguuacugugcuggggguuagcugaucuuauuccaaauugugauaaacugugaaacuuucagauaacuuaugaaacacaagagagugaacguuuucucagaccuuuugaaacuaauacuaugcauagcagaaaagugaccgauaugcuaaaaucuucaauauugcagcccaaaacuuaaugucugaaauaaacaggguuuuuuuguuuguuuggagacggagucucgcuccucucgcccaggcuggagugcaguggcacgaccucagcucacugcaaccuccgccuccuggguucaaaugauucgccugccucagccuucugaguagcugggauuacaggcgcccgccaccaugcccagcuaauuuguguacuuuuaauagagaugggguuucgccaauuuggccaggcuggucuugaacuccugaccucagcugauccaccugccucggccucccaaagugcugggauuacaggcgugagccacugcgccuggccaagagauuugaauauacguuauugcaccaaccuagcggcuauuucugaucauugaaaccaagcggacucuaaguaaacauuguuuauuagccuaucucgccccuuaggaauucuuuuucuuuaccucacuccuuagaaauucuuuuuaaacauucaguucuaagaggcaauguuucauguguagaaauugaauucaagggcugggcgcgguggcucaugccuguaaucccagcacuuugggaggccgaggcggguggaucacgaggucaggagaucgagaccauccuggcuaacauggugaaaccccaucucuacuaaaaauacaaaaaaauagccgggcgcgguggugggcgccuguaggcccagcuacuugggaggcugagucaggagaauggcgugaacccaggaggcaaagcuugcagugagccgagauugugccacugcacuccagucugggugacagagcgagacuccaucucaaaaaaaauaaauaaauaaaauaaaaagaaauugaauucaagaauugugcuguuaaaguuaccaauaaauucagucaaaauaccuccgccuuuccaauuccccuacaaccuugccucuacaaaggcaacuccagagacugucugggugcggagagugagacacguggagacucugacagggacacuuuccagaggcugaugcccaaagagcagaugucggcacagacagaccuggacauggacgcacauggccuguggcaggugcccagguggaggaggccgaacgaugaaggaaugaggaagcaaucacguagacuuuaguuccugucggucaauaugaaaucuuuaaaagcuaccauuugagaaccacuauuuauaaauaacccgcacagccuucaacgugcacucucgcccuggccuccuccagacgcagcccggcaacgccuccuguugcacccucaacagcacacggaaaggugcccugggaggccacuugcuaugaucaccgucauuaccccuggaaagaagcaaggcgggaagaaaaccacuccuuucugaugccagaauucacagcuuaagauucuaauuuuuaggggguauagcagguggccugugauuccugugccaguccccccaagcuuugacaauagacacaucauuccgcugagcucuaaaauggcuccaaacucuaaaacuaucaagguucuaucaccuacucuuacuaacuucacaaacauuaucauggcuucaauugcagcaagaauucaguaucguucuuugaccauugugggccucucagaggcucugcauagcacugggggccacaggugcugaacaagcaacaaaaggccucaaaggacaacaauccuagacggucccugggaaggaugcacacagcacacuuuccaccagaaagcuccuucuggcauagggacaggauuaauggagcagcaguucuguaccacgguggggagaagaugggcaugucgugcauucuccaucccaaacuuuggagaucauuaaaaauacagcuuucuaguugugcagccugagauccuggugacauuuuccacgccugccagagcugcugcaugugaccgacggagaggcauuccuggggaaggaagucuggccucuccaccucgcugguaaaaaacuaacauuucaucucugccguggcuuccagcugccccagggcacccgcugacgaggucacuuggaaacagggcacaaggaaccaggaaacauauuuugauguggaaccagaacagugggaaaagguuaacugcaaaccccaggagcgaguuugggacauauuuacugagcuuuguuugugugaacacucagaaauguuacaggcaucacaccuaacugggcgcucugcagccaggagauaaagcuaacagggucacgugggcacggaauucuuccugaaacccccaagcagaggaaaaaauaaacagccacccaugcuuuccaaccuccacaccaaacacagguccaagguggacaggaggggcugugccugccagaacacgacaucccugcggacaccuugccgcccaggagacgaagaaggaaccaggacgagcuugcgcuuucaaaggcugccugccauuuuuacugcgacaguaagaccggggcugaggcagccgaacggugcuccccgcaaacucacauaauggaguccugcccagcguggggcugugucuggagagagggucuuuacagagcgaucaaguucaaaugaggccaccaggguggccccaacccagcaggaccaguguccucacaaaaggggacaucuggacacagacaugcacgguggauggagagaugaggagucauggggagaagacggcgccuccaagccagggagacaggucaggcagaugcucccucacagccuccaaaagaacagccccugaucucggcuuccagucucaggaccccgcgagaaaaccuuccugcuaugaaggccacccgucugcgggaccuugucagggcagccccaggaaacaaauacgugggguucacccaaagguucacaacugcauuacgacacuccucaugccaagucccagucuugggaccuugaugacaucacucuucccuuaucucgccaguucagugaaguuccgcggugauggacgacuuugucaccguccguaagccuggagaccaugaagcgcguuguacaugacugugggcuggagagucagugccacuacgcuuguacuuuuacuuaaacaauaacagugauaguacagcaggcaaaaacaguucuuaaauuuucccaaugccuccaacugaaugggauuuuuauuguaaauacaauccggguccugacacaggcucguugugaucaccuagaauacgccagccuuuuaaaccuuaauguauuaaaaacagaaguugggauagaaagguaaaugcgcccacugcaagucaagaaaaaucagggguaauccuugcuuucucucgaaaccucagcugacgacgauucuaaguaucacgccaguagaaaggcagaaucagccauggggcugcucaaagaacugucagcucuaacacuguuucuuugccacaagccuucagagagguuuggguggguucguucccagccuggaggcuuguuacugcuuguagcucuaauucuguccaugcgugcuccagccauggcugaagcauggccugagacugcagagcagagacggguccucccagagcacccucacugccugccuuccucacccugcaggcaugggggcugcaccugcccuccgcucugcggggucucgcccccugagugcucgcuaauaaaaaaggagugggggguggggagggacgaaaaaaaaaaaaaaacaaaaacaggaaaacacccagccuggaauaccccgggcugcgcguggcaaacgccucuuccugaggacacagcggcagcccugacgucacgggccauggggcacugcccucgaccuccugcacggacguuuucaugccucagauaaaaaucccagagcagaaagcacucucaggggccacucacagcccaccagcugggaaagcuguuucguuagagauaaaaacaccaagcugguuaaguggacccagcggaauuccagcagccccucacacgguuaaaaagaaaaaccaacaaccugggacccaaagaaggaaggcgcgugagcucccccagccugaugccacagccggcgucucuggggagcaggaggccgugcuguuccaaagcguggcggacugggugcucuggggcacuguugagcugcggucccaucugcacccgaggcagggaaggcaauuacugcaggggaggaagcgggagcagcaggcaaccaccgaggggggccaggcacgugcaauuccccgaggaagaaacugcgcgugugugagcccuccuuaggggcggauggcgucucccggaauucccacguggaagcccugaccgccagcagggccacccucuuugaaauggguguuugcagagacugagcgaacacgaggccaucagcagggcccgagaggaucuggagacuucagaugggaaacgcgcagacggaggcagaggcgaggcgcacaaggaaaagucugcaugaggaggcagacauggggacagacucugccucccagcuccacgaggagcccaccugcccacccagguccugacucucguccccagacacggccgccccgcgccgccccccgucccgcuccccgcguuccgccccgccccgcgccuccccucgccuccccgucccgccccgcgcugccggcucaccucauguaggacguaggggacaggggcuugggcuucgcccacugguaggggugcugcggcaccgccagguacuggucgcagaagccgcccuuccugaugugcuggaaagaggaguagucuucgggcgcgaagucggccgggggcggggggcugcccagguccuccccgacgggcuccaccuugagcgccacugagggcggcugcuccaggguggucuugcgggacuugacagggacgccaucucccagguccaggcugcugucgguggucagcgcguugauggcggccacgauggccgagcugguguacugggugguguugcccaaccacgagucgucggucacgcugacccgcggggagccgugcggggacggcgugggcgagugguggggugaguagggcggcugccggccguugaggcuguacuuccucuuguugcaaggggacgcgggucuggaggagcgggcacccagccagcucuccucagugacgcuggcgcggggcgagguggagggggagugccgcggggaacccagcagugugcaggcccccagcccgcggggaaagcccuccucgggguccguggucuugggagacacgcagggagacugccauggcgacgucuggggggacgcguacggguacgaguaguuggacucguaggaggaggccucugaguugcagcuccgggaggacaggcugcuggccgggcucaggcacgaggggucucuguaggccuccaggcugggcagacucagcguggccguggagggggaccguuuggagcuagggaggacgucuuccaccuccacaucguggaaaaacugguuauuguugugguacaggcccaagcacgagguuaucucgaugcgaggacucuccagggcaggggccccaucaggccugguguggccggaggagaggaaguagcccgcgggcccaccguccaaagcugcuccguaccccgaggggugauccgccggcgggaugaugcccgguguggaggucugaagguuguggcacggggccggcaggguggagugcgccguggggagcggcagggcggggcugacguuggaggaugcauagccauaguguucuagagagaaaaagaagcagaugggagcaugaggggcugggcaucacaaagcagaaacccaugaacucagggccggccagcaacccccggccucgaccaacggaccccaaggagcgggccucagcaaacgucccugagaccacgcugccggacagcuccgggcgacuuggagugacagccccagucccaccuggccaacaaggcucccgugagccccucacugcccaccuccccuccuccccuaacagcagcacaagcccccgaacguccuucccagggagaggcggccggguccucacggguuccgcucuucauucaaaaaccaccuuccccaaccaccccaucuucauccgaacguccuucccagagagaggcgacuggguccucacggguuccgcucuucauucaaaaaccaccuuccucaaccaccccaucuucauuuaaaccccaaacucaacacgugggccauccuucucuaguuuauuuuuucuccuaaauacguaucacaaucuaacagccuguuuuuacucauucaucccacacugucaucucuuugacaaacagaaaccuaaguuccaugaagacagaacaucuggacgccuuagucuauucugcucaccgcuguuuucagagccaaagacugugccuggcacauaaaauguguucaauuuguuuaauggauggaugguugguggguggguggacaauggaugauggauagacagguaaagaaacugauggauggaucaugauggacggggggugaagggaugauggguagauggagaguagguagauggauggugauggacaaacaagggaggaaugagggauaaagagauggauuauggguggguggaugaauggauggaugauggauggauggacagcuaaacggauggauggaugaaugaugcauuggggauggaggcaugauagguaaaugguggaugaauggauggauagauaaauggauggugauggauggauggauggacgaggaauggaggaauaauggauggaugauggauggauggaugaaugaugauggauggauggauggauggaugaaugaauggauagggaauggaggaauggauggaugauggauagauaaugauggauggaugauagauggauggauagggaauggaggaauaauggauggaugauggaugauggaugaauggauggauagggaauggaggaacaaugguuugaugauggauggaugaugauggauagauggaugacggauggauggauagggaauggaggaauaaugguuugauggauggauggaugaugauggauggauggaugaugaaugaauggauagggaauggaggaauaauggauggaugaugauggauggaugauggauggacggauggauagggaauggaggaauaaugguuugaugauggauggaugaugauggauggauggaugaugaaugaauggauagggaauggaggaauaauggauggaugaugauggauggaugauggauggauggauagggaauggaggaauaaugguuugaugauggauggauggaugauggauggauggaugaugaaugaauggauagggaauggaggaauaauggacagaugaugaugcauggaugcauagggaauggaggaguaaugguuugaugauggauggaugaugauggaugguggauguguuuuagaucuaaggaccuacauauguaaacagauuuuaacaggcuuaucacugucaaggugcccuaaucaccagcuacaaagaaaacuccucaaggauuggaugaaaacacagacugugaaaucccccucauggagauucugauacuggcucauauccuacgaauccaucuuuuagaacaaaacagaagauucugguacacagcuaguccuaagaaucauuauguguuaauuacacucaauaaaauauuuuuuaaaaucauuauuagggaaaucaguaauuuuaacaggaaagacgugccucuggauuucugauuugaaaagacuuuuuaugacaucuuggaaccucaugauuacaugccuagagguggguauucccaggccucuaaauaauacaaacaagcacauggaaauucuauauucaucuccuggugcaacugcacuggcuggaagauacuuuauucaaggacagugcugucuuuccgcuaagucgugguucagaaaccaacacggauaaaugccaaaaaaaucuagggucucaaaauaccaauacaaacccacuguauuuacuaacagaaaugguucuagcgccccagguaggugggaaacacggcacggcagccugguaagaggacacaccguggccucaaucccaggagucacagcugcuuucuggaaauuccagacacucagggggcagagccauaacaaagagaaaagaaacagagcugcgauggagccacaccucacaggugcgaccagaagcucucaggggugggaggugagaccugcucaggaugucuucguaugggaagggccccuccgcugaggcugagcgccuuggggauggugcuagccaggccccagucccgccuuccccaucguaaagaaaugcccucaagaggacgggagccacgcagucuccugcaccggagagagaacaguaaugucaauaaaucaaggagguggccaggcgcgguggcucacgccuauaaucccagcacuuugggaggccgaggugggcggaucaucugaggucagaaguucaagaccaaucugggcaacaugaugaaacccuaucucuacaaaaaauacaaguagccaggcaugguggcgcacgccuguagucccagcuacuugggaggcugaggcagcaggauugcuugagcccaggaggcagagguugcagugagcugagaucacuccagccugcacuccagccugggcgacacagcaagacccugucaaaucaauaaaucaauaaaucaauaaggaggucuuucuuuccccagagccacaggcagggacugggguggagcuggagcugggcauccugacgccaauuccagccuccagccuggccucuggucaggacacacacaccauccccaggaucugccccagcugcaagacgccagcucugggacugaccacccauguucacuggcauccacugugccccccgcccccaggcuccaugcucacuggaugcuucaggcaaacaccaggccccaacgcuaaaacuucugugaccaacuuucuaaaaaugagccuggaaagcagcuuccgggagaaggugagguuuccgaggagaaucugaaguccucugaucugcuggugauaccuggggggcucugggccaggcaaacuguagcccucugagagcuccgccugggcgucacgguggccccuccguggcccgugcaaagccccugagccggcugcaucagacccgcuggacaacaggccacacaggcaggucgcccugugccccacgccccacacgccugggugaccgugccaggccagcccugacgucugccccgcauggagcgcugcggaagacccgcggagccguggcuggcucugcggcugggggucucgggggaagcacagggacgcaguccaacgguggacagaaggaaggcgcggugggggacccacgaggggguuuugucgagcgcaggccugcggcuccugggggguucccguugaggugccacgccgagccaccuguucauuacucugcauucucaccaaaaguuguccaaaagauauuccuuagccaaaaacgccacauuacauacaccggcccaggaacucacacccacacuuacugcugggcccgcuuauuugucuagaagcccucucgccuguuggagcagaaacaacauuauguuaggaaccagcuuccaucucacaccagucaucaacuccaggagacccgaaagcacagcagcggaacugagggaacacgauggcagcguggauccgaucacgggggcccagccucccucccacaccccgacuuccucucggaggcauccguggccuucaaccggcucuucaggccccaccugcuccacacacuuccccucacuguccagaccucaaagggggcuuaacugcaauugauucauguacagauuccuacacuuccuguuucccaaucaaaagaguauuuauuuccaagacagcugaucccacagcugaacuaccauuugcugguagaaagguaauucugaagaauuuuuuaaaacccuagcaauuaacagagcaagucuuggggccuccccaccauccucccacaggacucagcccugaacuggcugcucagccagugacggagcccagagcugcgccacacgggguacuagagccagaucaccggaagguucuagaugaaacggggcaggaaaggggaggcggaccucacaggucucugugugcaaguccucaggggccguagcccuugacguuucugugacgggggcccaggcgugaggggaagugaggaagaggaggagacuccgcccacagcgagagcaggaagugcaugcagaggcccacggacgccuggggcacccgagggccuuuauuuaaacugaaguauugcaauaaaaccugauucgaugaggcaaagaaacaccauaaagcuuuauuaaaaaacaaaaagggcucaccuaagcaugcguuuucccugaucaaacaaaugacaaaacgaaagcucaaaugcuugaauuucauuaggaucccucgcccagguccuuggagggcggguaguggauaaaguucccuuguuccuccuagaagaagggcaagguguggggucaagcugcccccagaggccaagccccacacgccgggggccacuguccuggcugugagccccucccucccagcucccaaugaauuugguuucaugacccaccuaaaccguauucaaaucugaguuauuuaacuauucaaagggaucauauuuacaugaagggaaaauauucccaguaacuuucuugacgauucugaggcgcuugggcugauucaugucacgucagacaccaccacagagcucggugaccccacucccuggcugccgugucggagggccuggcucuuugccaaggaggauucacuaaaugacagugcaggugagcagggagacagcuggauucuaagcaaugaucgcggagagcacauucaaaaucccuuaacggaaggucauggcauggccccucugcugaaagugccaccuccucacuuuugaguccccugauccucaccggcucgcucagccaucaggugccccacgacacacaggugguuugggggugcuaggacagacggccacgcggggagcacccggcucucaggccagccuagucccacuggccucagcaaguuccacaugucagagcuguuaaaagcgaucucucucacucugagaaauaauucacuucagaaccacacaccuuucucguuucugaacaaccacaaaaaacuguaucggugccugacauuaaauuaauacaugaaauacuucuggucagggcucccuacaggugcacagcauucuaaccuugcagaccccgccgugcugagccccagggcaccugccccucacgacacgcaguucccagacagccacucccucacucgcugugcgcagggcaggacagccacgccucugccuugcgcaucaggccagcacugcugacaagaaucaccaacuccagccacagccagaucucucaucuuucacaaacucugagaggcggccaucacagacgacguuauuuuucauuuuaaggaacauucccuucagcacuugcuggggcugaaccacaggucgacccccaggcacugcugucaccucuccagacagccacggagucugcugugggugaggccagaugacaacugugaauguauuggaaauaaaacaaaacgaagcagggcgauccacgccaagaccuugcuguuggaagcaaugugcuuagcaggccugggaaacgcugccucacaguggcaccgggacguggucaggcccgcggcaugacagacagcaacagcuucccagacgccguucccccaacaaucugccagcgagaaagauuuacaaaggcaaauaggauggccucgucacagcgcaaacaaacgguauuuaauguuccauaaauaagcacgccaacgccuuaauaaggguccuucguccagcccggggcccaaccugggacaucguuccucagagguacuggaauauucccccugguccgacgcacacaucauuuuaaagcauccuuuuugaauucuguuuucaaggaauuaaaaaauauccaaguuguucauggcuagcugagaucuuccuuugaaaaacacgacacagaacugaaauauuccaaucugccagguaacuccacccuccacggaaacaccucuagaacgucaggggaugagcugugcaugguaauagcaggaacgcuuuccuaaaacacugaacuugaacaacagagcauuccuaauucagcucuccccugggaccucucugcucaccaggcgucucugccacggguuuccugccacagcccccgaccagccacggacaccccgggcccucuuggggaagagaaauccuauuuggugaaaauggacuugagaauaaaagucuuccaaagcuucaauucugcauaagauguugccuuuccacaagggaaccauuaaaugccccagcagugggcacaggccaguggcagacccgggcacacagagguucggaggguggccccgacugccagagaggcuccagcccaaacacagaggccuuggccaauuuccucugaguugccacggcgacagugcuggcagcagccaagcuggccaaaauaacuuagaaaacaggagcccuggggcgggaagcagggcacgcccgccucccagcugacagcgaagcagcuauuuccugagccccagaagggagcgggaccuccucucugcagagggaagcccggggccugcuccuggguggacacagccagaagccagacccuggaagcccaaacgccacucccaucccgccugggaaauuauuuacaauauucucuuuucauugucccaacaaaugguuacugaauaucuauucuuugcaccugcugagcacuuucgaaauaaagaacaagacacagccccucccucaaagcaccccgugaagacgcgggaccugugcccgcagccuggaccuaaguccagcgagauggaaggggugggggccacagcggcgugggccaggcuccuggccacagucagccacccugcggcugcagcccccaaccccgguacacugaccucagcucugccaggacguacagccccuucucaggggauccggcugacagacugccuccugggcucagggccggccacguccuuuacaacaaagcuugacuuucugugcuuagucuaaucuauaaaacccaguuugccuugcuuugcaauugaucucagacuuauucauguauucauuuauauccagguucaucccagaaacaacgugaaguaguuucuaucacccgucaaaagcuggagagucaauguaaucauuuaacaaugugauauaaauaauuaacaccauugaaucaucaucaaaaugcaguaauaaugguaauaaaaagaaaggagaaaacagcacggugucucacgggaaaacacaauauguacacguaacauaugagauacauaaagaacccuuccuagcaacuucuugacaccguaaaagcaggaaggggcucuucucagcucucgccucuccugcucggagccccaacuccuaaagcccaaaaccacgguggucucuggaggggcaaggacacagcagaaagcuuucacaagccgccuggagagccagcagcccagcucugcggggcucccggggaagggcgcagcuccggagggcccagggugccugcgagggugagguucacggcuucacucauucugcucaaggaguguuuugggggaaugagcccggugggugccggggaggacuguguccugaacccaccuggaaggcggccaccugcuucugggucaggagagaccccauguucaccaggguccccauauccgaugccagcaggaagcccgcccaccucaaaaugguguauaaacuguggcguccuugugagacuaggccucgaggggcagagacuggccuccugugcgucuucccggauaagccuggaguuaccugugcagucacaggaggaugccgccgccggcgguguccuucccgaggcugcugucgcgcacagucacgugugcacggaggcacggaaguggcccuugucacugggggugcgcugaccacgugccaagccagacacagugcccaguguggcacagcccacccuggaggccugggaggccggggagacccagcuccauggggauaacuacccccugugcuucuucaaggaggcaaagcagugaaaucuucagccagggccgagggcccagggccguacacuguccugcaggcccccugggccucugacugggguguagggccuggguucuggcagcacugggccugucgcaggcccacagucagugauucacgcugugaacgaccggggguguacugggaggucccacccgacccccgaugacugcacgggugugggagccuccaccccaacagaucccagaggggccacccugguggccacacucucaugggaccgacuuucaccccauaaagagaggucgggaguggggcgacacucucgcauggcacacccagguagaaaacucuucugcugaaauguccuggcucaagccggggaggacuggaaccagcucuggaaggcggcgccagggccacaggcagcccgggugggaagggccuccggcgggucucucucccacccucaucugccuuggcucccacugaccccaaagaccuagaacccaggcccaggcagggaagacauuuggggaguggugagucgagaaccgcaggcagcacagguuugguuggagcgcuuauuuucaaaaaaugaucaagacguuggaguuuuuaaaagagaguagugaacgauacggaaaauaugacccucauuacagacucggcggaggucccugcuugccaagcuccuccggcuucaccuccgcgcggggagggcagacacgaggccuugagaaugggcacagacaggggcggacggugaccagccuggggugaccuggacagaagagaucccgggcagcgggagaggggcccaggcccaggggugcccaccccacucacucgcugcucuucgggaguggggaguuauuugugguuuguuuaccugaaacccuuauuucugacacagagaagagaaaaugaaagaaaaggcuggggucaugguagcuccggguaaacuugaaagcuggaggcuugggggggucugcggggcguggggagacggcggcggggagggagggugacuguggggaggaagggccagaaggcggcggcaggggcgggaggucagggggaggguggcuggggggagggaggaggauggcugaggcggaggucggggggcggguggggggggggucggggggucggggaggucgggagggcgggacgcggggcggggagagggugucugggggagcuggggcuucuccgccucuggcagcgccaccagcccucuguccgggaccacuucguccacgcccguguccgggcugcgcucuucccccaggaccccgccgcgagcgcucggaggaaccgcauccgagcccaggacgccccgcacugcagcgucccccgccguagccccucggucccgggcgcgccggggacuccugggguccccggggagcgacgaggacgcggagggggccugggcgcccccaaaccccgaccuggccccgcgccccccgcgcccuccgggacugacccaccuggggcggccgcggcggcgcccucgucgcgcugguuaaacucgaagaggaacucgaagucgaacuccugguccuccagccccgucauggcgggucgggccggggccggggcgggagccggggucgcggccgccagggguucgguucucccggcgcugcccgcgcguccuccgcguaacgugacccccgccccuccccccguccccgccccgcccccgccccccggggcguuuccggguuuacauaaacaaccggcucgcggccgccggcuuccgaguuuuaaauaaacuccccggacacgaguuuuuaaauaaacucgugucccccccgcccccgcccccucgcgcgcgcgcgaccgcaggggucccccggccucuugugcccugggggucccggcccggcgcaggcuccuccggacccggggguaggggcgucgggaccccacgagcggcaccagguaccuaaggcugcgcccagggcgacggaauuuuuuuuuuaaguuuuuuuuuuaaagaaguuuucaauccgggccuccucgggaaagcggcugcaacggugacccccgagcgccacgugcgcgcccugcggagccccgggaguggggaggucccagcccgaggccgccaacgcuaggaaccccgauuucagcccgacggugccgggaagcgcagggauucccgcuggguucguggcgcgccccucggccugcaacccccugcaggaggcccggcacccaccggccucuccugcgaguccccagccuccaaacacccgcccugcgcgcccccgccccgcgggaaacccgccgguccuucuaggggcaccuccaaagaugaccuccuugagcggggcgggaaggcgaguucgggucccacccuaggcggcccgagccugugcgcggcggggauccggaaagccgggcugcuuagcugaggccgcccugggccugccucucccgccgcguguucuaacuucccccgggcucuccgcaccauauacacccgacauguggaauaguaggaggauggugggagucugagggcggaggggagccggcccgggcggaggggugcgcgugucaaggcuggcaaccccaaagcuccucggagcgcucccucuggccugccccgcgggcacugccuuuuccagaggcgagaaacccuccagucccagggucguccccgggcuucucccgcgacccuuucacuggcugguuuucuccagugauaagccaucguuccguguggccugauuuaguuucuaauaauacuucugacuuugggauggauguuggagcguuguuuuguuguaguuuugcugcuuuugccgaccuugggcaaguggaaguucuguuuucuguugagaagccacaacguuucauucucuuuccauuguacagguuuuuguuuguuugagacggagucucgcucugucacccaggcuggagugcaguggugcaaucucugcucacugcaaccuccgccuuccgaguucaagcgauucuccugccucagccuccagaguagcugggacuacaggcacccgccaccacucucagcuaauuuuuguaguuuuaguagagacgggguuucaccauguugaccaggauggucucgaucucuugaccucgugauccgcuugccucggccucccaaagugcugggauuacaggcgugagccgcggcgcccggccuguacauuguuuuuaaaacuccagccaccuuuuuacccccaccauaaaauuauacacaaaugacagcccuuaucaucuguuuagacuaaaacuuuuugcuaaacugucccgccugcugguggccccaggccgcgggcccugcagggauggaggcucacugcugcuguccuaggacugcacuggucuccaucccagagaaggggucgguggggcggcuccccugcugcuccuaggagcccccccuucccccgccccagugcugggcuuccuuccugcaaaugguucagagcuauugguccagauucaaagcugcccguuccacagacacugggugucuccauggaaauguuuagcuuggacgcauccucccagaggcuggggaugucugcggagacagaagccccgcugggugugaugaagcggggugccagcgcccugccauuuucuaaucugagcugggaaacaacgcugugaaguuaaguggcagagaacagggugagcuuuguuuggccccagcccguggggcauugugucuggagcgacuucugacuggguggcuacuuacaggccuguacuucucugcguucuccaugaggaagcaagcccggggccuucaggaaccacgacgccuaaugagcuuccacccagauggucccgaaacccgagggacgcaggggaggcgcccagguccucagaugggccaggaauggccucguggggccuacucagaaggacucagaguucuucccgguggucucagcgauggcugguguggaaaccacgcguguccccaugcugccggccuguguguaucaaggacuagaucacacuuuccggcuggcccaguucugcagcccucauaaaauacacccaugucggucgggcgucgcugcccggcgcacugccuugcagcagggaccuuuucgagcuuauuuucuucaguaggaaacacgaaaacuagccacugccccgucguguuuuuuccuugcguaaaagaaaggggcuccuuacuacaggucggccaccggcucuucagguacagagaucugaacuuggaaagaccugccuuucuaaagggagugauaaugaacacugcggcguaagugucccaggauuuaaaaccgaaacuccaacaaaaaaaaauuuuuuaaacucugcuacuagcaagagcacauuguguaaaacacugacacgggacaugguuuaaacaugucaacauuuucuaacauugggaugaaguggugucuaccucccgucccgugaagcgucagggcaccgaccacacggaccccccuccguggagcucacggcccugugcucagcucugcuaagaccagcgaguuuuccagagcugggggagcccgguucucaagcaagccccgcaguuaucagggucgcgcaggaagcggcagcgcucggaaggacgucugcccuuaugaaguacauauguuggcaggugugcuggcgcucuuuaaauaaauuauauaaaauauuucagagcugguaaggaauuuggaaaagcgucuuccaauuuccauuagcauugcaaucccuaaucccuaacucguaugcucacaccucugcaaggguauuuucaaagccacuugcaggagcccacccggcaucgccaggggugugugccggggacgggcuaaggugggggacuggaaugugagaugcgccgcaggggggucucagcgccccccacaccggguuucagggacccacacugugccaucuuuuuuucacuauaaagaagcagcucgaaacuuggcgguuccuuuucaaacuugccugaaacaucuucucuggcuggaacuccugccuauaggauuucaaaauggcuuaaauucggggcugugcugcggccgcgcuuuggaucuuuugguccugcagguccaggagccggcgugacgggcucggcccuggggaauucaggggcgcggcgcgagggagacgccgccacgagcucgggguggggguggggggcgcagaacccccaaaccgcgaucuuggcgccagaggguggcucugccucgcucaggaagacacggggcauccuucacucccaaggaagccucccuuccucccucccacgugcccucugugguccugacggcccagccucgcccguccccaaaucgccggccugcgagccgcuuccucggcgggacccgcggcggccucgccucgcgcccucagcgcuggggcagaggagacaccuauuggcagaaggcgcgcucggaaccgggcugcugggagcugggggacgccguucccgguccgcgccgcgccccucccugggcgcacagacccggccgaccucguucucuggcccggaccccuccgugcgggcgacgggggcggggucggggggcgcggcccgggccguggggggcgcagggguccgggggcggaggccgcgcggggcuuaccuuccuccgcugacuucauggugccgccggcgcgcggcgcgggccccaaaguuucuccucucccgaagaccgcagccgcagggccaaguggaaacuuggaagggacuggaaagcuggugcuuggcauccgcgcggcggcggcggggaguggagcggcgggcggaggcacaggagaagcggccgccccgcgcugccggggucgggucuccgggaagacagcccucgccccgggcucagcgccgcgcgccccggaggaaagucaucgaggggcgugugcgcgcguggcggggcccggccgcggcccuaggaccugcgcgguggcuccgagcccugcccgcgccccggugcccgcgcccugcugcugggaucuggcgcggcgacuccgccggcgaguucggagccucugagucucgcucugacgcagggccgcgcucugccuccugccuuuuuaaagcuggaaaacaccucccccgccuccccgccggcccggcggcucccgcgcccccucccugccgugacaucacgccccugcugcccgggcccgcgcggggccccggggacgagucgccgagcgcccgcc

SEQ ID NO: 192768 - RNA, 308886 nt, Homo sapiens
ggggcggucggaacauggcggaccagaucccgcuuuacccggugcguagcgcagcggcggccgcagccaaccgcaaacgcgcggccuacuacagcgccgcggggcccaggccgggagccgaccggcacagcagguaaccgaggcggcacuggccccguuccccgccgacgcuccccggggcccccagcccaccgcaggaacccggagccgggcgggucuggggucgcuaccggcgcgccccaucuguucgcugggagccgggaguccuuggcguucugagcgcgccgcagcuguggcguccgccgguggugagggccgcgggcagcugccggggcgagcggcugcauccccgggacgccugggccgagcguaggagccagaacgggagcagagaaccgcgguccaguguugagggguggcugcucuccuaaaguaaacggggaucaaaagugcuaacuucucggauacuucagagucuccgaaacuuguucuuguagcccugugaauugugaaggugacggauguaacuuuuaauugcuuuguuaaaaacacacuucuuauugaaaugacuucucuucgacauuucgauaucuuugcuaggcacacuuuuuguuuaaacauauauauacaaagugcuuuuugucgacaaguaauuuugcuuuuacgaaagggaaaugggguauugagaacgguuaacuuguuuaguggggucacagguuagcaguagaauuaguguacagaccuuucauacucgagauugcauuuagcucauauuuaacauuucucauucaaagaaaagaaaauuuuaaaaaguguugcuucuuauaguuuuugaaguuuuauuccagaggaauugucgaaaacauaauuucacucaauauguaguugcuucagaauuugaguuuuugaauaauuuuuguuuucggccauuugagagacuaacauauagcucaaaguacauacuggaauguuauaacgcugauuugaguguuuacccacuagcgauuuacucucggguaacuuauuuaaacucaagccaugguuuccucaucuguaaaaugcuggauaauauuuuuucuuacgggauuauuggagauuacaguagaacauguguaaggugcccuuuuuucagugcuugguuggaaguggguucugguguuaccuauaacaguaauuguguuaguaaaucuguuuaauuuuaggaguucuuuaguuggaaaugugccaccuguuucaaaauagguuuccaucacagauugaauccauuuuugccucauguacuuugaagcacugucauguggugcacgcacauucaagauuuuuugucaucucgguggauuguuccuuucauuguuaauguuccucugucucugguaauuuucuuugcucuaaaaucuuuauuagauauugaugucgccauuuaugcuuuuuuuuggauuaauguuugcaugguauuagcuuucaacuuaccuauguugaauuugaagugaguuucuuguuggaucuuauauuuuuuaucaacuaugccauucucuuuugauuggcauauuuacaccauuuacauuuacgauaauuacugauauguuagaauauaagugugccauuuauuaucuguguucuguuucuucugauucucauucugauuccuguuucuuuuuuuuuuuuuuuuugccacuuuuuggguuacuuggacacuuuuuugguaucccuauaguguguuugagauuagguguugguauaguuuuuacagugcuugcucuggguauuacaauauacaaaugugacuuaucaccaugguguauugcuguauuucaccacuuccagucaaguguggaaacccuucuuucacuuagguccucacuuuaaguaucauguccuggguaucagaugguguuacaguuuuugugucagucaucaaauaugguuuauaaaacucaugaugauaaagauaguguauugcauauaccacauacgcauauuuccccuuuuucuauuguucuuccuuuuuuuuuuuuuugagacagggucucacucuguucuccuggcuggaguuagugaugcgaucguagcucauuacagcuuugaucuguugggcccaggcaauccacccauguagcugggacuauaggcacauaccaccaugccuggcuaauuaaaaaaaauuuuuuuugaagagacagcaucuugcuauauugcccaacuggucucaagugauccuccugugucauccucccagaguguuaggauuaaggcgugagccauggcugcuagccugccauucuuuucuuagcacuugaaaaaucuugugcugcuuccuucuuguguccaugguuucugauuaggaugcugcugucacucagauugauguuccccuguagauaaugugucauuucucucuggcugcuuucaaguuuuuacuuugucuuuaguuuucagaaguuuaauuaugaugugucuuaucauggauuucuuuggauuucauguuugguuuuguuuuuuuuuuuuuuuuugguuuucgaauaaauuuagggaguuuuuagccauuauuucuucaacuacucuuuguuguuguugaaauaauggagaguugcucccacucucuucucuccauuuggauuuccaguguuaagaaaguuggaucuuauguugguguuucauaauuuccuuaggcucuuucccuguuucuuuucucuguguuguucagauuguguaaauucuauuaaucucuucucaaguucccuaauucuuuuuuuuuuuaauuuuuuucaguauuuauugaucauucuuggguguuucucggagagggggauuuggcagggucauaggacaauaguggagagaaggucagcagauaaacaugugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccgcccuuaauccauuuaaccuggaguugacacagcacauguuucagagagcacgggguuggggguaagguuauagauuaacggcaucccaaggcagaagaauuuuucuuaguacagaacaaaauggagucuccuaugucuacuucuuucuacacagacacaguaacaaucugaucucucuuucuuuucccgacauuucccccuuuucuguucgacaaaaccgccaucgucaucauggcccguucucagugagcuguuggguaccccucugagacaaggcggcugccgggugggggcgcccccccaccucccagaccaggcggcugcugggcgggggcgccccccaccucccagacggggcggcugggcggagaugcuucucaccucccagaugggguggcugccgggcagaggggcuccucaccucucagauggggcggccgggcagaggcgcuccucaguucccagacaggguggcggcuggguagagaugcuccucaccucccagacagggcggccgggcagaggcgcucgucacaucccagacgaugggcggccgggcagagacgcuccucacuuccuagacgggaugacggccaggaagaggcgcuccucacuucccagacugggcggcggggcagaggagcuccucccaucccagaugaugggccgccaggcggagacgcuccucacuuccuagaugggguggcggccgggaagaggcgcuucucacuucccagacugggaggccgggcagacgggcuccucacaucccagacaauggguggccaggcagagacgcuccucacuuccuagaugggguggcagcugggcagaggcugcaaucucagcacuuugggaggccaaggcaggcggcugggaaguggagguuguagcgagccgagaucaccccacugcacuccagccugggcaacauugagcacugagugagcgagacuccgucugcaaucccagcaccccgggaggccgaggcgggcagaccacucgaagucaggagccggagaccagccuggccaacacggagaaaccccgucuccaccaaaaaauacaaaaaccagucaggcguggcggcgcgcgccugcaaucccaggcacucggcaggcugaggcaggagaaucaggcagggagguugcagugagccaagauugcggcaguacaguccagccucggcaacagagggagaccguggaaagcgggagacggagacgagggaggggggagaccguggaaagcgggagacggagacgacggagagggagaagggagaggguaauucccuaauucuuuacucuguuaucuccacucuauucucaaucucauccagugagguuuuauuucuguuauuguauuucucaguuuuauaauuuauguuuguuucaagauaauauuugauuguggaagcauuuuuaugucugcugcuuuaaaaugcuugucauauaauuaaugccaguaucugaguuagcucagugucggugucaugugauugccuuuucuaauucagauugcgaauguucuggcucuugguuugacagaugguuuucgauugucucuuggguauuuuguauauuaggagaauuuggguucuauuuauaucuuuuauuuuagcgugcagccacccuguuuagauucagcacauagguccugggcuacauuugugggcugugguucuaaaugacauuuuaauucucagagccuuugugcugugaucuuuggucugcuugguuuaugugguaucacuggggcucuuccuggucucuguuggugcugcgugagagggaaagguggauuuuccuaggccuggcgucucuuacuaaaagauggaagugucagacccauggggaugaagaggcuucuuuggcugggcccuggcuguggcuguaucccauccauauggacccaguggcugcccuggugugucuggguuggagaagaggagucuuagcaccaccaugguaaaaggguuccuguggcagaaucccuauugcuggugccaccucgaugcucugaugucuuggagcaaggucuuagguuauggauaaaaagguuuucuggacugggccccuuauguggugggguugcaccugucggugcugccuggcucucccuaaugagagagaccagucucgggcaugaggggcacagagccuuacugggccagcagcuuguaguggcaaguuccccuuacugcuacugcccagaugccccgguauccccugaugggagaggggagccucaggccccaguaucccuuggugggagaggggagucucaggaagucacugcugccuucuuaccuucuuccagaacucuccuuugauuggcucuugcuuaauuacuaggauuuauaguuggacuuaacuggggaggagcagagaaaugggucuguggcauuuugucuggaccagaaguugugcuucuacauuauuuucugaaguuggguuuuauuuuaucgugguaacauacacauaguuuauaaaguuaaguggugcuuuuacaaggcuugcaguaagauauugugacucaaccuguauguugguaacuauucucuggcuuuugaaaauaacauuuauuuugcuguuaaauguugauuauuaccuuuuaguuaauggugcuguugaguucaucuucccuugugacuuuguuuauucuuuuuagaguuuuuuuuuuuuugagacggagucucacucugucccccaggcuggagugcauuggugcagucuuggcucacugcaagcucugccucccagguucacgccauucuccugccucagccucucaaguagcugggacuacaggcgcucacuacagccucgaccuucugggcucaagccauccuccugcuuuagccuccagaguagcugggauaguaggcacaugccaacaugcccaacuaauuuuuuaauuuuuuuuuguagagaugggguugcacuggacuugaacuccugggcucagugaucgccuucugucggccuuccaaagugcugggauuacaagcaugagccagugcacccugccucuuuuuagaguuuuaucaauuguuguuucacauauuuugcaggucuguuguuuggugcauacacauuugagauuccuguguguucuagaugcauugacacuuuuaucauuauguaguucacccaugugucucugguaauuuuucugcucugaaaucuucaucugacacuaauauagcuaccucugcuuuccuucaauuaauguuugcaugguauauaauuuuccauccuuucucucucaagucacuuauauuugaagugauuuucugguaguugucauacgguugguucuuuuuuuuuacccaccgccauugucugucuuuggauugauauauuuagaagguuuauguucagcguaauguuuaugccauuuuauuuuuugcuuucuguuuuuguuucucgguuuucuuuuuccugccuuacggauuaugcuucaacauuuuuuagaauuccaguuugauuuaucuauagcguucuucaguguauuucuuuguguagauauuacuuagugcuagcucuaggaauuacauuacauauacauaacucauugcaguguacuguuguugguauuuuaacgguuguuggguaaaguguaagagcuuuaccucuuuaaaucccuuuauucucccauugguaauauaauacucauguaaaaguguauguagauuuuacauauguaaaaguauauaaauauuucccuuauauacaauuagaacccuauaucagacaguguuaacaauuuuugcuuucucucaaucuagaauauucaagaggcaaaggaaagccuauuauauucaucuacccuuucugcccuuucuguuuucuuauuuccugauaguccacaauuucuuauuuuuguucuguuucaguaauucucuaacuauucuuuuaggguaagucuacuggaaacaaauucucuuuguuuuccuucaucugaagaugccuguauuucuccuucauuccugaaggauaauuucaccagauacggaauucggaguugacaguucuuuucuuucagaacuugaaaaguguuaugccacuucuuucuggucuccgugcuuucugaugagaaaucugauaucauuugaguuguuuuuccuuuugagauaggugucacuuuucucuuacuacuuucaagcauuuuuuuuaagucuuuaguuuuuagucguuugacuguucugggucuugguauggauuucuucaggauuacccuguuuaggguuugcuuaguauccuaauucuauaaguuugugucuuuugucaaaucugagaaguuugcagccauucuuugagugcuuuuugagcucuacucuccgucccuucuuuuacccuggugacaccuugugaaaucuuuucuuguaccauaggguccugaguuucugcucauuuuuucuaaguccauuuccuguucauauugggcaguuucuguuauuuucucuuaaaguucacugauuuuuucuuccucguuuuuuuaguuuuacuguugagcccauccauuaagauuuuuaguuucaaaauuuccaguugauucuuccucauacuagcagugucucuucugagacuuuauauuuuuucauuuguuucaagucuguucauaauuguccauugagacauuuuuaugauguguguuuaaaaauccucauuagauaauuucaguaucuguguuguuuugauguugacaucuauugauucucuuuucucauuugaguugaaauuuuucugguuuuggggauaaugagugauuuuccaguauagccuagacauuuuggguauuauguuaugagauuugggaccuuauuuaaaucuucugcuuaucgggccuggugguggugggaguggaauguggggguuacugccagaaggggcugaagagccagauucccuucacagcccccuuugacaucugggaagggaagguaccaugugacugcuggcuccccaguggucucugcuaacaauaccuuggcugggaaggggaggagugccugguuacugcaugccuguggccuccacugacauugcaugggugguguuaccuuuuagaaggugguuagauuuuccacuuuucacuaggccuccucugacauuauagagaugggcaggaaugcuuuauuacugcuauuuggggauguuaaauacaauguaccagaggccauuauuucagacuaagcuccugcaccaggcaaagcagaccagaacaaaccagaauggagucacuugugcuaggugccacaaucaaacuaaauuaaaaacagaccaguuuccucaaaaacaagagguucacagcaaccaaucauaagggggccaaacugagccagcauaagagaguccucucuacuuuacccuguaaggaaaguaacuuugaaaugcccaaucuguauuuuguuccucguaucugcuuucugcagcccucucuggcuguaaaguuuaccucugcugcucagcauaucugaguaucuuucuauuucauagaugaaauacugccugauuugcuaauaaaagccgguucgaucuuuaaacuaaauuuuuugaaacuuuaacaggaacgagcauccggcacccuugugcauguacccuacaaugacugccaggcuuggauggauguccccacuccugacuuggucugcccugacaccaccugggcaauggggagagugucuuccuacggcuggggcgugugggaguccaggcuucacgcacucuuugcuguucaauguaggugaggcuauuugcuuuuucugucgucuuuggaugggauauagcaauuacuaucaaaaauuuuucguuccacuaggcugcccuuuuccugguccuuuggcuggagagaccagacuuuucuuggggacuuuuuuggucugugucuauuacuuuucugguugcuaacucucuaguacacaacaugggcaugagaccaaaaggaaauacuggaaacucacuguugucuuguucucuggguccaaggaccuuacuggucugcccucuucucuccacauuuugauguauaauguccaggguuuuuaucuguuuagugggaagaacagggaguagcacaucuacuccaucuuggucuagaacuggaaggaaggagcaguuuacauuuuuucuuuuuucuucuuuuuauuuacucuuuuuuauuuuaaaauugcuucauuuacucauuuuuaacagcuuuuuugauauaguuuacauacauacaaguuaccccacuuaaaguguauaguucaguuuuuuuuuuuuuuaugcuuuaaguucugggauacuugugcagaaugugcagguuuguugcauagguauacacaugcuguggugguuugcugcaccuaucaacccaucaucuacauuagguauuucuccuaauguuauccuucaccuagccccccacaccccgacaggccccgguguguguuguuccccucccuguguccauguguucucauuguucaacucccauuuaugagugagaacaugcaguguuugguuuucuguucuuguguuaguuugcugagaaugacgguuuccagcuucguccauguccacgcaaaggacaugaacucauccuuuuuuauggcugcauaguauuccaugguguauuugugccacauuuucuuuauccagucugucauugaugggcauuuggguugguuccaagucuuugcuauugugaguagugcugcaguaaacauacaugugcaugugucuuuauaguagaaugauuuauaauccuuuggguauauacccaguaaugggauugcugggucagaggguauuucugguucuagauccuugaggaauugcuacacugucuuccacaaugguugaacuaacuuacacucccaccaacaguauaaaaguguuccuguuucuccauguccucuccagcaucuguuguuuccugacuuuuuagugauuaccauucuaacuggcgugagaugguaucucauugugguuuugauuugcauuucucugaugagcuuuucuucauauguuugucggccgcauaaaugucuucauuugaaaagugucuguucauauccuuugcuugcuuuuugaugggauucguuuguuuuuuucuuguaaauuuaaguuccucguagauucugcauauuagcccuuugucagauggauagauugcaaaaauuuucucccauucuauagguugccuguucacucugaugguaguuucuuuugcugagcagaagcucuuuaguuuaauuagaucccauuugucaauuuuggcuuuuguugucauggcuuuugguguuuuaaucaugaagucuuugcccaugccuguguccugaaugguauugccuagguuuucuucuaggguuuuuauaguuuuaggucuuacguuuacgucuuuaagccaccuugaguuaauuuucguauaaguuguaaggaagggguccaguuucaguuuucugcauauggcuagccaguuuucccaacaccauuuauuaaauagggaauccuuuccccauugcuuguuuuugucagguuuguuaaagaucagaugguuuucgauguguggcguuauuucugaggccucuuuucuguuacauuggucuauaacucuguuuugguaccaguacuauacuguuacuguagccuuguaguauaguuugaagucagauagcaugacgccuccagguuuguucuuuuugcuuaggauugucuuggcuaugugggcucuuuuuugguuccauaugaaauuuaaaguaguuuuuuucuaauucuuugaagaaagucagugguagcuugaugggcauagcauugaaucuguaaauuacuuugggcaguauggucauuuucacaauauugauucuuccuauccaugagcauggaauguuuuuccauuuguuuguguccucucuuauuuccuugagcagugguuuguaguucuccuugaagaaguccuucacaucccuuauaaguuguauuccuaguuauuuuauucucuuuguagcaguugugaauggaaauucacucaugauuuggcucuuugucuauugguguauaggaaugccugugauuuuugcacauugauuuuguauccugagacuuugcuaaguugcuuaucagcuuaaggagauuuuggguuuuguaaguauacaaucaugucauccacaaacagagacaauuugacuuccucuuucccuauuugaauacccuuuauuucuuucuuuugccugauugcccuguccaggacuuccaauacuauguugaauaggaguggugagagagggcauccuugucuugugcugguuuucaaagggaaugcuuccagcuuuugcccacucaguaugauauuggcuguggguuugucauaaauagcucuuauuauuuugagauacauuccaucaauaccuacuuuauugagaguuuucagcaugaagggguuuugaauuuuaucaaaggccuuuucugcaucuauugagauaaucgugguuuuugucauugguucuguuuaugugauggauuacguuuauugauuugcauauguugaacuagccuugcaucccagggaugaagcugacuugaucaugguggauaagcuuuuugaugugcugcuggauucgguuugccaguauuuuauugaggauuuucacauugauguucaucagggauauuggccugaaauuuucuuuuuuuguugugucucugccagguuuuguuaucaggaugaugcuggccucauaaaaugaguuagggaggagucccucuuuuucuguuguuuggaauaguuucagaaggaaugauaccagcuccucuuuguacuucugguagaauuuggcugugaauccaucuggucgugggcuuuuuuugguugguaggcuauuaauuaccgucucaguuucagaacuuguuauuggucuauucagggauucaacuucuuccugguuuagucuugggaggguauauguguccaggaauuucuucuagguuuucuaguuuauuugcauagagguguuuauaguauucucugaugguaguuuguauuucugugggaucaguggugauaucaccuuuaucauuuuuuauugugucuauuugauucuucucucuuuacuucuuuauuagucuggcuaguggucuaucuauucagcuaaucuuuucaaaaaaccagcuccuggguauucauuauauccagccaaacuaaacugaaggagauagagacacgaaaaacccuucaaacccuuuucuucgaaggguuuuucgugucucuaucuccuucaguuuaguuuggcuggauauacaauucuggguugaaaauucuuuaagaauguugaauauuggaccucacucucuucuggcuuguaggguuucugcagagagaucugcuguuagucugaugggcuucucuuuguggguaacccgaccuuucucucuggcugcccuaaacauuuuuuccuucauuucaaccuuagugaaucugacgauuaugugucuugggguugcuguucucaaggaguaucuuugugguguucucuguauuuccuaaauuugaauguuggccugucuugcuagguuggggaaguucucccggauaauauccugcagaguguuuuccaacuugguuccauucuccccgucacauucauucacacaaugaaacauagguuuggucuuuucacauagucccauguuucuuggaggcuuuguucauuccuuuucauucauuuuucucuaaucuugucuucacgcuuuauuucauuaaauugaucuucaaucucugauauaauuucuuccacuugauuuggcuauugauacuuguguaugcuucaugaaguucuugugcuguguuuuucggcuccaucagguaauuuauguucuucucuaaacugguuauucuaguuaacaauuccucuaaccuuuuuucaagguucuuagcuuccuugcauuggguuagaacaugcuucuuuagcucggaggaguuuguuauuacccaccuucugaagucuacuuuugucaauuugucaaacuccuucucuguccaguuuuguucucuugcaggugaggaguugugauccuuuggaggagaagaggcguucugguuuuaggaauuaucagccuuuuugugcugguuuuuccuuaucuucguggauuuaucugccuuuggucuuugaugcuggugaccuucagauggaguuuuuguguggauguccuuuuuguugauguugaugcaguuccuuuguuuguuaguuuuacuucuaacagucaggcacgucuguugcaggucugcuggaguuugcuggagauccacuccagauccuguuuaccuggguuucaccagcggagguugcagaacagcaaagauugcugccuguuucuuccucuggaagcuucgucccaaaggggcaccugccagaugccagccggagcucuccgguaugaggugucuguugaccccugcuaggaggugucuccagucaggauacauggcggucagggauccacuugaggaggcagucugucccuuagcagagcucaagcgcugugcugggagauacacagcucucuucagagguggcaggcaggaacauuuaagucugcugaggcugugcccacaaccuacccuucccccaggugcucugucacaggaagaugggaguuuuaucuauaagccccugacuggggcagcugccuuucuuucagagaugcccuucccagagaggaggaaucuagagaggcagucuggcuacaguggcuuugccaagguguggugggcucugccuaggucagacuucccagcggcuuuguuuacacugugaggggaaaaccaccuacucaagccacaguaauggcagacgccccuugccccaccaagcuugggcaucccagguugacuucagacugcugugcuggcagcgagcauuucaagccagugaaucuuagcuugcugggcuccgugggggugggauucgcugagguagaucacuuggcucccuggcuucagcccccuuuccagaagagugaacgguucugucuuguuggcauuccaggcgccacugggguaugaaaaaagacuccugcagcuagcucggugucugcccaaacggccaccuagcuuugugcuugaaaugcagggcccuggugguguaggcaucgaaaggaaucuccuggucugcggauugcgaagaccaugggaagugcguaguaucugggccaaaaugcucuguuccucacagcacagucccucagugcuucccuuggcuagggguggggaaguuugccugaccccuugugcuucccgggugaggcgacaccccacuuugcuucagcuugcccuccuugggcugcacccacugucuaaccagucccagugagaugagcuggguaccucaguuagaaaugcagaaauaacucgccuuuugccuugaucucauugggagcugcagaccagagcuguuccuauugaccaucuucuucuuuuuuuuuuuuuuuugagagggagucuuucucuguugcuaggcuggagugcaguggcgccaucuuggcucacugcagccucuccuggcuucaagcgacuccccuaccuuagccucccaaguagcuggcacuacaggcacgugccaccaugcccggcuaauuuuuuuuguuuuaguagagacaggguuucaccauguuggccaggauggucuugaucuccggacuucaugauccacccgccucggccucccaaauugcugggauuacaggcgugagccacugcgccuggcucaguuuuuuuuuuuggaauauucauagauaaauguaacucaccaaagucaguguuugaacauguucaucauguccaaaagaaaguuuguaccccguuggguaccccggguaugaguaccccuaucauuuuccuaccaacccuaucccaucauuuuccauuccaccuaucccccaaccaccauaucuauagaguuuuuucacugugguaaaauauagguaacuuaaaauuuaccauuuuaacuauuuauaacaagucacuaauuucagaauggcacacauuucccaaaauagaaauauuagaacaugacaauuuugcuauaaacuuaauucacuucccaauuuaaacuuugggaagugugugcuauauaauagaguaaaaguaaaaaaaaaaaaaauguaagcguauugucuuaauuuacgagaaacagaauuuuacauuaugcagccuagauauccacauuggcgguugaaaacuaaauaguuauuagaaaaacagcuuucauaugagcuuuacaucgcuuugugagcauugaaagcuuccuuccuugaccauuugaaaaugacauuuugcucuuauguauaaauaauuguacuuauuguauuuuaaaaguucucagguuuuccuugaaguggaauuauuuuuauuucauuauaaucauacuacuuuaggacacaguguauuuaaaagauaacguugguuaguuguuaaaacuuguauaaaaauuuucaugacugggcuuauauuuuauaaaaauuuccaagggaagaauuagaugugauuugaguaugauguuaguccauucuugcauuacuauaaagaaauauaauacuugaggcuggguaauuuacaaaaaaaaaaaaaagguuuaauuggcucgugcuucuguaagcuuuuaaggaagcauggugcuggcaucugcuucuggugaggccucaggaaguacacaaucaugguggaagguauuggagagccagcaugucacaugacgaaagggagcaagagagagaaugggaggucccagacuuuuauaaacaaccagaucucacgugaacugagugagaacacacuuaucaaucaccauggggacucaugagaggaccacccccuaccccaugauucaguaucucccacuaggccccaccucugacauuggggaucacauuucaacaugaaauuugcaggggacacacauccaaaccauagcauaugguuaaggaagauuaagaaauucaauagcacauugccuuuauuaucaucgaggaugaagauguuacgguuuucauaugucauuaaguaaacaaaaugacgugugccacacauaguagcucauaguucacugggaacgcaguuacuuguucagucuguuuucuacaaagucaugugagauacugauuuuuccuucgcauuguugauaucugggugaaaauaagguauuuguuaaauugguauuucccuuuuuuguguuuuaagugauaguggugucauucaacuuaucuuugcaguugaaugaagaaugaaugacauugagcauuauuguuuuguuuauccauguccauuauuaguuuuucuuugcuuuugccagcagugugacuauuggcccugcccagagccauuugcaaucuuacaauaguuaaguguuagcacugaaagauacuaauguuaagaacagaugucuacugucugauuauugggaaaauauuaguguuucuuaguagaagcaacacaguuuuuuuuaauacuagauuucucauucugagucuauacacaauuuucuaugaaucauaaaacuuugauaauuaugauagucuaauauuuuacuaguuguaaaaaugaaacuuauuuugcugugauguuucacaauugaaaagccuuuuuuuuuuuuaaggcguaguacuaauucuuaagacaguguuuaucuaauuguccagucccaggauucauuggaaucagagacauuuucuuagggggucuauaagaauuuccuuuaaaaggcauccguaggcugcgugcaguggcucacgccuguaaucccagcacuuugggaguccaaggugggcggaucaccugaggucaggaguuugagaccagccuggccaagguggugaaacccuguacuaaaaguguaaaaauuagcuggacgugguggcgggugccuguaaucccagcuacucaggaagcugagucagaagaaucgcuugaacuugggaggcagagguugcagugagcugagauugcaccacugcacuccagccugggagacagagcaaggcucuaucucaaaaaaaaaaaaaaaaaaaagauaaaaucucaaguuuaaaaaauuauuuacacuugccagaauagaaauguuuuacuuauuuuuuuuuuuacaccuaauaguauuagcaugaagacagaguugauaguagggaacaucacaauuuuagguaacugaaguauguauccugagcuaauuggcuauauagcuucaaauuuuuggguuugcauuuauauaacauuggauauuguaccauuaacucuaauucagaaguuuuucucaauuuauguauagcaguguuauuucuuauuucaagaaauugguguucaguuuucuuguagaacauuuuagaaaucauuagcuccaagguuauuguauauaugauucccaugggggaaaugacaucucagcucaagggacuauuuccauguuccuuuuccuggguuuugcuacuaaagucaaggcauauuuuucaggcagccaucccuuuaaauuuuauuuauucauuugucugcuggguuauuuauuuauuuuaacaucuugcccuuugucuuaguucauuuugugcugcuguaacaggauaucugagacuagauaauuuauaaagaacagaaauuuauuucucacacuucuugaggcugggaaguccaagaucaagguauugacgucuggugaggccuucuugguguguccucacaugggagaagaugggagggcaagagaggaugaaugugguuuccucacauggcagaagagcaggagagagcaaacccauugcaauaugcucucuuuaugauggcauuaaugcaucaugagggcggaacuauugugagcuaaaugcuucccauuaggcacuaucuucuaagacuguugcauugaggauuaagcuuccaacacaugaauuuggaggggacaaaaacauuucaaccguagcaccauuugucuccuuugcugcuauuggagggagagucccaauuucucauuaguuuaugcagcuugcugcuuaguaaugacuuaucaaugacaguugaaacuuguaguuguauuugaugaaggaaauaugcacauuucuuuauagcacuuaguuuuuugcuuuguuuuucuacuuuauuaacaugcaggcaaagugggaguguuuauuuuuaaagaagcuuugagcauuagacauguuuuaaaucuauuucuucguuuaauaucaguugucuucuaagaaguguuucucaucaaaauggaaacaauaaggcuuagauauuuaagauaaaauguaaguuuuaagcuaguuauuguaaugauuuacuuaguaacuuuuacuuaguaacuuauguguaacuuaugugccuuccaguacuugagaguuccuaauuuuuuuugaaaccuuuggcugcaguucagauagcuguccuuguuucuuagcauggcagugcucuuggguuugguaucauccauucugucaucuuuguucauaauuguuuuuacucauuuuaaaaauauguuuccagaauuauaguuaauugcuggaaacguugauuuuucuugagugacaaaccaauuaaguguguaugacaccaggcaacaaagacacuuaagauucugcgcuuuuccugucucugaaaaaaauccauuauucaucaucuuauuguuuuuaaauacugagguaaaauuuucaguacaauaggaaaauugccuuggaaauggaauaaauugcuugccaguucaaaggcuccauuucuggaguugagguuacaaaacaugauguugcuuauauuccuuaucuuucagaacucguugugcugcguuucccgcauuaaacuugauaggauugugacuuuuacuaaaauaagacauaacuguugaauaacuuaaugaaaaagaucaaaagucucauuuaggguauuauauuacaauauauuuauguggugguuugaauuuauucacauuuuguauaaauacucauuuucuaguugacuguuuuaaaagaagugaucucauacagagaagaaaaaaaugacauuuuaagggaaaauauuauuaauguuuuagucuguuacuucauagaucauguaauuuuuugccuaaauuauaaugaaacuuguauguugugagguuguucugugaugcugucgauagugguuggaguuguguauaaaagauuaucuggagacacuaaagcaaguaacauuuugauugguagaguaggguguuuaaaagaggggugaaaagaagugacugccauuucuccuaacacauuuacuuucaacaaaggucuucuuugugauuauuuuuagugacaauauucuauuccaugguauauuucaccaauuauuuauucauggauacuaugcuuuuugccauguuuccuuuggucuuuuucaacaucacagcacagugaugguuaucuuuguagagaaaucuugaacacauuuuaaauuuccgugggauaaugagaaaccaugguuaaaguuuauuuacguuacagaaauaaaaagcuuucaaugcaucgucacaaauuguucuccacucuuaccagcgauuaagagugccuguuuauccaagaccguuggccauauugaauguuaagaauucuuuuuuacauuugauaagcaagacauggucucuucuuguuugaauuugcauauuuuaaaaguccuuugugauggcauaagaaugaugcaguggacuuuggcgaugcagggggaaagguugggaagggagugagggauaaaagacuacaaauuggguucauuguauacugcucgggagaugggugcagcacagucucacaaauuaccacuaaagaacuuauguaacuaaauaccaccuguuccccaaaaaccuauggaaaugaaaaauuauuaaaaaaaaguccuuugugaaaacaaaaauuauuccagguuuaaaaccuuccaauagccuuccauuacacuuaaaauuaaaccccuuccuguugcuuggccugcacugugucccuuguuccugcccaucucuucagcugcuucugguguccugcuccccuuggcccacugugcacgugcccagcuggcuuuguguuguggcucucuucaaggucucugugcuaguuggccagucuuuuuaggccuucagagauugguugcuuuuccuccagaugucacuacuuggggccuagcaucuugggugaucuaaggaagaccucucccucacuuccagucuuaugaaaaaaaauuauuguuaauuauucguuauuauagauacauaauguuuauagacauuuaugcgauacauaugauguuuugauacaugcauacaauguguaaugauggaaucggguaauugggauauccgucaccuccagcauuuaucauuucuuuguguuaggaacuuugcaauuuuauucuuuuaguuauuugaaauacacaauaaguuacucuuaauuauaguugccuuguugugcuacugaacacuggaucuuauucuuuguaucuaacuguauuuuuauacccauuacccauccauucuuugucccccacucuccacuacccuucccagccucugauaagcaucauucuacucucugucuccauaaguccaacucuuuuuuaagcucccacaugugagugagaacaugugauauuuaucuuucuguacuuggcuuauuuuacuuaaaauaauguccuuuuguuccauugauguugauguaaaugacuggaucuuauucuuuuuuacuguugaaugguacuccauuguguauauguaccacauuuucuuuauccauucaucuguugauggacacuuagauugcuuccaaauuuuaacuguuguaaacagugcugcaacaaacauaggaaugcagguaucucuuugauaacaucgauuuccuuuauuuuugguauauaccaagcagugggauuguuggaucauauaguagcucaauuuuuaguuuuuuaggaacuuucaaacuguucuccacagugauuguacuaauuuacauucccaccaacaguguacaaggguucccuuuugucuacauccuugccagcauuuguuacugguuguccuuuggguauaagccauuuuaacuugggugagaugaucucuguuuguaguugugauuugcauuucucugaugaucagcgaugucgaacaccuuuucauaugcguguuugugauuuguaugucuucuuuugagaaaugucuauucggaucuuuugcccauuuuuuauuagauuauuagaauuuuccauauagaguuguuugagcuccuuauaaauucugauuauuaaucccuugucaaagggguaguuggcaaauaggcaaauauuuucccccauucuguggguugucucuucacuuuguugauuguaucauuuguucugcagaaacuuuuuaacuugaugcuaucucguuuguccauguuugcuuuaguugccugugcuugagggguauugccgaagaagucuuuguccagaccauuguccuggagauuucccccaauauuuucuuguaauaguuucauaguuugaggucuuagauuuaagcuuuuaauguguuuuaauuugauuuuuguagacagugagagauaggagucuauuuucauucuucugcauauggauauccaguuuucccagcaccauuuauugaaaagacugucuuuuccccaguauauguucuuggcaccuuugucaaaaacaaguucaccauagauguguggauuuguuucuggguucucuauucugguccauuggucuaugugucuguuuuuaugccaguaacuugcuguuuugguuacuauagcucugcaguauaauuugaaguuagguaaugugauuccuccaguuuuguucuuuuugcuuaggauagcuguaacuauucugggucuuuuguaguuucauauaaauuuucagauuguuuuuucuauuucugugaagaaugucauugguauuucgauagggauugcauugaaucuguagauugcuuuggguaguauggacauuuuaacaauauugauuuuuccaauccauguacauggaauauuuuuucauuuuuugguauccuucaauugccuucaucaguguuuuauaguuuucaucauagagaucuuucacuucuucggugaaguuaauuccuagguauuuaauuuuauguguggcuauuguaaaugggauuacuuuuaaaauuucuuuuucacaguguuuacuguuggcauauagaaaugcuacuuauuuuuguauguugauuuuguauccugcaacuacugaauugaucaguucuaauaguuuucuugugaaaucuuuagguuuuugcaaauauacguucguaucaucagcaaacaaagauaauuugauuauuuccuuuccaauuuggauucccccuauauguuucucuuguccgauagcucuagcuaggacuuccaguacuaugucgaguaacaguggugacagugggcugagaguuuugaagucuucaguugcuauuguggauuugucuauuuuucuuuccacuuguauugguuuugcuguauguguuuugaagcucuggugguaggugcauacauauuuaggacuuuuagaucuuaguggugauuugauccuuuuauuauugcguuaugucccucuaugcuaggcaguucuuuuuuugaugucuuuguuuuauauuaauauagcuacuuggcuuucuuuugacuaguguuugcauuauauauagucauguguuguugaaggauggggugugauguucugagaaauguuaaauaccauuaauacuuaaaauacuuccucuagauacugaguuuugcacuccagaaauguguuuggcaauuucauuguugugcagccauccuagaguguacucaaacagaccaagaugauagugacuacugcacaucuagccuauaugguauagccuauugcuccuaggcuacaaacuugugcagcauguuacuguacugaaugcagcaggcagaugugacacaauuguguaucuguguaucuaagcauacugaacauaguaaaauacaguauaaaacauaaaaaaucauacaggacacaaauuuacaguguguaaauuaaucuuuagcuuacuggaacuuuuuuacuuuguaauuuuuuuaauuuuuaaaaacuuauugacuuuuuuguaauaacgcuuaguuuaaaacaugaagauauuguugcacaaaaauauuuucuuuuuuuauauucuaauucuauaugcuuuuuucuuuuuuaaaaaaauuuauuuuuacuuaaacuuuuuuuuuuuuuuuuuuugguuaaaaacggaaacaaaaacacacauauuagucuaggccuauacagggucaggaucaucaauaucacuaucuuccaccuccgcauuaugucacugggaaggcaguaacacacggagcugucaucuccuguguuaacagugucuucugcugggauaccuccugaaggaccugucugaggcuguuuuacaguuagcuuuuuaaaaaauaaauagaaaaugucugaucuaaaauaauaaugauacaguauaguaaauacauaaaccaauagcauagucauuaguuaugauugucagguauuagguacuguacauaaguguauaugcucgacuuuuauaugaaugacugguagcacaauagauuugauuuacaccagcaucaccacaaagaugugaguaaugcauuauacugugaacguuauuauggcugugaugucacuagguguuaggaauuuuucagcuuccuuauuaugggaccacuguuuuauaugcaauccauuguugacugguaugucauuaugcagcgauuaacuguuuauuuuuccauuuuuuuuacuuuuaaucuuuuaaaguaagguugacagagucucuuaguuuucuuucaucugagaacaucuuuguuuugccuucauuccugaaggacauuguugcuggauguagacuucugcuuucacaguucuuuucuuuuagcacuucaaacaucaaguuccacugugcuuuggccuccguuuuucuccaugagaaaucuacaggcauuugaaucgauguuccucuauauguaaugaguuguguuucucuggcugcuuucaagauuuuuuccuucaucuuugcuucuaguaguuugauuaugauguaucuuuauguagguaucuuugacuucauccuguuuuaaguuugcuuuuuuaauuaguaaauuacuuucagcaaauuugggaagcuuuuguccauuuuuuucuucacauauuuuucugccucaaucuuuucugguauucuaauaaugacaugcauguuagaccuuuucauauauaaauauagagaaauaguguguaugcaugggugcgugugcacacacccccucccccaucugcuuagaauuucugucuacccuaggaugcuuguagaguauuuuuaaaaaaagaaaaaaagaacuucuguuuuucuauucacuucaagacuguucaacuuuaucucauggagcguggauauaauggcuguuuuaaaauuccaauauguuuuucauacugcaauuagcauuuguugguuguucuuucucuugacuauuggccauauuucccuguuacuuuguauguugaguuaaguuuggcuuguauccuggacauuuugaauauuguguugugggauucugggucucauaauccuuugaagaauguuuuaacagugcauugaccuggguagguuuagacccccaguucuguuucaccaccaguggguggugguugcaaugucaguucaguugcaaagccuuggcugugccaucugcuccccgccagugcuugucagggccuguuguguaggaccugaguaauucccagagccuguccugugcuuauuuggguuugggcacauuuuugcagcucgggggugagccugggacuucuguugauucauauacagaauuagggcaucccucguccagcuuucuccacugucugguuuaucccaugucuccaauuuccaggguuguuuuuucucagcuuuaugcuuucugaaagucaggguuuucucucagaguuuuagcuguucguguuguugugaagguccaccugacugggacaguucucagggaaaaguugugugaaaagagagaacuaccagggacguccacauccuguuuggacuccaggagcccaucuuccuguuucccuugcucucauagaaggugacuacaguguagcccuaauagggcuaggagaaacaaaaaggaaaaaagaaaaaaacguucugcuuugcaagagcccccuuugcuggggcuguggcuagaaaggguggguuucuucuggaguuugcauucugcauauugugggcaaugcagauagagucuucacuuugacaagaacucugcauuggauuucaagagccuguuuuagauaccuggagcuaagcugcccuugucuugaaacugugugugucagccccaucaacuggaggucugaaaggaggaagaauuacuaggaaugaaaauaugacagguugugaucagaaauaugauuccaucguacacgacauguacacucggccacugcauacgcguaccuucauaucacccaugccuuuuggccucuggguacuuaaaacgugcuguuucucuuugaguuuucuaggcagugaggacugaaugacuggguuccugagacucccuguauucucuugaaaaaagaaaagucuuccacaauacugaccuaucucuaaauugcacuuuagcagaaugugcuauaauugccugcuuauguguuugauuccuauuuuuuguuucugaagagcucuuaauuuccacuuauugcuccuuuccuuccccucaccaacaagccuuucaagaggugcauccuucuucccauguggacuucugcccccaacauugaugccuuacuaaccaagcuugcugccuuggcucuaugcacccuccuguaggucccccaguaaccagugcugugaucacagaccuauugcccuuagacucuuucuggguauaauuuucauccauggucugccguugcuagggcccccaguccuguuuucccccuaagcugccuggcugugauccagacuggacucuggaccuggcuuuguugguuuggaauacuuacuuuucuccuuaugugucaauuaaggaugguacuaucucugucccuuauuuauguuuuaauaguggguuuugguuaguuuuagcugucuucuauauggaauuuagagaauguuaaaaaagauuucaauauaaaugacugccuuuaucccagaggaacccacgagucugcuuucucaguuuuuacauugagacaaugccuccacaaauacuugaugcaaaauucaguaagacagcacuuguugaaucaccauuauaguuucugacaaauuguucucaaaaagguaaguuuuuauuuuuuaaagauaaauuacauuugugauugaggaaggauaaaaggaacaguuuugaugauaggcugccuguuucuugaaaucaagaggauuguugagcuuuaaaaggucugcugguuguugagauuuuuucauugaauagcgcauuuuagugaagagaauaacagaauaaaugggacauagcaucauuccccaaagauauaaacugucagcaaaccaagggaugauguugauaccuuucagauacagacagcuacauacugucgaaagucacuucuagaauguugguugaugacuuaaaguuguguaacauagaguguuuagauguugcuuggagugaacauucuuugcuauagucauguuucagaagauugguuuuuucugacuggauuaagugcagugaggagcuguugagcagcauugguugugcugucaggcugcccauccgcaccacagaugccuccaggauuaugcucacagcacgguuaacagagacuucuucagcuagcacaggucucguugggcagcuuuuuuaccuuagcuaacuuauuccuuugcaaaagaaagcagccucugcagucuuauuuauaaugcuuucccucagcugaagacagccuaauuugaggaaauauugucccuaaaugaaacacacuguaaagaagacugcuuggccuaucucagcacuccauuuuuacccuaacuagguaccagcuggaggaugagucugcgcauuuggaugaaaugccacuaaugaugucugaagaaggcuuugagaaugaggaaagugauuaccacaccuuaccacgagccaggauaaugcaaaggaaaagaggacuggagugguuugucugugauggcuggaaguuccucuguaccagguuuguuauccauugcuaccuaauuuccuuauaugcuaagguuacuuauaagguuagcuucuaauauacuuauuagcuauauuaauauaaaaacucaaggagauauuccuuaaaugauaucauggagauuaucaguacauuaaucaaagccaaacaaugcuaauaugaaaggaaaggaaagccaaauuauuaucuuacgagaaguuuuaaugguuaaaagcuggaggccgggugugguggcucaugccuguaauccuagcacuucgggaggcuaaggcgggcagaucacuuugagcucaggaguuugagaccagccuggacaacauggugaaaccccauuucuacuaaaaauacaaaaauuagcugggcgagauugugagcuccuguaaucccagcuacuagggaggcugaggcaggagaaucacuugaaccugggagguggagguuacagugagccgagaucgagccacugcacuccauccugggcaauggaguaagacucugucucaaaaaaaaaaaaaaaagcuagagaaaauuagugacuuuauagcuaaugcaugauagaauuaauaaugguugcucuaucaacauuuauaaaugguuuuucuuuuucuucccaaaagauagauaugggccuauacuccucugguauaucuuuuacucagauucaccuauauuuuuccccacauuuugcuacauuuauuuuauuauuauuuuuauaucauuauuuuucugagucauuucagacuagguugauuacuucauuccucuucuuaauucuucaguguguauuuucuaagaaauagguauuuucuuuuuuuuuaauuuuuuuaauuuuuuauuuuuuuauuuuuuauuuguucuuucccuccccccuccccccuccccaccacaguccccagagugugauauuccccuuccuguguccaugugaucucauuguucaauucccaccuaugagugagaauaugcgguauuugguuuuuuuguucuugcgauaguuuacugagaaugaugguuucgaauuucauccaugucccuacaaaggacaugaacucaucauuuuuuauggcugcauaguauuccaugguguauaugugccacguuuucuuaauccagucuaucauuguuggacauuuggguugguuccaagucuuugcuauugugaauagugccgcaauaaacauacgugugcaugugucuuuauagcagcaugauuuauagucauuuggguauauacccaguaaugggauggcugggucaaaugguauuucuaguucuagaucccugaggaaucgccacacugacuuccacaaugguugaacuaguuuacagucccaccaacaaggcuacaguaaccaaaacagcaugguacuuguaccaaaacagagauauagaucaauggaacagaacagagcccucagaaauaacgccacauaccuacaacuaucugaucuuugacaaaccugagaaaaacaagcaauggggaaaggauucccuauuuaauaaauggugcugggaaaacuggcuagccauauguagaaagcugaaacuggaucccuuccuuauacaaaaaucaauucaagauggauuaaagauuuaaacguuagaccuaaaaccauaaaaacccuagaagaaaaccuaggcauuaccauucaggacauaggcgugggcaaggacuucauguccaaaacaccaaaagcaauggcaacaaaagccaaaauugacaaaugggaucuaauuaaacuaaagagcuucugcacagcaaaagaaacuaccaucagagugaacaggcaaccuacaacauuggagaaaauuuucgcaaccuacucaucugacaaagggcuaauauccagaaucuacaaugaacucaaacaaauuuacaagaagaaaacaaacaaccccaucaaaaagugggcgaaggacaugaacagacacuucucaaaagaagacauuuaugcagccaaaaaacacaugaagaaauagguauuuucuuauauaaccuuaguacaguuaucaaauucaggaaauuuaacauugauacaaugcuuuguaucuacuuuaaguuuauauuucaauguugucuaucaucccaguaauguccuuuguagccuuauuuucucuaguacuggauauggucacaugucacauuuagguggcaugcuuuuuuagugucuuuuaaucuggaguaguaguucaguguuuaucuuucauuccauugacauuuuugaagaaugaacaucaguuauuauacagaauguuucacauucuguuuuguuuguguuuccucgaaguuaaacucagcuuaagcacccucuguggaauacuguguaagugaugcuauggccuucucaggguguuugauuccuguuugauugauuucuggucuucccuuuauuuucucucuuauuuuguuugacuuuaacucgcuuuucuuuuucuagcuucauaagaugaaugcucaggucuccaauauucuuccuuuuuccuuucuaaaaauaggugcauuuaaguuuugacagguauuaucauuaaguucaaaaucuauuucuuuuuucuuuucuuuucuuuuuucuuucuuuucuuuucuugagacggagucuugcuuuguugccaggcuggagugcaguggugugaugucagcucaccucaaccuccgccuucuggguucaagcgauucuccuuccucagccuccugaguagcugggacuacagaugugcaccagcauccccggcuaauuuuuguauuuuuaguagagaugggguuuugccaaguuggcaagcuggucucaaacuccugaccucaagugaucugccugccuuggcuucccuuaguguuggaauuacaggcgugagccaccgucccugggcccaaauauuuucuaauuuccauugucauuucuaaucuaaauccauguuugauuuauaacuauguugcuugauuuccaaaguuagagauuuuuccuaguuaacuuuuuauaauuauuaucauuuuaaauagagaccaggucuugcuauguugcccaggcuggucuugaacuccugagcuuaagugauccaccucagccucccaaagugcugggauuacaggcaugagucaccaugcccaaccuguuuuuugcaguuauuuuuuuguaauugauuuguaucugaauuucaugaggccauugaauauacuuauaauuuuaaaaaaugggccaggugcaguggcucacgccuguaaucccagcacuuugggaggcugaggcagguggaucacgaggucaagagauugagaccauccuggccaacacagugaaacccugucucuacuaaaaguacaaaaauuagcugggcaugguggugugcaccuguagccccagcuaugcgggaggcugaggcacaggagaaucacuugaacccaggaggcggcgguugcagugagccgagaucaugccacugcacuccagccuggcaacagagugagacucugucucaaaaaauaaaauaaaaauuucaguguuuguaauguguugagacucgcuuuaugguucaucauauagacaacuuguagcaaauuuucuuuguguauuugaaaauaauuuguauuuuucaguuguuaagugcacugcucuguaugucagugaagucauaguuguugguugucuaguucaaaucuguguugcuguucaugguuugcuuguuugucaguuacugagagacuucaugaguuucuaaacaucauuguggaugugucuuucuuuugguuaauuuuggaguguguuauuagaugauggacauuuaggauuauuaaccuuuucaguugaccuuuuauugucuuuaauuguuccucuuuuaucuuuaaauauacuuugugaagacuugucuaauuucaauaaaacuauaccagcuuuuuugauuaauguuugcaugguauauauugucauucuuuuacuuuuuaaaaaaauuuuuaaaaauuuugaauuuggaaauaauuagcuacaggaauugcaaaaauaguauagagggguccuguauuaguucauuuucacacugcuaauaaagacauacccgagacugggcaauuuacaaaagaaagagguucaguuagacucacaguaguuccacauggcuggggaggccucacaauuauggcagaaggcaaggaggaacaagucacaucuuauguggguggcagcaggcaaagagagcuugugcagaaaaacuccuguuuuuaaaaucaucagaucucgugagacucauucacuaucaggagaacagcccaggaaagucccacccccauaacucaaucaccucccacaacaggugggaauugugggaguuaaaugcaagaugagauuuggguggggacacagccaaaccauaucagguuucuuguauuuuugacccaguuuaccccaguuguuacaucuuauguaacuauaauaugaaaccaggacacuuaccuuggcacagugugugugugcaguucucggugauuucaucagguguugauuuuguaaucaccacugcagccaagaugcagaaccauuccaaccccacagggagcuuccugugccacagccacuccugucccucugagcccuggccuuggaaaccacucaucaguucugcaucucguuuuaauaucaagaauguuacauaacugaaauuacucaauaugugauacuuaaaaauuguucuauuuuuuuuccauauuguagugauaucuguauuaugugauuuguuuuuugagguuggccuauuucauucaacauaaugcugugagagccauccaagcuguuguguagguugugucaaguuuuuggauauuagaaauaaggcugccaugaacaauuguguacauuuguguguguggauguguguggacagaaguuuucauuucucuggaauaaauguccagaaacuucauugcuggguuguaugguaaguguauauuuagcuuuuuaagaaacugccaaaauauuucccagaguugcuguaccauuuuacauuugcacuagcaguguuugagagauccaguuuauugucacuguuguugauuguagcuguucuaguagauauggagugaugguucauuguguuuuucauucccauuuucuuaaugcuagggagguuggacaucuuuuugccauuuguguacucucauaaguaaauguuuuuccaucuuuaauuucuacuuguguuguuuauuauuuuuuucuuguugaauuuggagaguucuuuacauauucuaacuauggguccucugucagacauguaguuggacauauuuucuuucuuuccuuuuuauuuuauuuuuuuucuuuuuuuugagacggagucucgcucugucacccaggcuggagugcaguggcucgaucuuggcucacugcaacuuccgccuccuggguccaagccauucuccugccucagccuuucgaguagcugggacuacaggugcccaccaucaugcccggcuaaguuuuuuuuguguauuuugguagagacaaaguuucaccauguugccagucuguaucuugucuuuccauccguugagauucagagagacuucacuggauccaguguuuuuaauuuuggugaggucugaauuauugcuuuuguuacuuuugugaauugugcuuuuggugucgcaucuaagaauuucacagaacucuuuguugaagauguucuugcaugcauuuuauagcuuuacauuugaauauuuaaaaaaauuuuuuuggugaggugagagguuuagguugaaguucauuuuuuagccagugcguauccaaauauucuaauaccacuugauuguacaugagcggagcugucuguggccuugguucuguucucuucuccaucucaucagugugucaguuccugccaguaccacacagugugcuguacuguggcuuuauagaaaaucuuaacauggguaggcuaauucuucuuacuuuuuucagaaaucuuuaaguuauucuaguuccuuugccuucacuuagaaauuuuagaauaaucuuguucauaucuacaaaauccuuacuaggauuuugauaggacuuguguugaaccuauauauuuuauuaguuugggggggauugacauguuuccuauguugagucuucuagaucaugaacaugguaccuuuugcuccguuuuauuugaagauaauuugaucucuuucacuagcguuuuguaguuuucagcaugcaaacauuagauuuacuccuaaguguuuaacuuuuuggagugaucguaaaugguuugguauuuuaaauuuuggauuccacauuuucuuugcuaguguguagaaauacaguugauuuuguauguuagauccuuuauccuauaaccuugcugaacucacuggugcuaagagugguuuuguagauuccuuguaaucuauaaagacagucaugccaucugcagauagcagugguauuacuucuuccguuauggucugugugccuugccuuguggagcuggcuggaacguacagcauugugcaguagcgagaagggucaccgucaccuuguucuuucccaggugggagcugacaguauugcagcauuaagcagauauggacuguggguuuuuuaaagauauuacuuaacuaaaccaaauaacuauuuguaguuuuuuuuuuuuuuuuuuaagaaaucuaucuuguauuaagaaacaaaacaaagcauuggcaggagaaguggucuaauacauaguuuugucagacccagaaacaggcucuggagauguaaguugcagaguccuuaucauuguggugaucguggaagccacacagaaggaugauguucuugaaaagguugggagacaugugguauaccucugugaagaauaaggaggugacaccuuuggaaagaggauguauuggaaaggaagaauaguauccauccucuuuggcaugaggaaaacuaggggaggaagaaugaaauagugguggugacugugacuucuauucucaauugggaacaucaggucaauuaaguaaggauaugauuaggauucagacgagggcugaaaaaaaugggaaaauuuggucacgcuuugguagagaucaucaauaaucagcaaaggaaaaucaauaauaauuuguauugaacuuggcauaaauuuauggugaugaguccaucagggaagagccugggugaugacagagcuggcugaggaagugugguguggggaguuguggugagguaggcccccacgacguugugaauugaugaguuuguaggggcagagaguugacugcuaccaauuugcuuaggcuaagugcuuuucuucugugguccauauggucccuucuuaaagaagauggguguucucaccacuauuuacagccaagaaccggaagagucccuuuugugacagcuaagagccagcccagaaauugaaccagguccugaccuggugaccuaaagcccuuccuuuuugcacccuggacugggaacuuugcuaggauaaggacgcguggcccgaagaagacccugauuugcugucuuugaaguggaauagcucuguggcaaaugccuggucuccccauccuagagguacaucaccauggagaucauuggguugagaagguugaggaucuguguccaggccguuaggugauuuuuuguguguguggaaaaucacuggguauugggggagacugcaggauguucauagaggaagugggaacugggcacugaugggugcagugcuggggacaugggcaaugcaguguucaugguggggacucuucacagacccuguguguuguggaagugauacuuauuuggccauauaguaacaguagcauaccagcacuguacuagucagguaguuaacaagaauugcggacuuuagaauguucucagucucaucauaguguuaaauagauuauugaacuaauuuuucugguuuuucacaugauuuuguuuuuaccaagugaaauguaacagccaaauuuuagguuuuacuuauaauauacuccuuuucuuaaggaaaauauuaagaauauacuugaaaauauagaugguagcagcaaaaacacccguguuugcgggaguuaaaacagcuuaguaaaauauccuagauuugucuaggaagucuuuaucuuuuuuuuuuucuuuuugagacaggcacucucuugcccaggcuggagugcaguggugccauuauggcccacagcagccuugaccuccagggcucaagcaauucuuucaccacagccucccaaguagcugggacuacagucaugugccaccacacccggcuaauuuuuuuauuuuuauagaggcagggucuuucuauguugucuaggcugaaagucuuuauuuuaauaaauugugaucauguggaaaaagcuagcugagccaucuuggcaggcuguaaucagucuauauuggcacuaaggaauguccuacugccauaugggaugagaagcgaccugagguauugucaugcuguucuuauucaggagauaccugcuacacugagaaaucauuauggaaauuaaacccugcacguuagagaaccaaacuauacauuuagcaaguagauuggucuucuuuguuucuuauaaauuuucaguugugaauguuugcuacuuuuuaauuucccaaauaccaggcauuauaaaauucacuguuacuaacauuauuugguggcucaaagaauagauuuauacaguuaguuuaacugcaggaggaaaauguuuggaaucuugcaauacagguagauuguaacuauuauuaaugaguuguaaauauuuaaguguauuucuauuuguagauccuguaaguaguaaggaucauuuuaaaauuauuauuaaaagacugagcgaguaggcuuuaauuucuucauggcuugagaccugcuuucucauuuuuauuugacaaaaaucccaacuuggacacuuugaaaaaauuguucugguaucugucuuuuaaaacuuugaaucuuuuucaugugagugaauacaccuuucuguaagcgguugugagucauauugauaguucucugaucuggguuaaugucuuucucacgagauuuacauuucacuuguuaucaaaaaucacuuuguccuuaggaaaguggagccagugaauggcauuuccauaagaggggaggggagguaucaaaugcugggauuauuccuaguucuaauguccucaacuaaucggcagacguugagggcacagaagcaugggcgaaugugcucaucuuuuaagaagacaucagcauuguguugcuuuuaaauuggugaccauagguaucuauuggauguaauaauugucuaauuuuugggggguggagagaaaggaggcuaaaucugugggaauuauuuaacuaugacuaguuaacauuuuagaagauaggcucuugauguguuaauaugcuuuguuuaauguuaugauuugauuauagaggcauuuugugaaaagcuacuaauccuaaaacauuuuaagaaaaaguauaacuuguacacugcuggauauaguuucagcuggacuugaugauguaaggcaauuuaaauauaagggggaaaguguuccugaauaaucaauaauuuagaaacuauuucgcguacauagaaaugcuauugaguaaagcuccuaguuacugucucccaaggacuucuguuugcuucucccucguugugcaauauuugccaguaugcuuuccucacauuuuuguccucaaaaauuccccauauuucauuuuccuuuuuagcucuacuacucagugaggcuuaaacauacuguuuucguuacaguguuuauguauccuuggggcucaugccuuuuacugcuagcauggaagucgccugacuccccuguauagugguuucuggcugcaugauccaggggcaguucuggugcaccugcaggccuuucacaccucaugccuguugcgaguguauucauucaguuuuguauaguagcacaugauaugauaguggcgucuuaaccacuacuuuauucugucuguacacaauaaaauuauuaguagcacagugauacaaauaacauaauuuauaucaucaaagucuaggcaucuuagauuuacugguacaggguuauagaggaaaaaacugaguaaaauguugaauauuuauguuuuuagcagugggcauugaauuuagaguuucucgagugagagugaugucagugaggcauuaguucauguaguugcugacagugauggugacguuaagguuucuguugugcugcuguuuacagugcucauguuaugcagacaguggucuugcguuuauagugucguuugucuggaagaacauguuaauaucagauaaugcuauaaagcuuauauuuucuaaauuuuauauguaucuuuucaaauacuuagaucuuaauauuugauuuuucauuuugaauuugucugacuuuuguauacuagaacaucagaguagauaauuaugugucuuagagcaaaaauucauaucugaguccguuccugaagaauuuugcucuauuugaaaugcugaagagaaaugugcucauaugaagccugucuugcaccuguggcccagcuugcaaugugcucuguugaugccacugcuguccaguagaacucacuguaguaauggaauauucuccaucugggauguccauuaugguagccacuagccagggugcccacugagcucuugagauguggcugaugugacugaggaacuggaugguaaguuuuauuuaauuuuaauuaauugaaaugaaaguugccacauggggccgauggaugcucauuuggacgguccaggccuggguacucuuugugcccaagcuacuguugggaggagggugaccuuuugagugggauguugggaggcaggagagugaagaccgaggccucgggggcuuccuccgugggcggcauugugcugagccuucguaguguguagacuccacucuugucagugcuuugcagaugagugaacagagacucagaccaaggagcuuccauagggucacuugcuggugauugucuccaaaacaugacuuuaaaauccauguuuuuccauuguguuuuguugccugcucacaagugauucauuuuuuucccaucaucucuugaauggcuguggugccaugccugggcugaggaaaggcggugcaugaacuugagcaagagcuggccucugccuguugucagcucagugaauggacaugauacugauguggcgggagguugagauccaggcucucguuucaacucugccauugccuagugguuuagucuuagagaagucacuugccugugggaccuccaguuuucuugucuaugugaugugggaguucggcaucaguauaguguaguugcaguugucugagaugguaauucuuagguaacauaacuaggauuuuccuggcacuaggagugugugcugucaccagauaaaagagugaugauuuauagcugcuguuggugggaggaguuggggaaggagugcccaugagccccugccaugggggaaggcgacucagaguagaagagagcacagagcagucgcagucugcauggcaccacagcagggaugcuggagggaaggaggcaugugagaguguucgagauggacaguacaagcaagagguaaggugagagaaauagucauugaaagcuuacucuauuuuauuugaagccuuauuuaauuuuucuuucauucaagcauaaacagauaaaauauuaucagcauuuuauugaaaucuacuugaccauuuccuuuccuacccuaccaaaaauauuaauggugaacauacuuguuuugacaaucuuaaaucacuuuaauaccacccugauuuauaacuguuguggacuugaaaguaugcuuucaguuuggagguguuuggguuuauuguuucaaaagugcugauggcagugcuaagauguuccacucuugcaaagcucagucuuugugugcugcgguagaaguucuagaauaaggguggggggagcuggcuugcuuggcuauccccguggcagagcaucagccccgugagcgagcacugcuuaagggagcagugcuuggcaguccuucacgugcuggaacagucccuguuagggaugggcagccuccacagaaccaaccucugaccuuucagugugaggaucuucccagcacagcugagaauuaaguggauauucauagggauaguaccaacuucaguugagacacacacacaugcccucauaaggaaugcuacuaugggagauuuaugaaguuuacuucauauauucaaauucauaaauucaaauacugaaaccugcaaguuuucaguauuuguaaagugauuucuaaagcaggagagcauuacgauuauauaguaaggguguggcacuccagcaugggagacagcaauucugagauggagcucugaugugucagccucauuuuguaaucagccuuaugcugucauuuucaugcaaaacuuuuuguuaacuuuuaagcuuccuuugucacaaacaugaagaauauuugacuuauacggcaggcuuucuauucuagccuugaauacaauuagaaggugagauuuaacaacuuccuuuaguaagccauucugagucuuucucuacauuuugaaaauuuaaauuaaaccaaaauuuuaauacugaaguuuaaauucaugauuauuuugugcuuaaaagagaugaauuugauaccuuuucaucauuuucugagguauuuuuagaaacucuauacugucuaccccaaaauaaugguuuggaugaccaagaaggggaagaguugugcuccugaaacccagacacuauuggaacaggguaaauguaaaauuaaaauauuuacugcauagaugaagagagcuauguggaaauacagucaagcuuuuauuaucauuagaauaucacaggaaacauuuguauccucuuuaaauauuggauugagcugucuuuuuuuuuuuuuuuuuuuaagauggagacucacucuuucgcccaggcugaagugcaguggcauugucuuggcucacugcaaucucugccucccggguucaagcuauucuccugccucagccuccugaguagcugggauuacaggugccugccaccauggcuggcuaauuuuuguauuuuuaguagagacgggguuuuaccacauuggccaggcuggucuugaacuccuaaccucaggugauccgccugccucggccucccaaagugcugggauuaccgaugugagccaccacgccuggccugagcuguaagucuuaauauugcauuaguuaauacuacuggaaaagucauuuuuuaagaguggaaaaagugauuauuacuucagagaaugagccacauccuggauuaauugaaauccaaggaccuuuaucauugaaaaguguauugggaauuaccaguagguaaccuauagcuauagcuauaccuuuucucgacauauagagcauugacugcuucagaauauuaaugguuuuauuuugccaauaagagugucuaaacagaaagauaauuccccugggguacauuuauauaagacuuuguauuuuaugucaaauuuaaauuuguguaaccaaccuauuauaagaaaaaccccacaaauuagcauuaggugugcuauuaguguguggugaauacagaaacaaucaauauugacucuaaauauguacaauuaguuugaacuuuuuuaaaaagcaaaaaaaaauacacaauacguaucuuuuguuucauacaguugcugugguuggcugauaaauauuugucgaagaaagaaagagcugaaagcucgcacaguauggcuuggauguccugaaaagugugaagaaaaacaucccaggaauucuauaaaaaaucaaaaauacaauguguuuaccuuuauaccugggguaagacuauugcauucuuggagauggguugugugucagagauugcuggcuuccuuugcuauaggauggagccuguugagacucugacuuagguauugaguugugucacauccaaaucaguguccuuuugcuuuugaaccaucuguguucccaauaaucgcuaaauaauucauauguauuuuuaauggcuacaucauagaguucagcucaagaaaauguacaauuugauuauugccuucaguucuugauaaacaucauauuuauauuauuuuagaaauauagacauaaugaaguaaaaguaaauaaaauuaacagaaaacaaguuauacguuuuguuugucugggaacuaguuuggagaaaacaguaaauguaauguuuaaacccugccaagagauuucgcaaagaaaaugaaacaauuuuuuauacugaaaugauacaguaacaaaguaucuguaauaugcauauuuauauauagaugucuuugcuacuucacauuauaaaucucagaccuucuuauauuguuauaucguuaguuaucuuuaauuggguauuauugcuaaauuuaaauacuguaguuuaaauauuuuauuacuuuuguugcuagugauauuacuggcuuaaauuauaaaacaguucauauacaauuagaauaguugaauaauuuuuguguuuuguaugucauuccuuauuuuaauagauuuauuuaucuuucuaaaggaaaaggaagcugguauugauuauauuucuauaucaaaguuuuuggcauguuuuaugucuuuuauuugcaagaaaagcucuugauuacauggaauguggguugcuuuaucuuguauauuuaauuuaaauaaucaugcugacauuguauuuggcauugauuuuacucccacccccaccucauccccauccaccuagugauuggcaaauacuugauaucuaaugcacuucuuuauuaaaacccacaaaacuaauggcuucauaauuaaaagacagaccuuuugucaggauaauaaaauguaaacugucuuacaggcagauaaauauucgcaucuuuauugaaugaagccacuguuuucugcuuagguuuaaauuauuaaauacucacagaucucagagauuggcuaagcaguguacguuuuccuaaaggucagcagguucagucaguagacuguagaguauugauugcagucguuuaaagccagcagugcagcuuaacuuugaucaguguaaguccacacagccugcccagauuggccgcaugcugaaaauaccuguggaugugacuguaugaugauuaccauguguaugaguuuuuuaucuuagaucgucucugaaauuagucuuuucaucuaaaauguaguauuuuagaaacauuugguaauuacccaguaggaguucuaugucauuuuuaccacgaauggcaauuucuaaguugcuaauagauauaauuuaugcugagauuuuaaagaaaucacuaaggaaaaagcacuuuauuuccugcugagauuaauuuaugaaauaauucaaaacauucuuagacagcagguugaacgugauuaugaacauaaauauauugucaguguaacugauuuugagucccacacauugccguaugaugaugcagauaaccucauuuucugaaaacaaguugcagacucucuaguugagcaauaagcacuuaacccauugcccugcuuggugaaauuuucauaccuucuaaguggcauggaaauggcauccaaagagauugugauuuguaaguugcagguuugcaaguuugauuuaauuguagugugcuguuugaauuauucucaucuguaaacguaaguuuuguuccauuuugauuuucaauguaaaucuaauaauuagaggcguuuguaaauugagaucuauuaauauguuagaucuuggguuuucuucucuaaagauaacuauuuaaagugaaaaccaaaaccaaaaccuuucaguauugacauuccuaaaauuuuauugaaugaugaaauuucuuuuauauuugaaaauauuauuaagaauuaacuacccaaagaccauaagaguagcuggguagcugucuucuugaaaacuggucugcaauuacaacuucuuauauuuuaucauuuuuaauguuuugagggaaguaaauacccacaagagauuaaggcagucuaucucgugaaguuacaccuguucacguuuggcuuguucauucagucuuuguaaagcuaccuggauguccguguuaaaaaaaaaaaguggcuauuuauuuguuuuuuaccauuucauaaauauaagguuaauaugacuuuuccauuguaagauuuucugagucauuaucaagauacaccuguauauuuacuggcuugcuaacauugggaagguuuugcuaucuaacuuuuuuucauguucauguaaagacuuacuaaaugaguauggaaaacuggaaaauuucauauaagaaaaauaaaaaaacuuuuagaugacauuuuuaacaauugaacguccuaauugucuuauuuucaguuuauuuaaaauauauuuugggaguaaccuuaccuuucuuugugauacagcuauuagaaagccaaugugaaaauuaauacauuuacuuugaaucacaacauauucucacuguuugauggaaaugugguuauauguugugcagauuuuaauuguuuaauuuagguauuaaaauuuuuuccuugaaggaauuuuguuaauuuucucuuuuccuuuuuagguuuuguaugaacaauucaaguuuuucuugaaucucuauuuucuaguaauauccugcucacaguuuguaccagcauugaaaauaggcuaucucuacaccuacugggcuccucugguaagaaaagacuuuaaaaauuaaguuaaauuaugaaauauuuagaauauaguuuuaagaguugagaugguuaaaaguuaaauugaccagauuuuuaaaacaugguguuguaguguucacugaacuucuguuaaaagauuuugcugagugauuucagucccucugagaaccaugggaaguaugguggcagcaccugccuguagagcugccaaaguuacaaagugccugagcuggcagcagagggguuuuccuuggucauucugcaccuguguuaagguugcaggucaucagcagcucccuccuguuugaugcagcuguugggaaugggggcuggggcugugggucuguucuguuacucucuucacacccugaccauggugagcauucugaaguauccaagugcaguacguaugauuucugguugauaucucaguguauaaaguuuuucaaaaggccagugaugcaaugaugcuuaucaaugaauguuuccauuucaaauauaugcugucuugauagucuuaagcuguuggcugagaguuuucauuaauuuuuagcuuguagagacaagauguacaucgucuuuccuccuuucauagaaaaauguacuuacuacuuccuuuauuuuuauuuuuuauuuuuggagauagagucucacccugucacuggaguguaguggcacaaucucggcccacugcaaccuccgccucccgggugcaagcaguucuccuaccucagccuccugaguagcuaggauuacaggcacaccuggcuaauuuugugguuuuaguagagacggcguuucaccauguuggcuaggcuggucucgaacuccucaccucaaaugauccaccugccucagccucccaaagugcugggauuacaggcgugagccacugcgccuggccacuacuuccuuuuuuuugauuugcucccuuuugggcagaugacccgaggaaucuagguaggaaacacagagagugaaaggguuccuucagugaaagaagagugcaguccucgggguuccacaugaguuguggccuuccacauggcgagccgagcagucugcucccgaggggucuguccuggccuggguaggcuccgucucccuaaccagagaacuccagaugaagcaggagaacuggaagguggacuaaauucuuguuuccuggagaggcacagucaggcuuuccuguuuaccuguuaguaaagccaugcugagggaaauuuuuugauuucucuuucacauagacuucauaguaggguggauuugaggaaugaguaacuuuauauguaauauaaacacgaaauuacuagauaaaugaauacauuuuuaacuuauuaaauuaguaagauugaaagagacauuggagcugagcauggguaaaacuguaacacuguggcgcucaucccauuaauauagaugccgugagcucccccauuagugugcauagugugcaugcaugccuguguugccuuuuuggagggucauugguaauauauaucaaagaccugaaaaccagauucagcauuuuuacuugaggaauuuauccuaaagaaauaaugauugacuuccucuuuuccuaauugaauacccuuuauuuccuucuccugccugauugcaaauugucccuguuugcagaugacaugauuguuuaucuagaaaaccccaucgucucagcccaaaaucuccuuaagcugauaagcaacuucagcaaagucucaggauacaaaaucaauguacaaaaaucacaagcauucuuauacaccaacaacagacaaacagagagccaaaucaugaaugaacucccauucacaauugcuucaaagagaauaaaauaccuaggaauccaacuuacaagggaugugaaggaccucuucaaggagaacuacaaaccacugcucaaggaaauaaaagaggacacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuacaguucauauggaaccaaaaaagagucugcaucgccaaaucaauccuaagccaaaagaacaaagcuggaggcaucacacuaccugacuucaaacuauacuacaaggcuacaguaaccaaaacagcaugguacugguaccaaaacagagauauagaucaauggaacagaagagagcccucagaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcaauaccauucaggacauaggcaugggcaaggacuucauguccaaaacaccaaaagcaauggcaacaaaagccaaaauugacaaaugggaucuaauuaaacucaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaacacuuuuccacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaccaucauucucaguaaacuaucgcaagaacaaaaaaccaaacaccgcauauucucacucauaggugggaauugaacaaugagaucacauggacacaggaaggggaauaucacacucuggggacugugguggggucgggggaggggggagggauagcauugggagauauaccuaaugcuagaugacacguuagugggugcagcgcaccagcauggcacauguauacauauguaacuaaccugcacaaugugcacauguacccuaaaacuuagaguauaauaaaaaaaaaaaaaaaauuaaaaaaaaaaaaaaaagaaauaaugauugaucacaaagucuaaagaauguccauuauaaauauuuuaaaaagucgaaugucuaacaauagauuauucaaacugccauauccuguguacuuguuggaauacuguguagcuuuaaaaaugguguuuaggaaaaguguuuaauaacauaaaaguuauguauguauuagaauaaauuuuaaaagguggcucaaaauauguauagaaggaaauccacaguucuuuugaucaaucaauauugagcuccuucauguccagccauagucuagguaauguugauacaacagugaacaagacaaaccaaauccuguucuaauagaacuaaaauucugggagaaaaggcaguauauaaacuccuaaugccacguagccauccaucaggcuaugaagaagaaaauauaaagcaggaaaaaugaguagaggaugaaaggguuauucuauaugggauggucaaggaaggccucuccugugaggugacauuggaaugacaucuuacugguaaaacagucagauaugaaacagggaagaguguugcaggcagaggaguaauugcagaaggucuuggacuguuuuagcaugcuccagggugggaggaggucauccaggagggugugggugggaagaaguaguuggaaaggaggucagagggccuggcgucaacucuuccagggcucucagauuucauccugggugaaaaaggaagccguauguuuguguauauauugcauguauucacacacagaagaaacacugaaguguauacaacagaauuuugaaaguuguuguugaagcuagguaaccguggaagagaguauagauaacuguuucuccuuucuuuucuccaccuuccaccacauuagcaguaaccuauucugaaugugagauuauaauuccuauguaucucuuaauaguuuuacuguguuuauauuuaucauuaaaacaauaugcaauauuauuuuguaugcuuuaacauuuuuuauaaagguuaucuuaaucuguguggccuauugcaacauacuuuuuuggcuuaacauuuguuuauaaaauugauccauaucaacacauauaucuacuucauuuuucacuucacuaaaguguuucauuguauaaauauaccacaacugauucaucccuuccuuugggaaaggagacuuuggggucguuucucauuuuuuaccauuauaaauauuguuaaacaauaugauuguucauaagcauuguuauaaugaacaaugugauuguuaacgauugcuuaugcauuugugcaaaacauucuacaggcuguguacuuccuagaagucucauuuaaaaacugcuguugauuuuuuucauuuucuaauaaaagcaguauagcauuauagaaacuuuagaacacagagaaaaauacuugcucauuuuaaaacacaaucauauugaacguuuuuguuuuuuuuuuuuuuuuuuuuuuuuuuuugagacagagucuuggucugucgcccaggcuggagugcaguggcgcgaucucggcucacugcaagcuccgccucccggguucaugccauucuccugccucagccuuccaaguagcugggacuacagauaccugccaccaugcccugcuaauuuuuuguauuuuuaguagagaugggguuuuaccauguuggccaggauggucucgaucuccugaccucgugauccguccgccucagccucccaaagugcugggauuacaggugugagccaccgugcccggccaauuauauuuaugauuuuaauguauuuauuucuagccccuuuuuuucuauucauagcuuucacaguuguauuuacugcuuaaguaucguuucccggcugggugcucguaccaguaaucucagcacuuugggaggccaaggcggcaggauaucuugaguucaggaguucaagaccaaccuggguaagauggugaaauuccaucucuaccaaaaaauagaaagauuaauuguguguggugguacauaucuuuagucccagcuacucaggaagcugagguuggaggauugcuugagccugggacacagaaauuguugugagccaugauugcgccacugcacugaagccuggguaacagagcgagaccgugucuuaaaaaaaaaaaaaaaaaaauugccuuguggguuaaaacuguuuuaacuuaaacaaugauggucugagaacacaaauucuucuuaauaaaguaaagcaaauguauuuauauauauuuugcuucagccuuuuguacuuacucugauuuaacuagguuucaaccaaagaaaauguccuuuugaugguucuuucugaagaacuuuauuugauuuguucacaaaauugaugaucuuggccauacuugagugaagugugcacacaagcacacacacgucuguuuaccaagacgagaaaacguuucucuguuuuuucuuuucauaugauuguucauuuccaguuccagcugcaauuuuuaguccuuuagcuugaauuuucauccucuguuauuuugaaguacuuuaucauuuuuugacauguauuagcuuuaauuauuuuuagauaauuaccucaauaagcaacuacuucaauauucauauaaaagauacuguuauuccacuauauuugcguuuuaagauuuuagagaagugaaaagccacuuuuuccauuugaauaaugcuugacguugccuucugaugcaccuagaugaguucucuuguguccugaguaucauauuguucgaucugagaauugauuuacuuuuuaaaugauuuucuuucguuccuugguuuggcagcagccacaauugaugcuaccuuucagauaacaaaugaugaauaguaugcuuucucuguuuauaugcaucuuaaccuuugauugagcaaaccucuuaaaaaguugauguacaccuuaggcuuaccuucaaaucugagaagcaagcuuaggagagcauauugauucuuuuaaaaagcuuuuaaaaacgcugaaaaucaagacaauuugaauaauuagacaaaguuaaggaauaauuaaacauacacuaaaucuaaagaaaucucuuuaaaggaaacuauuuaaaauaaugcaaauuugaaaauauguauaggugucucuuuuuuaacugaagaaaauguucuucaacaagaauuccucauaagcccuugaguucuugcauuuucuauaccaguuuauauuaaccccauuauauccagugccagcaacaccaucaucuuuauacauacauugacuucuuuuugccaucuuuuguucucuaagguucuauaauguucucaagaaaaagauaucaguuaacauuuccagauuucuucuagccaaaauccugccucugaggcauaaaaccauuuuacaguugucgguuguaaaauccuauuucuguuguucgcuaauuuuaaauaaaacaaguuacuucaaacuuacucccucuguucucuaauuaaaauugagauguuuuugaaaacaaugauagcuuaauuaauaauauuucuuuuucaguugcuuuugguaauauuauuuauuagcuuuaggucugaacuaauuucuguuauacuucccauauaauagaaguguaaauugaaaauaaguugauuucauuacauuuuugugucuggaugaagauuacuuuucauacucagcuuucagaacaauucuuuaaagcaaagcuuguguaaucagaguaacaaaacagaaugucaugcuucuaucaaaaugaacgagauggaauagaucugucuaugcagaagaucuuuagauaaagaaagcucuggcucuaacaguuuuuaacacuguaucuucuauauaaaaugucuucugcuacuuuguuaauaaauaauugguaaccggauaggcuauguaggugagaaaucaaucuaugaggacuuugauuuuucagucuuauuuaaaaaucuucccuucauccacucuuuucucgugugcgugucucugcauuagaggugugggcaaaguaagaaaaggaaaaacgaaugaaauugcuuggaaucauccagagacaaccauuguuagugaucuguguggccuugguaagguuacuuacucacuuugugucucaauucccuuaucuguaaauuagagguaaagauacauacuuuguaggauuuuugugauauuuaaaagggguaacucauuuaggauacuuggaaaaguguguggcacaugauaagcccucaaaggcacaucaauaauguacccaucuaacuuuuucuccuuuuacaaaaauguauauuguuuuggacuagcuccgcauuguucuuggguuaucuggagaaauaggagaaaggcuguggacaagccacgugagaagaaguccauguuguccagucuguguaacacacuugugcccaaauacugcuguuuccaggaugacaguaguuuaaauggcccuucuugcuuccaguuuugauuuuucuagggagcaguguuauagcauaaaucucugaccuuguugguaccgagguaaugggaagauccaagugcuccuacaguaagacuugcuuacuccaguccuccauaaaccaccaaucuguaaugauccauuuaagaacucagaucuaaacucuuacggguagaggcucauuuguuguagacuccagugguagaaggaaauaguggccucaacuucccuuuccuuuagugucuuuuauguuccuaggcuggccauugggcauuuccuuggauagauacgcaggggauggacgugaugguggugacaucuuuuggguguugagaaucguacacauguguuacuuauucagagaaacagauuuggaaguguguuguaaaacagcuuggacagucuaauaguccuugccugugaccaggaucuuguuuccucuuaagaguguuuaacuccuguuuucaggacuuaggaccuaacccucuuuauucugucuucucuaauacuacuucauuugaagugggagcuuaauuucacugacuuccuugaguucuuaggaacuagcacauuuuuguggcuuaugauuacucaaugaauuugguuaacuuuugcugucuuuaagccauaaguuuaaaggggugaaaauuagagucaccuggagaguuuaacauaugugucugaggucucuucccuggaaauuagagguaaaaguacacauuucagguagggucugagcaaauuuauguuacaaaaaaucuuuucaggugauuaugauaugcuuaccugauuaaaaaacacuccuuuaaaauauugucuauacuauauaaauaaaaugugcuugguaaucacuuucauucucuuaucucagugagucacaaacagaacuuuuuuuaagaaguuaccucugcaucaugaacaugagucuguagcaguaagucuucucuuacgugggaauagcugcagacaaguauauuucuuggauucaaagaugcauauuuuucauguuacuaaaauuaagcuguggcuuauaaaauguguauauuuacaaugcuauugucuucccacccaagacuacuacuaaaauaauacugacguaucuuaaaaccagugacaucuuugaaucaaggaaauauagcauuucaucauaugacugugcuaugaauuucuuacuuguggacauucagguuauuucuaauuuuucauauucaugcugugauccuauaauuuuuccuuuaagauaaguuucuagaagugaaacugcuuguuuaaauaugugcaaauuuuaaggcuuuugacagcaccaacuuucuuagaacuuuuuuggggauaucugcugcuuuggcuuuucauauucauuuucuuuguuuuucuguugcuaacucuaguucaauaaaaugaugaauuuauauucaaguucuucuuugucucuaacaggcuuuuugauaaccacuuuuauuucauugcugcuuugucauaacuuguuaccagcuuugaagaaacuggccaucauucccuauuguauauucuucacucuauuauggagacguuuaucauaauauaaaaauuucuucuguucuuaaaauuuuguacuucacacagcugacaucacucuuaaucauaaaagacugaauguguuccccuuaaacuuaggaacaaggguguuugcucccaccaguucuguucaacauuguauagggcaguuaguuaagaaaaugaaguaaaaggcaucuagauggaaagaaagaggacugucuaucucuagucacagauggcaugaucuuguuuauaggaaaaccuagggaaucuacacacaaaaacauuguaacuaaacaaaaugaauuagcaggguugcaggauacaagaugaacauacaaaagucacuuguauuucuagcagugaccaucccaaaauggaauuaggauaacaauuccauuuauaaucucaucaaaaagaaaauuauaggaauaagcuuaaagcaugaaauuacauaaugaaagcuauaaaagaauuuugaaaaaaaagaaaggucuaaauaaguggaaagucauguucaugaguugaaagacuuaauauuguuaagauggcagcacucuccaaacugacacacaaauuuaauccaacuccuaacaguauccuagcuggcuuuuuuuuuuucuuuauguuuuuaaauguuuuugcagaaauugacagauugauccuaaaauccauaugaaaaugcaaagggcucagaguggcuaauacgucauagaaaaaaguagaucaaaguuggagaacucacacuuucccauucccaaacuuauuacaaacugcaugaucaagacaguaugguacugacauaaagauaggugcauagaucaguguaauugagaguccagaaauaaaccuuuaaauuuauaacacauugauuuucaacucgggcaccaaaauaguaacuuuuauaacucaacaacuaaaccuaggaaaaagguagguaaaggaucugaguagacauuuacccaaagaagauauacaaauggccaauaagcaugugaaaaguugcucaacgucauuagucaguagaggaaugccaguuaaaaccagagauacuacuucacacccaguaggauggcugcaauacaaagggcagacaguaacaaguguuggugaggauguggagacauuggaacccucauuaguugcuggcaggaauguaaaguggugcagccacuuugaggagcaguuuggcaguuccucaaaauacuacacacacaauuaccaugucacccagaauaggcaaacucauagagacagaaaguggaugagucauugccagggccuaggagugggagggaauggguauggugcuucauuuugggaugauggaaaucuucuaaaauuagaugauggugacgguuguacaacucugugaagguacuaaaaaacgaauuguauacauuuauaguguuaauuuuauggcaugugaauuauauaucaacaaagcuauuaucuaaaaaaagaauacagugugugcuaaaggaccuaagugaggucuuacucugcucaucagcuggugucuucaguggaaaccauggcaaauacauggcacaugccgugccaugccugccuucuuugcagauggggcacaucacaaauuguucauggcuucuuuuuccuugaguccaagaguggcuuuaggauacuucucaaaacagugcuuccaacaaccccugggaauacacuggcaaagaucagaaagacaucaugguguuucaggagacuacucauaguucccugguguugaaggauacagcaauauugagugggggacaaggcuagagaucugucuauucguaagguuagggguuuggggagagcacuguauuucauugggagagcuggggagagccugcguccggcuggggugccacaccgaguacagucaggcuggagagauguguggaaggaagcacaguuagcaguuggaggaaggagccauaguauugcuuauagaugauggcagugggauggguagagaauuaggccaucagugggcugaggccagcuuuggggugacuggauaaagaggggugcauggcuucagaaagacagccaggagaaugugguguccaggaagccaagggauggggaauuggaaagagggccuggugaacaauuggaaugcacagaggaaugggaaguuucgugagauggucugccuuacuugagaauaguuuuagucaagugguggaaggaaauuguggcaaguggagaaguauacuggauaugaaaagguuuccgauggugcagagugcagacuaagggaggagaagacuugaugugcucagggagagaugguuguagggccgagggaggcucaugauuagggggagagcacacaguauggcugaagagagauggcagaggggcugaaaaggagugagagacacaggcugucagguugauuuugaaugggaaagagacuagaagaauccauguuuaagucaugacuguugaagggguuuucaaauaggacacuugagaaaaauaccauuucaguaaauacaagaaacauucuucagcagcacacuuaauuuggccuauugguuauacagaaaacaaaaaacugaaauaaaaaagauuauugugcuuucaguggacauacauccaguguucuguuauuuacaguuuugacugaagcaaggucaucauuaauaauagagauugacuugaagaauauuccuguaacaugucagaaaauauauaugcagccuuuaaaaaugaugggcauuagcuucauauuagugguauaaugggcuucacaauaaauuaugagaauauaaaaauuuuuuucuagcuagcaucauauuaauacaggcagauuuuuacuuaaaaagugagaugaaagcacuauaauuguucauucuacugcaguuauauaauaaugcacuauguaagaaaaucgaugugugauuaucugggaauuguuuuguguuccuaaauacuuuuauucuguaagaaaaauuuaagugcagaaauuaaguguaagauuuuuaugucagucauuguaaauuuuguauuugaaugcccaaguauucuaaauauaauuuguggauuuauugaagauuguuaauuucuuuuucuuuggguuacuagguauuuucugacacuuagcuugaaguaucuauuaggaggugaauuaaaaauuuggggaguauacuaagaguugcauaccuuuuacaaugaauccuuuuguaauauuucauuguuacuuuuugacuuuuuugguuuucauuuauuuuauguuuuagagaguaauauaaauugaaggaaaaaaguuaaaccaaguaacaaauaauuuugucuuuuuuguuaaaguuuaguuuucuaaaaauaccuuauuuuguuuuauagggauuugucuuggcuguuacuaugacacgggaagcaauugaugaauuucggcguuuucagcgugacaaggaagugaauucacaacuauauagcaagcuuacaguaagaggucagcaagaugcuuuaauccugcuuagcguuugcuuacuguaauuaucauuuuagaguuaacauaacaaauguaugaaaacauuuuaauucuauuauugaaaauaguauuaugugauuguauaugauaucuaauuaauuuccuuauaauguauaaugcaauuuuaggguagauauuuguucauucucuagcuguuuggauguauguuguguacacauauauacaaaugcacacacaaccacacaagcauguacauguauuacuaauaaucauguaauguguucuauugguauauacguauuuucugagaggcauaaugucacuucaucuaaaaucuaucuugguauuuuaaacacacucauaaaggucaaaugucuauaccauggcauuaaccuauucuuaaguacagaggccuuugaacaacagaaauaaauaucgugauccaagaugauaacugaugcaagcacacuucuccuuaaccuucauucagggccuuaacucuugcuuaacuuacauccuucaagcgcuuguuuauuugauuuuucaguccauaguacaaaaggaagcaauguauuaagaagagagugggggaaacgaugacaaguaggcauaagauaguaaaaaagugacugaaaaccuugggaaugagggagacacugaaaaacugaauggguauucauaguaaccccaaagucuguuuaaaaaguuugcaguggauuuuuaucuuuuguauguauauaagaggacauuuacaaugaauuauuuaacuugaaauaguaccuucaaaaaugacuuauuuuuaacaccuuauugggcucuauuucacauaacauaaaauuuauccauguaaaguauacaauucaguguuuuugguguauucauaaaguugugcagccaucaccaacacugucauuuaaguuuagcauacuuuugacauucucagaaggagcccugaauacaugagaaggcaguggucguucuugcuguuucccuccccacccuaccccagcuccaggcagccgccguucuccuuucugucucugugguuuugcccacucugcacauuucauaucaauggaauuaugcaaugugugguccuuggucaccagcugcuuucacuggacauguuuucaagguucaucugguaguagcauucaucaguacuucauuuccuuuugcugcucaguaauguuccaguguaugauagagcacauuuuguguauccauucauuaguggguggacauuugggguuguuucuacuuugugaccguugugaauaaugcagcuauggacauuuguguacaagcuuuugugugaauauuguuuucauuuaucuuggauacauaccuaggagugagauugcuggauuauuugguaacucuaugauuagcauuuuaaagaauugccaaccugcuuuccuaauuggccacaccauuuuacauccccaccagcaauggaugaggguuccaguuuucccacauccucaccuguacauaacucucugccuguuugauugcagccacugcuuuuugauuauagugggugugaaguaguaucucauugugguuuugguuuguauuuuccuaaugauuaaugauguugagcaucuuuucauuugcuuauuagcuguuuguauaucuuuucuggauaaaugucugcucagauccuuugccgacuuuuuuuuuuuuuuuuuuuuuuuuugagacggagucuuguucugucgcccaggcuggagugcaguggcgcaaccucugcucacugcuaccuccuccucccggguucgggcgauucuccugccucaaccucccgagaaacugggauuacaggugccugcacugcgcccgggugauuuuuuguauuuuuagucgauacgggguuucacuauguuggccaggcuggucuugaacuccugaccucgugauccacccgccuuggcuucccaaagugcugggauuacaggcgugagccacgcccaucccuuuugccaacuuuuuaacuggguuguuugauucauuuuguguaugggguaagguguggguccauauucuuuuguaugaauaucagguuguccuaguaugacuuguugaaaacaauguuuuuucuccauggaguugaaaaauuauuaaaaaucuuugaugcucgaaugguggugugguggaggaaggaugaagaagguaagccuuaguauuggagaaaaaaacccccaaauggcccgguaaauuguguauaacuuugcauugucuuuguaagaauauaauauagaucuaucugauuuuuaaaauuguuguaauggaggggcuaggcagagauguuuuucugguguauuaauuguauuauucagaaauaacuagaguggugauggcagugaaauggcagaguuggcggcuccauaugccugcccuuccacagaaacauugaaaaucaagcagaaacuguuagaacuaacuacuucagaccucuagaaaagucaaagguuuacagcacccaggaaauugcugcauccagagaaagucaaccuagaaacaguuggaaagcuuuuuccccacaauuguccugaucucagcaccuucucccaacacuguaacagggcacuaaucuugaagauaauggcccauguucccaguuugcagcuuauuccaaauaauuguuucugccucuaaccagucgggggacugcuuggaggguugacccuaggugcuugucuuuuuucaccuaacuugaacucagggcagaaaaguagaaauguagcgccauuucucaaacauaugcaaggcuaaugaauagccuguaguagcagagggcaaaagaugacagucaagccagauaguagagugucaaaugccaggcagaagaagcuagggagggaguuucuuugggaaauuugagcauucaaaaauuccccuguguaugcuggggaauuuuggaagcgacaugcaagccaagaacuggaggaaugcucagauccaaagucuuucccucuggccagucucuaggcucagugcaagaaggaagggaaggaugcagcacaguuguuaauggccuggcuaaaucuucagugaggcugccgcacagagccaggcuccaaagcccaggacagguuuuguuuggguuuguuuccuccuccccccugccccuccuuuuucucucuucauuuugaaggaaaucuuugucagaacacuggcugaauauaagaauggaagagagacuuuagagaccauccaugauaaagaauacacacuuuacaaaaauaguguagaaaaaucaguagacaaacacagcuacagcauguaacaauaaaaucaaccaagaagagggagaaauagcuaauuuccagaauuaccagauuauaauguauguccaguuuucuuuuuuucuuuuuuuuuuugagacagaguuuugcucuguugcccaggcuggagugcaauggugcgaucucagcucacugcaaccuccgucccccggcuucaagugauucuuuugccucagccuccugaguagcuggaauuacaggcaugcgccaccaugcccggcuauuuuuuguauuuuguagagaugggguuucgccauguuggccaggcuggucucaaacuccugaccucaggugauccacuugccuuggccucccaaagugcugggauuacaggugugagccacugcacccggcguauguccaguuuucuacaaaaaacauuacaaagcaugcaacaaaacaaaauguggcccacucccagaagaagguaauaguaacugccccugaggaaagccagacaucagacuuaggagacaaaaaguuuaaaucagcugucuuaaaugugccagggcgcucaaggaaaccauggggauguugcuuaaaagauaucagaaugauguagaagcaaguagagaauuaucuaaaggaagcaaacaaauucuggcacugaaaaguauaguaagugaaaagaacacucacuggagggauucaguagcagaauugagcacaccaaagaaacagugaacuuaagccuaggucaguuguauuuauccaguuugaggagcagaaagaaugggaaaaaaaaaacaaaaccgcucuuaagagaccugugggacagcaucaagcguaccaaauacacaugauggagaugcaagaagucgaggagagagagagaggacagagaaaauaugugaaggaauaauggccaaaaacuuucuaaauuugauaaaagacauuaaucuguacauucaggaaguacagcaaagcacaugaaggauaauacgagaaaaauccauaaugagauacauaaccaagcagcugacacccacagaccaagaggacacccugaaagcagagagagagagagaaguaacuggucacacacaaggaacccuccguaggauuuaucagaagccauggaggucugaaggcaguggggugacauuuuuaaaauggugagagagagagaaaaaaaaccugucaguuaagaauucuauaucugguaaaacugucauucagaaaugaagaaguuuucugggccugguggcccaugccuguaaucucagcacuuugggaggccgaggcagguggauaacuugagguuaggcauucaagaugagccuggccaauguggugaaacccugucucuacuaaaaauacaaaaaugagcugggcaugguggcaugcaccuguaaucccaguuagucaggaggcugaggcaggagaaucgcuugaaccugggaggcagagguugcaaugagcugagaucgugccacugcacuccagccugggcgaaagagcaagacuccgucucaaaaaaaaaaaguuguuaagacauucacagauaaacaaaagcuaauacgcuuucgugcaucuaagggcauuaucaaaaauguaaaaagaaagaaugagagaaaauuguauaucugauaaggauccaguauccaggauacauaaagaacucuuacaauuucaacauuagaaagauaacccaauuagaaaauaggcaaaggaccuggacaggcaauucuaauucuccgaagaaaauauacagauggccaacauacaugugaaacgacagucagucaacagccuuagaccagagggaagugcaaaucucuaugagacaucaccauacaccacuagguuggcuguaauuuuaaaauauagaauaucgagugcuggagaggaucuggagaaauuagaaucuuugcacauugcuugugggaacaaagugguucagcagcuguggaaaacacacugucaguuucucaaauaguuaaaaagaauuuaaagcagggacccaguguuuauuuaguguuuauucacuauucacaauagccaaagggugauaauagcccagauguucacuaaaagaugaguggauaaacgaauggauagcaaauuucuaugauggaauuuuauucaggcauagaaaucaugaaggguugcuacaugcuacaaccuggaugaaccucaaaacauuaugcuauguggaagaagccagaugaaaaaggucccauauugugugacuucaucuauaggagauauccacaauugguaaauuaguagagauaaacugcagacuggagguggccauagaugagcggaagaagggagcacgaagcaucugccuaacaggcauuggguuuccuuuuuuggugaugaaaguguuuugggacuugauagaguuggucgcacugcauugugaauacagucaaugccacugaaugguucacuuuaaaauggcuuuuuauguuacguacguuucacccaaaaauggcauaaaauguugaggaagaccuucugcuguuacgucuuuuguacuucugugauacuugaacuucagguacuuuaaaaauaauuuucaguauguuuauuucaaauguacaugaaaauuuaccauuuaagaaaaauuagccaucauugcuggucaucuaagaaguagaaguuucacaugucaauaaugauaaugauagcuacuuuuuuacuuccuugugugugucagauaacauucagaguacgaguucucauauccagcaucguccaagcgggaguugaugugcucuccgaguucuagaugagaaagcugcgguuugugaauaguuugcccugagccacaguaguuuuagguagagcuggugcuugaaccuagaucauucugacucuaauccaguguucuuucagcuguggcacacugcuucauggcuggugguucugauacagauguuugaugaguaaaauccguaguauuaaaaaaugcaucaguuuaggcuuauuauugagcacaguuuaaaauuuacuuuuuuauuaagaauauuuucuguugaccuccuccucaguuuccaguauuucacaguuaccucuuugaauggcauugauggcagccuccuugugugccuuucuguaguuugcuggaccauauuuacaacauuuggacugugucauuuuggaguucucaagcacauucuuauagaaguaaacuggaagaauguucucuguuacuuuuuucuuuugaaaaggaaagccacuuauaaauacgcuuuguuuggaagcagaaaauauuuuaaccaguauauuaucacaaucacacugaaauuauuuugaguuaucuuguguuuuauuuucugauaacuuuuuuggguguaggaauuuucuauguauguugcuguuacuuuacuuucuucuuguuuaugacugcuuguuuuuguuuuguuuuguuuuuaguagaggcaggguuucaccauguuggccagguuggucucaaacuccuggccucaaauaaugcacccgccucagccucucagagugcugggauuacaggugugagccaccaugcccagccuuucuugaaguguacuuaaaucauuuuuguuuccguggucugacaccugagcagcauuugaaaaggauccaucccaguauuucauucaggaacauucaguauacauccugguauuagauuggugcaaaaauaguugcaccaaguaauuuugucauuggaaguaauggcaaaaaccacaguuacuuuugcaccaaccuguauuucugcuauguaaugauauuucaugaacaccuuccauuuuuuauuauuaguucucuguggcuggaccaagguagauauacucagauguggccauauagacucaggagugguuauaaacacacacacacacacacacacacacacucacucucaaguggguagauacacucagguguggccauauagauccaggagugguuauaaacauacauacacacacacucaaguagauacauaaacucauuaccacuguuucuucucaggucacccuuagaggaucugugugaauucauuucuucaugauauaucaacuacaagucuuuccauccuuccuuuucacuugagaugugugugcuaccucuaggucucaccagugcuucuaaccagggagauacuucuuagucacuaaagcggacugaggucugccccccgcagccuuugaacagcccuuagcugggccuggcugaugggacuuuacuggcggcccugcagcuccuggccuggcuccagcucugacuccagcugucucuucuguccgaagugggaaauggacuccucacugcugauacugcuccaucuuuccuuugcgguagcacucuccuuucaaaguaaaaaguauuuuccaaaagugcaucugaugccauuuuauggcuuagaacccuugagucgcaugugacucuccagcucccuguggccuggcucuggccaccugcuccagcuccuucugugauuuccgaagugugguuguacugguuuuuccuuuaguucuuuggauaggccucuccuuuucccucuuagagacuggcuuuuaaaguaauagccacucugucuggugguucuuguucuguccuguacuguuuggccacuuccuacucaaaacuucagguuuuauuaaaagauuaucuuagagaguucugccucgauuucuuccaguguuauuccccaccccagcccacacauacaucccauggcaccuguaccucccuguggggaguggcguuacucugaggacuacuuuaauuccuggacucucaguuucgugagcuugggguccugguuucccccagaguaaguagagucauuggcauggcauguggugagcacucagugaacugcgggagucaagaaagaaagaaguuccagauccagaugaaagugcugagccuggucuaaggccagggggcugcccugugagauggcaccaguuugcguuuccauugugccaacaaauguccuuccuugcccacucauuccaguuaaaaaaguuucauuguucauuugugaucuuuuauaaauuacuuaauaccuuuuguuucuuuaucuauuuuuaccuuauuacaauuuuucuacuaaaaggaauuugccuuugucacauguagcaaauguuuuuaccuugacuuauuuuuaaaaaaucauuuuucuuggauguaauguauaauuuuuauauaauuuaaauauccugaucuuuugugauuuuuacuuuaaucuuggaaagucuacucauuccccauauaagugagcauuguguuuucauacaguguuucuggauuuucauuuuuuguaguuaagguuuacugcauuuguaauuuuacacuuaagauguauacuauguggagaagggaucuuucuuuucuuuuuucccccacaaaugcucagcaguuguuuugaaaccauguuuaaaguuagcagaguucuuccccagaccuuugagacuuaaccagguuuguuguccaaggacucagaacaugagcuggcuccacugaaccugugccucucagccugaguacaguaugggccuuaugugcaccagagcuaaucucaagaugaauuuuauguuuuauauuacuuaacaugaaaagccccagacuccaagucauccuucagauucugcauuuuaauuaccaugggauacuguguaucuuuauucuuacccuuggucuuguuucacugugcuuccagaauucauguucuguuuuucccuucauaaccugaagcuuuucuaucuauggauucuucucugaaugugccuucuugcucucauuaaacuguggcucuuuucugagggcccacauccuaaacagacucuuugguagcucuaguuuuggcuccuguagccuuagugccacuccaccugcaguuaggccccucuuuccggcucauucucuuuagugccuggacuucaguucguuuucaaccuccaguuuauugacuuugcauccuuucuaccauuccuagccccuucgaucuucuauuugaagaaguccaguuggucaguuuuauuuaugauugugcuuuuguuguucuaagaacucuuuuccuaacccagguuuuacaaauguuucuuucugcucuguuucuccuguuuucuucuagaaguuuuuuuaguuuuaggaauuauacuuacgaauauccauuuugagucuauuuuugucuacugugcagaguauggguguuuuuuugcauauggccauucagucguugucaguacuguuuuuugaaaaagugauccuuucucuacugcauugccuuuaaacucuucauguaaguuuaucucuggacccucuuucugcuccauugaucuguuugucugucuguaaacaucaugcucuuuugguuacuguugcuuuauaauuuuugaaaucaagccuuccaccuuuguucuucauuuucagagcuguuuuuguuaaggaaauacaaagggccuacaucuaacaacuaauacuaguguauuaauacaacuaauuauuaauacaacuaauuaauacaacuaauacuaguguauuauuuggcuuaccaauuucuacaaaaaagccuucugcaguuuugaaugggauuucauugaaucuguaaauccauuuggcagagaacugacauuuuaauaauauuuaaucuuuugacccaugugugagauacaucuuccccuuuaaaauuuuuuucucagcaguguuuuguuguuuuuugaggguuaguugucuuuuaucucagcuuucaauauuuuguuacugguuuugagcgauuugauuaugaugugccuagguguaauuuucuuuauuuuuuuaugcuagggauucauuuaacuuuuugaaucugugggauauaaguugcauuaaauauggaaaguguuuagccuuuauuucuucaaauauuuuuucuucccucuccagugucaagguuuccaguuauaccuguauuagacuguuugagguagugacacauucauugauguuuuuaaauuuuucuuuuaaauucuuuuuucuguuuuauuuugcacaguucuauugcugugucuucagauuuacuguucuuuccuuccacaaggucuauucuauuguguguuagucuguucucacgcugcuaauaaagacauacccaagaccgaguaauuuauaaggaaagagguuuaauugacucacaguucagcauggcuggggaaggccucaggaaacuuacaaccauggaggaaggagaagcaaacacguccuucuucacaugguggcagcaaggagaagugcaaaaaggggaaaagccacuuacaaaaccauuagaacgcacucacuaucacaaggguaacagcaugaggguaaccgccccaugauucauuuaccucccaccgggucccucccacaacauguggggaguauaggaacuacaauucaagaugagaguuggguggagacacagccaaaccauaucauacuuuaauuucauuuguuguauuuuuuaucucaagcauuguuuuugugucuggaaguuugauuugggucuuuuuuguauccuucaugucucucacuuucuggucugggaauacaguuuucauagcuguuuucauguccgugucugcuaauuauaacauuugugucaguugugggucaguuuugauugaaugguuuuucuccucguaugggucauaucuucuugcuucuuugcaugccuauuaauuuuuuauuggaugucagacauugugaauuuuaucuuuuugggugguggauauuuuuauauuccugcaaauauuguugaguauuguuugggaugcuguucagcuacuuggauaggccuugcuuuguugcaucauuggacagaucuggggcaugcuccaugggguugguuauuccccagcgugaggccagacgugcucugugggucaugggcuucuccagucuggcucgaagggcacuuuguaaacaugggcauucucuguuccuuuuggauaucccccgucacugccuuccuuucuggacacucaguuuuucucagcaugcaggcauguucuccuucaggaacucugcccuggcccuuccuucagccucugcaugcucuuagaugccuguucguggccuccgcacuguuuccugacuccuggcuccaaugccuccuuuucuaggcguccucuccuaacccugcaacagucacagaugcccaccuuugcucuccaccagcauccugggccgugugcucugcccucauuuuuccauagcaccugcuacauuccagcaugccauacacccuuuaaaggugugccauugucacuaauguagcacaggugccugcaguaggaacuggaauguaguagguguugaggaaauggguuaaguacugucuucagauuuuguggagguuugcuguacuucuuucuugaaguauguucucagugcuuuaauacauuuuaggaauucauccauuugaauucgcuucuguggaguguuuuacagccuagaguaguaaugccaucuacaucauaagauaaauuguaacuuuuuguucaacuagaauuuuuaccaguauuuauguuuauuagguaagaaauuuuagaauuagcuagaagauagcaguaauuuuguucaacucaguuuauuggaauuauuuuuaggaacguuuauaugaaauauguggauguuguggccugcaaagaaacuaauaugcucaagugacacaguuuuacaugagaaagcuccagccuggaccucaguguuuuugacuuacauuucacacaccuuugcaagcagaauggagaggaauccuaguuuguucacucagccacuucaucacgaaauguuuauuguguaccugcuuagggcuuuggcacaucccauuuacuuacuuaaacgauaugccucaaacucuacagagauacauggaugugaguaauuuggcaaugagucuaccugcuuuugcaguugaagaucuuagagaucuaaguuuuguuuacuuugaucagcauauucauuuaguuuacuugugaggugguaaacuaucaucucaacuaaauuuguuuauagaaaaguaaguuauacuuuauuucacuuuaauggauggauauuaagauguaaugauuaauuacuagaaguauuagaaccuucuguucauuauuguuguucuuacauuaaaaaaaaaaaaaaaaccaguauuggccgggugugguggcuccugccguauucauagacugauguggguggauugcuugagcucaggaguuugagaccagucugggaacacggugaaaucucaucucuacaaaaaauacaaaaauuagccgagugugguggugcguacuuguagucccaucuacuccagaggcugagguggggggaucacccgagccagggagaucgaggccacagugagccaugauugugccacuauacuccagacugggugacagaaaauaauuuaaaaaguuacuuaauuaucuaucacucauaccuuguguguguguguuuggauauaaauacauuuuuauccuuaguugcuaguauuuguguuuaguaggucuuacuuugcuaugugccuuaauccguuaugacauugacucauuuuaacuacuuaggacauuuuacuuagguuguaaguuccuuugauuuuaaaauggguuaauuuuuuauaguaaauccacaaaccaguaauguggucauuuauuaucauuaucaagucuguucaguacauaaucgagugugcuagacuuugacacagcugcagugcuguggauguuuugcagcaggauguuuuauaccacaaacacgugacucccuccuugugcugcgguggcacgucagcuacuacaucacugggacaguaagaauuuuucagcuccauuaucaucuuguuuuccccaaaguggcuguauuuuauuuuguuuucauuuuuaucuuuuaaauuuuugugaguacauaguagguauauauauuugugggcuacaugagauauuuugaugcaggcauucaauggguaauaaucacaucaggguaaaugggguauccauccccucaagcagguauccuuuguguuacaaacaguccacuuacacucuuuuaguuguuuuaaaauguacaaguauuuuugacuguagucacuuuguugcucuagcaaauauugucuuauucauucuuucuauuuuucauaccuauuaaccauccucgcuuccccccacaacucccacuaaccuucccagccucugguaaucacccuucuacucucugucuccaugaguuuaauuuacuauggguaaauuuuggauaugcauuuggaaagaagaaacuacaugucauaaaaguauauuucaguuacccuuuaaaccuaucguaggaucugaaauuuaguggauacucagauauuuaaauauugauagcauuuuaagcacauuauuuacagguauauauaaaauauuacugguguuaauguggguuauuaaaagcuucacagagguuagacuugcugugucauuaagucugggaagggagggauuucaauccaagggagcaagugcugggagcuucugcgaguaaguggagggacgagguucccggugagguagagcaggggccgacagagauggaggagccagcugguaaagccuggcagcuaacuuaggguccauuuugaggaacuuauauuuuuugauacaaauaugauuaucuucuaaauaauuaucaucgaauggaauuuuuugggggggaauuucuuuaguuuuuuucaacucauucauuuggaauuagggaaauuauaguauuauauuuucuuuacacgggcagaaauuaaugacugguagugggguuggugggcagguuauauguuuaagaagcauugguauaagaacaggugguuauggccaggcacgguggcucaugccuguaaucccagcacuuugggaggccaaggcagguggaucaucugaggucaggaguucaagacaagccuggcccacauggcaaaacccugucucuacuaaaaauacaaaaaaaaaaauuagccgggcaugguggcgggugcuuguaauccagcuacuugggaggcugaggcaggagaaucacuugaacccuggaggcggagguugcagugagucgaaaucgcaccacugcacuccagccugggcaacaagagugaaacuccaucucaaacagcagcaaaaaaaagaguagguaguuauuugguauacauuuggaucuuucucagaggagcccauauaauuuguuguucaugggaacaagugagaugaaugcuuuuccucuaugaggaaaaacccacuugugcuauuauguuucugaaaaauaauggaagggaacauuuauugcuagaaagauuuaguggaaauauuuaauugaaauaguuuagagaguggaaaguacuguuguuaccuuacuuggcgauaccguuuggcuguguccccacccaaaucucaucuugaauuguaguucccauaauccccaugugucaugggagggacccagugggaaguaauugaaucaugggagugguuacccccaugcuguugugauagugggugaguucucacgagaucugaugguuuuauaaggggcuuuucucccuuugcucggcacuucucauugcugccaccaugugaagaaggacguguuugcuuucccuucaccauuauugauuguaaguuuuccaaggccuccccaguuaugcugaccugugaggcaaugaaaccucuuuccuuuauaaauuacccaguuuugggucugucuguauuaguagggugagaacagacuaauauacuuggucacuauuaacuaguucauuaaaaaacaaaaagcugauaauacacgacuuacugagugugcacuugauaguauauugaauaggauaguuuuaagaaaaaaauaugucauuagauuuaaauacuagcauuuacauugaaaugucuuugcuacuguauuagagcuuccuucucuaucaagugcaacucugagauuauuaaauucugaguguccauuuccuaaacacuuugugucgucgauugcucuguaagauuauugaggccaggugacaguuguguguuuuauaugugcccagugacucuuaaaauugggagauuuuucuguuuuuaccagccucucucaaaucugauauuaguauauuacuaggaucaguugucagcuccgucaacaaaguguuagccagaaaucaaauauuuaauguaaguguaggcuguuagaauguggcagaaaaaguaauucaugcuggaccuucacugguggacaggugugugaaagcggguaacuuuccuccccuguguucucuguccagugccuuaaauguucuuuggcaaagaggacagcaaauaaguuauuuaagaagcuaggacuugauaacaauaugaucauuucuucaaaauuuagauauguguacuuugagcagauauauaaggcagguggucauacuauuuuguuacuguacucuguuuagcuuucuaauacuuuguucauuguguaauagcauuuugagaacuuuuuaugcuguauuugaucauaaacuuuuuucguuaaacauguaauugaagguaauuuccauagaaauuaaucgugaucacuauauaaugccugagaauuaaaggcuauuaaauauguuaacucucuuaccgugcuacagaauaauaaaucucucagaaauguuagaucuuaauuacagagucagaaaggauauguuuucuauucaaaauguuuuaaaguuauuuacuguauuauguguuaugacuguaguguuucuuuuucucuccuuuuaagauguguugauuacagagaaugugaaaaaaauagaaggaaagaagggugaauuggauagcuaggagagagggugaaauuagaugaugaaguaggaacuuuaggucaguggggcaucucuacugccggaugcuuugcugugaaaagcauagcagugggggaggaggccugaagcuccuaaugcucauaggaauuaaaguggacauuuuauuacaauuaaugauuuuaaagcucaguuaagauuuguuucacacguaauucuaaagaccauugcuauuuuauaauauaaauaaaaauagcuucagcccuuauuggcuuguauaauugaggcauguagaaaaaacuacaacauaaugcauauaaaaguuuugauauauccaaaucuuuaggaacagugugauacuacugaaauacagcugcuuuaagagguauuugggaaauacgaucuuuuaauaaguuggauaugggucuaaaagucaguguaacgagugugauguuaguuuuugauagcugucaacauaaacugaauguaaaaggaaggaacauuuucccuuguuaggacaguaauuacaaaaauguaaaaauuaacacacaaggccauugcuagucuuaaaagagagugagacagggagagagugaggaagugagggaaagagguugggagaggcccaggaagagaaagaggggcagagacagacagaaagggaggaagggagggaaugaauuugccuguuuuguuacgugugucucaaauuaugggugcaacauucaucuacucuacaucauauuauacaugauauuuaaguauauaugaaacuuugucaacgacuauucuacauuagauguuucguagauaagaauuuauucacauagagaaaucacuuuuaguaauaaaguuuuagauauaacuuuuucacucuucuccuguguugguaaagcuauugauagagggugauuuuacauauaauuugcuuuauuucuuuuuuggucaguuaugugcuaauuaaugccauuuaugauauuaacuuaaggauuuuuacaucucuguguuaaguuuuaaugcugagaucauuuaguaauauuucugaucauuguugacuuggaacugaaacaauuacaaaacaugggaauaaucuucugaguguaguccccuuuuaaauuacuacgaagaaauucucccucuguuuuuauugggagauaaaaaauuauuuguguuuggcaguuuacuaagagaaguuaauuauuagugacugucugaaaguacaaguauagggaaauuucuaaaguuuuuuuuucuguagcuuauuucuaaaguaauuauuuuuuaauugaaaguugaacuugggugugcuguuguuuccuugaguugacuguacuucuucuuuuuuuaagguaaagugcaaguuaagaguucagacauacaaguuggagaccucaucauaguggaaaagguugaugauuuuuuaauauauuuuagaccuauguaugcuaguuauuaauguuuagccugauuauaaguaacuucugaauuugaaagaaauugagacauguauuuugaaucauaauauccuuguguaagauuuguuguaugugaagaaaaaucuagauuuuuguauauuguuuugcuaaaguauauuucagugugugcaggcaaagucauauuuuuucugaaauaagaugguuaacugcuuaauguugcauuaucaagauuauuuuauaucaucacagaauuguauucaaaccuguucauaauacugugcuucaguuuucagaacuuccuccuacagggauaaucaucccucaauauccaugagaggguaguuccaggaccccaccaaggauaccaaaauccacagaugcugaaauuucuuauauaaaauugaauagucuaugcaucaauaaauccucuguaugcuuuaaauuagugguccccaaccuuuucagcaccaggaaccaguuuuauggaagacaauuuuuccauggaccaagguucagugggcuugguuuugggaugaaacuguuccaccucagaucaucaggcauuagauucucaugaggagugugcaaccuaggucccuugcgugugcaguucacaauagggcucuugcuccugugagaaucuaaugcugcugcugaucugacaggaggcggagcucaggaggucaugcucgcuugcccuccccuccccuccugcugugcagcgccauucuugaaaggcccgggguuagggaccucugcuuuaaaucaucucuaguugauuuauaguacuuaauacaaugcaaaugcuaucuaaauaguuauacugucuuuuuuuauuuuuguuuuauucuuauuuuuauuuuuuuucugaauauuuucucucaaugcuugguugaauccccaucuauggaacccguggauacagagggccagcuguaguuauauuacacauaauuauuggauauaauucauacaguuaaaaaauuuaagagggaaaagugaauagaaguaaaagcauuacaaaagaagaaguuuagaucaguguacgaagaagcuauaagaaaaacaucaaagguccaacguggagauugucagggcugcuggcgguguggagagugacugaaggugcaagcugcaugucgggggagcuggcggugugcagagugacugaaggugcaagcugcaugucggagcuggcgguguggagagugacugaaggugcaagcugcaugucgggggagccggcggugugcagagugacugaaggugcaggcugcaugucggagcuggcggugugcagagugacugaaggugcaagcugcaugucgggggagcuggcaguguggagagugacugaaggugcaagcugcaugucgggggagcuggcggugugcagagugacugaagguccaggcugcaugucgggguugcuggcggugugcagagugacugaaggugcaggcugcaugucgggggagcuggcggugugcagagugacugaaggugcaagcugcaugucgggggagcuggcggugugcagagugacugaaggugcaggcugcaugucggggcugcuggcggugugcagagugacugaaggugcaggcugcaugucgggggagcuggcggugugcagagugacugaaggugcaagcugcaugucaggggagcugccgguguggagagugacugaaggugcaggcugcaugucgggggagcuggcggugugcagagugacugaaggugcaggcugcaugucgggggagcuggcggugugcagagugacugaaggugcaggcugcaugucgggggagcuggcggugugcagagugacugaaggugcaggcugcaugucgggggagcugacggugugcagagugacugaaggugcaggcugcaugucgggggagcuggcgguguggagagugacugaaggugcaggcugcaugucgggggagcuggcggugugcagagugacugaaggugcaggcugcaugucgggggagcuggcgguguggagagugacugaaggugcaggcugcaugucgggggagcuggcggugugcagagugacugaaggugcaagcugcaugucaggggagcugccgguguggagagugacugaaggugcaagcugcaugucgggggagcuggcggugugcagagugacugaaggugcgggcugcaugucgggggagcuggcagugugcagagugacugaaggugcgggcugcaugucgggggagcuggcggugugcagagugacugaaggugcgggcugcaugucgggggagcuggcggugugcagagugacugaaggugcgggcugcaugucgggggagcuggcggugugcagagugacugaaggugcgggcugcaugucgggggagcuggcggugugcacagugacugaaggugcaagcugcaugucgggggagcuggcggugugcagagugacugaaggugcacgcugcaugucgggggagccggcgguguggagagugacugaaggugcaggcugcaugucgggggagcuggcgguguggagagugaccgaaggugcaggcugcaugucgggggagcuggcgguguggagagugacugaaggugcaggcugcaugucgggggagcuggcggugugcacagugacugaaggugcaagcugcaugucgggggagcuggcggugugcagagugacugaagguccaugcugcgugucgggggagcuggcggugugcagagugacugaagguccaugcugcauaucgggggagugcauucggaguguucucaucugucucaucccugaccacgugaguacgcaggacaccugugucuguguuaagggaguucguuccuaagugcucucaucugccuacuuccaugacugugugaguaaaaagggcucaggucacacacaagaaggaagaaauuggaaacccaggaacacauaucagaggaaaccaacugaaaacaaauaauaaaaugcagacguacguucuaauggucuaaauacgagacagaauggauaaaaaacaaaaaaaccaagacgcauuucuauguugugugcacgaaagucucuucaaauacagugacauagauaggaugaaaguaaaaggauagaaaaauagauacaauguaaaauuaaacaaaaguaguaggagcuauguuaauguccaagaaaguguacuucagagugaagaaaauuaacacagacaaaaagagauguuauacaacaauaauaggauuaauccaucaggaagauacaaugaucauaaauuguuacucaccaaacaacaguuccauaaaauucgugaaucaacaagugucagagcugaaaaaaguaggcaaguccaguuacaagugguuacuucagcaccacccuucaggcauuggauaaaaguaggggauagacgcuccgcagugauguggaagauuugcauaggcagcaggaguugccuagcaugcauagaccaccguaccugucaguaggagagaacacauuuauuucaagugucuauagaacauucaccaagauaagccauuuucuguaccauaaaccucaacaaauugaaaagaauugaaaucacacagaguguguucucucacuguaauagaauuguuaaaaaucaguaaccaaggcagcaggaaaacucuaaaacguggaaagugaacagcacacuuugaauuaauuuauaggauagguagucucaaggaaacaauacauacagcugaauaaaagugaaaauucugcauucuggaauaagugggaugcguguaagggcacugcugggaggaauucuguagcaugaaacuccuguggggaaacaagcagaggucuugggucaguaaucuaaaccccuacugcaagaaauuaggagaagacagcaaaguuaaaccaaggcaagcagaaggaagggaauaauaaagauacaaguagaagucaguaaaauggaaaauaggaagacaagauagaaaaucaaucaauacaaaagcugguucuucuaaauaaguuaauaaaauugauagaccuuuagcaaggaagacugaucaaaauaaaaagugaugucacaaaucaccaguauuaguaaugaaauaggggcuuucacuauagauccugcagccauuaaaaagacaguuaugaaauacuacaaacaccuugaugcucauaaauagaagaaauggacaaauucuucugaaaccauaaaguauaagaacucagucaaaaugaaauagacaauaucaguaguccuguagccaauaaagaagcugaauuaguaauuuaaagcucuaggaaggaaauaccuagguccaggagaauuccuuaaaaccauuacagaagacuuagcaucaacuuugcacaguuauuuucagaaaauaauugagaaugguacacuacccaacucauuuuaugaggucaagaauaucuuuaucucaguaccagaaaaaaguacaauaaaagaaaacugcagcccaguugguaucagcaguauauaaagaagaguaauacaucacaacccaguacagguuauuccagguguguaaaugugguucagcauucuaaaaucaagcaguguaaucuacgcuaucaacagaauaaagaaaaaucacacaaucaguuguugcaggaagaccauuugacuuaacccaacacucauucaugauaaaaacucugagcagguuggauuagagggacaguaacaauaucuuguuuaaaaagaaucuauaaaauacuuaaugguguaagacugaaugccuccucucugagacuggcgacaaggauguuugcuguuacuguuacucaauggcacuucuagucuguaaggcaagaaaauaaaagauggauuagaaaagaaauaaaaaugucucaauuugcagaugacauaacuacguauacauguacauaaauacauauacauauauguugaaaaccccaacggaucuauagaaaaucuccuggaacuagugaguucaacaucgugucaaguuauaagauugaugcacaaauaugaaccucauuuuuauauaauaaugaaaaugugggcacagaaauuaaaaaugcaguacucuuacagucauugcuaugaaaaugaaaucuaugcugaaacuuacaauguguugauaaaaguaaucuaagaaaacauaaguaaauagacccaucucuuuucgauuggagcauucugcauuccaguuuucccaaaauuguuuuguacacuuaauaccauuccuaucaaagucucagcaggguuuuuuucuucuuauuuuuaaagacauagaucaucuuacucuaaaacuaauucggaaaggcacagguguagaacagcuaaaccaacuuugacaaggaaaauaaagugagaggaaucacccuugaugugaaggcauauugcguaguuacauuagucaacauaguguggaagaaggauagaaacaaagguuaacaaaacauuauagagaaaccagaauuagacaaaggugugaaaacaauuaaguggagaaaagguagccuucucaaauggcgcugggcauccugagguuuaaaaaaaaagaucauggacuuaauguaaaaugugaaacugcaaaacuuuuagaaaaaaaaaauauuuagaaucuaggaauaggaaaauauuucuuagacuugauaccaaaaggacaauguguaaaaggaaaaauugauaaauugcauaucauuaaaauuaaaaaugugugccuugugaaaaccaugugaauacaaugaaaagcuacagauggagaaaauauuuguaaaccauauauucaacaaagauuucugucuagaauauauaaaaacuccuaaaacuuaacaguaaaaaaaaaaaaaauuugaaauuagaaaaugagcaaaagauuucaagagacauuuugacaaagauuuacagauagaaaauaaacacaugggccaggcacaguggcucacaccuguaaucccagcacuuugggaggucgaaggggacggaucacaaggucaagagaucaagaccaucuucgccaacauggugaaucccuaucucuacugaaaauauaaaaauuaguugggugugguagugugcaccuauaguccuagcuacuugggaggcugaggcaggagaaucgcuagaacccgggaggcagagguugcagugagccaagauugcgccacugcacuccagccuggugacagagcaagacuguaucucaaaaaauaaaaaaauaaaaauaaacacaugagcaggaauucaacaucauuagucaucaggaaaugcaaauuaaaacacaaugaaauaucaguaugcaucuaucagaacagcuaaaaugaaaaaauggugacaauaccaaauauuggaaacaaugugaagaagcggaucacuuguauauugcuuguggaaauacaaauaauacaguuauccuggaaaaucgcuggauaguuucuuaaaaaaaaaaacuguaacuaucauacuacccaacaguugcacuccuggacguuuaucacagagaaauguuaaauuauguugauucaaaaaaaccugugcaggaaugucuguaucuacauuauucacaguagcucaauuccagaaaguccauauaucccaggugggugacuggucagagaaguagcugugcguucacaccguggcaugugguguuaggagaacacagggcuccuugcucuuguggugccccuaguuuugaggggaagcaaaaagaaacaaaaaguguccauaauuauuugaaauuaucuaguuuguuuaugaguacuccauagaaaauaagacagaauaaggacauaaagagucugaauaugacauuuuuaaaaauacuuuuaaaggccgggcaugaugauucauaccuguaaucccagcacuuugggaggccaaggcgagaggaucacauaaaacuaggaauuugagacgagccuggacaacauagaccaaaauuuaaagaauuagccaggcacaguggcauacaucugcuguccuagcuacuugggaggcuuagggaggaggauugcuugggcccgggaauucaaggcugcagugagccaugaucauuguugaaacguauuaaagagaccaaaguaaauguaagacaguucaugcccaugguuagaaguauguuauucaaaaggcaguguucccuaaauugaucuguagauucaguguuaccccucucaaaaucccaguugaugucuuugcagaaauugacaggcugauucugaaauucauagggacauugaagugacccagaauggccaaaacaauuuugaaaaagauggacaaacuuugaauacucgcauuucacuauuucaaaacuuaaugcagauuuacaguaaucagcauuuacaggaacuagcauuacauugagaauccagaaauaaacucagaaauuuaugguuaauugauuuuuggcaagagugccuagaaaauuuaccgaggugggaguguguuugggcaggugcuuuuuuggccccauguucuuuaugagauacauccauguuguugugugguuguuacccacccauuuggguguuauauagugugguuuuuaucuguuuuccugucgauggguuuuuagguuacaucuaaguuuugcccaucaugaaggauacuuuugugucauauuugacuauauuucuuggugcauacauccacacauugcuguugcaggugugccuaggaguggagcugcuguguuuuggguuaugcaguuccgcuaugguagacccugcacgugguuuugcaaagugguguaccaaauucuacuccaaucagcgugccuuggcauguuugccagcaugugcauuuucagccuuuuaaaauuagcauuucugauauguauguagaaguguuuuuuuuuuuuuuuaugaaguucugggauacaugugcagaacgugcaaguuuguuacauagguauacacaugccauggugguuugcugcacccaucaacccgucgucuacauuagguauuucuucuguugcuaucccuccccuaaacccagagugagcaggcaaccuacagaaugggagaaaauuuuugcaaucuguccaucugacagagggccaauauccagaaucuacaaagaacuuaaacaaauuuacaagaaauaaaacaaccccaucaaaaagugggcaaaggauaugaacagacgcuucucaaaagaagacauuuaugcagccaacaaacaugaaaaaaagcucaucaucauuggucauuagagaaaagcaaauuaaaaccacaaugagacaccaucucacgccaguuagaauggcaaucauuaaaaagucaggaaacaacagaugcuggagaggauguggagaaauaggaacgcuuuuacacuguuggugggaguguaaauuaguagaagugguuuuaaugcauauuucuaugaagucuaauaagauucaauacuuuuucauaugauuuugugugugucugucuuuuauaugacaagccugcuaaaaucucuuggcauuucucuucugaguuauucuuuccuuucuuaucaguuugugggcuuuuauguacucugguuuggagucuuuuguuaguuauauaugcguugcagauaucuucuuuccuggcaggcuguguugaacagaaauucuuaaguuuaaugaaaucugcuauuaaucuucauuuaagguuaguuuuuuaagacaauuuuuguugauggucuuuauuaagcauccuuaccucucaaaaagucaugaaaauauucuugucauguuugaugaaugacgacaauucaguggggaaagaacuuuuuuuuucucuuuuaggcauuuuauuguuuuggcuuucacauuuagagcuguaauucuagauagauuuuuguguuuacauugaagucgaggucaggugucgucucccaucauccccugacgguacuggguuuucucagcgcuauugauugaaaacacaauuauuuccucacugauuggcaguuucaucuuucucauagugucccuauauauguggaccuauuuuuggacaucuagcuuuguauugguauaaucgucuaucuugguguaaucucaucuuuucuuaacuacucuaguuuaaucuaguuuuauuagguuguacaguuaauccucacauuuaauuucucucaacgauauuuuauaguuuuuuauguagaggucuugcacaucuuuuauugguuucaugcuaauauuaguuuuuuuccccuaguguuagaaagaaauagcucuauccaauaacauagcuuucuucagcuuuaacauguuaccuguugacugacaauccauuuaccauuuauuauccauuuauuuaccauggguagauaagucuuuacuuaggucucaaaaaucauacauaauucaugacauuaugugacguauucuuaauacaauuauauauuuuuucuuuagacugauauagcuuucccaguugauagaacuauuagugauaauaauuaaauguaugaauagugacuuguuagaguuuuuauaugccauaaaaugucuuugaguuuuucugugucaugaaagaauaucuccucaaaucugugggguuuugcuuguuggcuuguucagucauagauuuauucuuucacaucuauuaaguguuuuguguaugaugugcucuguuuugugggcauugcaggaccacaguccuccucacuuuccagggccauuuagucuaauagggaggacauaauuuuuuauaaggcaauaccugcuguguuacauguacagacuaacagaggccacagaaauggcaauauuuaacguuuuuuucagacauaaagcuuuuuuuuuuuuuuugaaacagggucucccucugcuugccaggcugaagugcaguggcaugaacauggcucacugcugccuugacccuccuggcucaagccauccucagcccucagccucccuaguagcugagaccacaggcaugccaccacacuggcugcuuuuuaaacuuuuuguagagguggagcuuugccauguugccucgucuggucucaaacuccuguccucaagugauccucccguguuggccuuccaaaguacugggauuacaggggugagccaccauggcuggcugacaugcagcuuuuuuuuuuuuuuuuuuugagauggagucucgcucugucacccaggcuggagugcaguggcacaaucuccacucacuacaagcucugccucccggguucacgccauucuccugccucagccuguagcugggacuacaggugccugccaccacgcccagcuaauuuuuugcauuuuuuuuuuuuuaguagagacaagguuucaccaugucagccagaauggucucgaucucaugaccucaugauccgccugccucggccucccaaggugcuggaauuacaggcgugagccaccggacaugaagcauuuuugaagucacuacuacauaccauuauauggcucacuuauggggaaaaaaaucuuagcauuucaauuaaaaugugaauuaaaauaucaauuuuuuauauacaaauuguguuaguuauuucagcacaauuuuaauuauauuaucuuaguuguuuucauagguauuucuuauuuggaauggaauuguguuaauuuguaaaccugcauauagauaauuaaucuuuuauaaugcucuuugcagaaucaaagaauuccaucggacaugguguuucuuaggacuucagaaaaagcagguauuuuuacauuuaaaaaaacuuaccuaacuguauauuauugcaaaaacaaauuuacaaauaucuauacaaggaaaaacuguuuuccuuacauuuuuaguaugcugcagcaaugaggaauauucuguagaaaugcuauuuuacuuugaauguaaacacaugaaaccucugaaaagagaguccacauuuucauaugaagcuacuuuacaaaguaaaaacacaugcugcaguuacauugcugaugauuuaguauuuucauaguuuaauuuucacuuuaaaagguaaaaguaaaaagcauccuauaaaaauuuucuuugaaugacaguauauugaauucauuaacaucuaaauuauauuuaauugucaauauuuaaaaggguguuugcugugaaauauauuuguuuaaaaauaauccuuucaggaccuagguauccaaugaguguuuucauucagauucauacugacaucuaauuaaaugaugauguuacuuaaaauuugauggcuauuuugcauuugcaguuuuauucagcgauucagcaaauacuuauuuaccacuuauuauuaauauguaccaggcacuaauuguugcuuaagauacaaaagggagcaacuuucaaagaguuuauagucuugguggaagugcauacauugacagcaauaauccuaacuguauagguacuguacucagaaauguuuggggcuaugugggaacagauaauuuugccuauugaguugaugcagacuuugcagaaaaaaugcuguuuauaugaccugagcuuucaaaaauacuaagauggaaaagagguaauuggauagaagccuagugucgccaaauagaaaaucuguuggaaauugggaaaccugaguuuaaaucacuuuggcccauuucuaguuaugugaccuugccaagugggcacacguuuucaucaucucugaaacgagagagguauaucaaguaauaugcagaguuucuuucugcccuacauuccugacguuauuuauaaaugaacaguaguuuuuauaggaagcuaagcauguuauuauuuuuauuaaaaacucaucauauaucuuauuucuaaugugaaaacuguagaaaggacuguuagauuucagaguuguugauuuaauuuuucuguauuuauaaacaacauacuuuuagaagggacauuuuugucaaagaagaaacauguuuucucucuuuuuuuuuuuuuuuuuuuuuuuuuuugagauggagucucgcucugucgcccaggcuggagugcaguggugcgaucuccgcucacugcaagcuccgccuccuggguucaugccacuccccugccucagccucccggguagcugggacuacaggcgcccaccaccaugcccggcuaauuuuuuguauuuuuaguagagacgggguuucaccauguuagccaggauggucucgaucuccugaccuugugauccacccaccucggccucccaaagugcugggauuacagacgugagucacugcacccggccaaauguuuucucuuucuaccaguuguaguuacaugguuacuuacauugugagaugaauucugccauuaacgggagaucagcucuacccaauaaucaagugacuucuguauacuugauacguuuauuauguguuguuucaugugagcuuuuauuuucccaacuguggcagggacuggcuggcuacuuccagcccauuucucuuuccucuuggaaacacagcuggacucccuuuccugccuaguuagcuggucccaugucacugaacucuggccaaagagggagagccaaaagucuguaugccacaucuagcccugcgccuaaccucuccugcaggcaccugcucaucucuuccgccuugcugguuagauggccaugacuagggcagucuuggaaacugcuuguuaaagaugccaaagcuuccgucagccugguguccugaaugaauguauggaacagagccccuccccuuccauuaucaaauggacucuauauaaacuauuguuaagcaguuccguuugcaagguuaaucuuuuaugauagcugguguuuccuuaacugauuucucauccuaauugcucuucauucuggaagccuucuuacuaauucucuuugcaaguggcauuauuugcuuuugaaguguuacugcuuauauuuugaagccaucauuugccaauauuggaguauaaugugaucuuuuuucaaguaauucugcucuucuuaacaauaauguaaugagaccauuuaggugcuuuugcaguccaguggguaggcugccuucauaguuugucacaugugaaugacucaucucauagugcauugcuucacagcacagacugcugcgugggagaagucugcaggcccuccaguccccggaaaggcucaucuccucaaccacagacagaggccagaauacauaaccuuugaucaugggcguguaguccuucuguguguugcuggguuugauuugcgacuguuuuguuaaggcuuuuuuugcaucuguuuuuaaaggauguauuggacugggcgugguggcucacaccuguagucccagcacuuugggaggcugagguggguggaucacuugaggucaggaguuugagacuagccuugccaacauggcaaaaccccgucucuacuaaaaaaaauacacacacacacacacacacacacacacacacacacacacuagccagucaugguggcacaggccuauaauucuagcuacucaggacacugaggcaggagaaucacuugaaccugggaggcauagguugcagugagccgagauugugcuaaugcacuccaggcugggugacgagagugaaacuccaucucaaaaaaaaaaaaaaaaaaaaaaaaaaaacauguauugacuuauaguuuugguuuugcuuuuucuuguguuauuuuuguuuuggugucaggguaauacuggccuuaguggaaugaguuaagaaguguucuuucuucuauguuuuggaagaguuugugaagaauuauuauuaauucuuuguuaagcguuugauagaauucgcccaugaaacccugugggacuggacuuuacucugauuuuuaaaaaauuacuaauucaguuucuuuacuuguuacaggauuauucagauuaucuauuucuuuccaagucaguuuugguaguuugugucuuuuucauaauuuguccacuuuaucuagguuaucuaauccacuuuaucuagguuaucuaaucugcggccgugcaguuguuuuuaggauuuccuuacaguccuuuuuauuucugucagguugguaguaauguaaccuccuuuguuccugauuuuaguaauugaacucuucucucuuuuuuucuuggucagucuagcuuaaagguuugucaaucuuguugaucuuuuaaaauaaccagcuuuugguuuuaaugauuuuucucacuuguuuuucuguucuuuauuucauuuauugguuucuguuuuuauuguuuucuuccuuccacuuauuuucuguucaguuuagucuucuuuuuguaguuuaagguggaaaguuagauuauuuacuugagggucuuuuuuaguacagguguucauaacuacaaauuuccaucuaaguacugcuuuugcuguauuucaugagguuuggccauacaucucaaaauuauuuucuaauuucccuugugauaucuucuuugauucauugcuuauuuauuuuuaguuuuuauuuuuauuuuuauuuuauuuuuguagagacagggucuugcuuuguuacccaggcuggagugcagugacaugauuauaguucacuaugaugaucacuguaacuuugaaccccugggcucaagcaguucucuugccucagccucccagguagcuagcaauacaggcauacaccaccacaccuggguaauuuuuaaauuuuguuguagagacaggcugugucuguugcuguguugcccaggcuggucuugaccaccuggccucacgugauccucccaccuuagccucccaaagcacugggauuacaggugugagccaccuuaucuggccugauucauuguuuauuaaugaauaugaauuuccucauauuuauacauuuucuaaauuuccuucuguuauugauuucuaauuucauuccauuguaguuggagaacauacuuuauaugauuucuauccuuugaaguuuauucacauuugugaaaaauguccuaacauacuggguauccuugagaauauucuguaugcacuugaggaaaaucuacauucugcuccuguugaguggaauguuccauagauuuuguucuaggucugcagcauuguucaaaucuucuuuuuuuguucaucuucuaucuaguuguccuauccauuauugaauguggaguacugaaguuugucacuauuucucuguuuuuccuucuauucugucagauuuugauucauguauuugaaguucugcuguuagauguaauauauuuauguuugcuuggcagauuggcccuuuuaucauuauaaacugucuucagccaugcaccucucuuuugguuacuguuugcaccuuuuuucuguugucauacuuucuaccuauuugugucuuugaacacgaagugugugucuuguagacagcauguaauugcaucaugauuuuucauucauucugucaaucugcuuguuuaaaaaaucagcuuuaguuaggaaaauucacauccagcaaaauguauccauuuaaaaucuuagcagguauguacacuugcuaauuauuauuauucuccccauccagaugagcucccuuugcccuguuacccugccugaucagcuuuacagcccuacaucagucucuccagugucucuucucucauaccuggcuguagaguuccaacucagaaggccacacaagcaucugacugcagcucugugaaucaguagaguucacuguguaacccacaguguucccguugacuaggcccauuccugaaggcagcuuauuccagcuuucucaguguuucuccugucugccuuuaccaccuguucauuaacucuuagccaucaacccuccccucaaccccgccacuuucagcuacagcuccauugccuucuuccuauaggcguugaaacgugucucuacccagucaccaaagaccacccccaacccccagugacccagcacaccuaucuagcuaccaucccgucucuguccuuugcuuugcagccaaaccuuuugaaugagauguuuuucgucaugaccucacccuacauccccuuucucugugaaauuuaaaugguguuucucaggauucuguccuaagcacaccuacauuugugauguacauguucuuccugggaaacuguaacuucauucauggcuuuauaucaucugauuauacaccagagccugaugggagguagguggcacacucaaaagguuccaucgaucucugccuguugauuggagccuuuaauccauuucuauuuaauguaauuacugauaaggcagaauuuacaucugcaauuuugcuguuuguguucugugugucuugugauauuuuugugucuuuguugcuccauuacugccuucuuuuguuuuaaauauuuucuaaugugguguuuuaauuccccaucauuucuauuauaauguacuuaaaaaacuauuuuguuagugauugccgcagggauuuuaacuaacacagcucacucuuagcuagguuuaguguuuuuguugaauaaaugcuccuggaauucuuucaaguccgguuauuuuccagaguucugaaacaguugcuuuuggcaauuuucacuagucuucucauugcaguuacacagaaguauauuuucagagguuuuuauacugccaucccugcuuacuucaccuacuuauuuaugauuuauuuguccuguuuuacaaauguguauccaguguaaugaauaacaaaaugcuuuaauuugggagaugcuauuguauuaauugcccuuuuaacaguugugauagaaauauguggaagauacuauuccaaauaugaaaacaguuuuggguaauuaauuaaguggaaaagauuauauagauuguguuagaagauaaauuaugaacaaagucaagcacuuuaaagcugaaagguguuuagaaauguccacuuuucagaagaggaaucugagggcuggagaauguaaauaccuugcuuaacauuauaugacuauuagcaauuuuauggguuuguuuguguuuguuuguuuguuuguuuguuuuuucucuuuuuggaggaggucucgcuuugucacccaggcuggagugcaguggcgcgaucucggcucacugcaaccucugccuccuggguuccagcgauucuccugccucagccuccugaguagcugggacuccaggcacgccaccacuccuggcugauuuuuguauuuuuaguagagaugggguuuuaccacguuggccaggcuggucuuguacuucugaccucaagcgauccaccugccuuggccucccaaagugcugggguuauagguguaaaccacugagcccggccacuaauagcaauuuuggaaauucuuccucagccucuuaauguuucacugcaucauuuuuaagccauaguaagacagaaaaacguaaauggaauauuagaacaugacucaaaugagauaaucuauuguguuaaccuuggauaaauaacacuuucaaauugaugauguuuuaaaacauuucucucuaauuuugucuuacauuccauguuguagggagaaucacucuucauaguggaguaauaauauuuugaaggucguggaucccuuugagaaucuuaagaauuaucaccucuuuccucagaaaaauguauacacugcacaggcaugcuggauuuuuuauuguuugcauaucccuggaggauuauugauggguucaaguuagggcccugcuguaguuuguuuuaaucuaugcuucuauuuucauccucaguuuuauuuuuucugucaaauuuaaauuguuaaaauaauaguuacucaaaugcagauauuaagaagucagggcugggcacgguggcucacgcuuguaaucccagcacuuugggaggccgagauggguggaucacgaggucaggagaucgagaccauccuggcuaacauggugaaacgccaucucuagaaaaauacaaaaaauuugccggcgugguggcgggcgccuauagucccagguacuugggaggcugaggcaggagaauggcgugaacccgggaggcggagcuugcagugagccgaguucgcaccacugcacuccagccugggugacagagcgagacuccgucucaaaaaaaaagaagucagauuguuuuuucaugcuauuuuucuucuuauaaaauagaccaaauagcuuucaagcuauauaaaauuuguguuauaauauugcuuucaaucaagaauucuuagcuuuagaaauucuguuuaugugauuuuuaaguaauuaaaguuaucuuauugccuaguuguuuucaguagacuacaaauguacugaauuuuuguaucuacuaacaguuuuaauacuauuuuauugcuuuuuaguuucaguuugaaaaaaucugauaauacacuguuuauuauaauuacaauauuuuaaaucuuagguaugauggaaguccuaaguguuaauauaugcagcauaucccagcuugaacacuggcagcugggugcuugucaguacagcaugguggguugcucauggcaucguauugacuguguauuaacacagaauauucuguugggcugugagcugauuguuuagaauguaaaugaagcugcugauggaucuggugacugauggcuuaaauuccaauuaaucaauuacuucaucacuuucuuaauucagaucaaauaucuccagagugcacacaauucuuuuagugguauuaagagaaauuaaugcuuuagaacuaauuuucaucaaucucuuauaaaugucaauaucuuuuucacuugucuccuaagugaugacauuauacuuuaaguguuugggacauauuauaguaccucagcugucugucacuuguuagugggacgggguggugguuaaaugacacuguacucauccacauggucucuguagugcuauucgucuugcuaccagcuugaaaauuucaugcagagucauuaaaucguaugaaugauuuaaaaauuaaguuuaauggcagacaaucugguauuauaaaugcaaagucaaugccuaucuuucuuuuguuggccguauacccuagccgaucucuuucagagcuguuggauuugugagcuguuguaggaagucuacuaauauuacaggguaacuuauuaugcgauaugacagacucgugcuccgacgguguccugucaguuucuucagcacacuugaugcacccuccuaugugacacauacacgaguugaucuuaauugucauuaagccuguugacucuugucaguuguauaaaauaaaaucaaguauucauaagcagucuguaauaggauauaagcaggccaacuuaguaauacauuuuuugcugagccuuaacuggcgucaguuuuagcgagugcuuucuguuaaaaaauuauuagaugcaguucuugugaaauaagucaagcuggccaucuuucugauuugcuagaguucauucuuucucucuuuaaaucaccucaguuauugaaagguuaguauuuuuaacuguacuuaacuugaguaaaaguaauaacguuguuuuucucuaaguuuaaaaaauagcauaugauuuaacaugaggcauggcuuuuuucuuuaaacaaagucagcuauuuuuucaguguuuaauaaguuuacagaaauuuagauauuuguuucacuuuuagaaacacagaauacaggaaauuuaugagacuccagagauucucacuuguuuuuuucuuuauguaauagaaaaucuagaguagagugaauggcauugacaucucacagaugugucagauagagucuagaauuuaguccauuuuacguuacuuuaauauuuuauaucagaacauucacccauauauaaagggggaaauucaaucuagaaaaaaacuguaacuuuaaaauaauaugcacugcaaccuuucuuguacugcuucuuaguugaaaccagugagcucgugcaauauauuuuuuuauaauucuuuugacaaauaaccccuaacgguuuauuuaaauauauguaugcguguguguauauauauaugcguguauaauauaauauaugucucuaaaaucucuaaaauuaaccucaauuguuuaguuauuuaccuuuaggaauaguuguuuuaauauuuuuauauuuuauuuucauauuuuauuuuauacacacacacacacacacacacacacacacacacacagggggagacagagacagacagacagacagagacagaaaaggucucgcacugucccaggcuagagugcuguggcuuaaucauagcucacugcagucucgaacuccugggcucaagugauccuuccaccucaguuucccgaguagcugggacuacaggugcuugcuaccaugccccacuaauuuuuuauuuuuuaguuuuuguagagaugggguuuucucguguugcccaagcuggucuugcacuucuggguccaagccauucucacgucuuggucuccuaaagaguugagguuacagacgugagucacugugcccagcccuauauuuuuuaaaguauauguaaucagaugacauugucucagauauacuuuaauugauaacgccaauaacuggagaaucuuuucauggcucuugaucuuuuugugccuuagacagguggguucaugucucuguauuucccagauuccauuuuaacaaugauaauucccauauuacaggguacuuaaaaggauuaaaaauaaaauuggugacugggcaugguggcucaugccuguaaucccagcacuuugggaggccgaggcaggcggaucacgaggucaggagaucgggaccauccuggcuaacauggugaaaccccgucucuacuaaaaauacaaaaaaaaaauuagccagacaugguggcgggcgccuguagucccagcuacucaggaggcugcggcaggagaauggugugaacccgggagguggaguuugcagugagcugagaucgcgccacugcacuccaggcugggugacagagcgagacuccaucucaaaaaauaaaauaaaauaaaauuggugagguaguuacauagauagggcagauuuaggcacugaguugcuagaagcuauaauuaguugaaaaugcaucagcuaggagagaaaagcauuuaauauuuguguagaguaagagaccacaagaaugcucaguagcauguggaaauacuuuuaggagguucagagggggaaaugaggguauuauggauguggauuugcauggacauuuuaguuguagaauguucuguggaaagggugggcuggacuaagccaugugaagaucuguucuuacauaaucuacuuuaaugauuucuccaaauuugagaaacaacuagcuaccaugauacgaguucccaguauaugacacucaugacaggcuuucacguauuuucccugaauuuuacaacauaacuccaggguaagucuuauacagauuaaaaaacugaggucuaacaaggucaaguuauuugaaagggagcauugaguagucaguuacagggcugguguucagcuucugacugucuggcucugccuacucuguuaugccaguuugggauggaagccuccagagcaggcauucucaccucuaccuagcacuguuggugcuuugggcccaauaugucucugcuguggugggcaggucugucuucugcacuguuggguguugagaauauucuuguccucauuccaccagaagccaguagcauucuccuaacuuccuuuccaguugugaaaaccaacagugucucuagaaguugccaaauguaaauugucccuaguugaaaaccuauggagggcuuuucauccauugaagagaaucucuaaaauuaaccuuacuuguucaguuauuuaccuuuaggaauacuuguuuuaauauuuuucgagaccuucuuucucagugagaacagacugagucugcagaaauugagccauggccuguuaucuuccucucuaccccagcuccaugugcaggaagcucuacucuaagcccaugcagccaaaaagucaggggcucugucuuccugcacuuccuaggcuauggcugcagccccacccaggaggggcuggccaugguucuuauuuuccccagacucauguugccgaagcccaauuccugacaggcuuggccuagggcacuaacauaaaguaacuuaaaguggacuauauucuagacucuaccugggcuccugagcauuguaucccagugaguuccagccccagcagcuuguaaggcagaggugacagugcuggaggggcuacaccacaaccccauccccagugcccacuugaugaccugaguaucccuccugguagagcuggcugcuguccuguccccagcuccaaugccauacuccagagguucugcccagggugagagacagguccuaagugcugagaugucugcagccuucccuacagacuuuguuugaaaaauagccuggcagaguucauuucugaggaugucguugagaacacuggagagcuugguggccaccauuucagagggcagaaacagcaacccagucagaagcuucauggagaguccuagauccagccuauccuggagccaggagacugugagcaugugcuaggcgcucucagaagcagcugcaaugggacucggagcaaaugugaaaggacucccugggagauaacagcccugcaugaugccagagcccacugacccaaggggcuuaccuacaaccucugagcuggccaaaugaugcaugguccucuguccccaaggugaguccuacaaugcugagcuuacacaugacaucacaggccucccugucagccuggaagaugguuuuugcccaagaugauggucucaggagucaauggagaagaccuccaagccacccaucccugacugaacacgggcaaagucgugaaaucccugaauugugagaggucucuaagccacacacagccagugaugaagcuuggaaguccaacuagcuaagccagccugagcaccaccuuuugucacaggaucuuugggguguugcuuuuccagccacaaaccucuauggcccguggagccuuuguccaaguuuugcuuaggccugcugggcucauucugccuccuuggcccagcaggcuuugcuuagcuugugcugccggcccggaucccacgccugccgagggugagcccagaacagaguggcaaggugugugugagcgagcgugggaucuggccacugcacacagccaggcaugcuggcuguggcagggcaggcagcuccaggugccggcucugugugaggcuguggccaaaucaggcguuccauaagcgacuuccacugugggcaccaggaaacguggcccuaggaggcuuggagacgcuaggaaccgcagauccccaaagaggaugucacagcccuggcucggugagcuguuaagucugggcucucugaagagccacagaucuucucuccuucucauugcuugcaauaaggcgaauggcagggcguguuucugcccuguuugugcuacagcucuuucauucccaccauugagcuggucucaaguucuuguccggcauccaggaagaacaagguauauggacaacuagaggguaagcaaggcaaagaggugguuuauugagcgacaguacagcucucaggagacgcuaaguggguagcuccucuccacaggcagguggucccgaugauugcagcucucaguggagaggagacccggaguagguagcuccuaucagcaggcaggucguucuguugagugugcagcccucagcggacaggggaccuggaguggguagcuuuucuccgcaggcagguuggcuuguggagugugcagcccucagaguagaggggacccggaguggguagcuccuucccacagcugguagucccaauuucugugugagucuggccgaaacucgcuuuuuuuaugaacuuagaagggaggaagcgcaugcugauugguccaugggcagccaugggcgggccuagaaaaagcacuauccgauuggcuguauggucaucaaugaaguccucacuuccggcaguggaccucacugggaacuggcagcccggccccgaggcuucagguuguuccuggcuugaagguaggguuucacaggggaccugccaauuuuugcccaggaacuugugggacucccaccaucaacaugccauguaugguucccaggcuguuugucccaagguugccugcaggccugccccgagccacccucccgugcuuguuggcgcccaaagucuggagagggccaagccggcagagugccaggcaugucagcacugcccugagcacaugcauaccugccaacucggaaggggauggggauccugccagcuccauggagcaugcagcccuaggcacaccucccucauugcagucuucgcagccgccacuccagaggcgccacugcugccaucacauugaccagaaagugguuuacguggagccaggagcaaccuccggaaagccaagaaaaauagaaggagacuuggugguggcauuucagccuggcgacugcagagucugagcaggggguccguggcugcauccugcggggggauagauuuccuagaguucagccagugacuauaaaaauaaacaaaugaguauaacaacaaacaacccaaauaaguuuuguuuuugauuuuguuuuuuuuuuuuuuacauuuguguauuguaguugcaacuguucaggaagucaacucuugguugaagugcugagguggagggcugagcuauguguucuuguauaauggguuuggaguuagauggaccuaaucauggcacucuucacucacuugggagaccuugggguacuuuaccucugagccuaaaauagggacaguuuuuccuucugucucacaggacaucagauauugcagauaggccaugacuggcacuucauaaguagaugcuuaguaaaugucaguaaccuuccccuuuuugggggagaaagaagugacuucccaguagacauguauaacuccauacauuuuuugaagaagggguagcugugggcaagucuggaguacaguauggaauaaauuccauuacuccuuccuuaauuaggagugcuaugucuguuucuccccugacagucuuugggagguauuuucucaaugagccaagcacccagugugugcuuguauuaaaucucuuccaugccucauucuucuccuugccacauuaucccuguccuucucucuucuccucuccagcccccauuguucucucugaucuugguccuuuggccuuugagguucgugacagaaaagagcaucaugcuugcagaggcagcauauuuguggaggcagcguccugccucguugaggagacuuugagaagaccugauacaggcuguuguuggucaucuacuuccuguacaguggaggcauuuuucuaugacgggucccucaagggcuuccacccugucucuggaaugggacuuuccguaucuuccaaguggugaacagugaguuuucuuggugauuucugaggcugggcuauuuguauggucaaccccauaccauuaauagguccuucuagaaccucuuauuuucucuuucacauuugguugucugucuuuacuuguuauacugucaccuaacacuguuaaggucaguaggaaacuugguagcuagaguaaugcuuucaguauaguagguguucaguaaauauuggugaaauaugugggagcuugcugugugucaccuguguugaggaagagccuggcuggacugugugaaagccgugagucuucacacagaguuucuggacucagcguucccacggaguguuuuuggacauuuccuguaaaaucuucauaaagucuccauuugcuuucuucaagauaaaaguaaaccuuuucuuaacauaccuuuucuuaaccauuauuuaguuauacauuuguuaauuaugaauacuuaauaguauuaguuuaaccauuuugaauuauuuugaccauuauaccguaguauuucagcugcuuuaugcauuaggugaucuuuaucagacuuuauuagauauauaaaaguuuagucauuucugugggaagaaugguuccugaaugcugaauggcuuagaaaugaccacaaucagaaguuucaggcuguuuacuacauggcugucaccucuaagcagugaggagcuuugaaaggcuguuuaccuauuuuuucauuuuaacaguaaauuacaaaguuaucuuacgacuuccagcaaaguuacaaaauuaccuuacgacuccccaauacuuaaagccauacugucauuacuguuacuguguaagacccuugucuuuaaugcuuccguuuugcugcggugaucacuugcaagcugacugagcucagacugucucuugcucuggagagggaaaggccaggagcucuguucuggcugaccuuggcugccaagguagggaggagcugcagccggccgguaacuuucauucaccggcucuguccgaugagcacaagcucaugucaggcacuccccagagccacacugggccuggguggcaucgauuccuagugugauucugaaugaaauugaugaaugggagcacacagugauaaacaggauggggaacucuccuagaauggcagugggagccaagaacaauugagaugagucuccuccucuguagguguugaaauaguuacagugugcuuccuguagugcaauauuuagagguuaaguccaguuacuugcauuauuuaucucuuuacugcaaacaccaaauguuugagucacacuuuuagguuggccuuuucauuauuuaaucuaaauguguuuuaaaaacagauuuuuaaucucuggguuuauaauaugauuuuuaugccauucuguagacuuuguuugggaaagcaucuuaauauauuuuuuagguuucuggaaucaaauuguauauuguguuggaauuguuguuucugaguuuaaacauuuccaucaguugcuggaaaggcuggugugugaaagcccccuucugguccagugcagugucagaggucucucuccugcaugucagauuaguucgucugcugagcuacuugauuauaagcauucgccaguauaauacugaguucugaaaacuagacccuaccugauugugacgccaaauuuauucaguuuauuaaguuguaggcacuaaaacacauaguacuuauugccugaaucuugcuuucaaaacuuggaggaaaaaccauuuucuucccugguuucuuguuuuugccuuggcugugcugugcagcuuuacaugguaugcuucagaaucuucguagauuuucuuaaguuguaccugaaagauucuuugcuaaugagcauauuuuguuuagucuaauugaugccaccuucccccuauaguguuaaguaacuuuuuuacuuaaaaacagaauuaaaauucaagauuugaaaguauauuugaaauauuuggaacuugauagagcuuuuuuauuaaaaaccuauuuuuaaaaaucuagauauuauuuaaaucugauuguugcuucaguaccauuguaguauauuagcacuguugaaauuuuguucauuuccaaaauuuaagacuguucauguuugagaaaggguguuaugaagcaauucacucgugaaauaugaauauuuuuauacuaguauaguugaguuauauagauacauauuaauaggaaagauagauugcaguucuauuagcaaccuaaauugagagcuuuaauuugcuauuuaaaacuuauuccuagagugaacaacaccuuuuuuaaaaauacauuuuauauugacauaauuaaugacuccugggaaguugcaaagguaguacagggagaccccgugugucccuucaccgagauuccuucagugguugacaacuuaccuguaguagaauaucagaccaggauguugacacugguacagugugugcgcguaaggcuguguuauuucaucuugaguguggguuccugucaccaccaacgcagucaaggugcagaacuguugcaccaccgugaggaucucccucacacuagcccagugggcucagccaucccucugcuuccagcagcccucacccuggguaaccuugaauuugucuucauuucuauaaauuugucauuucuggaguguuauauaaaugaaauaaaccauucaugaccuucggagacucguuuuuuuuuguuuguuuguuuguuuguuuagauggagucuugcucugucacccaggcuggagugcuauggcgcgaucucagcucacugcaauuuccgccuccuggguucaagcaauucuccugccucagccuccugaguagcugggauuacaggcacacaccaccauacccggcuaauuuuuguauuuuugguagagacgggguuucaccaugcuguucaggcuggucucgagcuccugaccucaugauccgcccaccucaaacuccugaccuugcgaucugccuuggccucccaaggugcugugauuacaggccuagccaccgugccccgcccuugcgauccgccuuggccucccaaggugcugugauuacaggcguagccaccgugccccgcccuugcgauccgccuuggccucccaaggugcugugauuacaggcguagccaccgugccccgcccuugcgauccgccuuggccucccaaggugcugugauuacaggcguagccaccgugccccgcccuugcgauccgccuuggccucccaaggugcugugauuacaggcguagccaccgugccccgcccuuccgauccgccuuggccucccaaggugcugugauuacaggcgugagccaccgugccccgcccuugcgauccgccuuggccucccaaggugcugugauuacaggcguagccaccgugcgccgaccuugcgauccgccuuggccucccaaggugcugugauuacaggcguagccaccgugcccgccuagagacuuuuucugcuuagcacaacacccuggagauccauccaaguuguuguauaugucaauaguuuguucauuuuuuacugcuaacuaggauuucauggauggauguaccacagcauauuuuaaaccauucaucauuguugguugaaguuuuuuguuguuuacagguuuuuguuauaaauaaaacugcuuugaacaauuauguacagcuuuuuuguggacauaaguuuuuauuucuccagaucgauguccaggagugagguugcugauuuuuauggucauucuaugcuuauuuuaagacugacaaacucuuuuccagaguuacaguuuuguuuuacauucccaccagcaaugccugggacaucuaguuuugccacauuuggccgauguuugauggaagcggugcuuccucgugguuugcgugugccguuccguuauggcuggcgacguugagcacguucuugcugcauguuugccauccucaggacucuaguaaagugucuuuucaugucuuuugcccauuuucuaauuggauuuauuuuaaacuauugauauugagaguucuuuauauauucuacauaggaguccuuugucagauauguggcuuacaaauauuuuguacuaguuuguaguuugucuuuucaucuucugcaaggaucuuuacauauucaaaguauuuaauuuuaucaaaguccaauugauuuuuuuuuaauggguuguuccuuugauguccuguuuaggaacucaucuuccagcccugugcccugaggauuucuucuuguggugguuuuuuuuuuuuguccuaaaaguuuuacauugagaucuguggucuguugugaguuaauuacuguauaagauguaagguucaggucaaggcuuuggguuguugggcuauguauguccaaaugcucuagcgucauuuauagugaagacuccauucuccauaaauugcuuuuguaaaugcaucaaaaguaguugccauacuuguauguuggggggacucucucuggguucuuuauuuuguuccauugaucuguguuucuguuccuucuucaguaucaaacaaucuugauuacugcagccaucugguaagucuuaaaaucuggugggcugauuucucccauuuuuucuuccuuuuucccccacauuguuuuagccauucuaaacaacuuuuagcuguuuuaaacaacuuuaccuuucuauacacauuuuagaauaaucuugccuauaucuuuaaagaaagucuucaugggacaaugauagucaugaagucugcaccuguuggcauuuauggguggccggguucuucauuugcuagucugagauaaaaagggcaagaugaaaacaggaaaucaccacuguccuuucuugauacccgaggaauugagcuggacugcacuuuuccuccucuuguagaaucaucaucauuuuuaaaaauuuaauguucagcauuuuuugcuuuauuuaggaagaauaagaaagaguacaucugcucuaucuuucuggaaguaaacuucccuuaaagguuuuauucauuuucuguuuuuuaaauuggaucuuaaacuuuauucuaggaauuuucacugcaugaagcuauaguguaauggacugcugcgucaccaucguccccuggaagacugcucauuaaauggccagucuugcuucauccguaugucucauuuggaugaaauccuguguauaauuugauugcauuaacaaauucagcauuuacagauuacaaccacaauuccauuaucauaccauaaacuauugaacagggauuucuuagauuaacgcuuggugagucuccugguuucugauugucucacacacuucuuacaguugaucuguuccagucaggaugcgagggcccuucucuugcgcuugguacaggugucucucaaaucuguuuucuucuaaaacaauuccuucucuuucuuuguuuuuuauuuguugaaaaaacaggguuauuggacauagagaauaucugauauucuagauugugugagugcauacacaaaacaaccauguuauuaauuaauacauuccuuuauauccuguauuuuuguuaacugguagguggaucuaaaggguugaucauacucauuuuugguuuucuuuuagcuuuucauuuuuuugguuaaagaauacuauagcaaugcuccuguauaguccuguuucuaacuccaggcagaugucuacaugucucucuuuuagugaugaauaaauacaggugcuaucaacugaucuucccaguguaaaguucuucaucaggccaggcgugguggcucacaccuguaaucccagcacuuugggaggcugagguggguggaucaugaggucaagagaucgagaccauccuggccaacauggugaaacccugucucuacuaaaaauacaaaaaaauuagcugggcaugguggcacgcaucuguagucccagcuacucggaaggcugaggcaggagaauugcuugaaccugggagguggagguugcagugagccgcgauugugccacugcacuccagccuggcgacagagcgagacugucucaaaaaaaaaaaaaaaagaaaaaaaaaaacaucaaaacuuuugaaaccucaaaagucaccuggaugaauucucucugugauuaaacugaauuauguuuuauacgcugcuuuuuauuuuuuaggaguuuuuuaaaaguuugguguaauuuggcuuuuuaauuauauaaaauguaucugguuuuaaagugaacaguauaagauauauucaaaaggccuagcaucuauuccuguucccuuccugccucuauagguauuauacacacauacaugcguacacagauauaugugcacacacacagaagcauuugcaugcauacagauacacucacacacagaggcacacacauagaaacacagauuugcaugcccucacaucugucacacagauaugcaugcaugcguacauagguacacuugugugcacacagauauguucacacaccaauaugcacacacacagaaacacacagauccucagguacuuguucacaguuauacaugcauauuauacacagauacccauguacacaaacauacacacaagcacacacaaauacauauguacacaugcaugugcacacacagauacgcuugugcacacacagcacacacaaguuagccaugcacgcgcacacacauauacaugcacacacacagauacacacauagauacauauccacacacagaugaacaugcauguauacaguuauauaugcauagagaucuguauggacguauacaaauucucucuccucccucccuuguucuuaacuauaauguauuuuucuauauauaauguccugcaccuuacuuucuuuauuucacaaucuauauccuagagaucuuuccaugacaguguauugaggucaucuuguuugcuuuacuuucuucucucuguauugccguaugugcucuguuuuauucagcucguccucuguuuguuccccuuuguuucacaacagucuucuguuauuauaaauaaugcugcaaggagcagccuuguguguaugucauuuugugcuuuugcuauuccaucauuagaauagauucugagaagugggaugauagcacggccaaagaguaguggauuuucauaauagaauaucuuagcauguuugaaacuggauaggccugagagcauaugguaacauuuaccugggucuuagcauuguagcugugcuuuuaugauugaacauuuuuuaugacgguaaaucugguauuuuauuagcaaaauaauacuauacacuguuggauauuuuuguguauuuguuauuuuguuauuaucaaaacauacauugaaaguagaaaugaucaaugcaguuuuucuaaaauagaaggcugauuaauguuaaaccuuaauaggcaagaacagcaaauaggaaauaagugauuuaaaaaaauauaauggccuacaucuuuucaugaaaccuguuuugugaaucaaggaacauuguguaaaauaaaaguuuuuaaggaguuuuguuccugggaauaucuagauuguuauuucuuuguccuacugugcccuggaauuauucuuugauggcaccuguagcucaggaaaaaccuucuguaacaauucaagagugguaaauuuuuauucucuacuuccaagguucguguuuuauucgaacugaucaacuagauggugaaacugacuggaagcugaagguggcagugagcugcacgcaacagcugccggcucugggggugagcagcaccaagacuacuccauccuuuuaucuucaaugguaguuucuaggcuucacguauauuucuguuuauaccagcuaauuuauuuaaugcauugagaauuuguuuuauaauuucuuuauuccucaugaagguucauugaagaauugugccaaaauaauuucugugaugucuuagcacauaaucaguuuuagguaauugugaauuuucuuugacacuuagguuuucuuucuccuucugcucaccuuccugcccuuccucccuguccuugcccccuucccccucuuccgccuccuccuccucuuaauguccuuuuccuuuuucaauuuauuuuauuuuuuaagugauagguugucacucuguugcccagacugaaauacaguaacaugaucauagcucacugcagccucaaacgccugggcucaagugaugcucucuccacagucuccugaguagaugggaguacaggugcacaccaccacgcccagccaguucuuaauuuuuuuuuuuuuguagagaugggggucuugcuauguugcccaggcuggucuugaacuccuggucucaagcaguccucucuccuuggucuuucaaagugcugggauuacagguuugagccaccaugcccagugauaaauuuuuauuucuuauuuggcugugugcuccucuccuuugcgacuuuguauugauauuugccaauuaaaaaguacauacaugcucguguguguagaaucuuucaaaucaguaaaaccagauauucacaaaugaauaucuguuuuuaauuuucacuuaggcacauaaaaguguuuuucuuucuucuauuuucucucuguaccucacauggacuucauuagccuucaggucagaagcucuauuugaaaauuguccaagcugcuucucugggucaggcuucucagucaaagccaggcagugaagugcugcucagaugauuuguuuucauggguuuuuaauuuucaguguucuaugauuguuuacuuaaauuaucuaggauacuaugcauaauuuauauguuuagaguuauuacaacuuaacauuuuuccguggucagugaaugaaggaagguagguucuacuggaccaacagaugagcagauuggagagguugggcaguugacagcugccuuuuaccugcuuggugguggguagagucaaccaggcagcuauuaaauagugaaguuauaugucagggagcagcaccuccucaccugaggauggggcuggggugugugugcauguggcaguuccuggaucacacaguguggcuuucaaaggagcugccaaacuguuuuccagaguggcugugccauucccuguccucaccagcaccggaugagugacccgguuucucuguguccuugccgccuucaauguugucaccaguuuuuauuguagucauucugacgggugugcagugauaucuuaucguggcuucaguuugcguuucugugauggccgguuguguugaacguuguuuugugugcuuguuugccaucugcuuguccucuuuggugauguguccuguugacagucucggagcaaaagcauuccgccuugauguauaaugcuagcugcagcuuguucagggagucucugucagggugaggaaguucuuucuagucuuaguuugcugagagguuuuaucaugaauggguguuagauuuuuccaaagcuuuucuguaucuguagggaugaucauauggauuuucuccuuuaucuauuaauaugaugguauguggacugauuucauauguguuacaccagccuuguauuacuggcauaaaccucaccuaguagucauacugcaugucuuuuuauuaugucacgguauuugauaugcugauauuuuguuaaggauguuuugugcugauguucaugaaacauauggaucuguauugcuuuuguuuaaugucuuuaguuugauaucuggggguaggcuggccuuauaaugaguuggggagucuuuuugccuccuguaauuuuuaaaauaguuggcauaaaauuggcguuauuuauuuuuuaaauguugaacaaauucacuuuuggaacuaucugauccaagagauuacuuuuugggaaaacacuugauugugaauugaauuucuuugguauagaguuaaucagauuuucucuucauuggaaauuuguguuuuucagagaauugguucauuucacguaaguugacaacauuaauggcauaaaguucauaauauuccauuauuuuuuuagccauuuuaggauuccuucuuucacucccaauauugguaguuuauauccugucucuuuuaucgaucauuucaaagaacuuguuuuugguuucauugauuaucuucauuguuuguucauuuucuguguuauuaauuucugcucuuuauuuccuucauucuacauaguuuauaauuuuuuuuguuucuuccuccuuaagguggaaguuagaccuuugauuuuauaacuuauuauuuucuauuuauaaacuuucagagcuguaaaccuguuuccaagcauuguuuaccugugucacacaaauuuugauuuauuuaguuaaaaauaauuaauaauuuaguuaaaaaaucauuuucauuuaguuaaaaauauuuucuaauuccuucaugauucuucuuuucauccuugauuauuuggaaauacacuguuauuugcuaaacaguuggggauuuucccaaugucugguaauuuauuguuauuuaauucucuuauggucauagaacauauucuguucuauuucaguccuuucauauguauugaaacuugugauauggcccagcauaugaacucucugggucaguauuccauguaagcuuuaaaauaauguuuguucugcuauugccuggauguucuguaaauguucauuaggucaagcuaauggaaaguguuguuuaaaaaaguuuuauaguuguuuucuaccauucguucucugaauuacugaagaagacuuuuaagaucccauaccuuuuguagauggaacuauuucuccuuuuggcucuguuaccuguuuccugaucuauauugaagcacuguuacuggguucauacacuuucagaauuacuauauuuuguugaauuugcccuuucauuauuccugguaauauucuuuguugagacaucuauuuuguucuuuacuauuauaguaauuucagcuuuuuuuaaauuaguauuuacaugguuuaucuuccauuaguguguguuuuauauaucuuuuucuuugaauuuaaaguguuuuuuaauguaauaaaaguagguacugcuuuuuuuauucugagaauugcugcauuuuuauuguguacauuuacaguaaucguuaaugugguugagcggaagucagucauuugacucuguagguucuacuuaucccauuuguuucuuuucuucaucuuuugguguuguguuauauuuccauuuggcuaauuagcuauguacguuaguucuguuuugugucauuaucauguuuccaauggguguuuuuaacuuaccgcaauauuucuccaugucacuuacaguguaagaguugugcacaguagaugcccauggcuuccuucccauccuuuguauucaugucagcugucguacuucuacauauuaucagcugcaccgugcauuacuguuuuuuuuuguucaaaguugucaagcauauuuuaaagauaguaaaaaaugaaaacagucuuuucuguuuacccauguguuuguuuaccuguucugagacuucucuuuccuguguguugauccagguuuccauuuacugccaauuuccuuuagcccuaagaacuucuuucaacguaucuuguagugaaaucugcuagagauugucaguuuuuguuuguuugaaaauugucuuuauuuugccuuuuucuuuucucauuuuuuuuuuugagacagagucucgcucugucacagaggcuuaagugcaguagugcaaucucgacucacugcagucuccaccuccuggguuuaagcaauucuccugucucagcuccuagguagcugggauuacaggcaugugccaccaccacgcccggcuaauuuuuguuuuuuuguuuuuuuuuuuuuuaaguggagacgggguuucaccauguuggccaagcuggucuugaacuccugaccucagaugauccgcccaccuuggccucccaaagugggggauuaagggugugagccaucacgcugggccuauuuugccuucacuuuugaaggaugucuugaaguuuucauuuaucuuugccuuucagagcuuugauuucaucugauggcauccauaguccugaaaagaugcuuacaggcauucuuacccugacuccacuuuauccucugugccuuuuucugugggcguuuggaaagucuuuccuguuuugacuggcuuucaggaauuuaaguguguugaugcauuuucauuugucuugcuuggguuuguugggcuucuuguaucuggaguuucaugguuuuuauccaguuucaagauuuucagccuuuauuuuucuuaucuuuccuucuguccaaaccccucugagacaugaccaacagaauuagucuaacuacuaauaucaaguaaauuagucuaacuacucauauuaaaaaagaguaagaacuucaaugacaugggaauaucaagugguuagauucccacaugccauugaugcucucuuacucuucuuuuucucagccuuuuuuuuccuucuguaacucaauuuugauaguaucuguugcucugucauuaaauucacuaacauuuaucuuuuucaguaucuagucuucuguuaagcccacccaaugaauuuuguuauucugaguguuguaaucucuggauguuucauacguuucucucauuuuuguuguuuaaauaccuuuucuauucuuuccuaauauguauauggcuucauuggacuauuucaacgguuuguaaugcuuaauuccauguauguuaaaacuccuuuaucucugucacuuuuggguauguuucuauuuaaauuuuuuggcccucguuauaggcccauacuuuccugcuucuuuccgugucugguaauuuuuuauuguaugcugaguauauaaguguuacauuuaaugucugagauuuucauuucuaucuuuaaagcaucucgaucuuuauuaaauuaguuaaacaacuugugggucaacuugaugucuucaaggcuuguccuuaaacuuuguuacaggccuagaggcuccuuuauuggaaugcuaauuaauccuguugcuagagcaugauccugcugggauccugcugaugucuacugaaauccuugcugguucacaggugccucugaacucuggcuagucaaaacucagcucuccaacucuguggucucugcaggugguuggggcuggagcuccgugguucuccuccggccggacauacucuuacccuguaugcuguguguacucacuuucaguaacacucagguggaacacuuugcauauuucugcaauucuguuucuuccuugccucuuuucaguauuuugcaaaugcuagcugucaguuuccuugaauucuggucucagucuccuaaauucagaacagcugccucccucugccuggcuucugcugucuaaagugguaaaucucuuuaccugggcuuauguggggcacauggcuuuguuucuccucucccuggggcacuguaucuagugucugaaaauagauacuuuauaaauauuguccauuuuccaguuguuuucaugggaggacaagucucauauuaguuaccacaacaugacuuguagaagcccuugauuaauuuuuaaugaaaaauauuaaguuccuuguggaugaaacaaacugcaugacauuucaaauuauaauuaaacuaaaacaaacaguuauuuguuuauugagaauuugcuuguugguagggaucuaccugcugggaggccugugacugcccugcagagccuggaugccggcccuucugccaccuuuagauguuccugcccucucuucaggggcauuccuuuaaaaaagaaguggaugucaauuuugaguccugauucuaauaguaaugugugcauugaaaauaauacacaaaucacaaaauagaaaaaaaccugccagucugcauuggccaucagagcauuuugguauaaauccuuucugacaguaccuuccccuagccacauucuugcaugguuggauaaugcuguauauuacuguuuuuacuaguagaauauuuauucaacaauaugcuaugggucauccuuucauguuaggaauuguguauccuugcaaguguuuuauuagcugcauaguuucugacaaauuauagcuuccauagcugaccugauauugguaaauuuaaaagauaucauuuugaaauucuagauuuaaaaaaaagcauauuucaagaauuuugauuauuuggccaaaaugcuuuucagaagacuaugcaacuuaucuacuguguauuaauuaaucaauuaaucuuucacuguuuuccaaucugauaacuguaacaaugguaucccauuuaaauuuacauuuguuuaguuuuuuaaugugugagauugaagauaauucuuaccuaagaaaauguauuucucauauuuuuauuuucuaagucuguucauguuaucugcuaaaguuuguuaauaauuuuuuauuuuccaauguuucuaaauacuucguuuauaguuucuguugcccauauaaaaguucaguguauuuagauaaugugaccuaccaauauuuuuuucaaugauuucugcuuuuugguuuuaugcuuugacuauuucuacucaugauuauauuuuaaauaauuaguuuuaaaauaauuccugcuuuccauacaaaaucugauuaucuaccauuuuuggggggaguauuuuuuuuuuaguuuaaaguuaaaaaaaaaaaaagaaaaacaguaaguugcaccaguaccauucacugaagaacuuuuuuguuagauuuuuauuuuugcacaaauuuaauauuguccccauauguuuauacaauucuaauuucucaacaucaggguaucagcguaucuguuucuccauaacuuuacccaguacacauugcaaauauauucuccaaucuguuucuuaacuucuggccuuauaauaucuucgcuauguaaauauuucaaauuuuauuuagguaaauauuuauauguuuucuuuuauuguuuauauguuuuucuuuaugcauuuauaggcuuugucuuguaccaggaggcuguuugcccaccaguauucauuuaucauuuuaaccacuuuuaaauguuugucaguagguggaaucgaaaagugagagccaaguaauuugcauuuacacuauuauaauuauuaaaauaguuccuauaguuccagcugaugcacaaagaccuagcagagggaaguugaaucuuucacuuaguauguguggcuaaagaauuguuugagaguuaagguuaaguagguuuuuuuguuuguuuguuuguuuuuuuaauuucauguuaugagcugagcagaaucgugcgucacuccagccugcaucuucugugucaucauuucccuccucagcccuuucucauccucgcucugcuucccaggguuuucgacuugcuuuugguuuuuuuuuauguugugaaauaagucuguucuauuaucuuauuacuugacaucuagcuuauuguucucauacuauuuauuaagguaaguuuuaucauagagacauucuugcagccuauugacuuucuaauguaauuggaacugauugcuggguuagugcuacuguuucaugguuacauauuuccuccuuguguccuucuuuuucuuguguacauacucaaguaaucucugcagaacuaaagggauaauaugaguccuuaaaugacuggaggggauuuugguuggcuguaacacuuggacaaaagccccacccucugcauccuccuccugaagaaccuuccaagaauucuagggucccuggcaguaagcagcuugggagcaagucacacuaaaugauaauuuucuaacagauuuaauuuugcuaaguguaguagaaaagaaaguacagaaucaaaacacuauauuagaaaaaauuugucugaaaaaaaaaaacccaaaaaauccagccaagcaaggaugucgguacauguuuccauuaacauacaauucuguacaagcgaucagcaggugacagagguuagcagugcagggauaggcggguugcaugggggcacggggauacuuuugugaguaaugaaaauguucaguaucuugagguggugguggucacaggcauacacauauaucaaaacaaaaugguacacuuuaaacgugcaguuauugcauggaaaucacaccuuaugaaguaguuacagauuuucauacuguuaucuauaacuuugaguaaugcucuuugccaugauuauaggaagugacauuuuauuaucuucaauauuauaaggauacuuucuuuauuuuuauuagugacagauauauacacauauaaauucaaaaauauguacagaauuaaaauaaauaauucguacaaugcaacuuuaacauuuucguggccaguacacuuugauacagagucugauuaaggauuuuagugacauaacuauaugguaaaugaaaacauuuuaauuuuugcuguuaccacaccaccaaaaagcaguauauccuaggaaaaaaggaaguucaacugaauaucugauucauuaaucaauuuuauauuuuagcuucacauaacuuggcauauuagguauagaucuuuuuucuauagagaagaaagcucugauuucauuauggauaugggcaaggcaauugaguuuuucauguaauagcuuaugcccguaaucaucccucauucugacauucgugucucucgugguguagaucugagggucuucuguguugugagcuguuuguuguaucacaguugugucacaucagacuguguccauggugacagccaggcugaguaaacuuagagaccuaagaacucaucuggaagagcugaggacacagccaagaauaaccuuuguccauucuguuauauucucagagaauuaaaauuucagagucauguaauaauaacugugcugcagagccuguaauggcaggugcaguuucuuguggcuucauagcugucuggaggcacaguuuucaggcguuguagacauuugggaaauauguuucuggcuuuugugaucaaacaaauuuauuaacaaccacaaggccacaguaacuuucaauaaaucaugacaugcugauuuauuucaaaagauccguauagcaguaaacaauaccauuuacauuuaauuaguuuuauugaacgaaaggcaauuuuauuuguaaugaaccacauguuaugauuaaggauguauuuuaaugaccuuuaaguaaugcgaacaaguguuggccuugaccucacagcagaggcuuuccuccguuauugaaaacuucagaaugauuuuuaaauuaucgugaaaagcuucgaaugacauucucauuauugugccauuuauucagucauuugaugucuacuauacuagaugaaaugcauuacucuaaaugcugauguguguguagaaaugagcuugccagccuguuuuuuauuuucauguaucaaaaaguaguuugagguaugaaaguuucauguuuugaaaauuacugugacagugucauauuuaaaugaugagugauucucagacuugccuuaucccuggaaucacuugacugcuuauuaaacauucuaguagaaguuucauaauucucaaguuacuagagaauauuucuuuucauguaaacuagcuuaauuuaaauaaauuuuugcuauuaauaguacauagucuaagcuacuauaacaguugcacugugguaaacuaguauguucaaccuucaguccacccuuccugcagccucuguucuuuagaaauuuggaaacuagccugcacguauuuuucacaguuucuugaaaggugugugaauuugcuuucacauugaauguacuuucacagagcuuguaaggcaggagugaggaggagguaucuuuuugccuguguguucucugcugacagguguccucaugggucugaguuccugcucccgcucuccagcuuuagggcuugggugggagugcacuaugugcaugguggucuccaaaccacgugucucagaugugauccuugccauagugcuuuccuuggauggauauuuugguaacauucugagaguagcuuuggagcuucaguccugaacuucauccuuucacugauuugggaagcaucuuguucuguguaugaaaucacuuucugcuacacugucuaggguggcuucuguuuccuguacugaaaugugacugacgcaccuuaaaucaaaacagauuuucacccucacaguagcccagguggguggucaaagggugauagggcaacuuugucaucucugauacguggguuccagugacugccccaccuccacacugucccacaggggagguucggaaggaaaggccuggugaguacuuggacucaaaggggcacauguccuuucgcaugcucugcuggccagaaucaguuaccugguccuaaccagcugcaaagaaugcugagaaaugcauucuuuaagugagaaccaccuacacaucuacagcuccgaaguucuauuuuucaaaggaaaugggaagaaauauggaagguggucucugccgagccauuucuucauuuuguuucccguugagugucugauucccccugugcugcugcugaauggagugcacaaaaccauuccagcaguucucagaggacugugcugcccugagaacaggaugcucccuuuagcauugcuguuauaauucccuguuucauuagcaucaguuguuucccaugcauucuucaaggaacucagagcaauuuacaaauuuguaugguaaugacucacauagauuaaaauagaaaaaugaaugaaauaucaacagaaaaauaguaaauaugucuucuagaaaugaaauaugccauaucaauuuuaggugaucgaaucuucucuguuaaagauuuuuuuuuuaagugauugagcaugacuuacaacucuccagucccuuuaagaagagaucuggcaggcaagaguccuguguagaaaacaugaggacgcccuuuagcugugcuaccccuuuucugaaaggauuauuggaaugcguguguagaaucaacaggaaagagaaagcccggugcaaauguaaaagcccagcccagaggaaguagguguuccaggaacagaaaagaauaaauucagaugucuaauguacuugaagaaauaugagaggauguuacuaacaaccuaaauaaaacaagcuaugaaaaaggaucauguggaaaauaagagcucuuagaaauauauaugguugcugaaauuuuaaaaaaguaaauaagaguggaaaaugaauuguucuacgucccucagaauacaggccaagguugggaaauacaaauugaugguuaccaguuuuagcucggcccucggugcucccuguaauccuuguuagaaguuauaaucaacugugguuccucuuacugaugacagugcuuucagacuuuuccacucuccuuugauuucugauccaccugucuuuuccuucaccgguaagaccaguuugucuuaccuuacauggaaaaagcauucuaucaaauggaaauuccuucaauaucccauuaauaaauaaagaacauuaccucuauucucccauuuugcuauaauugcaauaaagaauccuucuaagaauaauuauuuuauaguuuucaacugagcuuaucaaauugugcuuuuuagagaccuugguagaugaguaguuucuucucucuuuuucuaaucuuucucuguugguuucuuucuguuaucucuuaaggccuucaaguguaccucggcuucucaagucuuccuuuagaucuuucuucaauuuuacuguaauugaauauuuuuagaauacuauuuuaucucuuggcuuuuuagcauuuuuuuuuuuuuuaguuugcaguauucuguuaacuaaaauaugccuuuaacuagaguuuuuuaacuaguuacaguaugccuuuaacuagaguuugcaauaugccuuuaacuaaaaguguauugugaaaaguaaaaauuguaccauuucacauaaaauacaagaauuuuguccuugaggccaggcacgguggaucacgccuguaaucccagcacuuugggaggcugaggcagguggaucacaaggucaggaguucaagaccagucugaccaauaugguaaaaccccaucucuaauaaaaauauaaaaaucauccgggcgugguggugugcaccuguaaucccagcuauucaggagacugaggccagagaaucgcuugaaccugggaggcggagguugcagugagccgagaucuugccgcugcacuccagccugggcgacagagcgagacuccaucaaaaaaaaaagauaauuuuguccuugaauagaccuguuucccccacccacccuuuguacuauacauuccccuugaacaacacaggggucaauuguaucaaucccccacgcagucaaacauuuauguguaaacuuuuaacuccccccaaauuuaacuguuaauagccuacuguucacuggaaaccuugccgauaaccuaaacaguugauuaacacauauuuuggaugucauauguauuauauacuguguccuuacaauaagguaagcuagagaaaaauuauuaagaaaaucauacggaagagaaaauacacuuauauaguacaguacuguauuuuuugauagcacaaguugacaucaccuguuuacaaggugaacugucugucugaaauggugggcagccacagcugcagacuuuaauccaccacacauacuuagcagcucaguuuuuucuuguagugugaugacuuuugucuacuuuuugagaacauuuccagcaucacuagaagcacuucuuauuggucccgugguauuauucaagguucacgccaugguauuacgccaaacacgauggaaaacaugugagcaccaugagcgagcacucggaacugugaugcacaggguccuggagcggagacggcucacacagaggucaguggugccgcaccgcauuuccagcagacccuugcacgcacuccccgcagcagcagcaggaggggcugcgacacgauuccgggagcacaguguguacugcacuuaguucugugcaguuaggguuugauacugcaucuucaggaucauuagcaagucacucggcugcagauggugucaugaccuguguguuuagguuuuauuuuaacuuuuuguaauagauuuguguauauuuuauuguaguaagugauauaauagacuaugucuacauacauuuuauguucucauguuauaccuaacuuuaaacauuuaaaaaaaaauucuaggguaugugguguaucuucaagguuuuucaaauuaucaacaaaucuccaaaaguuuucuaacagauuuauugaagaaaauucauguauaaguggaccugcacaguuccaacccauguugcucaggagcucaauguacuuuuuaauauguaguauaucuacacauaucauaaacuguuccagcccuuuuuauuuauacacacacacacacacacacacacacacacacacauauacauauauuuuuggcacagaguuuugcucugucacccaggcuggagugcaguggugcgaucucggcucacugcaaccucugccucccggguucaaccaguuuucuccugcuuuaggcucgugaauagcugggacuacagacgugcagcagcuugugugguuaauuuuuguauuuuuaguagagacggaguuucuccaugagggccaggcugcucucaaacuccuggccucaugugauccaccugccacggccucccaaagugcugggauuacaggcaugagccaccgugccuggcccauuuuauuuauauuuuaaaggaauuaagauuaaaaacaggauuuggggguuuuuuuuaaauauuuacuuagauauuuacuacuuuuguuccuuaccauuccuucuugaagauaugaguuucugccugauauuguuucccucugcugauauuccucugguggaugucugcuggaauggaguucucauuuuauuuauuugacagugucuuuauuucaccuguauucuuaaagaauauuuuugcuggauauugaauucuggcuugacaagucugccuuccacacccuccaccccucacuuuaaauauuuuguuccauugucuucugacuccauuauuuauaaugagaaaucagugguauuuugauaguucuucucuuguguauaauguguuauuuuucuuuagguauuuuugagauuuuuuuuauuuuugguuuuuagcaauuugauuuugauauuuuuaaauuuuauuuauguguuuagggguuuucuggacauccugaaucuguacauuucuggcugacaguaaauuuggcauauuuuuagucauuauuucuucaaguaguuuuuguuuuuucauccucucucuguccacucauucugaaccccaguuacaugcauguuagacuccgcgauauucccuucaugguucuaugacuguauucauguucaaaauaauuuuuuccugugucuuuuugaaucauuaucucuugacccgcauuuagauucaccaucaucuguaaucuguuaaucccaucuaaagaauuuauugcagacauugcauuuuuucaauuuuggaauuuccaugugcuucucuguucuuaaauacacuuucucuuucuuuguugugauuuccuacuugcuuacucguuaggagcauguuuuucuuuaagaugugcuaaagcugcuuugaaauucucauuucuuaaugcugaaguuugaccaucucagggccagucuucacugaucauguucuuucuugauuauggaccuuguguuuuuguuucuucauauguuuagaaauuuggaucaucucuucauuuuuuuaaaugauucauuguagagaggcaggauucaggauucuguuagguucuccugaagaguacugguuuuuuguuugguucuguuuuaacugguagcuaacuugacugaagucaaacugcagacucuaccuuucuggcauuagggagcugcugugguguucucgguuccauucguuuaguggauauaguuuagggcaugauagguuaggugucagaaugagaucauacacagauucggccccuucugaggcacucuccuuucugagcuuccauuucuuucucacuuugcagcugcuguggucacccuaaucucucaccucugcuucuucaugucugggagucugggagguuucuguuugaguuuuagcagccaugacagaacuuuauacacucacacguacagaauggaaaucaaaauuauagaaauggcaaacucuguguguuaaagggucauggguuggggggcgggucacaagaccacccgaaauuagaugguuuauuaggaggacucccaggacucagcauaugauccucccccuggcugugauuuaugacagcaaaagcauacagcagagucagcagcgagaagaggcacugggguggcguccauuggagaccaggcucagccuugccucuggagacuuucugauuuaaccuuuauguguagccaaugaaugaagcaaccuaaacccuaugucuuuucugcucuaaaauuaaugguaugaaaguagccaugauguguguuucgugaaagcuuucccaugugauuguauaaguaugugucaugagcaugugauucagacacacaggacaagcaugucuucauggcuguaaggaaggccacccuuagcuuauagugaccagugccugcuugaaugaaagcauguaaacagaucuaggaauuuauuaaacuguuuuauaaaacuugugaggaauugcgaugguuccuuauuucccccugaauacuuugauacccaggugacuucaagauacuccuaaacaggcuccaccucuaccauuggagcccccuggacaggccccggggcugccuguuuugagugucuccugcaugauuuugacucacaccugcuguucaaaagcacacccugucaagcuuaaaaaugguuucuuucuuuaucugacauucuaauuuauaguguuggcacacaaaaaucuaagaaaaucaaugauugcuuuugguaaauaauauaugaacaauauuaaucagcaaaugagaaauuuccaaguaauuuuacuaaacuauaacauucuaaucgauucaaauguucuguauuccaggaccuuuuuucuaucagugcuuauguuuaugcucagaaaccacaaauggacauucacaguuucgaaggcacauuuaccaggguaaguuaaaccuguuguucaauacaaauagaguuauuguguaaguuaaaaguagcaaaccuuugagacaguaauucaaucaagaauaaauucaaacagaaguuucaaacuaggaagggaaaaccuauauaauguuugaaguucuuaaguguacccauauuaaauaugucuuugggauacauuuaguacaguuuuuggaauuuuuuuuagcauauuuacuaauaagaucuuuaucuccuaaaauauugugaaucaguuaaaugaaguaauuuauuuucauucugacugaauaguugguauacuaucuuauccacaucaugucuagcuuuuuacugucugaguuggguggguauuuauauauaugugagucuguacaugcauguuguguuucuuuauacacauauguauauuucaugccacacacuuuauauuauuacagaguuuuguuaaagcuggaagcaccuugccccugacuaacagggcuugagagacucaauaacucuuuauuuuaacagcuuauaacugauauuauaaaugcuuuauaguaagggauuuuaguacaugacuauagguuauuuguaauugcugcaguuauuuuaaaaauacuuuuguuggugaauucaccuuuauuucacucuuggucacuugcagggauuggcaagcaguugucaucacuugaaaaagcauuuacagagcuuauauaaugugacaguuagugugcagacuaugggaaugugaagcacgggcaccugugaggucguuaaagucccuuggggcacugggccuuuuguagcugccuauuuccauaggugcugcacacaagcaugcauaagauguucauggagggacagaggaggaagcaugaccuggugauaaauaucauggagugaauucugaaauaaacucacaucuuuuuuuuuuaaacaaaaguaguuacuaugaaaacaacauguucuuauuaaagacaacauaugagaauaaauguuacaaaaagguacccuugguaagauaaaugaaaagguauuuauguaaccacuauuaagaauuugaaauauuauuugcuuucuuccuuuccuuuucuugcuguuuccucuaauuuauauugcucaugacuuugaaaagucggaaauguucgcuagacaauguguggaaguacaaggaagucggagagcaagugcagguuggcugaaaaaccugguucaaacgggagcguauggcucagucugcaggugugacaagggcuggggcguauuggacuagaaagguaucaguggcuugaccggaggaagccauugaaggaucuuuagcuuagaagagaaaugauaaauacagauguuuuaaaaagaugcauucauaaauucugauucccuuaagauaaugguggccacuuaacuuuguuacauaccacacaggcuuccaaaaucauacaggcuaacuaugagaguagagaguuuaaucuguagcucauguuuagcagaaaugugagacagaaaauacugugaacuucaauuuacuguaaguggggaaaauauccaaaauaacacaguuagcuccagagccaggauggugcagcagaaggagauugucuugggaugcugauaucauccagguuuugcacacagaagaaaauaaugcauccugugaaugacuuggguaaguaaagcuuugggacauugaagggacuuguggagaaaguacagguuggaagugacguugggggaauguauaggggcaaggggcacugguaaagaguugguggcucuaggaggcuugguuaggaagaaaaagacaaaguugaccuuccugaaacauuauaauaaccaucagaagagucagcccacaccaucccaaaaggaugcuuuucauugaagacauagaacuucauugugccuguagaagaagggacucuuggacuaagaaacaaauuccaccucccauccuuggaauaggauuuccuauuuguacagauucaagaaaaauagcucuuauuauuaugaauagaagaaacucaucuugcugucucgcccaggcuagagugcaguggugugaucauagcucauugcaaccucaaacuccuaggcucacacaguccuccugccucagccuucuaaagggucgggaucauagacaugagagccaucgugccugggccaauguaguuauuaacagaagaaaacauaagugggaagcaaauuuucaauuaauaaaaaauuucuaaaagcaaggaaagaaaaaaccucaaugcaaaguaauucuauaacagugcaacaagccugauuuaaauguuacuaaccaaacaaugguacuuaggaaagaacaccauaaaucagacauuuaaaaacacaagaaucaaaauggaauaaauuucucaagaauguaagaauaaaagcucaagaauaaaacaggauaacgugaaugagaaggcuaacugaacucaggagaacacugaacgugagcaucugagaagggaggaccgaaucacagcgugccugugggggaugcacaguaagagauagggagguuguaaagaagagagucaaggaaacgagauaaucaaagaggugaaaaggacuagaaguugauggauguggaagauuggcaagaaauacucaacaugagagucuugaaacaaaaucaugaaaugguuugaaacauugacagcucaaguguguguuauuaaauacaaggaugucugaagguacacacuaaaagggcccagcaugcacgugagaaaacuccaagacguguaacugcugucauauuuuacauauacagggaaaaauccuuugaucucccugggaaaaugaccagcuccccacaguuggaaggggccagguuggugucaguguucucagcauacggagccauacaagagcagcacagccuuuccaggaggcucaggggaagaaugugugaguggaguguuuugcuccuucaaaacuguccugcaagugccaauucuguggagagcagucucaagcauacagaguucagguguguuguacacaugagccuuuugugaauaaucuuacagaggauuagcucugccuggcugauagaugaccuggguggaaguuuuauggugagcacugaagaucuaacagacguaagaauaaaacaguggagggaggauggguggaagaugguacaguguauaugaauuuuauacgcuuccucuaauaaucagcugaaaagcaggaagaggaggagaaaauagaaggagcucauugguugcuacguggguguuaaggcagucagagacuauugaaagcugacgagcucaauaguagcugucaaagcaaggagaguaggaugaaggcaggcuacugggacaguggcaaaaugguagugaccagaaaauacacaccucaccaaaaaauaaauuugguuuuaaaaauuagacaacaguugaucaauucauauggcuaaagaugcauaguaugcaggcucuuucacacagaaaauuaauuggaucagaaagccuaaaggaaagauauaucaagcaaauacaaauaaaaaggaaacaggaguugcagucuugguacuuaacaagaauaccaguauagaaucgagaaagcauuuagaaugaggugaagaaagaugcuauaagauaauaaaguccgucauaggaaacuuuaacaucuaccugcaguucccagugggucagguggacagaaagguaggagaggcauagaagagagagcucagaacaugagcaguaaaauauaucauuuuaaauuuuuauugaacuuuguuccccaguaauuuuuauuugagcauauauagggugucaccaaaaguugaacauacauuugcuuguaaagaaauuuuuauuucuauaacauagaacucauacagacaauauucucugaucacaaugcaauaaaauugguaagcaguaacaaaaucagugaaugaaacgacuuucugccuguaaauguaaauauauuaaucaauuuuuguaucauaggagaaauauaaacugaaauuggagaauuucuauaaaauauugguaauggagacacugcauaucagaaucugaaucuguuugauauguuuggaaauaggaaaauuuauaaucuuuauauauauauagcaauaaaaauaaaaaugaaaauuaaugaauuaaauaaguauaugacaaagugaacaaaaagagugcagagggaaggaagaacauauaaagguuaaggucauauaacuaaaaaauagaaccuuaaagccauucuguuaggguggggauuucagaggccagguaauaaaaggagguaaguuuuuuaaaaaauacuguguguuaagugauacaauauugauucagaguaaacugugauaaguaaagguugcauauaauaauucucagagcaaccacuaaaaaaagaaagaggucaguagaggugaugaaguuagaugcuaaagugggaucaacugguuucuuuccccugaaaaaagacaggugcaggaaacccaauaccaggugugacaaguagaaaacaaagagcagcaaagagcaagaugguugacucaguaauuaaacgucucugcaguuaaaaggcagagacugucagacuggagaaaaacauaguacccccgaauucauagaacuaauaggcaacauaaaaucuacgagaacggauuuuuuccuucuaaucuauagaauaaggacauguaguuuauuaagacuauagaauauuaaaauaacauuaggaaggcacuucagcauauugacagauauuauuaaaugcaacagcuacauaauacacauuuuucaaaaucucauggaacaaucccaacuauaguugaauauaaaacaagucuuaguauauuuuuuuaaaauugcaauuguauauucacuaauuacaauauggaauuagaaauaaauaaaaaaucuuuaaaauccucagguauuuggaaauuaaacucaaaaaccuaaguuuaaaauuagaugguuuaaauccccaauuaaauggacaggagugucaaguuguauaaaaaagcaagauucaaauauauggugccuauaagaaaacacauuaaaaacacagguaaaaaguaaaaaauagauaccguaccaacacuaaucaaagcuggaguuacuuauaguaauaucacacaaaguacauuucagaacauaaugagaaaaggguuuauuauggagacaaguaagcccuaaacauuuaugcacuaauaacagagcugcaaaauacggucaugaguugcuuaauaguagaguuacauucugagaaguaaguuagaccauuucgucauugugcaaacaugauggagugcacuuacacaaaccuagaucguguagccuacuacacaccuagguuauaugguguagccuguugcuccuguacuucaaacuuguacaacauguuacuguguuuaauaaugugggcaguugucacacaaugauaaguaucuguguaucuaaccauagaaaagguacaguaaaaaaugcuguauaaaagauuaagaaaugauacaccuguauagaguacuaacgacaaauggaguuuccagaacuagaaguuggucugggugagucagugagugaguggugagugaaugugaaggccuggacaugacugcacacuacuguaaacuuuuuaaacacuguacauguaagcuacacucaaccuauuuaaaaauguuuuucuuaaauaguaaauuaaucucagcuuccuauaacuuuaauuuuuuuuuuugagacagucucacucuguugcccaggauggagugcaguggcgcaaucucagcucacugcaaccucugccucccagguucaaguggcucuucugccucagccuccugaguagcugggauuagagucacgcacugccacgccgggcuaauuuuuuguauuuuuaguagagaugggguuucaccguguuggucaggcuggucucgaacuccugaccucgugauccaucugccuuggccucccaaagugcugggauuacaggcaugagccuguaaacucauuuuuacauaccuauaacuuuacacaaaguaaauuacacaaaguaauuugugcccggcccuauaacuuuaauuuuuaaaaaaucuuuuuacucuauuaauaacacuuagcuuaaaacacaaacacauuguacaccuguacaaaaauauuuucuuuauauaccuagucuguagucuuuuuuaguuuuuaaaaauuuuacuuuuuaaacuuuuuuuuguuaaaaacaaagacacagcugggcgugguggcucacgccuguaaucccagcaauuugggaggccgaggcugguggaucacgaggucaagagauugaggagaccauccuggcccauauggugaaaccccaucucuacuaaaaauacaaaaauuagcugggcgugguggcacaugccuguagucccagcuauucaggaggcugaggcaggagaaucacuugaacccaggaggguagagguugcagugagcugagauugugccacugcacuccagccuggugacagaacaagacuacaucugaaaaaaaaaaaaaaaagaaaaaugcagacacacacacacacacauuagccuaggccuacucggaucaucaguaucacugucuccuccuacacauuuuguccugcuggaagaucuccacguguaauaacaggcagggauuugucccaggauaacaauguguuuuucuggcagaacccuggaaggaccugccggaggcuguuuuacaauuaaguuugucuuuuuauaaguagaaggaguacacucucaaacagugauaaaaaguauaguaacacauaaacuaguaacauaguuguuuguuauuuaauauuauguacuguacauaauuguaugcacuagacuuucaugacuggcggcccaguaguuuuguuuucaccaccgucaccacaaacacgugaguaaugucuaaugcuaugacauucugauggcugcagcaugaccaugugguaggaaugcuucaucucuguuauacuuugauggggcuacugugguuugugccauccacugucuacugaaauguuguuauguuguacacgauuguaccugaagcagaaacuguuagaacuucaaggagaaacugacaaauccauuaugauaguuggagauuuuaauacccacuucucaauaauugaacaaaugaguagggagaaaaucaguaaggauauaguagaacacuauaguguugaagaacacuauucaugaaguugaccccauugauagauacagggacuuaaggcagcaggauggguagcuuacccagugcacacagaacauuuauuaagguaugccagaaaaaagcuuaggaaaaaaaaggcaacucauaaaauaugcucucugaccaagugggcuucauuaagaaauuauaauaaagguuucucggaaauugccaaauaucagauaauaaaggauacauuucugaauaucuugugaguaaauguguuuaugucagagcagagguggagguggggacugucggggucagagcagagguggaggugggaacguuggggucagagcagaaguagugguggaauuguuuucaucagaauagacuuggguggggcccuggauuuccaggccacaaugcucaguugccauugagguucuagagccugaggcucccacacccuuuuaggagcuggugcuggcuguugcccuggcugcuuuaggacggucgguuggccucucaggugcaagugccaaguguugagcacaaacugaauuuaggaacgggaauggcuucaccccaugaggcacaagacgugugcugauggccuggugauggugaccacuugugggaggcugugccacucaaagagagaaacuuauuugugguuuucaagcuaauuaaagauacauuuacuuuguguaaauuacuucaaguucauucacacagauagccuuucauugccuuugauguuuucuaacaguuuuuuucucauuuuagauauauccauucugaaaucugaauuauuuugaugauaguucuugauuuuucuguguauuuuucaaaaaggaagagaauaaagacaugauaaauaacuuguuuauaaugagaaaauggaauucaguuaaauucaaauuuaucaacugggcauuguuaaggagugguauccacuuaucuuccuuuuuuauaguguaauauacauaagacaaaauaucuuuugugucagcuuaaauacuuaaauaagaauuagaacaaauuggcugggcaugguggcucaugcuuguaacccuagcacuuugggaggcugaggugggaguugagcccaggaguucgagaccagccugggcaacauugggagaccuaauuuacuucuuuauuuuuugagauggagucuugcuguguugcccaggcuggagugcaguggcgugaucucggcucacuguagccugugccuccuuguucaagcaauucuccugccucagccucccgagcaguugggacuacgggugugcgccaccaagcccagcuaauuuuuguauuuuuaguagagacgggguuucaccauauuggucucgaacuccugaccuagugauccacccaccucggccucccaaagugcugggauuacaggcgugagucacugugcccagccccugauuucugauuuaaaaaaauuuuuuuuuuaauuagccuagugggguggcuacagcuggagcacgccuguagccucagcuaugugggaggcggaugugggaggauugcuggagccugccagguugagguggagccugcccugagcugugauuguaccacugcacugcagccugggugacagagugagacccuguccuaaaauauauauauauacggaauuagagaaaauuaauucaaggucccuguggcaguauacccaguaugcaugcugaugccugugcagaaucuaauggagauguggcgcugugauggugucugcuuccucuuuccucagauaaugugagaacaaccuaaauuacugauuguauaaccuuuuucauuaugugaaugauugauaucgcuaauuucacuuauuguucaaaaucuguauguauugucuuggaaguuuggaguuguaaauuguagccaguuuugaaguauuagcaguauuuauaguccuuuaacaucacauucccaguuagucauuuugagaauguauuuucugcuguaauuucuuuugcaaaccauagcacacuuacauuguucaugucuucuucagccaaaauacucuccuucaaaaaagcaaaccucugcuguuuguuaaguaggguaugcuguugagagaacagcaugaaaugguaacauuuugcauccucccccaagcagauuuuaucuguucacacuuauagaccauuaaagagaaggaaagugaaauagaacauuuuagagauaauuuauuuucagucuucccagucuuuauucugugcuucaugagacugguaaaaaacuaucuuuuggaauaauuuucuccauguuagaaaaauguuuauagucaaucaucgccauuccagaacugaaagaaagaugcauagauauuguguuuucuucaacauaaaauuguguuagagacagaaacauucauauggaaaaauggucauagaaaaguaacaggaaaccagcuaaaauuucuaaaaugaaauuauauagaaccuuuuguuuacauuugagaaacccuucuaaaauuuuuauguuuuuuaaugcccuuauucucuuggacuuugacauuaggagaaaauauaguacuaaaagauugacaugcaucaauaauuaaacuuucauaucaagugaaucauuaggaagaguuuaaagggaauacaauugugugaauuucuacuuggguggugaagucacgaugggcaucuucaggcaggagaaccgggaggagcaggugccugaugccucauacagguggaaggcuuagaguaacagcaggcaggaggcccuggaggagcagguaccugaugcaucauggaggcaguaggacguggaggagcagguaccugaugagcgauagaggcaggaagcuuagaguaacagcaggcaggaggcccuggaggagcagguacccgaugcuucuuagaggcaggagggcguagaggagcaggcacccgauacuucguagagguaggaggcuuagaguaacagcaggcaggaggcccuggaggagcaaguaccugaugcuucauaaaaggagacucagaguaaccacaggcaggugacucauuauagcaucaugcuugugggcacugcaggugaaagacaucuugauuccuguggauauuagaaaaagaauuucaugaguguucuuuuguuuauuggacaauguucauugccuauucugugcuaggugcuaggaagguaauacccauaaaauaugggauuagaaacaugucaauugcucugauacaauaaaauucugaauuuaugguagauaaaaauuuuauugcuucaaguuuuaaaaugauaaauagggaauucaguauuuggcuucuuaaugccaacuguaugcucaauuggcugugccaacgcuggaaccucuagacccccagcagguaaaggauauaccgugucaaccguaucugggaaguaggaaugaggaugucuaucuuuuuuguuucuucaacaguguuagaggauauauaucuuuuuuuuguuucuucaauaguguuaagcugaguuagacuguaacaccauuuguuugaaugaaucagaaauugcccauuucagugcaauccuaaauucaauuacaaaguagucuaauccauagaggcuacuugcuuuuucuuuaaaguugauauuuugguuguucuaucaaaucauaaaagucauagggauaacucaguuuuucuggauuguuuaucuuagcauugaauaaauuguaugccuuuacucugagcagcuacuuuaguuauaaacaaaguaaacaaaaggcaguuuccaucugguauuuucuguggaaaaaacaagaacaguguuggaaaauuaaguacuugaauguucuucuguguuuuaaagcccguaauagugguguguuagcuacugugcaggagcuuaauuucauuccaguguauuuugacauugguaaacauauuaccauuaguaugaaacuauauaaaaaauaaagcaguuaaagguauaaaccacuuuuacagcccuccucccuuccugauacaaauacuaguauuacucuuuugacucuuccuuuuaaguucuuuucccuuguaaacaugcaaauuuauauugggauaauauaauucucagguuuuccacuuaaaaauauauauccuuaguauuuugcauaugaauacagguuaauuaucagauuuuuauaaguuguaacugcuaaguucaggaaagcaugcaacauguuguacuugauaaaguggaauuaauugaaggaaguaauuccuaagggacuguagaguuaaagguauuuguguaucugcagaaauaguaauugguccaugcuggagucagcacauacuguagacagauuguuuccauccaggcugugucugcagggcgccugcuccuuaagaccauugacaucacugagaagaccucuuuguguccuuuguuguggcuggcauugcacuugugccuacugagaucauauuguagaugacguaaccaagguacuguuuauuuaaaugccaguguauauuuuugaaaugauuuuuuuuuucaaagaaacagcacuccagcuguguuguaaacaauucccagcaucauagccuucauucucccaaaggcucagacgcuaaggucagucuucaggucaggcggucgccuucuugugaagggacgugguggaagguucaugauccccagggcccugagagucugacccugagcugcaccugcauugcaggacacuuccuaacuacugggcuugcuauuuugggcauacaaggcaacuggaggccaaacgccuuccucaaauugaauguaauugaaaauacuuuaguuacuaaauaauugccauauuaggggaaauauuuuggaaacuguuaggauugguuuagauucugugcuucacaaauaaacaaaucaaguauaugagagaaucagauaucuagcaaauaucuuccaaguaaugagcaaaacggccaaaauuacaucaucugaaagugguuugauaaguaacuagaaggaaaacaccaguuacauaaacguauuuuguacaugcagauuauuuuggaaaauauguuuucaauuucuuuccuuuucaaauuugauuucuuuuuuuuuuucuuaagguauauccugauagcaaauuaucauuucauaacaaaauacaguuuguggagggggcauuauuuuacgggagacgcccaacagucaggacaguguguggcuuuuacccuauccagaugucgaggucacugccucccacacgggacgucuucccuguguuacuucuagaugcagggcuguggaugcauuccuuuauucuaguaaggcuuccauuaccgaaauguaggccaugacuuuacauuaagaugaaaaauucccagauuuuaaauuguaauuuucuucucugaauaugaacauugaaaguguaaauguaaaacuagacuguacauauugcugucgugauacugauguguggccauauugguuugcuaucuguuaagguaguuagcaucauauaacguacuugaauuuuguuuaagaauauuucguguaauaacagcauacuuuuuuuuuuuuuucuuugagacagagucucgcucugucgcccaggcuggagugaaguggcgugaucuuggcucacugcaagcucugccucccggguucacgccauucuccugccucagccucccaagcagcugggacuacaggugcccgccaccaugcccagcuaauuuuuuguauuuuuaguaaagaugggguuucacuguguuagccaggauggucucaaucuccugaccucaugauccacccaccucggccucccaaagugcugggauuacaggcgugagccaccgcgcccggccaauaauagcauacuucuaaagaggaauuuaagagaaauacauuuuuaaaauauauguuuauuuuuuaacaauauucacagaagcauuuucucugucgugaauacaugcacacuuaaaaagcauugcccuuguccuucacaagagauagagagaggaaauuaugcuaugcacgcaaaagaaauguugaagaguugacuugugguuauuucugugcuaauauuuucuacuuuuccaggaguguuguuaaaugauguguuaaagauguaguugaauacgcuaggcaugcuggaugcaccuguaaaccuagcuacuugggagucugagaugggacgauugcuugagcccaggaauuugagaccagccugggcagcauaauaacaccucauaaauaaauaaauaaauaaauaaauaaauaaauaaauauuagaagguauaguacuuucaugaaaauuuagaauuauuucguuuguguauuaauguuaagcauugcaagcaauuaauugauuacaggaguucuuugaacuuguacuuucaauuuuuuauagucccuuuuuucuaacgucuguuuugcagugccuuugcacugcuguucacuuggauugagcuuguggaccuguuucuaauacugagguuauauaaggugugaauaaugaacaaucauuugacgguuuuguuuucuuuuugucucccugcacaggaagacagugacccgcccauucaugaaagucucagcauagaaaauacauugugggcaagcaccauuguugcaucagguaaggaaaacauucuccucugagugugauugcucccggauagaugaugcuuuguuuuguccagggacuccaaacaaggguuucucacagugcccugaaauauuuagggaccuugcuaaacgcagacuccagcucagugggucugagacaguccugggagcuuguggugaggcuugugcugcuccucagacacugcacgugguucgcaaggccugagacagggagaggugcugcagccuucgugcaggaguacagggauauucuguucgucuuugaccuguuucuugacaaacuugucaguguuccuuaaugagaggcaccacagaagagcuugggaagccaguggugauuuuagcgcuucucagucauccgacaaggguuggcaggaggagaguggcugaagugacuguggaacggaaaaguauuagaagaggccaggcgugcugugagagguagacgaugucagaugauuaccauguuaucagguaugaguugacauugaugaugauguuuggaaggaagcugaugagaaauuaggugaugcugagguugaugccagggaggaaguuuaccaggaauggguugguaucgaugcuggugccaguaauggggcuuagcagcagggagcucuggaagagagugcccgaaaggugauggcagccuggaaugagaggcuagauuguuggagcugugucuucucggugcugcccagugcugggugcccuucucuccuggaugccacucacucccccaugcaugugcauggagcaccuguucuccaccaggcacggugauucagucuggggcaaggcgguuccauauccuguccucagggagcuuauggcuuuguggacagagguuaagcaaguguucuagguaauguugcugugcuaaguaucaccaacacguacagagagugcuguggacgguuuguaauuaaagaagcuuauaggccgggcgcgggggcucacgccuggaaucccagcacugugggaggccgaggcgggcggaucacaaggucaggagauggagaccauccuggcuaacacugugaaaccccgucucuacuaaaaauacaaaaaauuagccgggcgugguggcgggcgccuguagucccagcuacucggggggcugaggcaggagaauggcgggaacccgggagccggagcuugcagugaaccgagaucgcgccacugcacucuagccugggcgacagagcgagaugccaucucaaaaaaagaaaaaugaaguuuauauagaccaggucuaggagcagcuuuucugaagaagaaacauuuaacuuggauuuaaagaauaugcagauguggcaggaugaggcagguggcagaaacagugugaggagcauuccugcuagcagccuaguacugagagacaguaccuugaagaaaaggauccaagggccagugugcuaggcccauggagaaggcaggugucacacaacagggcagcuuugugugcuuguguuuaacuguuggccugcaguaugcaaaacuaacuauacaacgaacuccaggaggaggacacauguuagcuuuuuggaugauagaauuugaaagaggauucaucuuauccuaguguuuugugucuuuaaaaaaugcuugauggguauaugacaguuuuaauaggugacaauuuuuguggguguuucaugauguuauuuauauauaaauuacaucuauauauaaauguuacauacauauaaauguuauguguguguguguauauauauauaaacauacguauauaaauuucuuaacauacaaagaaagagaacaagacaguuuuccaugaagagacuucagaggugagcaggacaguuucugggcucuguaggccucgagagggaccucaugccaggaggacucuucugggguggacaagugggcccugagcucuguaagggucuucacaccaugggcaggcacauuuagccagggaaaccugcccuccagccuucuucaugcugcugccuuggcauugcugagaggcaugaguguugccagccucuccgccagguggugaguguggucagugcuggccuggccucacgcugaauggcugcacucgggagguguguucccccugccaguuaccauagagccaggcugcacagggaccagaauggaguccagcugugcauucccugaaagccaguguccuugagugcucggccuucaguaguuacacgaaagcauuuaugauacaggacucagaagcugacacauggggagaagacuuacauuuuccauacauaguuauugcagccuguuucuuccaucucacugauauuuguuaauuaagaaucauucgugaagauaguaaugcuucccuuuuuaaaaauaaauuucaucuuuuuuuccuggugcugcauaaacauauauuaaauguuguuacugaucccuaguacuguugauuugugacccuucuccugagggagacuaaagcugcuugagcuaaaggcuuuugagacaucccauacgguucccugaacaaaguuuucucuccugaccucaguucucuugaugaccuuggcaagugggcccgacuaguuggacacuaaugaggcaucguaacaugccggccccauccuguccauucuguucucuuugccaucuagcauucaguguugugucuuccuagugggcaugaagacggcuuuaaaaccauccacucgagaagcuuaauuaagguaccuuuaauguuaguuuguauucgaacaucuuuaaauguaagcuuuaauuucagcucuuuuaguacauacauaucuuuauuuaaaagccuuguuaaugugaacaguuacacauucuauauaccacacugcuauauccuaaggaauguuugaaagauuuuaagauuuccagaguaaccuaggcacucuuguauucuuuguaauugauuacaaguugagaauuccuuuuacucuuauacuuuaaaagucguaucucaguugaauucaaguugacucuggaggggaagugaacucagugcuuccuccccaucccuagaguucugaaugcaugggaaccgggacucagguuagacacagacaggcagaugcagcagacgagaggugagccaaggcaggacacagagagccugcugugcugccggagguuucacuucccauguggauccagaaaacuugcucucuaaaaugcagaacuggguccuggagaaccaucguguuuauuauacugaugagcauacaaaggaguguuccugauacucagcugucacaaaacuggaaggaaagcugggcucucuaaggcaagguugacaaaagugugacggggcugucagagggcaaucccuggccauguggacccacgccugggugcgggucuccuugucacucagugggccagccguguggugucuagaccugggugagggucuucugugucucugugucucagccauguggacucuagaccugggugugggucaccugugucucuguguccuggcuguguggacucuagaccuugguugggggucuccuuuguagucugugcaccaguuuuggucuagguuguuuacauccuggggcucaguucacggucuucaucaguuuuccugcacuuggugcgugguuggaguuguacgugcagugcucagugucugccuugcuaucaucggguccagcccgggagcgccugccccagggagcagugcacacugggguucuguggaaauuggcuccuggagggcaucugcgaguuggaguguguuccagaggcugguguauguggcccugccugcuuuugcuaacgguaucuagcagguuuuggguguauaauugagagucaacaaauacauugauuuguuaauaccucugucucucauuagacacacaugaaauacauauuuacuuuuaguaagcauuucacaucauuuugauuugauaacuuaaggccauuaauuguuuuguuaaaguggucuagguuuuauauuuuguguuuuuaaauaauuuucuaugaaucaucuuaauuaauuugaauuugugaggauugguuaucugcaaauuaaacauaucagugguuagaaauagcaacuaaaaguauugcaauaggccuaucauuugaaauauugaguggacuacuuguuuggaagugcuggauuaugauuucugguauaaacuagaaauguuuaaauaaaggagaguauauuuuucuacaaaauuugaccuuguuagcauucuuugucuugcuuugcaacauggaaguuguuugcuuaaaauacaacuguagucaauuagaaggugguauaauuuugcaugaaauuuucuauauagccuguagcaaggaaggcacauaguaacuaacagaguaauuauuaucccacucacaugaaauugugauugaacagaaguuggacaugauaggguuggacuauagaaugacuugcagaccauccacauagcagccucuuugaaguaggcuaagucucgagggcccuagucauggggucuguggaguguaggaguaaauguggucauauuuuaugccucccuuuuuggacccaaagcaucugaauauuuaauauuaauuuuuaccuguagucaauuugaagugugcaguuauggaucaggcaaauguaaucacuggcuuugaagauuaagugcuccuaaaucuuuuaaaauguugucuugggauaaaugaaguuaaauuuuugauuuaaugaugaauacuggaccaccaucauuuuuaggguccuguuaagaacugguuuguuguugugguugugguuuuaaucuaccaacaugguccugaacucaggucuuucugauguagaaguuucuccaguuggagcgcguugugagggagguggaucuugauuuuacacugaaaauauggguuaaaguuuuggaauucuucuguuuaaguauuucauugagugagaaaucuuugugacauuuauauuugucacauucagucuccuguuaucuuauacgacacaaaaugaguuuaucauacuuuguugcccucucaugucucauuucgcaauccacaguuaaucccuuuccucuguuuugccuuguauacucagguuuuacucagucuuuuagccuauuguacuucauaaguacauacccuuugugaaagagaauggaaaaugucccaaauauuucugcacugauucuaguuacguuagauauuaaaaagcaugacacucagaaaaauucauuuaaucuaauucuaguaaguguugauuuuucaugagaaucaagugagagaauacuuacgagagccuuuagcaaacuuuaacagauuauacaaauauuguaccaggaccucuguuaaaaauguauaacauaugccuuguuauguaucacauugaauugagguacugugcauuguaaggccacucuagaguccacuuugcucaucagucaaccugcuuucagcucaacgguuucuagcuugauuaauucuugcaaagccuuuucugagauuugcucauucugcuaauguuaaaaaauaaguuaauuuugcaguuugccuucuuacaucauugugauaauuuaacauuagugggauguuuauauuuugauuuaaacuagauuggcaaaacagaaaauacugaucagaugauauuuaauauuuagcuucacugaugugaaguaauucuaugaucuccuuuugaaagcuuuuuauaguauuguauuauauauuuaauauuucucugcguaguaaguauagucaucuaaucucagaaguuuauguggauaauaguaauaaagacggcauuugugcaucggggagcuuauauucuaagugugagcuggccuugccuuucaugaacuuuuacaaacugaagccucacacuucucagugacacucaauuaaaagagaaauauauauaaucuccacacauaucccugcuggggaauacuucacaucuuccaccuuccuagauuuucuagagaggaagguguaagccaugugauauguauaauauguaacauaucaagguucacgaaaagccgggaguucauaucaaucaucuuuacuucaaagagccugucuuaugaugcucugcauuuuacauguuaaguuaaugugacaucagaguuuucauauaauuauuauaguuaauucuguaaugguugguaauugcacauuauguguauauacuuucucaccuuaauuguguuucucaccuucaaaauuuacaaaaaauuaaggaugaaaauuaggaauauaaauuauauauggcuguaguuucagaaagagauuuccaugguuuuuaauacugacauucuagagauaagugcccuuuagccuuugaaaucuaucggucauaccaaggauauuuuauuauucuuuucucuuaaauuuaaaaauuauuauaucuuuuugacguguaaaagagaguaauagcuucuaaaugcaaagucaaauaccguuuuuuauaauauuucuauuauuuuaauuguacacauuuugaaauauuagcaaaggcugucacugauauuuaguaauacuuugaucuuuacaguggaaauacacuaaaagaaagugguucaucugguaccaucuuuauuugaaggucaaaggacaaguuugauuaguuaaggauauagccucuuaauugaccuucagugauagaaccaccauuuuaguagacaguagugaaaggccauugucauuaucucuauugucagugaaaagaauauuaguacguuuccuaauguuauauguggguacauuuguauugcuuaacaaaucauuugacuuuuucaaaguccauuuuuaaaguugagauuagauuuucuugaauuagccaaauuaaauacacuguuggauaaauuuauauaaaaucaaauagugugauaauacuuuccaucaaaacaauuaauuagaaaguguuaucuuuuacucaucuuuaaaguauuucuacaaggaccacuuucauguuuuugcagguacuguaauagguguugucauuuauaccggaaaagagacucgaaguguaaugaacacauccaauccaaaaaauaagguaggcuagauugaggagcaacugcuuuaaugaacuuauuuuuccuuucaguaagaaagucugcauaguucugaauagcucauucuuuuggcuuaacauauaucuuaaaguagacuuucaaaaauguuggugacuuacaauaugaauucuccguauuuauauaacaacauucucauacuggcgaauuuccaaaaguaucauugcuuggcuaaucaguuuuauaugugucuuaaauuuucauugucagauauauaauuugcccguaauuugacaguuaauuguggcuaauuucuuaucuucagucuacuuauuuuacaauuugcacucuuuuauguugaugguucauuuuaaaauaaagcaaucuguauuaauguuuuuauacuauuuaauuugauguuacaguauuaagccaguuuuauuuauuuccaugucagaagaagcauauugaagccaaagauuaguuuuaaagaccgcuugauuauauccugaauugauuauauuucuaaaauuguuauuuaugcauccaacauguguguaaaaucauaacaaaaagucugaauccucaguaguugcuaucaucaugauaccauaugugagaugaauucacaguaugugcuaauguacaguuaaugagaagcucuuccuaaguauugauuuuacucauuuuuauuuaaaauguaauuuaugugcauuuagaugaaacaaaaaauccucacauggauuuaugccucacucuguggguaauuaauagugaagguuaucuuuugcugucuuuuucuggaagucuuauuaacgcaguggaaaucaaauaauucuuugaaaagauaggccaagcgugguggcucacgccucuaauuacagcacuuugggaggcugaggcaggugggucacuuggggccagaaguuugagaccagccuggccaacauggugaaacccugucucuaccagaaauacaaaaauuagcugggcaugaugacgggugccuguaguccccacuacucaggaggcugaggcaggaggauagcucaaacccgggagguggcgguugcagugagccaagaucgcaccauugcacuccagccugggcaacagggugagauucugucucaaaaaaaaaaaaaaaaaagauauauuugagcaagauguauuccauuuuuucagguaaauguuauuuuaaaaaugguuaacucuucaaaaauuaguaacauaucaccaacccuauaaaguccuaggccguuugcagcaguaaguagagugaggccuucugugucgauuguuugcuuguucacuggggcaugccuugagaacgcccuuagcugugcacacggagaauccagugugcaucuccuguaccugauagaaccccagauaucuguguguuacauguuugcuaaagucaaagaagaaugcugcguuacuauugaguauaaauccuaauugugauaauggggaaaguuaucucuuuagacuuacauugcaguuugacucuaauuugcauuucaaauauaugcaagucaguaguucuacaauaguguuacaauuauuuaaaaauaaauuauuaaaguaaucauauauagaguuagaaucacauacguauuuauauguguuuucugauaagugcuauguuauuuuuuucaugugagcaaaacuagaacaucuuuuuuuuuugagacggagucucacugugucacccaggcuggaguacaguggugccaucuuggcucacugcagccuccagcuccuggguucaagcgauucuccugccucagccuugcgaguagcugggauuacagaugagcaccaccccaccuggcuaauuuucauauuuuuaguagagaugggguuucaccauguuggccaggcugguuucaaacuccugaccucaagugaucugcucgccucagccucccaaagugcuaggauuacaggcgugagccaccgcacccgaccacaaaacuagaacauucuaauguauguacaguucuaggauuuuuuuccuaaauguuacuuuugcauuuaugaugauauuugaggguaaauuaauuuuaaauaugaauuuaaaaucuuuaaagcuacacugccuuuuacugugauuccuuuuuuagcccaccuuuuucuucaguucaacuuauuuucugucauuuuuucauuucagucuccacuuuauuauuucuucccaucuauacaccuguuacuuuuggcucgucaagcucuuuacucagggucuugguucugcguuggagcggccuccuaguuuugcaagcaugguuuggaauguagcccugaagccucgcugcugggucuguguccaggccuuggugcacacucgugugucccucagccucuucacccucuccacccuccccucucugaagugggcuugccaggaacaaggucaugcucaugcacacguugcucuuaggaaaguacuugcuacaugacagaugcucaguaaauguuagcuguaauuuuuauuuuucuauaaaaggaaagguuuucagugugguaauuuuucagcccuacccugauugcuagucaagaaauggucauuuuguaacuaguuugugcaaggcaggagguucuguacugucagcuaccacguggccuagaaauucuuccaguuuccgcugugugggcauuccuucucucccucuucuuuucuuuucccuguuccucucuuccucuucuccuuucuuaaaaaauagucuucuaaauuugcuuauuguuggcagaauauaucucauaauugaaagggugucuuuggaguuuuacagaauuggauuuacuucuugcugcuuaccauguuagcuuuucaaccugauguaaaaguguucuuucaguggcugguauuuuccuggugauuaauacaugcugaguccuccccucccaauagggauucacgauagcgguucuagcuccagcuuggagaacauugaccacaugguaggcacuugucuaaaacucuacguguauuaugucuugaauccacacgauggcucccggggagaagagugcguucccgacuguagagccggggagaucacaaggcauggagccgugacacgucucaagacaaagcgcugcugauagugaagcuccugaggacguuuuccuuagauuugguauuuauuucuuuguuuguuuauuuauuuauuuauuuuuugagacagagucuugcuguguugcccaggcuggagugcgguggcgcaaucucggcucacugcaaacuccgccucccgaguucacgccauucuccugccucagccucccaaguagcugggacuacaggcguccaccgccacgccuggcuaauuuuuuguauuuuuauuagagacaggguuucaccuuguuagccaggauugucucauucuccugaccucgugauccgcccgccucugccucccaaagugcugggauuacaggcgugagccacugcgccccgccagauuugguauuuaaacauccaauuaagacauaacauaacagggaaaugaaauauauacuuaaauauuucugaguguuaaaugcuaguuuuacaagaauaaaauucaggagaagguuuugagcaagcuacacugggcgaaagguaacauguaauuuauccaggggaagccucgguauugauacauguugaauggaagagaauugugacauuggucucugaacagagacggaaagguggaaauuauuguuuauugcugguaagacuguuuucugacggugacaucacaguguucuucuguugcuuaguaaaccaacaaacuuuugggcuucaaagaaggcuggugcaaacaaaacgguaaacauguacaggggaaaucucaucucauccuuuaccugagcuuuguuggauuucuucagguagcaaaaauguuucuaacacucaauucugacagcucucugaguagaagccauauugggacauugauacauuggaguucgucgucagcagagaaauugagcugcaaauacauauuuuugaaugaguagugguuaucggucaggauaggcugagucaugcucugauaauaaagugccucauacuccgcaguggcuuccccagcguuguguuucucauguuccagguccggccaggcuggcagcuccugcuggucauguuuuccucauguucuguaucuggcacaggcuggcagcuccugcuucuugucauguuuuccucguguuccauguccggcacaggcuggcagcuccugcuucuugucauauuuuccucguguuccgugucugacgcaggcuggcagcuccugcuggucauguuuuccuuguguuccaggucuggccaggcuggcagcuccugcuucuugucauguuuuccugguguuccaugccuggcacaggcuggcagcuccugcuucuugucauguuuuccuuguguuccuugucucacgcaggcuggcagcuccugcuggucauauuuuccucguguuccguguccggcacaggcuggcagcuccuguuucuugucguauuuuccuuguguuccuugucugaugcaggcuggcagcuccuguuggucauguuuuccucguguuccggguccggcacugacuggcagcuccugcuucuugucauauuuucuucguauucuggguccagcgcaggcugacagcuccuguuggucauggucacucagggccugucuuggaaacacauuuccaugaccacugggauaagaaaauacugauguggccaauuacauacugacugauucuuaaggcuuugcgagcgagugauaugggucacauuucauuggccagaacaauuaaaaggccuuggccaaguucaaggagucagggaguugcacuucuagcucgugugcagaaggagggagaauuggaaauacuucaugagcagcaacagccacgaacaagauuucccagggcuuuuacacaguguacgaaaaagaggaaccuugcagaacccggaagaauaccaauauuuaagggauaaggagaggaagagaaaccaggauaagaauaaugaaugaggaaagcauuuuagggaguggccaguagucaacagugugcuggggacagagaagaucauuuggagugaaaaguagaaaagagguugguaauuuuagcaacgaggaaaucuugguaaaauuaaaacugacaguacguuuauuagggugggacucaggugcaaucacagcuggaggacucuuccaaggguuugggggaaggagagagugcuguguugagggagccggguccagggugagggagagggaauucugagcauauuuaccaggcagcccagagcauggcgguggcagugcugaugagaaguggacugauugugcuguaagggaagagauuuuauugauuuugguuuuuuuuuuauggugagaaaaauccauaucacaaaccuauuaauguuuuuaguaaaagaauagggggucuuacaaauaaaaauauuaaucauauggaagaauaaguuuagugggcauccaguaguaacuuaaacaggauaagauuacugaaaagaaaaucauauagaauuacauggccaccacaggaacuauggcauuacuucuuucauuuguagaaaauauuucaagucuaucaguaugucacucuuucugucucccuccccucuucucuuucuuucuccucccucuccuuccguccuuuuuucucuuuauauuuauuuccuuucuucauuacaguguguauagcaggacccugacaauucacaaaauugcuuuacguuccugagguuaaaaaaugcuucaguaaaaucugauauaagaaagaaguuaaucacaacaacacuuucgguagugaaauugaugcaacaugguaagacuuugagacaguucuugaagggcucaagaagacgagagccuaacaauuuaggcucauacauuguuggcaaugugaaggauccagcuguuguugggaaucuuaaauuuaaaauggugccaguaaccaggauauggcuguucugaggcugauguucaggagccccaacgcagaagcagagauaggcugcugggcuggugcagagguuugcauguggacauguaagcagagaaggcagggacagccggucgugaugguggauggcagugagagggcuccuuauggacaaggaguuuuggaagcaaaguaguuauuggugguaagacuucgaguacagugaugaaaaugaguuguugaaguuuggaggcuguuacagacacuggauuaucuaaaauuauaagcuuuuauauaauauuuuggagagcauccuuuccuucuuacaaauauuuucugccaggugcaguggcucacuccuguaauccuaacauuuagggaggcugaggcggccggauuucuugagcccaggaguucgagaccagccugggcaacauggcaaaaccugucccuaccaaaaaauacaaagauucccugggcgugguggcaugugccuguaguaccagcuacucaggaggcugagguggguggaucgccugagccuaggaguuugaggcuacacugagccaugauugcaccacugcacuccagccugggcagcagagugagacccugucucauuaagaaaaaauagauuaauuaaaaaaaauacagccacuauuguagauuguaugucaaggcaaauugagcaucauuucacauuuucuagguuuauccaguaauugaucuucuagggagacaagucuuauauucgguugcuuguagaucucuuauguaaauucaauuuaauaaauaccacauuuauagaguuaucuucuuuauuccaugaugcagcaguaagaaagaagagagugcccuuuucuuuucagcuggagcuguaggaugucacgcccucuugcugggcccugcugccucugacuugcucucuucagccuuugggccucuugugcuuuugccucaguaucugcagcguccucucccguugcccucuacuguagguguggccuagacuaggaaguuccugggauauaauugccuuaaaaaucauccacauaaucccugcuacauagaaugguuaagcaauugacauuuuccaauguguugcuguucccugacucuagcagaggguguaaagcccauaagacuguguggccgagaccaggccuugaguccuugguaccuguuguuaaccaugugcaagucccagugcucccuguuggucuucagccccugaugggcccucaccaccuccaccaccgacuacccccgagucaucccagccccaccagaggcuucauguccuccugcaggacaugaaggagcauccucagcuccuggaagagcgccagccuccugcagccaucugcuuccacagauucagcugauaaggaggacuugccccaucucagcugcagguucauugaggaacaguguguguuaguacuuucaaaacuaucaggcugggcacaguggcucgugccuguaaucccagcacuuuggagcucaaggcaggcagaucacuugagcccaggaguucgaggccagccugggcaacauggcaaaaugcccucuuuacaaaaaauacaaaaauuagccgggcgugguggcgugugccuguauucccagcuacgcaagaggcugacgugggaggaucaccugagcccaggaggcauagcuugcagugagcugagauuaugccacugcacugcagccuggguuacagagccagacccugucucagaacaaacaaacaaaacuccaccuauccucccagaguuaaguugauguauguuagguauuuaacuaguuuuauuaauugcauuauaaaggcuuuuuuuuuuuuuaaacuucuaguucuccucagcuaacauccccaaacuucuuuggccaauuuuuuuuuuuuuuuugccuuuauuuuggccaauuuuguucuuuuuuagcugcuuuaaaaaaaaaaaaagaaagaaaaacuuaugaaaaauuuuaaacauacagaaaacuaaggagaaaagcauaacucauaucccuagacccugaguucaacagacauuucccacuugccuauccuguaguuacagguaccaugcugcauuauccuaaauauguacuuuuuccaaaaaauaauuuauauuuaucucuuagucuuuaucuuuuauuuuuuuagacaggcagagaccaccagccugcccaauauggugaaaccccgucucuacuaaaaaugcaaagaauuagccgggcgugguggcaggcgccuguaaacccaguuacucaggaggcugaggcaagagaguugcucgaacccaggaaguggagguugcagugagccgagaccgcaccacugcacuccagccugggcaacagagugagacuccaucucaaaaaaaaaaaagacacuuuggcugcugccuuaacucucuuucuuguuucugugacgccugguuguccccacacucuaggugaagugguguguagaggguggccccacguaggcaacaucagcagcagagcuaccuguauugaucccacccccuggaaugggaccugaggacgcaacuuccugguucuccucccuggacuuucaaaaaaugcagcauguuuuauccagacaugaagauaagaauaaauccuuccauuuuguuagauagaggaaaauucugagauuaaaaagaauucuugaaggugaggauuagaauauuuucccgccuccuagugcuuaugacagagagauuuaaaagaagauggagucuacucaaaguuugaaaauuuuaagacuaaacaaaaguuuuuauuacuaaggaauuacuauuauauuaguauuuggugaaaguucaaauuacaaggacuacaguuugaguaauggacucguuuauaaaagccagccucagacauauuuaaugauaugagacuugauuacauuuaagggagaaaaauucuuguggagguuaaggaaaaaucaauugugacagguugccauuuucaugccauucauaauaaucaguuacucagagcaagaacaucaaggaugaaaugauaauacaaauugcuucaagcaguuauuguaaucccuuggguauauugauuuguguaucuaauaaaaagaugcuuucagaugucucauuggcagagagauaggugacaugagccauuaugagaauuagagcuggugcuuguuaucugaauaguuguugagaaauuuugagaucauggaacaaaauagaguccagcugugguguacuuugcaacuugaaauaucaaagcaguuuuggagacuagcuuucuuguuuuaaaaaagauaauuuauuaauauuuuaaaaguuauauugauuuauauuaaaauauuacaauaaaauaacuuauuuuuaucuuuucuuguaguugcauacaaucauagaaugccuuaauuuuucuaacaguugcuuucuuguaauaaaauaccguagaguuuaaauacuuauuuuaaaaugugcccaugugcuucaccaaagagcuacauauuguagaacauauuaguaguauugcaguaaaucaacagagauagaaagacucuugggaugcuuuuuuugggauaacuguuguuaauauucacaaaucauaguguuucaguuccucaucaggaaaagauuaacuagaaaacaaacccaccaugacauaauucuguagcuucuagacuagacccaggguggcucuuugggguacauuagcacagccuucacuugcauacccggcacacuuugauaugacagcugcucacaauuagaaguuguaguucuucaucugcagugugaacauaaauaaacuuauaauuucaggaaaguaguaaagaaacaaaaugcuaaguguugaaaaaacaauccuacugauagcaucuggggcauaaugcucuaucagaguguauagcaaauaucuaaacuagaaaacuuagauuuugucccuaaauuccuuuuaaauaugaauuuaauuagaaaacaggugcuccaaauaaaaaaugcaagcauuuuuauuauuguaauugauuucuaucacagaaaagacuuaguuagcuuuacauaaaguucugaauaagaagggcuuacuaauuauuuguugcauauuaaauaagaacuauauuugacaguaucucaucauuucuaagcgguauagcuaaauucucuguaaucaaaauuccuaacagagaaguguaauuuauucaagaagcaaguauuuucauaauugucuuuauuuuuugaacuccuugauuccuuaccccugugccauaaaagcuguuagaaauguauggaccuugugauaaugauugacuuaugacauuuccugcaaaacuaagcaugucucccuaccagaucaugccccgugauuucugacgaggcgaucuggaaugucucgugagacugagaaugggaaagugcuggaaccucugugggguggaaagcaagugggcauguggauggugguuauguaguugcugaagauggagaagggagagucgguaucaccuuccccaggaggauuucugugggcugccagacuagggagggucugggguucauggacaugcccugucucaugcaaauggauucccuuuguggcuaccauacaucaaaaacaggucacgugugugcuguguguucagaagccaacuucaccagggacaccuucaagccagcagccagcuagcagggcaggucccuugguuuucuaauugucgcugccaaugucuguuggaacaaggcucucugcugagcaugugugccaucuccucugcacccuccuguuauccucccuccuuaggcagagagaaacccucagugucuacucaggaaagcaccagcugcuccacccugggcaggccguguagggugcuuguccuugggggguuauggcugcagcuaggaaacaccaguggagaaggaagcccaggccaagugcagccuucccacugggagaaaagggcgaccugucuccagcagcucccaggaaccacgaccacaguaacacaagcacugcuucuugucagacaggaaagucugccaguagggacuguguuauccuggucuacauuguaucuuaagccucugacacagugucugaaugauuuuccuuaaggcauaguuuguguuuuauuucucucuacaguuaucuuuaucuagugauaauuuaaaaccuugacaaaucugauuuugacuuauucaucuuuucauacagcugaugggauauucuggaugcuaauauuuuguuuaauuuuauuuuauugacauuagaguagaaacuguaccaaacgcucucuuuuacaauugcauuaacuaaaacauguauauaauaagcuaaacaugaaauuagauaguuuuucauuuccuuuaugcaguuaguauugucagcugauaauuaccuguugcaaaacuuuaaaauauaucaucuaagaguuuuuacacuauaaugagauauuaacuccaaaagauuaaguaaacugcaguaaucaacauucaugcagcacucccuaucccucuaggcuuccucuaccaugucuucaucauggggacguccuuucgaaaccauguuuuggccccgcaguuguaggacggccacugucuucagcgucugagugacugcugggucccgcagucgcagggcggccacugucuucagcgucugagugacuguugggucccgcagucgcagggcggccacugucuucagcgucugagugacuguugggucccgcaguugcagggcggccacugucuucagcgucugagugacucuugggucccgcagucgcagggcggccacugucuucagcgucugagugacucuugggucccgcagucgcagggcggccacugucuucagcgucugagugacuguugggucccgcagucgcagggcggccacugucuucagcgucugagugacuguugggucccgcaguugcagggcggccacugucuucagcgucugagugacucuuuguucccagggcaucuuucuauucuuggcucccccauugucaucacugccuccuccuauggcagcaugaauucuacaagggcucucaggcccuucagcuucccuccuuucuggcagccucauucagaguccauagugcagaguucaagcuccugucauuucucacccaguucacgacaguggccgcucugccgcccucucuuccugcucccuccaucauguuuugggugucacagccugagucauguuuaugaaauguagguuugauaugguucguucuuuggcuaaaacuucaaaagauucccauugcucuguggcgagccccagcaucuuccuuguguuccacgggugcuuugcuccucaugcguuuuucucagacugcugucuucugcacucuuggugcuuggccacaaagacuugucagccaucuguggccaccacagcgcauccugccuuucugucucaacucuuaggagagauguaacaaaaugugcagguagaugucgccucuuccacugaaauguuagcuucuuggcuuugaggacucuguuuaccuugguauucuggugcccugcacagggucccugcucagugaacacuggugagcacaugagucaagccaugauaaccguuugcuuaggugccucaucuuccacgagacuucccacgcccuggaggcaggagcugugccuucccccuuccuuugccccaugcugcucacccgcaguagaugggggacagccuacacaagaagccaggaggaucugaagaggacucaaaugaaaauaacacacaguuugugugggggagguggacuuaucuuuaauaaaaauggaaaguuugcagugcucuacgggauaagugcucugguagcguagagacuguagcaggcuaugaaaggagugcacauugacugacacccgcuguguguugggcccuauguacuaggcacugacugaacaccugcuguguguugggcccuguguacuaggcacugacugaacacccacuguguguugggcaccauauacuaggcacugacugaacaccugcugugugucgggcaccauauacuaggcacuucuugcauugucguauugugacuugugguuuucucuuuuuuuggugggcuauaaccuguuacuuuccuugauugaccuuuacauugucuccucucugucuuuaagcuuuaagcuggccucucugucguacuaucaugaacccaucauuuuuuuaguauuuuuuguuuuuacuuccacagacagauguuccagacucaucuuguacuuucuuugcuccagcccugggcuuggcucuggguuccuuuuagcaaaaaaugcuguuuagaagucagguucugggagcugggcuugcucauguguauugccauacgcuguuuccaaaucccugcagugaacagagucaggccgcgugugugugugaauugcauggauggguggauggaugggugggcggguggguggaugagugggugaaucggauggaugggugggugggugagugaguggguagaugaguagguaaguauauagguggauggguagauggaugggugguggauggguggauggaugaugaguccagggguuucuucuaguuuuuuguuuccacauuguaacuccuucccugacagugagaaacggauuuaucauuacacugaauauguuuacugauuugagcaaccccuuaccuuaccagccuguggcccucuuuacaucccucagcaucucaccuccccccgacuguucuccuuccucacugcaugugggcuccagcccagcacuuguuucugugccuucccgggagguucuaacuguucuccuuccucagugcacgugggcuccagcccagcacuugggucugugccuuuucaggaaguuuuaucugcucugcccaggcaugugugugcacuguguugagaaagcaggacagcaacacauugaacugcccauucucuaguuuuuaaaaaugguuuccuuucaugaggguugaaaaucucauauuuguucacuuuguauacauuagccaaagcucauagugugauaagacaaaaacauuaggcauuugauaaaugcugauuaacugaacacaugaauucaucauugagugaaucaaugcaggacauauuagagcuacuuaaaucuuuagcccaaaaaauagccuuuuagaugaguauggaauaguauuuggcuuuaauugauuuaagagaaauuaucaucagaauaucucaaauucuccacuagugauaaauuuugcuugaugagcagaauuuuugcacaucuguuguaccagacuccucugcccguagaacagacugaauucacugugagagagccuuuaucuuuccauagaaaauacuggauaaauacaggggcugacacaacauucuuuacauggacuuccaucuccucaaauuccgcuaguaccaaacuccucuuacugugaagccaagggaagaaaccacugaagggugcauugccuuccuuucuaaaucuguuguucaguaaacaaaauaaucccuguuuaaggugaucgccuguugcaucugucauugguuggggauuagaaauaaacacagucuuuaaagagauuauaaucagaagugggaagucauagauacauuugucuucugucucuuucccuauauuuugcacguaguaaauaauaaauaaugauuuacucaagaugugacuugcuguucugguaucagagauacuauuuuugguuuuuaaaaauuaauuuuucuaaaguaaccucaaaguuaaugaacagauuuaagaagcuggcuggacaugguucgccuguaaucccaccacuuugggaagucguggcaggcagaucacuugaggcaaggaguuugagaccagcgugggcaacauggcgaaacccugucucuacuaaaaauaaaaaaaauuaggugggugugguagggcacaccugugguacaaacuaccugggagacucaggugggaggaucauuugaucuucaaccaggagguugaggcugcagugagcugagauugugccacuacacuccagccugggcgacaguauaagacccugucucaauacaagcaaacaaaaaaagguagcagcucaggcuacaguucacacuuaugacuucuaaguuauauaaccagauuugugcuaauguuacuguuggugcugaugugaaauauaaugcuuuuuuaguacaauacuguugauaacucacacuagcauguuauguagaauuauguaauuacuaaaacugcacccugggcacucucccaccccaacaaaaagcaaaucaaauauaacgguaccacauaagguucauuaaccuguggaaaugagcagcuuguguaugauacaauuuagggagggaucuguuuugguugaauauucagucauucaggcaacaguuuucuuaaguuaaagucaauaauuuguuuuguuauuacaauuacaaaaauuguuucauagccuuaagacagagacauggucugaaacacacaguauagagagcagaauuuucauaauggaucaauuuaauauguuuuuaauuccaaacaauauaaagaaaaaugacugcuucugaggcuuaauuuccaucucacaugaggcgucucccccguccuuuggagagaggcagaugaugguguguuuccagaggcgcaggcgcucugcugucuucacagacacgucagguuacugcugcguguuucuagaugcaagaagaaaaccagauugccaaguuuccuugcauucuuuaaucagucaucauuucucuuucaaguuacauucuuaaaccuuagcuuucuggauaaaaaaucauaacaauuuuaaagauaauuuauggaugcuaauaagcugaaacaaaauuaaauggauucuugaacauuuuaaaguaucuguguuacuuguauuugcauaauuucauuuaauauacacuuugaaucauuuuaaggauguuugacaugcuagguuguaacuacauguccuguuuuugucuuaaaacugaguuuagugcauuaaaaaaaaaaggaacucaauaucugaaucuacuuuuuauaaaaugaaauuuauagauaugucagggaagaucuuuguguaagugcuaagacugaauaaaguguaguuuaauuauuuucccccuuaaaaugauacaaguaguucagagaauauaaaaauauauaaauuuaguauuaacaccguaauauuaguuuucaauaauaaaauggaaguuuccuuggcuggaaguccuagccacagcaaucggacaagagaaagaaauaaagcacauccggauugguaaagaggaagucacacugucacuguuugcugaugacaugaucguaugccuagaaaacacuaaagacucauccaaaaagcuccuagaacuagugaaugaauucagcaaaguuucaggauacaaaauuaauguacacaaaucaguagcccugcuguauaccaaacagugaccaagcugagaaucaaaucacaaacucaaccccuuuuauaaaagcugcaaauaaauaaauaaauaauacuuaggaauguacuuaaccaaggaggugaaaguccucugcaaggaaaacuacaaaauacugcugaaagaaaucauagaugacacagacaaauggaaacacaucccaugcucauggauggguagaaucaauauuauuaaaaugaccaugcugccaaaaguaaucuacaaauucaauacaauucuccucagaauacaccauuauucuucacagaacuagaaaaaaaaaauccuaaaauucauauggaaccaaaaaagagcucgcauagccaaagcaagacuaagcaaaaaggacaaauugcacgguacugguauaaaaacaggcauauagaccaauggaacagaauagagaacccagaaauaaagccaaauacuuauagucaacugauauacaacaacgcaaacaaaaacauaaagcgaguaaaggacacccuauucaacaaauggugguggguuaauuggcaagccacauguagaagccucaucucucacuuuauacaaaaaucaacucaagauggaucaaagacuuaagucuaagaccugaaaccauacaaauucuagaagauaacauuggaaaaucucuucuagacauuggcuuaggcaaagacuucgugaccaagaacccaaaagcaaaugcaacaaagacagauagauagacgcgacauaaacuaaaaagcuucugcacagcaaaagaaauaaucagcagaguaaauagacaacccacagaguggaagaaaaucuucacaaccuauacaucugacaaaggacuaauauucagaaucuacaaggaacacaagucaucaagaaaaaaaaacaaacagucccaugaaaaagugggcuaaggacaugaauggacaauucugaaaagaagguauacaaauggccaacaaauauaugaaaaaaugugcaacaucacgaauuaucagggaaaugcaaaucaaaaccacagugcaauaccaucuuacuccugcaagaauggccauaaucaaaaaauaguagaugcugguguggauguggugaucagggaacacuucuacacugcuggugggaauguaaacuaguacaaccacuauggaaaacaguguggagauuccuuaaagaacuaaaaguagaacuaccauuugauccagcagucccacuacuggguaucuacccagaggaaaagucauugugcaaaaaagacacuugcacacacguuuauagcagcacaauucacgauugcaaaaauauaaaaccagcucaaaugcccaucaaucaacgaguagauaaagaaaauguguguguguguauauauauauauauauauauauauacacacacacaccauggaauacugcucagccauaagaaggagcaaaauaauggcauuuaaaacaacuuggauggaauuggagaccauuauucuaagugaaguaacucaagaauagaaaagcaaacaucaucuguucucauaagugggagcuaagcuaugaauaugcaaaggcauaagaauaacacaauggacuuuggggacuugggggaaagggugggaggugggcgagggaugaaagacuacacacuggauacaguguacacuacucuggugaugaccuucuguaaagagggucauugcucaggggaaaagaccuuaccaggucugucccaccugggggaaggaauucuuucacuccaacccccucuagucuuccugucucacuaauggcaugggauaucauggggggagcugagaaacacuugugaaggguagagugcaggggcacagacccauuaaaaaacugagauuuaaucauaagauuguagcaugcuccuccuuccccacaccuugucugcacaccaucagggcucagugugauaaacaugaguucucugugaaagagcagcaagguguagaaucucugaggaaagcccaaagucaggggcauaggcaaaaccaaggacaugagaggaauuggcagccccuaacaccuacagcugcagcagacauugaacacagaccagcuccuggcaagaugaacauaaagccccacacuaaaggcuuguuuacuucagcuccuauuaucucauacaucauauccagcuuucaacagacauuccaagauaugcuaaaaggugggaaauaagcagucugaagaaacaaagcaagcaucauagccagacucagguaugacgcagauuuuuggaaugaccagauagggaaucuaaaagaacugugaugcacauguuaagggcuggaauagaagaaguagacaacucgcgaaaacggagagauaacuguaaucagagauggaaacccaaagaaucaaaaggcaaugcgagaaaccaaaaugaugguaacagaaaugaagaauguccuugaagggcuuauuuguagacagauguggccaaggagcgaaucagugagcccaaagacaggcuagugaaaaguucccaaacuaagaagcaagaagagucaaaauggaaaaauaaaaagaacaaaacauccagaacugugggacaauuucagaagauaaaaauauguggccgggcacgguggcucacgccuauaaucucagcacuuugggaguucaaggugggcagauugcuugagcccacgagaucaagaccagccugggcagcguggugaaaccccaucucuacuaaaaauacaaaaauuagccaggugaaguggcgcacaccuguaaucccagcuacucuggaggcugaagcaggagaaucacuugaacccggaaggcagagcuuucagugagccgagaucaugccacugcacuccaccugggcaacagagguguugucucaagaaaaaaaaaagauacaacuauguauaauggggauaccuggaggagaagaaagaauagagcagaguaauuugaaguaauaagucugagaucuuuccaagacacuagaccacaaauccaugaagcucagaggacaccaagcugguuaaaugccauaaaauguacacccugguguauaauauucaaacuacaaaaacacugaaggcaaagagagaaucuugaaaagagccagagaaaauaaaagcauuggccugggaaaggcacacgcaugacacuuccugucacagugaauuacccagaccccacacaugaggccacccucacgagagguggggcuuaggugugucguuacagauguugaugaacaggaggaauaggguacaaggaaauacaguugaccaaugagcagcagagggguuagaagugcugaccccugugcagucaacaauccacgcauaaguuuugacucuccccaaauuuaacuacuaaucaccuacuguugacuggaagccuuaccaguaacacagaccgucaauucacccacauuuuguauguaaaauauauacuguauucuuacaauaaaguaaacuacagaaaagaaugcuauuaagaaaaucauaagagggaaaaguuauauucacgcuucauucaguggacgugaucaucauaaaggucuucauccucaucgucuuccaauugaguaggcugaggaggaggaggaaggaggauuggucuugcucccuccuuggacucuugcaguucaaacccuuguuguucaagggucaacuacagguaagugcuggugaaaacaagaguggauacaucaaucuuggaacaggguuacaggaagagugggagggagcgaguagggaagguucugauuagacugggggaauauagagggcaguuuauuuagacgaggcuagaggccuucagaauccagaaauaaaugguaaacauggguuuuuuuaacuuuaugaaaggaaaaacuucuggauuuaacacauucaaauaauuuagaaauuuagaaugugaaauuccucucaccguugaccuuuuucccauuccgaguuccaugagcagugaggugugugucagcgugugcuccugcacacacauuuacacccgugcaggugcagccacaccuuuucuuugcauucaucugucauguugaagguagaucgcugccuuugcuccacgagacuucuuccugcguguucugcagggacauccacggccagcuccgccacuacagggcaugcuugcugcgggcgugcugcugugggcuugcuugcugugggugugcuugcugugggccugcuugcugugggccugcuugcugugggugugcugcugugggcgugcuucgugugggugugcuccugugggugugcugcugugggugugcugcuguaagcaugcuugcugugggcuugcugcuguggcugcgguuucgaccauggguuuguguggcuuagggagauaaucaacggacgguauuugguuuauugucacguucagcucuauguauaagauuuccuugguucagcuuuuauaaaaauguuuguauuauaagcuuauugcauauuauuuauuuauuuuuugagauggagucucacucugucacccaggcuggaguucaguggcgcagucuaggcucaccgcaaccuccgccuccuggguucaagcaauucuccugucucagccucccgaguagcugggacuacaggugcccaugaccaugccuggcuaauuuuuauauuuuuaauagagaugggguuucaccauauuggucgggcuggucucgaacuccuaaccucagaugaucugcccaccucagcuucccaaagugcuggguuggauuacaggugugagccacugugccuggccuuauuguauauaacuucaucagucucucauuuucugaaguuucagaaauguucuuuauuuuguagcuuauaagacauuaaguccaguuuuacuccaauuuaauucucuuguaaaauaaccuuccuccacauaucauauuacuaacacuuucuaucguaagccauagagcaauauaaacuagacucccauucagcugugaagcuuuuggucaguauuugaauuuuacauaauaacaauuauaauacuuguuuucugugacacuuuuugguuuuuguuuuuuauauuauugacggucaguauuugaauuuugcguaauaacaauuauaauacuuguuuucugugacacuuuuugguuuuuguuuuuuauauuauugacaacagugaugaacaaaagugcacacguuuuaaaacuuguacugcucaguuaaacaucauaaaacgagcacccacucauggugcgucacacuugucaagaaguagaauucucccagcucccgggaguguccccuccucaccaaggugaccaccaucuuaucuagugaaguagaauucucccagcucccgggagugucccuuccucaccaaggugaccaccgucuucuuaucuaguguguagucauaggcauaugugaaguuucccaucguugugugucacagcacauuuuuauaucgucuucuguuauaugaggaagccauaauuguaugcagccacggauuucuacaucuuugaucucuggguucuuugggcuuuuugcucuuaggaauuccucugcucugaaugguguauacagaucucuuggugcagucugcaugccuccuguaagguguguaccgagcgagugguauuccugggucguauagcgugucuguauucauuucacauaauuccggucuucuaaaauuguuguacugguuuuuacucuucccagccaagcaagagaacucaaguuucucuauaaucuuguccacacuuguagugucuaucuuacguuauuuuaauuuuagcauucuagugaguauguggugauaucucauuggguuuuuaguuuucauuuucuggaugaauuaugagguuuguuccuguguuuaucggcaugggugucuggacgucuugguuugggaauuuccuaugaaagucguagcucauuuucccauuggauuguuagucuuucuggcuguuguauaggagcucuuuguauauccggguuauuuucucccacucugcugguugccuucucacuuuguucauaguguuuugaugaguagcaacucucaguuguaacauuguuuaucaaccuuuuuuuuuuaugguuuaagaacuauuucugcacuguaggucaugaagauacucucucauauugucuucugaaguuuuauuguuuccuuucuguuacauuucuaaacaucuagaauugguuuuuguauauaagaagaaguagggacccaguuuucuguuuuuccccuauguggauuuccaguugacccagaagugauugucgaaaggcugccccuuccccacugugugcacggucugugcaggagucaguguccacaccugccccuuccccacugugugcacgguccgugcacgagucaguguccacaccugccccuuccccacuguguacacgguccgugcacgagucaguguccacaccugccccuuccccacuguguacacgguccgugcacgagucaguguccacaccugccccuucccccuuccccacuguguacacaguccgugcacgagucaguguccacaccugccccuuccccacuguguacacaguccgugcaugaaucaguguccacaccugccccuuccccacuguguacacgguccgugcacgagucaguguccacaccugccccuucccccuuccccacuguguacacaguccgugcacgagucaguguccacaccugccccuuccccacuguguacacgguccgugcacgagucaguguccacaccugccccuucccccuuccccacuguguacacaguccgugcacgagucaguguccacaccugccccuucccccuuccccacuguguacacgguccgugcacgagucaguguccacaccugccccuuccccacuguguacacgguccgugcacgagucaguguccacuccugcuccuuccccacugugugcacgguccgugcacgagucaguguccacaccugccccuuccccacuguguacacggucugugcaugagucaguguccacgcacagugggugcacaucugggcccuuuccugugauuggucugcugaucccuuucuuugcuaauaauuuuuaauugcuguagggaguuagggauugcauuuaaaugucuauagaucuucagagauaauuaauuuuuauaauauuaagucuuuuagucaacgaauauuguguauuccuuuauuuuucaauaaugucuuaugauuguucucuguagagguugguauaccuuuuguuggauuuauuucuaaguauuugacuuuuuuuuuuuugggggggggugggggaagacaaggucuuacugugucaccugggcuggauuucaguggcaugaucacugcucacugcagccucaaccuccugggccaaagccauccucacaccuccgcuuccugaguaacugggagggacuacaggcacaugccaucaugccuggcuaauuuuuuauuuuuuuguagagacugggccuccuguauucccuaggcuggucucagaguccuggccucaagugauccuccagccauggcuucucaaaguauuggaauuacagaugugagccacugugccuggcuuugacauuuuuugaugcuauuucaauuauuaucuuuuagaaaauuuuauauucuguuugcugcuauuuaaaaauaaaaaaaaaauuuuggugauguauuuuuauuuuuaaaaguaggaaagcauuuuauuuccaaauugauugccuacaauaaaaauguugaguucauauacucugcauuuuaaguacagauccuaaucagauguugaguacugucauguugaaauuuaccaugacuggauaagugauccuuuuuuuuuuuuuuugaaugagaacauuggcaacuaauuccacaauaaucucgugacugcuguuguccgaaugcugcugucaucucaaggcuguggggaggucaguuccggggcuuacgugagguggugauugugggcaucacgucuccggugcaggccaggaacacaucaggagcaugugcagggccccugccugggagcagcgugggcugcugcuguuccggccgggcuguagcuggacucugaggaccagguugcuucuccauuucugugcccccuccguguacucccuggucuugggagggugauggcucuuaagguggucaucgcgauucagacccuacuccagccccguucugcgcucuccucaauucgccauggugggcccugcugucucggcagcuguggacacagccuguggcgccccggccuguccugggcccuggauuucacgcuuccugucucuacccuaacucgagcuauggacaggcagcgaguaugauuuuccuccuccuccugcuguugggguggugaucuguggugaucauggaggaaccgcuaauagauuuccaaagagggaaauaucugcaguggccacaugggcagugacgcggacgcagugaagcggaugcagugacgcagacgcacugcuuagauuucagaguaagugggagaaucagaaagaaccaagucaggucaaaggagaaauagguauauuuuuaucacgucaguaagaacgagaagacggucacaacuggcacugaaauuagcaguuacuguuucucugcuucaugccucagguaggcaggcucaaggagagccuccagccacugagccccaacccccagucaucaaaacaacggggucaacugggaaggaaggauggcgucucaggcagagaacagaugugcccagauccaaggugggauggugugaaagagcugcagaaagcaugcagggaggugucuggggcgagacagggccuggcccugguggacuguggacuguggaccaccgcgugugccccuucagcccucuuauuuccaccgcuccacaauucaugacaagugcugcaucuugaaaccaaaacagagagguugggaauuuacaacaaaccaaauuaaaugaugguguuucuugcagacacugugagcccacccauggagguacacaaaccauccucauaaaaccaagccccagaguggguugugguaugagcaccgccagccaagucugcuguggcagggacagggacguaggacgauggugucacggcacuuaaaauugucuucagaggaugauuuccuucaaccuggagucauugugccgccauugucuagcauugugccaugcugcuuguaaaaagaaauggaagaaaaaucagcuucccugcaugcaucauugugcaagagguagcugaggaccagggcuuauuucaggcacuugacugcaguuucuuuuaucauguaaauuucuuucauguaaguuacaugauaguccuuuaggaguaauguguuuucucaccuugcuguuuucucgagagcauuguuuugugagggcgguugaucaucaguuaauuauuacacggaggcguuacugaagaggcaucugaauguggcugggagagcaugguuccugagggcuaagcguucccaaaggaugagcggagaggcuugcucugccugcguccccaucagcggugaccagcagaucaccacgccucaggggccccacacccgcggucucuuccuagagcugcagucccaagcuugccugcgcucucuggaacccuccagaguguucucagcgcagcccacuuugguagcacaggaggagagcccuccagcuagaaagcuccaguagaagcuggcgaagugaggugagggcauuguccucagugacuuugcuggacucaauauuccccucuguuaagggccuacugccuugguaggucauuuggauuacaacauuaaauuauuucauguagucucuucuccuuuucucgaagggcaguaauugauaccaguugagcaggaaguuuuaucacauccaaaugaaaaugguagaagaaaaaaauuuuaauauagaaaauucagccuguuuuauuucaugagcuuuaccacauccaaauaaaaauaguaaaagagaaacauuuugauaaagaaaauucaaccuguuuuuauuucaugagccuaauggaaguuugaguaguuaauggaaaguucuggccggacacaggcucacgccuguaaugccagcacuuugggaggcugaggcaggcggaucaccugagggcaggaguucgagaccagucugaccaacauggacaaaccccgucucuacuaaaaauacaaaauuagcugggugugguggugcaugccuguaaucccagcuacuccagaggcugaggcaggagaaucgcuugaaccugggagguggagguugcggugaagccgagaucgugccauuuuacugcaaccugggcaacaagagcgaaacuccgccucaaaaaacaacagaaaaagaagguucaaccagagacauccaauuuugagaauaaaaauaaugucacuucuaaagcauacuagugggcccugggaaccuuggcauuuggcagugucgggccaaggaugcagaacugaaguuggggacggggagcugcucggucuccaagcugccaugagcuguguguucuugaccaaacaccuaaccuccuuagaaguggaauagacauaguaagaccuggcagaguuaggaaggcugaauaacagacauuacacagcagcacuuguuaauuguaaagggcuauuggguuguaagcugcuuguggucaugaggguggaaaaaugaaucacuuauaauuuguuaauaaauuuaaaccaaaacuuaagcuguuuuauguauuaguuauuaguguggaguuagucucaucaagguaaaucaguuaugcauugauuuuuuugguugucucaagcauuuugacugcguuuuuuucucuguguagaacauggacagauggguuugucccgugugagaauuccgcagccuuuccauucucuugcugccccuccucuguuauggccucgcuaccuagggugauacuuaacauuugagcaggaagucuugacaaacgacucugagauuuucaagcuuuucuuagaucccccguagugugaggacccacagcuucucuaucgucugucuugagagaugucguucuuucucugugguucuucuggccuccgucgucagccagggugcugaucagguuccauacagagucucacuuagaaaguggcuguuucuagcucuaacuacaagcagcauucauccaaaguuagaaccuguugacuguauuuugccacaagacaauucacuaauuacuagaauuuuagcuccuugaguuuagggcaaccuuuucgucauuaugcagcaugccuguuuuuaucagcuaauauguguaauuacauuuagaauaagugcacucuaagugcuuuaaugguauucugauauuaguguugugaccuagcaguugucuucugcuggcugaauaauuaguuuguuucuaagagcuuuagaguuugauagucgccaaacacaagggcuuccuuguggaagguugauggcucccagugacccuucgcugccaucuggcacagauucaagggcugcugucaucugcugcuaauugcugucaccugcacuuuggagucccucagcacugggaugcugcugccuuuagagcgggccccuccuugggcccaccugugugugcaggagagggagcaccgccgugggccuguggucucaugcaggagcauuuucagccaguuuuuauuuuaaugccugagguaugaaaaauggugaccauuuugcgaggguuauuaauucgcuaaauccaagcguuuugucuguuuuaugauuuguuuuaaugguucucauucuuaguagccuguuuaggcuggcaagauuguuuccacaacauuuuacggaagacuucuuuaauccucuuucguaaacugauaagccauagucagggcacuagccuauagcaccauauuauauuaauguauuuuacuuguaauuuagagaacaagaagaauauccugauuugaagucuaaacugucccccguggcacugcacagcugauaaccgcaaacgagaaagauguguauaucaaauaguuuacaaaaugaagccagcuguguuucccuacauacuguggcuuccugacaugcaucauuaaaccuuauuagcuacuuccuuuuacaaagauucuuguagucuugaacauugcauauuaacauuuucugccccuccaacuggaaauuauuugcuuuauuguagagugucaacuugcucuaguuucugaugcguucuaauugguacuuuggaguauaaucaucgugugauaccacgccaugcauuucuuuauuuggaaauuaauacagaccuuuucacuuuaucugucaaucugagcaacuuuuuacacaauucucaacucuugggauugcuuacaagccauuaaguaugaaauggcucauaaagugucucugaagacauaaaguaacacaaaaauuuuagaugguuuaaaauaauguugcauuuugccaagauaccaguaauaaaccucuuagacaguuuuaauaauaaaagggugauuaugcaagaugaaaaguuuauuuaaccauauuaccuuuaucauuuaaaauucucagcaaaucugccaguucauuuuccuuacaaaagaauacaaauccuaacaaccauggauuuuugaaaacgauguaauucaaaguuagcuauuagacugcuauaacuauccuucauucuucuuucucuuucuuugcuauucuaugucugcaauucugcuauucugccuuaaaaauuaaaacguuuaccuauuauuagcuucugguuaauagcuaguuaagcagaugugugggcggaacagaaaauguacagaaccuagugacuuuguucacgaugauaguaauucugagguguuucagacauuggucagcauuuuauauauccucauguuuuuaauauaauuauaaauaggugaauaugcauuuaauugcaaggggaaugaaauagaauacugauuguaguucugaucagcaaauauuuuagucauacgucuugucaagacagcuaauggcucuugauuuaaaaauaguguugaguaguuuuacauagugguaggugccagauaucuggagaaugggauggagaucuuccaguggcuuauaaauccccacauauuuacacaauaagccaagaaacacagaaggagagugugacauguuacuugacagugacagccuuguguccuugacuagguccuguaacaucucuucugugcugauucugauacaccuguauguagguuaucaaggugguggaaacaugcugaagucagcuggaccacaguugagcacuuaagcauuaaggaauuuuccugaucauugucauuuuguggugguuucuaagauacuguuagaagaacaauuagcaacuucaaaugcuauguuuaguguuucaaguagccuuaaugaaaccagacuuucuggaaucucacauaaaaauguuuuucacugauacuguuuaguaaauucccuugcacaaaccauuaaauauguuauacuuguuggcaugccaaagcaagaauucggaugccaacauuuugaaauuaauuacugaagaaauuucucacuuuacuguagaaacuaaucuguaucauuaccucuuaauaaagauaaucuaaguuggaaauuaaaguuuuaauuauaaaauuagugaucuuguuuacuaauaaucauuuaaccauucucuuuucuaaaauuuuauaagagaaauaagcagguggaaaguagucuccccacuacccccccuccgcccccucuauucuccgcaguuucuuuaaaaacacaguuuucauggccauguuccaggcaggcuccauggaaggagggcuaggcuggugccugucugcugggccaccccccugcccuccugugcaccuacauuugcaaggacucacuuugcuuguggaaaggaauggucccaucuauuuuucucuucugaaucacagccuuuucccaccaucuauggcccaacauuuccaagguacuuacuggaauaauuucuucaauaucucacauucugaacacuagaaacgcaucaacuaauuuuuuuuuuaagcuccuugaaaagaguucaaagcucuuugaaggaaagacagaccuugugcuugggaauuucggaauacugugacauuagaagcccugaccacauauuuaguaacuuucuucaugaguuuuuaauagaaucugaugacauuuuaguacuacacaagauuuuuuguucagcaacauauuuuguaaauuauacuguaaugaauauuuaaaaguauauuuuaagaguguuucuacccuacccugagauauuuaaaauaaagacuugcuacauucaggguaaaauaaaaaggcagauaccucccagaagaaagauuuguaaggagcauagucucuucaguguguacuauuagaaacagacugagaaaaugaaaggagaugcgugcucuguauuuuaaaucauuuuaaagaaagccauggucuucccuuucuuaccaugucucuuaaaguuuuaugacuccuaguaagagacuuucuuuuacaauaucaguaccacuuagaguuauuauuagaauagaaucuauuuuuuauaugcuuuggggcaagaaguauuugagugugugccuuguaaagaagcaugaagcagucagaacuccugggcuccuagggacccugagguccagugaccucccaccccccacugucaggaucugcucuucuuggaguuccugcagagcuugcuggcuuguuuguaaaauacaaugagagcuuuauaaccccccuaaaguccuggguauuguguguuuagauaguaaggguuagagaauagguucaugcucuuuguaaaauacuuguuaaaauaaauauaaaauuacccaaauaaacuguguauuagacugaaaaccaaaugccacuucuaugaaugauguugcauguugagguuucugguguuaguggguagcuuacguuauugaaggaauuauuuuaaauugguggcuggucuuggcaaaaccauuuaaaauugaugccuuccuacauuaagacaaaaaaaacaguaaaucuguucaggaucuugaaaucauuaaggaagcuguuguuacaauguuaucaacuuaguuuuuagcucugaaacuucgaaaagccuuaggagggcaccacccuacugacugaggagggcaccgcccuacugacugugcggagggcaccgcccuaaugacugugcggaggguaccacccuacugacuggggaggguaccgcccuacugacugaggaggguaccgcccuagugacugugcggagggcaccgcccuacugacugugcggaggguaccgcccuacugacuguguggaggacaccgcccugcugacugaggagggcaccgcccuacugacugaggagggcaccacccuacugacugaggaggguaccacccuacugacugaggagggcaccacccuacugacugcggagggcaccgcccuacugucugugcggagggcaccgcucuacugacugaggagggcaccgcccuacugacugugcggagggcaccacccuacugacugcgcggagggcaccacccuacugacugcggagggcaccgcccuacugucugugcggagggcaccgcccuacugacugaggagggcaccgcccuacugacugugcggagggcaccacccuacugacugaggagggcaccacccugacuguguggagggcaccacccuacugacugcggagggcaccgcccuacugucugugcggagggcaccgcccuacugacugaggagggcaccgcccuacugacugugcggagggcaccacccuacugacugaggagggcaccacccugacuguguggagggcaccacccuacugacugcggagggcaccgcccuacugucugugcggagggcaccgcccuacugacugaggagggcaccgcccuacugacugugcggagggcaccgcccuacugacugaggagggcaccgcccuacugacugugaggaggacaccgcccuacugacugugcacagcauuuccgagguccugucuugaaauuagggcaucuuacgagaugccagauuuuuauucagggcccccuuccuaccccccauaauccaggauguucaaguauguagauucuggccagcauucugcgugacaaaacauaaauuuaggguaacgcuuuuugucagaaauaaauaaaugagugaguguaugugaugugcuggacugguuggguuagaaauggcuggcgcuuuccagagagcgggacugcagggaucaggacgcgcgccggccucgcgcucccccugcuggccgcgccccgcgcuccccgcgcucccuggcuuccccucccagccgccuaugggaggugugaguacgacucugagacagaugacucugagacagacgugagcaccgcagcggugaucggcaguguagugacuccuacacuucagccuccuccuccuccugauuuucaguuaaacaauguggugauuguaaaauaagauuaggaaugauguacauuagaaaauggauaggcuuaucuuaauauucagugcuggauuuuuaacguaauuucuauacguagagcaaaaauuaaauuuccagauaguuucuggaucauuuugcauguuaucacaugcauauuuuuguuuuaaauauggcuuugauguaucacaaguugagaacauuugaaagaauuuauaauacuaaaaauaaaaguuuuaacuuacuacuuaccuuccagccacuguguugcuuugcaugugcugaccuuucauauauugauuuacuuugcgaagguucuaauauaucaguaaaggcugccacacacuaacagauggaauccaguuguccuguaugaacguagacagucagcaugaguuuuguaagggcgagcaugagauguguauauguguauacauguguucagagaugaugcuacuuucugacauuauggacaauuauaaaaaauucuggugaguggauacguguccuaggaaaugcuagagccaguauugacauuucucaagcgaucuaggaguccagcaguuugagaagauaaccucauucugcacucaugaagcccccuucaaacuuagcagguaauaugcuugcaaauuuuaguaauaauuuuauccuuaaaaacauguuuauauaggucggcggacagagugacaaucaauaugcauagucuguaacaucaaaaguuggguagcuccaguuuguguaaacuaggugugaggguuuacuuugaacucccuugucucuuaauuacgugucauauguugguuucaaacgugguuuugcuucccuguuuaguagcugauucuugcauuaauacuuuucuuauuuauacaaaaaauauaguacuuuuuuauguuaauguucaagggaaaacauuuuauauaauaacuauauagcaagcaagggaaaaagcuuaaauucugaguauagaauaggcaaaauguuaaauuucuugguaggcaaacauguagguuaugaaauaauucuuucagaauagacuuuaaauugucuauuguguaaauacagguuuugauuuuuaagaacuaaggugauaaauuguaacauuaagaauuguugugcugauacuuauuuagggaauucuuaaagcacagauuauugagccaacagacuauaauggccaaaagaaacccuucuuauuucgcagaucacugaggcgauaaacgauaauggcucagccacaucuauagugugcggucagccugcauguacuacacacacuuaaggcuuaguaguucauauccaaaaaagaauaauaaacuucagaaggaaaaagacuauguagcaucacuuuuuaaaaacuaauacuuuuaauuuaaacuucguaauggaaaaguuguugcucuaaaauuuaguacuuagauuuagugcaugaguuucauuuauuugaaaugcagaaacacaaaugaaggucugaaaauuacuuauuuuuuucuugucucuuaagauucuacuagcaguggaaaauauagggcuuauuuguuucaaagauacuuaaaagaauaugcuuuuuauaggaauuucaguuagguuaaugcauagcccuauaucaguuuuguagucaggguccaaauucgaaaugaagaacugauccacaaauaguucagcugaugaaagacaagcaguguuaacaguuguguuuuucuguacguagucagccauguacaaagcuguucuucucugcuagugcagaguagcaugaaugaauugggugucagagucgaggcuuuucaaauuguccuauauucacagggaaacuacaggacaaacuaaaauaauuuaguuuucugcaagaguuuaaauuggcuauuugaaguuuugcauuuuacuauucuaaacuacuucuuuguaagggguaaguacgcgugaguuuuaaaagaugggugagaguguuuggaugccgacauccuguucacccagggugacaucaucagcaguaaguguugcacaggcacuuuguugaaucauggauagggccugagacuuuacagcauucgacgucugcuccaauuugccguguacauugauugcuuaggaacuuaguaguaugaugugaguuuuaauuuugagaugguuugaaguguugcugugucauggagauaaggucugauucucacucguccgagcauucauuuaaaaaaaaaaaaaagccugaucuuuucuugauuaagcaggagaauaccguauuuacccuuuauuguugguauaaaccauuauuuuacugagaaccauuagcuauuuaaaacuugguacauaaauuaaagaggagcuaaauggauuugugaucguugccauuaguagcauuuuagauuauacaggcaauuauuguguucauuauccuagaacagccccuuugcagaaucauugugguugucuuagacauuaugcacaaauuuucccuuggagauuaaaauuugcaguagcauauuuaauuuuguuauugcaguuguuucaaauaaauauuaugacaaguagaagaaaauuugcuuuacuaauauaggagaugacaaugaauguugaaaauaacuucuaaguguauuuacauuaccuuuucuuaaauagucguaauuacuucaagugauuaauauauuuuaugggugaaaaguuuacagucauggcaaaaguuaucuggucuguccagguauuuaagacauuuuuuaaagaaggaagagauccacaucaaaacuaaaguuaccaccuucuuuauagaaucuguaacuuuauaaguuaacugguuuuuauuuuaaauaguuuauaagaguucagauuguauuuuagaucaguugaagaaaagcauguuucagagaaauugaauauuaaaagauuauuaauugaaguggguuaaaaaaaugcaaguguugaaaugugucuuuucuucuguuuuguuagaauugaaaaaauaaaauaaaauaaaagcaaccuacaagcuuuacacuauaugcuguaguuugguuacaaguuauauuccaggaacaacagucauaguucagaaaaugccaccugcaaggcacagcccauccuugaaaaguuauauuuuauuccacuaaauguuuuauugcucuuaaguuuaaagggguugggagaagacaacauauacuuggcuucaaagugauuacauucacuagucaagcaucugaccacaucugucuucaucaaugagaaagguaauaaugcuuugaugaucugcauaucggugugcagugggcggcuuugaauguuuccauccaauacguggcauuuuuugaaaggaaacuuuguauucauuucugaauguuuuuguccuggcuuuuacaguuccucacugcuauguugcaggggaaagugugagguggugguuaugcauuuugcaagacagugauucuuuauuuuauuacaaaaaaagaccaacucuggaaggccagauuaaaucauuccuuucacuuuuuaaugggauuuggaugaauagaguaaaauaugcacuuugcauucauugauagcaucuuuagguugagguaauugagucuuuuuucccugagugaaugaauaaugacuucaucugauccucagugaggccugaaacuuagaccgccuuugucacagcaaaaggaucugggcuuugaaacaugcucuacuucccuggcuuaauuuuucuucauuuuaauccaaaaaccuauuuuucucaauaauucaagcauaaacuauguaguaguugaaguagcggaaauugcacgauauuuguccugguugugcugcuuuuuaaauagagcugauaaaucagccgcuguggucuucagcugccccauucucaagggaaggcacagcccauacccgcagcagcguugggaacuucagaacugguugaguaccgcucccuuuccgaccauuugugaucugggggagcggcgcuguuacugguacuguggcugacccagagaagagaaagccccaugcuggagcuccgagaugcugcuguggacguuuuacuuggcuagaaggggaucugcugcugugaauuagagggcagugugcuuucuugggagaauauagagcugggaaugugcagucuuugaagaguuucuguugaaaaugagcugcugucuguguugcuguauugcaacauggagaagaguuuuuguggcaggccaagugucucauuaauuguuacauuagaaucaagucacuauuucauauaaaacugacacuuuguguuugaaguguccucaggagucuuacacagugaaguggccaagugagcccuguggcagugugcgcaggacagaucacaggaggggccgccccaccccgcugaaugcggcaucccgucuguguuggucauggaacccacacucggcacaccagucccauggcuuuaggguccuugucaucgcuacuguugugaaaggccaugaaguauuuauuaaccgaugguagugcugacugucggccacaggaagugauuuaaaacaagccugguuagaaaagaaaacuuacuauuuuaugauucuguuuuauaacauagaucacugguguucaucuuauuucuccuacuagauuagcuuguagguaaaaucuuauaguuagcuuauuuucauaaccuuagaguuuagcacaaaauguaguagacauuucaauuuauuuguuuaauuaguugacuuuucuucgcagcugcacuuaauggacuuucugacaaaguuuuauuuuugcuugauaacugcagguucugaugaucucaugagaguuuguggaaaauauuaaucaaaaccagauauaaacuaaauauaugaguugugggaaaaggcuagcuuucuauugggcaaaguugcagauuuuucaaaaggcacuacaaaauaaaccaaguuauuuauuagcucaguaauucucaaacuuuauuuuuuuuaaucagguuuuuugcagucauguuuucuuuguguacuccuuuucaaaaguuguuccagauucaggagaaauugagauggcagauagauaacuaaccugauagaauuuagucuuccgcuaaugucacauagaucagaaauaaguagguaaguuaaguacaugcuguucccugaccuagugaugccaaaggcaguggccucucacccuggcaccucugcccuguggguaccaccacuuacagaugaggaaaacgaggucuaacaaagaguuuaaggguguuccucaagucacacauuuaguaaacagaggaaguggauuccaauccaaguguguaguaagagcaguagcagcacacauggggggcguacugcccaguaggaaccguggccacugugccaugcgcucccucuucgcauccccugggggcuguaaggaaaacaucccagaaucccuauuuuacagauaagaaaaccaaagcccagcuugcccaagguuaugccgcuaaguggcagggccagcaucuaaauuagccuaaauccagagucccgaggaauccuaguugcugugcugugucacuucucccacccuuccugcagcgccgaguucccucucauucccccagcccuacucacuggacugccuuguggucuuucagggcugaaagcaagcaaggagaaacaguccauagcgauugcuagagcucgaaauugaagcuacaugcuucagaagagcuguauucucuuaacuugugcagugagagcugcuuggguugcuaguucucucuguuuccaagauccuauacagaaugcagccaaaaaauugaacugaugcuuauugacauaauuugcccucacaguuugcucagcugguaaacgauccauagaauggacuugcauguagcgugccuuacugggagaacacacaauguaagaucugugcaaauuaaaaagguuuuauuuuaagcuagcuaacuauugcuuuuuuuuuuuuuuuuucuguaagacaaguucuuucagagagacugcugguagaucggaaagacauacauacuguccuguucuugggaacucuccaucuugaguagaauccucaugggggaggugcagaggcacccacacggauaacagaggcauggucauggcguagcacaugcaaggaagacccgccugcgcccucagaagucucuguucccgggcugggcccucagaacucuguguuccccugcugcgcgccgagcaagcuuccagugcccuucucuaggcuugcguuucacuuugccugagccggugaccagcgcgccacccuccagaggccgugucugaguucacugcggcugugugcucuggcccguguuuugucaguagacccuuucuggaaaugcucuggggaucaugauucauuucuagaaauucugccugaauuuucauauuucauuauaauaaaggcuaauaccaauaaauuuuaaaguuuuuuuuuuaugucaucacuaccaugcauucugauuuauaauauuagggacauugugguuagcuuguucauguauuauguguuuuucuuucagguugguuuguuggaccuugaacucaaucggcugacgaaagcgcuauuuuuggcuuuaguugcucuuuccauuguuaugguaaccuuacaaggauuuguggguccaugguaccgcaaucuuuuucgguuccuucuccucuuuucuuacaucauucccauaagguaaguuuaaaaaugaaaauaaaacaaaugucugguuucauugaguaugauuuuauugaauuuaucuuucucaguaugaaagaaauuacccaaacaaagcuagagaaguaggagccagaaguucugaggaaucuugaggaauucuucuguggaaauguuguugggggagacgucaucagugccgguagaaugaucuagaggugccauacuuuccugauagugaauguguugauggugucuucuucaacaaucagaagauauuuccugaugaaacauaaaccagaauuucacaaaauuaguuuuguuuuuugcugauagacuuuuaaauguccagugcccuuugaucuguguggaaucacuggcauuuuaaaguucuguuuaauauaucuaauaucugucaaguuagauaaaauauuaaggcuguguuuuaguagggacuaucauuucagaauguuaaccuauauuauaacuacagauuggaauauaaauaguucauauuagaugccuauuuaauguaaagacuaauauuuuaccauauaaacauaaauccauuuuaaacuauuuucuaaaauauuuuaagaaagauauucuuaauauauaugauuuaaaauuuucauaggaaugagcaacugaaaccuaaugauggauaaaguaugaaucuagaauaucuaccuuuuguaacagagaauggacuaaaacgguauagaaugcuuaggcucaaggauguagccacuuugaagagaaagauaucucuauuucuaaaccagcuuucuccaaaauuugcucuaaaaggugaugucucuuccauuuacuuacgucauaaagucagagcuauaaucuguucuugggauguguacacacugcacugcccucacaggcagucaccaggaaugaauccaguugcucucacccagucuguucgagagguaggaaaucagccuccuuucugcccgucacaguacagauuccuguggaugcugccuuccaugguguugcugguucacggguggccaggccugugcagagagcacgcagcaaauagcaacuucucauugcggcuguguaacuugcugcugacauagauuuucugcacuccauaaagcugacugcagagauggcuguuccagccuggcuuguggauuaaaccuaauaaggcccagcuuccccgcucuccucucccaccacacugcagcuauccccaugugccagcugcuucccacccuagcuguguccucugcuucagugcuccucuaccucaucauuccauggcugggcuugucuugucacucggcucuuacccuaaauaccuuuccucagagaggcugcguuugucugcucaguacagaccaagaaacagccagccacuugcuaucauagcagccuauugaauucuguguagaucucuaugacauucaucuuguuuguugccuguuucucucuucucacuaagcccugugagaauagaggccuuguaugucccguuuguuguuguguccuaguuaggaccuagaacggagcacgcuugggaugugguagggccucuguaaguauuuguugaauggacccauuacaaaggccccauccugcucagaggacccgagcgcagauugucacaguucuugugccggcauguauugagugccacagguggacucuggagacacaaucuuuguccucaaaauaccccccgcccacuggcuaaguggcaauaaacaaacuauaaccagaaaguaaccugccuuuuuuaucugacugucaugccagaauuuacuucuucagaugugaugguccuucagguaguucucauuuguuguucagccuaagcacucacuuugaucccaggcccuucacacauugcaucuucucuccaccagcuuccuccauuugaugccacccacuccccaagagucuccuuugucuccauacacaugaaugagcccuaaucuccauuguuguauuguccagugucgugugagaagauagguuagccaucaagugaaggaggagauaagacauuucaccugcuuuucuuaguuucugccagcuggaaugccugucucaggcaaagcaggcugcagugacugacucagauggaggagcugcuucugcuccuagagcugcagugagccccuccugacacugcagccuugcucacucaaagaccuucugacgaauggggucgagucucugguucucaguagcuccacguaaggcacauagaggggcacauaugcauguuugugccagcuugagaaccugucucaagggugguguauuuuucuccuguggagcaaauguauuccaacucccaaaauauguugauagacacuucugagauacugcuuuuuggguuauauuagguuaugcauucauuuuuauuagagcuucaugacacagaacguguuugggauucuucuccugcaaguugcuuccagagccucauagcauguuguuuucguuaccacuugcuuuguggauugguacauggucauuuuauaaauauuccaugugugcuuuaaaaauauauauuuuuuuacaugaaguuauucuauaaauauccauuagauugaucuuuaauuuuuaauaucauguaugugcuuuacugucuuuuuuuuaaaaaacuccuuaacuuuuuaguuacugagagugugcaaaucugucaccauaauaaugaauuugucuauuuucccaugccauuuugugaauucuagcuagcuauauauauauauauauauauauauauauacauacauagugaggcuauguuauuaguugccuauagguuuagaauagcucuuauuauucuggugaaugaaaaucucuuauaaacagcauuagcuaggugguagugguguuuucuuaaaucccaugcuaccaucuuuacacuuacugugauuaauacuuuauuugcauuaauuuaugucaccuuguuuuugcuguuuguuuuacuucuauauuuauuuuucuuucuugcaaucuuuggaguuuuuuaaauuccauuuuuucuuuuaacuugaagugauacccuauauuucuauuauugugguuuccuuagaaauuuuacauauuuaauauauaauauuuaguaaaguuuaaaguuaagcuuuaucuuuacucuccucucaaucaaugcuaagaccuuaaaauauuuuaagucagcucaucuucccucucccauccacuuacaugcuuuauuuagucgacauuugcuuucauuuugcuguccuguuugguuuauacucaguguuugcacuagaccuccgggccgcagccuucuuggcauuacugcaguagucaaagggugcuucuagcgaaucauccuacauauucuugaucagucuuuuuucaaaaaggauaagggcuuuuagcaggguaaauuucauuuacagaagaauaaccuuaaugauuauguuugaaguaagacuuggaaaauacagugcguauuauucacauucaauccuauugcuuuuuaucuuggccgggcgcaggggcucacgccuguaauccuaguacuuucggaggcugaggcagguggaucaccugaggucaggaguuugggacuagccuggccaucaugauggaaccccgucucuacaaaaaauacaaaaauuagcggggcaugguggcacacaccuguaaucccaccuacuugagaggcugaggcaggagaaucacuugaacccaggaggcagagguugcagugagcugagaccgugccacugcacuccagccugggcaggcaaaagaacaaaacucugucucaaaaaaagaaagaaacaauacaaggcagcaagguaaguguugucaguaaauagucaaagcugaugcaccggccccugcugacacagagcaaaugggcaggccauccagugcccuuggccucuucuuaauuggaggggauaggcauaagcauuuaaacgaaacaguuacauagugguaaacacuguuaguaaagucaaaccgggcacuggaacagagagaaccuugcagggcuucagagcaauguggggcuucccuggccugguguuuauuaagcggcaggcugcauggugaggccaccguggaagaccuggggaaaaugucuuggcagagaaagcacauugucccagcacagcagagacggccuguggcuggcacaagugcacuccagcucagccuccccagccuccagcacagggcgccugcucccaucucuguccagcaaacacaucuuuuucuaggaauuccuuuuucuucuuugcuuucauuaauuugauuuuucuuaaugucaguugauuucuuucaguucuagaaugucacaugauguuccuuucaagacugcuucucuuucaccacguaaaaggccuaaugagagcuuugcuuccuuuuguaucuagggcaccucugucuuuaacugacagcauugaagaguauugagacuuuuauuacauuuuagugaaauauuuuauuuauauggacuaucuccaaccacuucuuucuuuaguaaaauaacauagaaagauuugaccuuuuaccuuuauccaguugccaagaaaaauuaauuauaguuaugaaaauuaguuuacgcaauaagcauuuuuuaacuaaaacuaauuuuuguuuucauaccucaguaauuauauguauuuauaguaaaacaaaauagaaaauagggcaggcugauagcuugaguccaggaguuagagaccagcaugggcaacauggugaaaccuggucucuccaaaaaacaaaaacaaaaauuaaccaagcaugguggcaugcgccuguaguccuagcuaguugggaggcugaggcgggaggauugcuuuagcccaggagguugaggcugcagugagccaagaucacaccacugcacuccagccugagcagcagagcaagagccucucucgaaagaaaaaauaauaauaauaagagaagaagauaaguauuaucuguaauccugcugucuccacuuaaauucugucaaaccuuuccaauguguuuauacagacuuacaaauaugacuaugcauauuuauaucuacauacaacacccacaccccaggugaagucuguguauccuuuucuagugucugcuuagaaaaugaggaugauagccggcuuucugcgggucucucuugcucuaguuuuucagucagcuguuuuauguuuagcauguucagucaugcuuggagagacuuacgaagcagaacugucaguuccccucuguuuagcuccagaacaucucacacccacuucaacacaaggcucuaccauguuucucucacucaggaugcaguuacacagggugcacgcagggaugagaaccguugaugucaaaagcacaggacacugauuugggaaauuaaaguucacauuuuauuaaagccaaguuuguuuuccuuuugcaaauuuuccguaaaauaugaauaaugauacauucuaguauuugcuaaauaugcuuuuggauugaauaaaggguaagacuucuaaaauauguuuugguuuugcacaguauacaaaucuguuguccuaacacucuuaaaaggcuuuucaaauuuaagaaaguuaagcuguuuuauaaaaauuccucuguaugaaguaaaauauuuugagcuacuugauacaauuuaccuuguaaauuucagaggaaaauauuauaguauuuaacguugacuuuuguaauucuaaaauucauauauguucccuaaauccugugcaucucucauaagaaaaggaaaacugaugaucagaauucuguauucauuuaaaguucucugaggucagggacuugcaguuacuucccucuuuauuaacucuuucguccguaugcuuugaaaugcuauauaccauuguaguugauaaugcaaaaacugucuuaucagugcugggucagaguguuuuuacucccacaugaggcauaugugggugcuagaggcagaauguuguuugacaaagugauaaagguguuccuucugagaacacugaagaaccucuuguaaauacaguggcuuuguugaaagcacugaaggugaaggguguuuguguggcuuagggacaggguuuccucucauuuaccaagggucuagccuccaacccagugagcguggggaugcuugccugugcgcuuccagagcagacggaccagggaccccaagugcucugugcagucagcacacccccagauggaagaccaaaagugucaggcagcacaggcacagcagucauugcuccuggauuuaggagagaacuuuucugaaggaaaacuuuuaagagcuuuaucagguuacuuuucgguuagguacccuuucugugacauuuuacagguuuuugcuaauuuaccaaacaucuuuaguaagaccucauuuuccagguagaaugcuuggugaaaagaguguuuucaacuucuuuagaccuagauuugauauucagguauugaugauuuggaaaauuuggagccuauccagaucacauaaaaugcuaauauugggagauucacuguuuggaaagcauucaccaaggguguguccagguggcguuuugcucuuugaagagauagauuaggggcagguguuaguccguucucacccugcugugaagauacuauacuagacuggguaauugaugaacaaaggagguugaauugacucacaguucugcauggcuaaggaggccccaggaaacuugcaaucauggcggaaggggaaguagucaccuucacaagucaccuucacaaggcagcaggagaaagugugagcaugugaaggaggaaccaucccacacucaucaaaccaucagaacgcaugagaacucacucauuaucacgagaacagcauggaggaaaccgcccccaugauccagucacccaucucccucuacacacggggaguacaauucgagaugagauucggguggggacacagagccagaccauuucaggggcugacuaaaggaucuacucagcaacucugcagaaaccaggaguagagauggguuauccaagaaggaucuguguuggagucuguuuucugauaguguggacucucaggauaugcacaggagacccaucauguuuuaucagcagaaacuaccagcuugaccuaaaggaacagagacaggaugagaugagagaagccuguuggacucccagaaucuuacaggcaggaaacagcuugauagagcuacuggcugcaagcaugugcucccuuucagaaagaggaagaaugaccccaaggucaaaauuggcaugagcagugcagaggccauggagcugccagccuaagggcagagcacugagacacaguucuucuauuauucucagcucucgaaacuuaacaguuugccuugcugaauuucaaacuugcuugggaucagugaucuuguauuccuuccaguuucucccauuuggaauggaaauaccuauuuauccuugucccaccacuguauuuugggagcagauagcuuguuuucuaguuucacaggguccacagguggagaggaacuuaggucccagcauggaccauggccagugucucacccgugccaaauuuagaugguuuagaugaugagaucuggggccuuugagcagaugcuguuuggaugaaauuuuggacuuaauguugaugcuauaauaggccgagacauuagggauauugggaugggguaaauguauucugcauuugggaccaguguaaauuugcgagugcuagaggguggacucccaugcaugccgugauggcccccagaacaugugcccauaugaaaucugugagugggaccuuacuugagaaaagagucuuugcaguuauaauuaagauaaugaucucuaaacgagaccauccugaauuagaguaggcccucauugcagugaauguccuuguaaucaaaggagugggaauacgccaaggagaaggugaggugaagacaguggcagaaacuggaaugauuccucuacgagccagggcacgccaaggacugugagcagauccagagcuggagagaggcagagcagcccaccuccacccuccacaccccaccacccccgaccaguccaggaggaaacagcucugccugcaccuuccagauggugagaaaauaaaauucuguugcuuuaagacaucuagugauggcaucuuuaagaaaccaguacaccacauagagucauuuuuuacaaaaugcuucauccccugcucuuggcaagguagcgucaggaagggugagaugcugcagugcuccauggcuacuguuuugcuuguaagaaacaguucaguuucccgauauucaggaauguuuccucucugccuguuguugcucgagcguugugggaggaugucuccuuguccuacuaaguguccugcuaagcucccacuuuauaauaggcagcucagccuucugccugcugaacacuugguugaauguguaacaguucuucauuuacucaccauccgaguaugugcuuuugggagguguugugaugggccauucagcucaguacacgccccacgcugcugugugugagggugcagggaugaauggcguguacccucggggcccugcagcucaguccucagcgucuucaucuggacaccccgcuccccucccucccucccuccccuuuccuugcuuuuucucuccauagaaguaaaaauuaucugaaacuuuaauuccuccuccucuccccacaaccuagcccucaacaaaagccaaaaaccauucccuaaacauucaaguuuguuuagaauuuuuuuuaaauauauuuuucuuuaggaaaaaaaauacuuuucuauaauuuauguuacguuuuuaguuacugagcauggcuaauucaugaacucucaucacuaguuuuaucuaaaguuuauauaaaguugaaauaaaacaaaguuuuauuuuauauauacaaaccuuauugccucuaauuguggaaauagugcuggggaacagagaagucauuugauagaaaaagggcauaguuuagaaguaauuuuggcuaaagagccccuuuuucugguucacuuauuugaacucagaaaauucagaguucugaauuuggggaaacaauuugaaacauuucuaugaugaagcauguuuuccagauuuuaaggucaguggagaugcugugacaggaaaccugguuaauacugcuuuuguaauaccacaguccauccccuuuacgugguacauaugccagggauuccauacaugaacccugaggguccagcguggcugcaaaaaccaucuagcacuuagcacccguaucuucacccaguuucagaguuaaggugccauacacgcuuaagauguuuccuuuuauacuuuuucuguauaaaucucuuauuaguuauagcaugaauuaugugccaguuuuuauauuggcuuagaaaauauauuuuugcacaauucauuucauuucuuuugaaauaaucacugucuuggcuuuaaaaaaauuauaguuaacaaauuuauuuuaaucuaucaaaaaaguuauuacuucuuguugcacaagcuacuucagcagccuuugagcauuguuuuauuuuguaaugugugggcuuuacaauuuuuauuucauuuuuaauagacauauauauuuaugagauacaauguaauguuuugguauauguauacaaugcugcuuuuaugguuaacuucuugcuuuuccuaaagguuugccaccuaaaaauugcauauauaaauauaugcagucaucucuugguucccaugggggauugguuccagcacccuccauggauaccagaacgcauguguacccaagucccacagugggcccugcaaaaccuacccgugggacaaguggacccuccaugucugcgggguucgccucccaggaauacuguguuuugaugcauguuugguugcaggugcagagcccucagauacggaggguugacuugacuuacuaaaaagaguccauaucugagaggacuugcacaguucaaaccuguguuguuugagggucagcugugaauuaguuuuuccuguuuugcuaguuucuauaauugaaaucauacuggauguuuucuuuuugucuuauuccuuuuguuuuacauggcuguguacaggacguuguguugucuucuucucauuucuugcagcuugucauucucuugcaugagcacacuccaguguauucagugauccuuucugcuguuuugggguuuggguugcuuccaguuuuuuuacagugagcagcagugcugcuauuaacauuucaugauguguacuccacacguuagcacccugguauaagauaucuaagagcaggccgggcgcguuggcucacgccuguaaucccagcacuuugggaggccgaggcggguggaucacgaggucaggagaucgagaccauccuggcuaacacggugaaacccugucucuacuaaaaaauacaaaaaauuagccgggcgugguagcgggugccuguagucccagcugcucgggaggcugaggcaggagaauggcgucaacccggaaggcggagguugcagugagccgagaucgcgccacugcacuccagcccaggcgacaguguaagacucugucucaaaaaaaagaaaaggaaaaaaaaacauaucuaggagcagcacuacuuggcuguguuauuugucaaauuuaccagauaauguuuaacuguuuuucaaaguguuuguaccaauuuaccauuccaacaucaguguggagaauaguucacauccucagcaacacuuaauauaagugggcuucucauugcaguuuuaaugaucauuucccagauugauaaugagacuaaacaauuaugcacauauauauuagcuauuuagauuuucucuuuugugaacuuucuaagucuuuugucugguguucugagcagcuugcaguuauuuauauauuuuagaugccaaggcuuucucggcuuauguuuugcugauaucuuucucaaucuguaguuugacuuuuuacucacccauuggugaaauuaugaaaaaacaguuauugauuuuacaugccaaauauaugagguuuuuuuuuuguugguuaucacuuuuuauguuguuuaaaaaauccuucccuacuccaaggagaugaaacucuccucuuacauuaucuucuagaagcuuaacuguuuuuccuuugaccacuguaaguguuuuuuguuuuuuuuuuugauauauauggugugaaguacaguuuuuaaauaccauauuucugcaaaccaauugucucagcaccaguuauagaaaagacuuuucccagugaccuagugccccgucugccauguaccaagcauuuguauacacaugggccuguuuugguuaccuguucuguucccuuggacuguuuuuguauucucgccaaauaacaaacuguguuuguuaacagacuuuuauaauaguucgauguuugauagaacaagucuauccucaugugcagguuugugauauaggcagacuugugucauggggguuuguuguacagauuauuucaucacccagguauuaagccuaguacucauuaauuauuuuugcugauacucucccuccucccacccuccagccuccgacaggccccagugugcguuguucucuucuguguguucucacauuuaguguguucucaccauuuagcucccaguuuuaagugaggacaugugguauuugguuuucuguuucugcgauaguuugcuaaggauaauggccuccaguuccauccauguuccugcgaaggacaugaucucauucuuuuuuauggcuguauaguauuccaugauguagauguaccacauuuucuuuauccagucugucauugaugggcauuuagguuuauuccuuguugguugggcuggucucaaacuccugaccuccugaucugcccgccucggccucccaaaguucugggauuacaagcgugagccaccacgccuggcccgauguugagcuuuuuuucauaugauuguuggcugcauguuugucuucuuuugaaaagugucuuuuuguccuuugccuacuuuuuagugggguuguuaguuuuuuucuuguaaauuuguuuaagucccguuuaggugcuggauauuaaaccuuugucagaucuguaguuugcaaaaaaauuuucucccacucuguagguugucuguucacucugcuguuaaguuuuuuuuuugaugugcagagauucuucaguuuauugagaucucauuugucaauuuuugcuuuuguugcaguugcuuuugguaucuucaucauaaaaucuucacccaugccuguguccuugaugucuccaucauaaaaucuucacccaugccugugugcuuaaugucauugccuagguugucuuccaggauuucuauaguuugaguuuuugcauuuaagucuuuaauucaucuugaguuuguuuuuguauaugguguaaagaagggguccgguuucucucuucugcaaauggccagccaguuaucucagcaccauuuauugaauagggaguccuuuucucauugcuuguuuuugucagguuuguggaagaucagaugguuguaagugugcagucuuaguucuggguucucuauucuguuucauucauccuuguguucuuuaaagaguguuuuaggucuucuuggccaugaauaugguguaucucucaauuuuuuuuaggucuucucuaaaauaagucuucucaaauuuuguuagagcaguucuuagauacuugggauuuuuaaaaugaugucguaaauaucguucuuaaaggaaccauuuccucucuuuuugcugauguaaagaaauaaaauuaauuuuuauaaaauuauugacuaucaaucuugguaaaaauccuauugauuuuauuuauuaaucuagguguauuaaauuuuuucuauauauaaucauaucaucaguaaauaauaacagcuuuuuuuuguucaguucuuugcaccauuuauuucuuuuccuuguuucugcagcaaagaucuucaguauguuguuaaagaaaagugauuauaauaaacauucuucuuuuguucccauccucaaaggcaaaacuuucaacacuuugucauuuaaguaugcuauaaguuuguuuauagaagccuuuuaaugccuuaaggacauuuuucuguuccuauuuugcuaaaaguuguuuuaaaucaugaauguauuuuaggaaauauuuuucuaaaucuauugaggauuuuucaucuuuaaauuuuucuucuuuaauguauuaacacgguaaaugauauugauugacuuucuagugucauaccaaccuuguauuucugggggcaaaaccccaacauaaugaugguauguuaguauuuuguuuauuauuagauuccauuuacuuguauuuucugugagauuuuuacauugauuuacaggagugaaauugacauguaauuuuuaauuuucauaccauuuuuguggaguuugguaucuggauuaugcuagucucauaaaaauauuuuuuuuucucauuuucuuucucuaaaauaauuuaucuaaaauuggaauuguuuauuuccugaacauuuacauaagaagaaggccaugugagccucaacuuuuuacuguggaacauuuuugacacauugauuuaguuaugggacuauucaaguuuuuaauuucuugagucaguuuugcaaaguuauaguuuucaauucguaaucaaguauuuaaauuuucaguuuuauuuacaacaguuuguucauauuuuccuguuaucccugacauacauaggaucugugauaugaaccuuuuuaauucuucauacuuguuauuucugcccuuuuugcuuucuuuuuuuuccugaccacucuuccaauagguuugccagcuuucauuucuuauggaaauaccuacucuugucuuuauguauucuuugagcuguguauuauuuuccuauuucauuaauguuuucuuacuuaucuauuuccuccuugauuaguuuucaccuucugcccccuuugugaauauauguauuggaggcuauaaauuuuucuguaaguacuacuuugguugcauuucaaaaguuuucauauguaguauuuuuguuauuguuaaguacagaauauuuuaauuucgacgugauuucaucuuugacccaugcuuauuacaaacuuauuucuuaucuuaauuuauaagcauaguugagaaauuucuaauacaucuuuguucauuuuuaguuugauuguauuuuucucagagaacauaccuuuuuaacuucagaucuaugaaauguguugagacuuguucuaggguccaauauuuaguccauuuuuauaaacauucugugugugcuucaaaacaacuugcauucccaauuguuggucacaggaucucaucugugugaucagaucuagauucuuaaucuuguuuuucaguuucugucuaccacaaggguuuuucucuuucauaaaaguugcugaaauuugucaaaaucucucaucauuauugugacuuugucuauuuuuccuuggaauucuguuuauuuuuaguauuuuauguuuuguggcuuugauauuggaugcauacaaauuuaaauuguugucuauauuccuacuggauuaagcaguuucucauuauaaagggacuuucuuuaucucuacuaaagcuuuuugcauuaaauucuacuuuguuuuguguuaauguagcaaugccagcugucuuuaauuucuuuggcauaucuuuuuccaucuuuuuacuuccaacuucucuguauauuuauuuuuaugugucucuuguaauuagcguacaucuuguauuagcaugccaucuuguaauugguuuaauuuuuaucuaaauuugauaauuuuugacuagaguauugcauauucaauuauuauaauacuguuuauauuuuuaguuuaaaucugcuguuuuauuuugugcuuuuaauaugacuuaccuguucaauauuuuucuccuuucuugccauuuuauuauuuuuuuguaaugcaacuuuuuucuccagcaguuuagaaguuauguaagugguuucuguucuuuuaguaguuacccuagaaguuaaaaaccuucuuaacuuaucagaguuaaaagucaguucccuuaagcauuuaacuuaauuugcucccuucuggacuuacaccauuuuugucauuuauuuuaauucuaguuguucuuaaaccccaaagaaaacccugguuauucuuaaaccuaacaauaucacugauuuuguuuauacauucuccaucauuuugguuuauccacguuucgguucguaaugucuucuugcaucuuagaguagaguaauuugccuucuguuagaaauguguucgcuuuuugugcuuuugaugcuggucuguucugaacucucaauucuugcuuggccauccuucuuggaaaauaguuucauuggguauagaauucuaggcugucaccuuucuuuuuugucuucuguuacugcuuuuaagacuucacuucuuuggguccuuccaucucuuccagccgcuuuucuauccucuccucauugguggcauuguacgcucuacccuacauaauguguugagguacgauguuucuuuuuaaacaguacuuaggauuuguugggcuucuugacucuagauucuuuuauucauucuagaaaguccgccaucaucucuucagaugcugccccguccccaccugucgcguccugcucugggacauggggucagggcuuggucgauguccucacuguguccccacgcgggacaugaggucagggcuuggucacuguccucgccacaccuuuguuuccgcugcucucgcugcugcacuuucugcuuuuuuugcuugcaugcuucauuuuguaucauccucacugaccuguccaacaaguacucauucuuugacuguguguaaucagcuguuaaacuaaggaauuucuuaauuuuaauuauugauauuucuuaguucuaaaaauucugguugguuucuuuaucacauugauuauuucauuuuuaaaguugccuauuccacacaaacauuuaaaaaaaauuuuuauguauccguuuguuuuauaaucuguaucaauaucagauaccuuugucaaucuuuuuauguuguauuuuggucuucuggcucuugcuucuggugucuuguuuugcucuguguuaugugguaguguuuguuguuacgguguuuuugguaauuguauuugaaaaacuaauuauaggaaucauuugggaacaaagauggagguucauuuccuaagacauacacacuugcuucugcuguguacuuggagauacccucugucuuggagcaucuucauucaagauuccaagucacuggaaauguguucaggaaaugugaaccugacuucagcuccacaagcaggcucacuggccugcgccugcuggcccugccuucccugaggcgcauccuugccuccauaguuuuacugagguuaguguuaccauuggauagaaaacuaagcuuuucuaaccuugaaaagcuccugcuuauccuccuugcggccuuuagccggcuccuguuugccuggucagcuuuguuacuagcacuuaacauaaucacugcccgcuugguucugggggacuugccgcuugucuuugccauuccuuucuucuuagccuuuuggagacauuuuguuuuaagguguagcucuuaaauugcauaaaucaguauuuauuuauuuuuaaacuaaaagugcuagccuuuaauaggaauauuucuuccuuucacaauccuggcauagguguucagccuugcuccugcauucuugcgcguucauuuauauuuauaugcacacauucaucuauucuauguggcagcucugugugugugugugugucuguguguguguguacacuguguauauguuuguacugcuauacagaauguauuuuacuuuaaaauuuuuaaauuauuugaaaauugcaaaacucucuuaaaauuugccacugcuugacuuuauccaauacauauuuaaaccuugauuucaaauaucaaagucaagaaccaaacaauaacgugugacuccucuuaaauaugaggauuuuaaucuucauuuauucuuuuuuucuccuuuguacuuccuaguauuugaucauuuaaucuguaccugcaaacccuaauuuuauaguuauuuccuuuuaauauggaaaucuuaacuuucaaccagcaaugauggcucuccuuugagguuggcgcccauguuugcuuaacaacauggagucauuaaucucggugcucaccuuuccccauuccugaguuuccaauuuugauucauucucaaccaaccagaguacuuuucaaacaguguucuugagcuugccuggggaaugaagccccauuuguccccagaguucaggcacaggccccucuguguauuucacagugacuucccacaugaaagucggaagaguccugagugugagggaagcccugaagcacuguuucccaguugccacagcaccugguccugggggccacugucagucuaagcagaaggccgggaguuggcugcacugaagaccagccccugugagcugcaugugcagcagggaaugucuuuugcuugccacuugucucuggucuuucuuugauucagcucaucuucaaagcugguacucagcuuacucuuccgaaaacaccacuuuauugcaaaucuccaaucaucccacacccacucagaaacauuauaaugggauuuagaauuuugcuuacaccaguuuaaaugacuuucuguaauacuuugcuguauuuucuuuauuauuauuauuauuauacuuuaaguuuuaggguacaugugcacaacgugcagguuuguuacauauguauacaugugucauguuggugugcugcacccauuaacuugucauuuacauuagguauaucuccuaaugcuaucccucccccaggccccccaccccacaacaggccccggugugugauguuccccuuccuguguccauguguucucauuguucaguucccaccuaugagugagaacaugcgguguuugguuuuuugucuuugugauaguuugcugagaaugaugguuuccagcuucauccaugucccuacaaaggacaugaacucaucauuuuuuauggcugcauaguauuccaugguguauaugugccacauuuucuuaauccagucuaucacugauggacauuuggguugguuccaagucuuugcuauugugaauagugccgcaauaaacauacgugugcauuugucuuuauagcagcaugauuuauaauccuuuggguauauacccaguaaugggauggcugggucaaaugguauuucuaguucuagaucccugaggaaucaccacacugacuuccacaaugguugaacuaguuuacagucccaccaacaguguaaaaguguuccuauuucuccacauccucuccagcaccuguuguuuccugacuuucuaaugauugccauucuaacuggugugagaugguaucucauugugguuuugauuugcauuucucugaugaccagugaugaugagcauuuuuuugugugucuuuuggcugcauaaaugucuucuuuugagaagugcuuguucauauccuucacccacuuguugaugggguuguuuuuuucuuguaaguuuguuugaguucauuguagauucuggauauuagcccuuugucagaugaguagauugcaaaaauguucucccauucuguagguuuccuguucacucugcuguauuuucugugucuuaggacccaagacuacauuuguuuguccuuacaucuugugcaauggaugcagaucaaauagcaugcuuccauguuuaggguguaucucugccuuuguuccagcggcacagcauguguaagcugugugucugugcaugccugaugcaccguaugcauguauguaugaugugccuggugcacaucugcacuccggagccuucccugaauccugcacggauacgcuccugucccugagcucucuccacugaauccugcacggauacgcuucucucccugagcugucuccacugaauccugcacggauacgcuccugucccugagcucucuccacugaauccugcacggauacgcuucucucccugagcucucuccacugaauccugcacggauacgcuccucucccugagcucucuccacugaauccugcacggauaugcuccucucccugagcccucuccacuauagcucaggcucuucauuugccauaaacccucuaacucuucagaucagugaucauuuccugucauugauuacuugcuccacuguaacucucagucaccuucuguuaugcaucauuccuaauccacacaaugaccauggcacucuacagaugcuguucccgaggcucagaaaaaucaagucugucauuggucuaagaagguuugaaaauuaggaaucaauacagguaaaacacaguuaccuaugccuccucccuacgaagcauggaaggccaguggcuguggaacuuaggagguugaacuggcaggaguucuugauuaucuggaugcaggcacuggaaggaaaagggaaauggauuacucuuggugucuggcugcaguggcagguggccgugccagucguuaugauggagaaacuuuccacgcugaggaagaguacaugugcguguuuuauuuuguuuggcccauaaggggaggaaguaggaauguuaacacccauugugugucuguucauuucaggguguuugugaugaaucuaagauaucucauaggaaauagaacacgugugcaucugaagcccggagagaggucuaaacuaggccucgacauuuugggucuugucuccaccauggaucacacuggugggacucacccagggagaguguuugggcgccggcccugccucccuaauaucccaugaaaaauggaaagauuucacagagugacaaaugcugggaaaaauucagaucacauggccucuguguccuuucagcuuuacgaucuguaggaaaagauguuaauuucuucgguaaaacuucugauuaaaugacuucuguuucguuuugcucagauuagaauccaaaaaauaagucugacagaggaacgcaugugaauuauuucagguaguuucauucccugaggagaaucucgcgcgauucucagacaaguugugggacuggguucaccugguagugauaaaugcugcagguuuaauuauaacaaauuagagcuuaaauguagcaagcaucguggugccuaaauaagauugcaugguauauuuuaggaaaacgcacuucaaauuuuucagaguccaaguuaccuccucagacacuuuuguagcuguggagcagaaggaacuuuuuggacaauagggagguauaauuaagagaucugacauuccgagauuuacgaaugcuuucuuccuguagcauaaaacagguucauguaucuuccuacuccuaacauugcugaacacaguauuuguuuaagauaauuuauuucauuuuucauauugcauaaaagucaugacugccuuuuguuucagguaacugucugaaaugacagguaccuuuuuccacuuaucuggaacaggucucuugguaacaauuucacaguugcuaaauuagcaauaaaaugagcuuaaaauauagcugguauugauuacuuuauaaucuauuucuauaauucucaaaauacuagguuuaauauauauugagggggggugacauauuauguuacaguauaguacuuuacagcugaguagagauccagguuuuaaaauucuauaaaauuagaacauuacuaaaaauuacacauaaugcagcagugauagcuauacucugccaacuuaguguuugaaaucugagcaucauggagauuuuuaacguuaaagaggaaauugcuguauuaacaaucaaaguacaugugaaucacaugcauauaagcugucuacucuguauguaguauuaaaugcucccgauguguuguuauauacuccuuaugugguauuaaauaccccaugugguaguauaugugcccuaugugguaguauaugcauccuauguaguauuacauacucccuaugugguauuagaugcauucugugugguauuauaugcaaccugugugguauuauacaaaacccgugugguauuauacaugcucugugugguauuacauacucccuaugugguauuauugucuuaauugaagucagguguaguuuacucagugaucuuucgcuaguaagcuguaaacuugcauccugcaguggcucuacuuauuuuuuucauccugaagaugaucucucaccuuuucaugaguagcuacugcuuuauacaaucuuccgagagcacuuguauucaacuuaccauauuucagugguaauuauuauauuccaugaaauaacuuaauauuccaugauacaacagcuccgcguaagucuaaccacggaaacgguuucaugagccauaggccccucgugauugaggagcagcgcccagaagagccauccugguccuuuggcuuccaccacccugagcccaguggccaacugcaagcucuucagaaauucccagcuaacagcagaaacccauuugcauuauaguagcugaggcaggcugacacucuucaaaacaguaugacacaaaucugaaagaacacagcacauagauagaaagccauguuuuccaaagugcagauauccgagccaaagaaucagagccaugaauagcguaauaggaagucaaaucccccuuucaagcccuuuuccccucuucuguacaggaaggcagucauuucuuggccaccuugccccuugccugccuccuucuuucuugaguauugcuaacauuuuagcuaagugguccaugacuuccacuuucucuuucugauucacagagaaucuuucuccaaagcccaaaucaaagaagaguuaauguaaauguguuuucuuuuccuucuucaaaccucccacucacccuaaacucauguggaacagcccugcuauuuaguaaccauuugcaggaauguccuuagcuuuuccugagccuuuccugccugucaaacacuccucugaacauuuggcaggcagcaguucacauagucuucagcacagcugauaaagguuucgucucuagcccauuuguuaggaggcacuggaggcauacagguggguaacuuguaggcgucagcauggccagccagcacuccucgccagggagcugcagccguccugcaccaagaggccaaguggcugcuguguccggccuugagugucaucuugcaggggagcuuugagucaucuucgcuuagugcuugugucuuugauuaguuuguauuuuaaauagcgaaagauggugaggugcugguuuaaaaagcuguguaauugucaaaggcuuacuuucuaacuaguacauagaauuuuuaagauaugaacucuauggacagauaagucaaaguaugauuauuuaauguucuuuaacuuacauacagacuuccuucauugacugugauuccuaaagacuauuuuucgaguguguacuuauuaauaguugagcuaugugaauugccauuuugcugggucaaaaauguuugaauaucagcaguuucacucugugguauaaguacauccugucugcuuucuugacaggauuaaauuagacacaugugaacauuuuugaguugcuguauaggaagaacugcgcugccagcagccgcaugagcagagccugccuccuaaagugaugugaugugagcucauguucugacauggccgcucuguagguuuccaggccuacaggguuccagccuucugcuccacuccacugccuccaggcaagguucugcagaauuguccccagucagaugacucaucauaugugcuuuaauugcagucuuacuacacggacuuaaauuaugaaauuuuaaaaaugacuaaaaaguccagggcauaguuagcagauaccauuuuauuugucauaucauaucccauuuguucuguuuuccaguuuagcuccugaaacacgggaaauaucccauuggucaugguaaaacaaguggauaaaccuugaggcccauuucccauguugauuugcaggaggaccccgccugcuccaugugugugcccuguccuguaagccuuugguaguugucccuugcgggcauauacgggcacacucacaacagucuguuuuucugucccaucugguguuacagacugucuugaaggacagaauaggaguuaccuauuuuucugucaccuacaaauauuaucuuggguguaaacauguuuguugacuuaaaugucaguaaauacauuuauuuuaaagucuaaaauccaauauuauguauuuucauauaaaaugaaagauaaugcauauuaaaaaauacguguauauggaaccaugagccugaauguguggccugggucuggaucacauuaaccacugcaguggguuuuaucuggcaguuuggguaugaacuuggacaugggucuggaucacacuaaccacugcaguggguuuuaucuggcaguuugggugugaacuuggacauggcucuggaucacacuaaccacugcaauggguuuuauuuggcaguuugcgugugaacuuggacaugggcaaagcgguguauggauggaugaugaugaaagaugagaacaucccuggcacggucguucggaccagcacuaucccagaggaacuugggcgccugguguauuuauugacagacaaaacagguacuguucguggucuguguucaccuuugaauggacaaaaugacauuuaauaaaaaauagcauagcguauagauauauguuuauguguauguauauauguguauguauuggaacagaucauugaauccauauuuagaauuuuucagccucuacucuugaaacugucacacagcuuaaucaucuucuaguauacacaguaucauaagaauuaucaaaauguuaaguucuuagagcuuuaaguaacauauuucuguguuuuuaauuuucuacagucuuacaguuuuuuuuuuaaacuaccuuuguaacaccucccuaguggcuuauuaagagcaagaauuccauguuuguuuauuauagaaugauacuugugagcuauuagaagaaaauaacagauauguuaauuugguauuuaauacucaaauucuccuaaaaagcuuuacuacagacuauuuaucccacucuaaagcucuaggaccaaaauucuguuuguccuuauuuaauuuucuucuuuuuuucaucaaagaacucuuaccaauccguaacagauuaaagacaaacaauuggaaucugguacuauaaggaaagccacaucugagggcuaaaauuccuccuugauuuauugauuuguaauuuaaauugcaaguaauucuuagugaacuaaaaauaaaagaauacuuauauagcgugauaaacaaaauauguugcaaacaaaauucaacauaguuuuaaacuauuaaauaguagaaaaauccucacuauagucaacaagaggacagagaaaucugcaaacaagacuguuauuuaaaauucauaauggaagcucuagccauugcagcaagacaaauagaaauaggauauaagacuaaaggaagaaacaaauauuugcagguauagcaaaaguggcagauuauggauuaaaauaacaaaacaggucucuaauacauaguggagaacagaccgaagaguaaagcuccauucacagcagcugcguccauagaagacacagaggcaggaaccugaggaaugaauggaaagggcacacagacgguccgcagcuucauagucgcucgacuugaugcgacuuugaucgaguggugcgguagcuucacucgaacucgaugguggugcaguagcuucacucgggacuguacuuccacuauccgugcagcaguucuuucuuucacuuucaauacgguguucaagaaaucacaugggauauucuuuguguuagcugauuuugcccaacugucagguaacguaaggguucugacacaguuaagguagacagggcuaggccaugguauucggaaggugagaugcauuaauaaccccaucauaaguugaggagucucuguuuuggaagucauacuauuaucucaaaaguagaaauucaguauucuuugugucagcucucaugaugaauuuguaacuuuaguguaauugaaaguucaguuguuggauuuguguuugaguuccauuagacuuugucuugugagagguugaggaacuuggccaagagagcaauguuuaugaaucccagugacucggagagcaauuugaggggcuucugguucaaaaagguagacugagaaagaguguuaggauuuucccuucccaaccucaugaagccuacagaaaaauguuuaaagaauaaauaaauccaugguaauacacagaaaacaagcaggaguaaaaauauuagaggauccagaaauugaguuauuucuggaaaacaguuggaaucaguuugcaggugagagcagagcaaagcagaccaaaguugccaguggcugcugaggagaccccacaugggugggagaaacguccugcagaaccuagggguggacgagccccagaccuggagccgacaggugugugggguggcacgggaagccaucaggccaccgugagcggcgccugugagagcaggugaccaccaggauuugcucaugugcccccugcgagggcugcuuucccaacguggagaggcuuuuggggagaagcacucaugcgcccccugugagggcugcuuucccaacguggagaggcuuuuggggagaagcacucacugguucaugugccugccccuuaugcagaguucacagacagccccuugauuuggaaaccagcccuuuggaggaacagguuuauggaacuucagaagaaacccaccccagcuuacuuuacaaacaacuuagucuucauugauaaauauaaucagaaaugacaaaucaccagcaugaaaucaaaguagcaaaauaugaacaaccguacuguucccaaagaaaacaaauucauagaaaaagcaaaagaaacuucaggaaaauguucagaauuuuaagagaauuuauucauauguaugaguuuaauaucuaaauucagcagcaauucuguacaccagcaaccauuaggacauuuaauaccaaaacaccaguuagaguaacaacaaaaaguauaaaaucauuaaaaauaaauguaaacaaaaauacguaagaccuaaauggauguaaguuuuuaaaauuugaaagcccuuaagaccgaaauacauaggcguacugucuucuugaauagaauaucuuagcauaauaaagagauaucauuucuucucacauugaaagaucugauguguuugcaagccuaggaggaaucagaaacuccuguucacucuuggugggaacuuaaguuagcguuagcgcaucacuugguaaaacacauuuuggcaucaucagucaaguugaauaugcacguguucuacucuccagccguuuugcuccugcuucuguucccuacagaaauguuugcacaucuacaccagaagacaugcauaagaguauucacagcauucuaaugguuaacaaaagcaagcaacugucuagauguaacauaaaaaaguuuaucaaaaauagaauggaccaagaaauuguggaauguucuuacaguugaauacuaaauagcagugacgauggaguacggauauugacagaaacauggauggauuucaaaauagaauguucaagaacuaagagaaacauaaaaaauuuaauaagguuuauuuauauaaagauaaaagccaugaaagauuaaaccauugaauauuuagaggaaaauaaaggaucaagcuguaaauaaaagaaacauuaaaaaaagcauguagaccaauaugaaucagaaggaaacugguauaucuaccuugauuaauauuaagcaaaauaaaccuuaaaaugaaaaaaguuauuuaagaaagagggucacuacauaaaagguucaauucaaaauguuuguguacuuaauaaaauaguuucaauacauaaagcaagaauugauacagggagauauugauuauuugcugucaaccacaggaagaaauguuuagaucucuuuuuuuuauugauuagccaagcaggcaguucagaagauuugaauagcauaauugucaguuuagaucuuauggacauauauagaguuacuuaucuaacaacuagaaacacaugugcuuaucagacauguaugagaaaguuacacaaauuugauacauacuaggccgugagucaaauuucaauaaauuuuaaagaguggauauuucugaucacaauaaaaaagagaugaguuagaaguuaauaacaaagaaauaaguucuuaaaucucugcauuuuuagaaauugaaguauauacuuuuaaauagcauacauccaaaaauaauacagauucaaaaugccuagaacuaaauaauaauauaaucacuuuauaucaaagcccaugaauguacaaaaucaagguuuuuauaggaacuuuccuucauuuuuuuaaauagaaaaacaagaaagccuaaaaauuaucuaaauggccaacuuaagaauaguaaaauaaauucaaggaaaauacaaggaaagaagauaccaacagaaagcagugacuugauaaaaccaucaaugauuaauacguccugucagacuuuugaaaaagacaacaaaauaaacacacuuucagaauucugauuuuuaaaaaguaagaaaaggugggccaggugcagugacucacacccguaaucccagcacuuugggaggcugaggcggguggaucaccuaaggucaggaguucgagaccagccugaccaacauggagaaaaccugucucuacuaaaaauacaaaaauuagccaggcaugguggugcaugccuguagucuuagcuacuccggaggcugaggcaggagaaucacuugaaccuaggaggcggagauccuggugaggcgagaucacgccauugcaugccagccugggcaacaggaguaaaacuccauuucaaaaaaaaaaaguaagacaaagcaugaacacauacuacaaaagagaagagaaacauagauacagauguaucugauacuuaaaagaaauuuuaagagaaugacaauguuuuauaaccaguaaaucuaaaaagcugaguaauagaaaaauucucagaaaaaaaguguaagcuguuaaaaaugacucagaagaaacaguuuuagcaauccuaaaaccauuagaguaguuuuuaaaaaaaucuucuggggccaggugcaguggcucaugccaguaaucccagcacuuugggaggccaaggcaggcggaucaccggaggucgggaguucaagaccagccugaccaacauggugaaacccugucucuacuaauggaucuacugauagaucuggccaaaucaaauugaacaccuucuggaaaggauucacgauuccaguugccauuaagaacauacgugguaccugggaggaggucagcauucauacagguuuggaagaaguugauuccgacccucagggaugacuguuagaagguuucaagaccucagcggagggaagagccgcagguguggugaaaauagggagggaauuaggaguggagccugaagaugacugaacugcggcaaccucaggaugaaacucgaacagaugaggaguugccucuuacggaugagcaaagaaaguaguuucuugaaauggaauccgcuccuggagaagaugcuaugaauguuguugaagugacaaccaaggauuuagaagauuccauaagcuaaguugauaaagcagggucugagagcaucgacuucaguuucaaaugaaguucuuugaguaaaaugcuguccaacaacauggcaugcuacggagaaauauuuugugaaaggaagagucaguuuauguggcagacuucauuguugucuuauuuaaggaauugccacagccaguccaaacuucagccaccaccacccugaucagucagcagccgucaacauuaagacaagacccucuaccagcaaaaagauuaaaaguugcugaaggcucagaugauuguuagcacguuuuaaaaauauuuuuaaauuaugguagguauauuguuuuuuagacauacuacuaauugcacauguaauagacuuacuauaguguaaacaucacuuuucuaugaacugggaaacgcaaaaagucauguggcucacuuuguugugauagucacuuuauugcccaggucuggaaccaagcgcuuccccugucucucaguugugccuguaguuuccuaucuaguuuccuauguacuucauauccucaauuggaaagggcuuuggaaucaaaucugggauugagucuuggugccccccaacuaugugugauguuaggcaaauccuuuaacccuucugagcaaaagaaauguguugucagucacuaaaauguugugauaguuuguuacacagcucuagauaacaggggcacccaggccaacagagaaauacaaaucacucucaacucugaaagcagcugguuuugcccccuugccuuugugaggccucuaguacccuggugaaaccagugcauguauuuacugcuaaucgguuguuuuauuccaggaacuuaaauaauuaagaucuuucuauuuuguauuccauauuuuagucauauaaauaauucugcucuuuugcucugcccuucaguguguaaaucagaagucagacaggcuuuugcagucaccuugggggccucagucacagcagagguucuguaacuguggaugguuguuuauuauaaagcguccugguucuccguaucagaggaggcauguugagccauaaggcaguuugcagauaucuuccaagugccuugaguuucagcugaagugauggagagugaacugcugucucaggagccuuaauguuacuaacauaauuggaaggugguccuucgcaggaguguaaauggggucugugcuucaucaguaagcuuuuggauaagaagcguccaucacagugguucucucauuugccacggcagaauagaaaaugaaguaucccaauaauugcauuauaguuuccuucuuguggacaagaaagcaaugugguauaauuagguuugauuggagugcacauuuccgguaagaucugaaauuaaugauguugcuauagugacacaucuguggccaccagugcaugaaacauaaagcaauucauucgacaagcguagacaucugugaacugcaaggaugcagagcauauugacacugaccagaaauacucgacgccggcugauaaaugaacaaaugaugcugaaacaggaggacagccaauuuguacuuaaucugcugggagaacuuuaaucuucucacugguugcauuugacagugccauuguuuaaagaacaaugcugcagagaacucauaaauuuuaaaacuuaacucagggugcagccuauuaaagcaauacauuaauuccuuuguuagggagguuuuaucuucauguagaacaaagccguuacuaaaaacacccacuaaaacaacagguuuuuuaggacucacauuuuaauuauagcauccauuacccaaaaugccauguuguucagaauugaaucacauauaaguuucacaagauggcaucaucaugaaggggaaagcuguuuucccaguuuguaagggcaggcaagcaugacgugugugcuagugagugcauacgaggcaagcaaaucucacagguaagacuuggaaauguuuuuuaaaccaagucucuuaugcaugaugcuaauaaccggguauucaguuacagcaaauaugaguagccuuacugguucuguuuuuacuaauguguguccuuggauaugagugcuguaauuaacauuuuggggguguuugggccaguugagauauuaacacaugcagauaauuaacugaugcauaccguccugagaaucgcaguuuagagaaagccugauuugcagagacuguauuuaacuuugaauauaauauuugacuucacuuuaaacagugucauugacuuugaauauauuuggcuucacuuuuaaaaagugucaaauauuuucaaaauucaaagcauacuuuaaagauuggcaaauuagucuuaucacuuaaguuuuguuuccauuucauuuuuuuuaauuuuuuuauuauuauuauacuuuaaguuuuaggguacaugugcacaaugugcagguuaguuacauauguauacaugugccaugcugugugcugcacccauuaacucauuauuuagcuuuagauauaucuccuaaugcuaucccucccccccaccccaccccacaacaguccccagagugugauguuccccuucccguguccguguguucucauuguucaguucccaccuaugagugagaauaugcaguguuugguuuuuuguucuugcgauaguuuauugagaaugaugauuuccaauuucauccaugucccuacaaaggacaugaacucaucauuuuuucuggcugcauaguauuccaugcuguauaugugccacauuuucuuaauccagucuaucauuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaaucaccacacugacuuccacaaugguugaacuaguuuacagucccaccaacaguguaaaaguguuccuauuucuccacauccucuccagcaccuguuguuuccugacuuucuaaugauugccauucuaacuggugugagaugguaucucauugugguuuugauuugcauuucucugaugaccagugaugaugagcauuuuuucaugugucucuuggcugcauaaaugucuucuuuugagaagugccuguucauguccuucgcccacuuguugaugggguuguuuuuuucuuguaaauuuauuugaguucauuguagauucuggauauuagcccuuugucagaugaguagguugugaaaauuuucucccauuuuguagguugccuguucacucugaugguaguuucuuuugcucugcagaagcucuuuaguuuaauuagaucccauuugucaauuuuggcuuuuguugccauugcuuuugguguuuuagacaugaaguccuugcccacgccuaugcccugaaugguaaugccuagguucucuucuagaguuuuuaugguuuuaggucuaacguuuaagucuuuaauccaucuugaauuaauuuuuguauaagguguaagaaagggauccaguuucagcuuucuacauguggcuagccaguuuucccagcaccauuuauuaaauagggaauccuuuccccauugcuuguuuuucucagguuugucaaagaucagauaguuguagauaugcggcauuauuucugagggcucuguuauguuccauugaucuauaucucuguuuugguaccaguaccaugcuguuuugguuacuguagccuuguaguguaguuugaagucagguagcaugaugccuccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuauaaauuaccuugggcaguacggccauuuucaugauauugauucuuccuacccaugagcauggaauguucuuccauuuguuuguauccucuuuuauuucauugagcagugguuuguaguucuccuugaagaaguccuucacgucccuuguaaguuggauuccuagguauuuuauucucuuugaagcaauugugaaugggaguucacucaugauuuggcucucuguuugucuguuauugguguauaagaaugcuugugauuuuuguacauugauuuuguauccugagacuuugcugaaguugcuuaucaguuuaaggagauuuugggcugagacgaugggguuuucuagauauacaaucaugucaucugcaaacagggacaguuugacuuccucuuucccuaauugaauacccuuuauuuccuucuccugccuaauugcccuggccagaacuuccaacacuauguugaauaggaguggugagagagggcaucccugucuugugccaguuuucaaagggaaugcuuccaguuuuggcccauucaguaugauauuggcuguggguuugucauagauagcucuuauuauuuugagauacgucccaucaauaccuaauuuauugagaguuuuuagcaugaaggguuguugaauuuuaucaaauucauuucugcaucuauugagauaaucaugugguuuuugucuuugguucuguuuauaugcuggauuacauuuauugauuugcguauauugaaccagccuugcaucccagggguaaagcccacuugaucaugguggauaagcuuuuugaugugcugcuggauucgguuugccaguauuuuauugaggaugcuugcaucaguguucaucaaggauacuggucuaaaauucucuuuuuugguugugucucugccgggcuuugguaucaggaugaugcuggccucauaaaaugaguuagggaggauucccucauuuucuauugauuggaauaguuucagaaggaaugauaccaguuccuccuuguaccucugguagaauuuggcugugaauccaucuggucuuggacucuuuuugguugguaagcuauugauuauugccacaauuucagagccuguuauuggucuauucagagauucaacuucuuccugguuuagucuuaggaggguguauguguugaggaauuuauccauuucuucuagauuuucuaguuuauuugcguagagguguuuguaguauucucugaugguaguuuguauuucugugagaucgguggugauauccucuaucauuuuuuauugcgucuauuugauucuucucucuuuucuucuuuauuagucuugcuagcggucuaucaauuuuguugauccuuucaaaaaaccagcuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucacuuuaggaucuuuccugcuuucucuugugggcauuuagugcuauagauuucccucuacacacugcuuugaaugugucccagagauucugguauguugugucuuuguucucguugguuucaaagaacaucuuuauuucugccuucauuucguuauguacccaguagucauucaggagcagguuguucaguuuccauguaguugagcgguuuugagugaguuucuuaauccugaguucuaguuugauugcauuguggucugagagacaguuuguuauaauuucuguucuuuuacauuugcugaggagagcuuuacuuccaacuauguggucaauuuuggaauaggugugguguggugcugaaaaauauguauauucuguugauuugggguggagaguucuguagaugucuauuagguccgcuuggugcagagcugaguucaauuccuggguauccuuguuaacuuucugucucguugaucugucuaauguugacagugggguguuaaagucucccauuauuauugugugggagucuaagucucuuuguaggucacucaggacuugcuuuaugaaucugggugcuccuguauugggugcauauauauuuaggauaguuagcucuucuuguugacuugaucccuuuaccauuauguaauggccuugucucuuuugaucuucguugguuuaaagucuguuuuaucagagacugggauugcaaccccugccuuuuuuuuguuuuccauuugcuugguagaucuuccuccauccuuuuauuuugagccuaugucugucucugcacgugagauggguuuccugaauacagcacacugaugggucuugacucuuuauccaauuugccagucugugucuuuuaauuggagcauuuaguccauuuacauuuaaaguuaauauuguuaugugugaauuugauccuguuauuaugauguuagcugguuauuuugcucguuaguugaugcaguuucuucguagacuugauggucuuuacaauuuggcaugauuuugcagcggcugguaccaguuguuccuuuccauguuuagugcauccuucaggagcucuuuuagggcaggccugguggugacaaaaucucucagcauuugcuugucuguaaaguauuuuauuucuccuucacuuacgaagcuuaguuuggcuggauaugaaauucucgguugaaaauucuuuucuuuaagcauguugaauauuggccccuacucucuucuggcuuguagaguuucugccgagagauccacuguuagucugaugggcuucccuuugaggguaacccgaccuuucucucuggcugcccuuaacauuuuuuccuucauuucaacuuuggugaaucugacaauuaugugucuuggaguugcucuucucgaggaguaucuuuguggaguucucuguauuuccugaaucugaauguuggccugccuugcuagauuggggagguucuccuggauaauauccugcagaauguuuuccaacuugguuccauucuccccgucacuuucagguacgccaaucagacggagauuuggucuuuucacacagucucauguuucuuggaggcuuuguucauuucuuuuuauucuuuuuucucuaaacuucccuucucacuucauuucauucauuucaucuuccaucacugauacccuuucuuccaguugaucacaucggcuccugaggcuucugcauucuucauguaguucucgagacuuggcuuucagcuccaucagcuccuuuaagcacuucucuguauugguuauucuaguuauacauucgucuaaauuuuuuucaaaauuuuuaacuucuuugccuuugguucgaauuuccuccuguagcucagaguaguuugaucgucugaagccuucucucaacucgucaaagucauucuccguccagcuuuguucuguugcuggugcggaacuguguuccuuuggaggaggagaggcgcucugcuuuuuagaguuugcaguuuuucugcucuguuuuuuccccaucuuugugguuuugucuacuuuuggucuuugaugauggugauguacagauuaguuuuugguguggauguccuuucuguuuguuaguuuuccuucugacagacaggacccucagcugcaggucuguuggagcuugcuggagguccacuccagacccuguuugucuggguauuagcagcagugggugcagaauagcggauuuucgugaaucgcgaaugcugcugucugaucguuccucuggaaguuuugucucagaggaguacccggcugugugaggugucagucugccccugcuuggggggugccucccaguuaggcugcucgggggucaggggucagggacccacuugaggaggcagucugcccguucucagaucuccagcugcgugcugggagaaccacugcucucuucaaagcugucagacagggacauuuaagucugcagagguuacugcugucuuuuuguuugucuguguccugcccccagagguggagccuacagaggcaggcaggccuccuugagcuguggugggcuccacccaguuggagcuuccuggcugcuuuguuuaccuaagcaagccugggcaauggcgggcgccccucccccagccuugcugccgccuugcaguuugaucucagacugcugugcuagcaaucagcgagacucugugggguaggacccuccgagccaggugcgggauauaaucucauggugcgcccuuuuuuaagcccgucagaaaagugcaguauucgggugggagugacccgauuuuccaggugcugucugucaccccuuucuuugacuaggaaagggaacucccugacccuugcucuucccgagugaggcaaugccucgcccugcuucggcucgcgcaacaugcgcugcacccacuguccugggcccacugucuggcacucccuagugagaugaacccgguaccucagauggaaaugcagaaaucacccaucuucugccuugcucacgcugggagcuguagacuggagcuguuccuauucggcugucuuggcugccccccuuccauuucuuguaaggucuaaguaaguuuguguuuugauacauccgcugauuauguaugugucuuacuuuguuuaacuagaaucuucacaagaaaguuuauugcucuaggugcguggcauaucucaguguuaccuuucuuuauauauuaaaaucacuggcucccuuuuguaugauggugugguagaguuuaggggugaggccaauucacaauucaggaauaugugguccgaaaccucugcagcugugucucagaaacugucuacucggcucagucauggaucacaucuguugccacucugagaaugaugccugcaggacuuuuucccuagaaauuaauuuccucuuugccugcuuuguucauuauagucccaaaaaacucuuuuucauuaaagagcugcagcuuuuuuuuuuuaagaaaucagaaaccuuuugucaaaagacauuuucugucuauauagcuacauaccauagccgagucugcugugaaucucuuugacgugacggcacucuuacucucuggcugcauucauuccucccuuuuccaaagcuuccaauuugggggcauauuaauuucuguuguauuaaaaugacaaaaguuguagaaaucaucaguguuugaaaucauggagagcauuugagguaagauuugaaaaauaauuuuguauuacagacucuacauuaucuacuacugcauaagaggugaaggaaagucugaaauuagcaaguuaugaaauuaaaaaaucaucgagauuuaaaaaauauuuuugggcuucaucuucauaugugaagaaaguacgugugccacucaccugaaggaaugucugcauaaguauugcaguuucuuuaacccaacaaggugugauugcauuuauucacauggacagaauaacaaacccaaaaacuuuaucauucguugaugagaaguguuagucauuuauuugaaugucaguuuuaagcuacugauaacaugauugauuagcaacggaaacauuuuagaagauaccacgcauuuguuuaauucaaauggucaacugucaggauacaucgcucucuuauuccacucucaccacaaucuaacuuuaaaacauucucaucacccuaaaaagcaaccuuggcacuccccauccuccccuuccaucgcccgugccccaggcagccccugguuacuuucugucucugaggacuugccuguccugggcguuccacguaaaugagucagaccuaugcagucccugcuggccuccuucacuggcauauacucuuuuacugguucauucguauuguaguguauaucaguaccucauuucuguuuauugccaaauaauauuccaucguguggauacaccacacuuuauuuauccauucauaaggugauggacauggguuguuucuacuuuuugccuacuacgacuaaugcugcugugaguauucaggguucuagccaaugcaguuaggcaagagcaagaagguggcguccacauuguaaaggagagcaaaacucucucuguaugugugacauggucauguccguaggaaauccucaggagucacccagcccucuauuaauuaaagggguuugguaagauuguaggacgcaagaucaacacacaagaaugaaauuguauuucuguaugcuaacaacgaaccauccagagauagaauuaagaaaacaauuguauuuacagugcaucaaaaaauauuucauuguguuaagacggcaacaauucuagcuucuuuuaucuauagguucuguguaauaccuacuaaaaucccagcuaccuuugcauaaauuggcaagcugauucugaaauucacauggagauacuagggauucagcauggcuacaacaaucuugaaaaacaaacaaaguuagaggacuugcaacucgugauuucuucuuuaaaaaaaaaaaaaagacaugcauccgaggaaugugggcugcagaguggggggugggugaaagaugugagguuagggguuuguuuuguuuuguuuuguuuuguuuuugaaacagggucuugcucugucacccaggcuggagugcaguggcacaauugugggucacugaaaccuugaucuccugggcuuaagugauccucgugccucagcacccaaaaugcugggauuacaggcaugagcuauuacaccuggcagcagcuccugguuucaaaaccuaauacaaagcuacaguaaucaagacaaugugguauguggugcgggcauaaggacagacacauagauugauggacuagaagugagaggccauaaauaaauccaaacacuuacggucauuggguuuucaacaaggaugccaagauaaugcuauggagaaagaacaguguuuucaacaaauggugcugggcaacuagauaucccaugcaaaaaaugaaguuggauacuuaucccacuuguaccuaaaagcuaacucaaaauggaucauagaccuaaauacaaacacuaaaauuauaguauuuuuaaauuacucagcuuugagaaaguauucuaaauuuguuauacaguuugaauguuugcccccucaaaaacucuuauugaaaugucauccccagugugacacuauuaagagguggggccguuaagaggcaagugggucaugagagaucugcucucaugaaugaaugaaucuacucauggauuaaugggugaauggaucaguggauuuucauggaguguuaguugucacaagagugggucuguuagaaaagccacuuuggcccucuugagccuccucccaucauggggcggccugcagugccucaggacucugcagagaguccccaccagcagaaaggcccugaccagaugcagcaccucagccucggacuuuccagccuccagaacuguaagcaauaaauuccuuuuuaaaauuaauuacccagucucagguauuugguuauagcaacagaaaauggacuaagacaguucuccauuucauucucccuggcuccaauuaaguaacugaauaagacuuuugguaucuacugagauauaaagcuuuauaaacauaacucaaaaggaaaaauaguucaaaccuaaguuucaguuauauuuuaaauuauuuucaacuaaaugcauaaaugcgcagauauuauauucaguauuuuagcaucgccuugcauguuucugugacagcuaucuggucuccaguauuuucaaggggucuuuguguacauguagaauuccucucaguuuucuccaagcagcaguaagaagcaaaguauaauagcauagcugaaguugggaaucucagaacuugaaauacuaccaccaagcugagaaaggacaucuaacuaaagcacuggauuaaaauagugcuuuaaaaucccugauuuacugucuagaaagagucugugaauggagugauuauaaaugauguaacuuuguuuuuggaaaacaucuguuguccauguggauuuuuugcauuuagaaaugccagaguucucuucuccagaaaaagaugucccaaagucaaugauaaguaccucaacuauaugccacuuucaacccaugaugaauucgugggccuaggaaucgauuguggguggcuguuuacaucagaggaggcggccagacacccugcuuccugauggaaggacgcucccugcgcugcagcagucuccacggaaccuugccucgccagccuugcccagccguggcucacaggaaacacagggcccacaggcacaggagaaacggccaguggccaaguacagauugugggaacugaaaccgucaguccagguucuuuaacaaaucaauuucaaggaagaaagagauggaggagaaagcuguagaguaaaagaggcucaagagaccuuuccuggauccauacuucagacaagcaguguaaaaaacuaugacacacgagacaccuggaaauuagaacccugacuucuguuuaacauggaggaguuauuguggcugucuggugugcuaauauuucgguucuguuuaaagugucuuucacaaaugauacugacaugcccaugguugaaaugauauggcucagauuaguuucagcagcgccaagaggagugaagugagggcucagaugaaagagcugcccuagguccauguugccaaaaaggagcgauggccacagggcuuucaggagacuaucugucuucuugagguaauuuaacauuuccuuuuaaaaauguagaaggggugaaaagaacauacguuccuggauuucaguuccuugcauuuaauaucuuucaaauuuacauacaaaaaugacauuuucuguguguuuugguuuuauuccagcuauagguacgugugcgugcauccaugaaugcaagcacacacauacacagacacagacacacacacacacacagcaagguugaugccccauauaccaugagggauuucuaguguguauuccgcauguugaaaugguauuauuaccaggaaaguggaaauuuugacuauuagacacccaaaaucaacauuucacuguucaaaucaacugcccuacuaaagcaucagaaauacauuggucuagcaaagugaaauuggcacguaauuauguuuauaaccaucuuacucauugauuuccucuaagaaaacuguguuauuuaaaaccuauuauaaaguuucauaucgagaaaacuugaaucuuuuacugucuacaauuuuucucauugcuuuuuggccaacuguauaagugaaaggggguauuaugucugagggcagaauguacaugguguuuaaagaauaauuuucacacauggcaaauuccacauuugccaaaccucuccucccauuuucuuuuuaaauuuuuauaugugucauuagaauagcuuuauucacaaugcagugauauucccuguuguuucugacagcagauacguuacacucagguaucauguggccugaauguucaucucucucuaaaaucccuguguugaaacugagucccagaugauggcauaguacuaauuaggagaggugacugggucauggggcagagcccccaugaaugggauugguucccuuaaaagcaagguccuagggaggcagauucccucucccagcccugaggacacugcaagaaggcuccacuaugaugagggcccucaucagacaccaaaucuccuggugccucaucuugcauuucccagccgccagagcuaugagaaguaaauguuuguuguuuauaaaccacuugguuuaugguauuuuuuaauuuuaauuuuuauuuuuugagacagggucuugcucugucaccugggcugguuugagacaaggucuugcucugugacucaggcuggagugcagugucgugaucacagcucacugcagccucaaacuccugagcgcaguccaucuuccugccucagccucccuaguagcugggacugcaggugugugcugccaugcccagcuaguuuuuguauuugugauagagaucgagucucaccguguugcucaggcuggucuugaacuccuaggcccaagccaucuuccuaucuuggucucccaaagugcuggaaugacaggugugagccaccauguuacugcagcccagaaggagugagacaggaauuaauaacuuaauaacacauaguuucaaaaaucaauuacuguaaauugugugguuuuuuccuaaagaucuuguguggcuuuaaauuuaucugcauguugccaaaccuguggugagaauccuacgcuagcugcacuuugcaacgucaauaacgagguaaaaaacagauuuuucaaauaaaucucaaguauuuuuaaggacaggaaagaacuaaauauagaagguaucuuccggauuuuuauauaauauuuccaacuuuggauuccacacagaaaauauuuucauccagggcagaaacaguagugcaaguguuugauuucuguuuacagcagucuucuauauaccuuccaccacccuuguuucauaaauuaggcucguuaucauuauucuuuuuuaaaaauuuaaaucagcaacuuuuuuggcugcuauuuaggagucagguucuggggauagaguugggauaauacagacacugccuuccuggagauuccacugcaguaggggagaugcacgcucagcagcuaaagacccagagagaagacagggaugacccacagagaagacagagaugacccagagagaagacagagagaugacccagagaggagaaagagagaugacccagagaggagacagagagaugacccagagagaagacacagacgacccagagagaagacagagacgacccagagagaagacagagagaugacccagagagaagacagagagaugacccagagaggagacacagacgacccagagagaagacacagacgacccagagaggagacagacgacccagagaggagacagagagacgacccagagaggacaaagagagaugacccagagaggagacacagacgacccagagagaagacagagagaugacccagagaggagacgcagacgacccagagagaagacagagagaugacccagagaggagacacagacgacccagagaggagaaagagagaugacccagagaggagacagagaugacccagccagagaggagacacagacgacccagagagaagacagaugacccagagaggagacacagacgacccagacaccacaggggcuagcaagacgcggcccgccguucucaucgcguuaugaggcacucaguaaauauuaaauacacauuuuauauauuguggguauuuuugguaauauaucuacuuuuuagugagacaaaugggauguggaauuccaugacugucuauguggguguccauuaggacuguaguuuguccuguagcuuaauuuuacuauauuuagauguagggguuuguacuuuacagaucaaaaauucucuucuuaauagagaaguuuguugcacuuucaaauacauuauauuauguuuaguuuaaggagauaaaacagcuacucagggacuuaggauuucauguuucgccuugauaagacucuacacugucguguaauaauuguaucuaaugcuggccugaucuguaauuaggaaggaaacacugcaaugaccuuaacagaacagcccuggguauaaagagcaggaagggaugcagaaaagcauaugacaaauguagcccucauucaugcuuuaagaagaaaacucggaaaacaaggauuagaggggaacauccucagguugcugaagagaaucuuaaagagcugaggcugaggccucacucugugugauggagacgcacgcuuucccuaggucaggaaggaagcgagggugcuuguccaacagugccagcauuccagacagugcaguacgguaagaaaggggaaugcaagguauggauaucagaaaggaagaaaucgaguuaaaauuaaagaaagaaaauugucccugucugcagauggaauaauuaucuaccuagaaaauccaaggaauguacaaaaaauucugugagccagugaguucagcagggucacaggguagacuguccacaugcagaaaccaaugguguaucuacacuugcagugaauaugugccagcugagaugaaaaguacggugccguuuauaauuccuugaaaaaagcgcgguacuuagccgugaaucuaauauaaaaugagugggccuugugggcugcaaacuacgucacacucaugaaagaaaccaaaauagaccgaaauaaacacagugauuuugcucauggaccucaagucuccacacacuaaaaaugucacuucucuuuucgauauucaguuuaauucaguuucugucaagauuuguuuuguagguaagauuauuucuaaauuuauuuuuaaggcaaaggagcaggauagcugaagugacuuugacaaagaagaaaguugaaggacucacuaccagauuucaagacuuaaauaagcugcagucaucaagacugugugguauugggggauuuuucaauggauacagaaccuagaaguuggccuugcaccaaagaggauaugggaacagaacaucaguaugaggaaagauguuccuccuucucaggaggcagaguggcugucccauagccacuucagacucaccaucuguguguucuccccuucucccaaagcugucuacuuucuuaauuccuguuucuuguugagggccagccucccugagcaaggcagucagccugagcugcucuucgaggucuuggauccggagccuccacauucaguucccaaguccaguugaugcucuuuucuagacuucugaagauuucaugcauuugccucuuccuuucugucuugaugccugcugccacaucauccuucacguagaccuugaucccaguucuuucccccacauuugacccccaccacucuguccuuagaauaaugccucaguuaacucuguuaccuggacagggcccauccagaaugaagccgggacuccugagccuggcucugcaugcccucuugguggacaggaggcucucugcuucacugugcucucuugaugggaccuagagagcuccucacccccuccucccucuccagcccuucucuugugugugucucuuccauucacaggcauuugucuuugcucccagacccaugugcgagccacauacaguucccucuuccuggagcgcuucucuuguggaaaccacuaguaaauucauaugcuucaagucacaggucagaugccaccacuccugggagcagucccugcccccucucugcagucuccugugacugcaccacauggacccugcauuagugccucucaguagcaugaucucuugcagccucucucccuguuaugcugugggauucuuuaggaaaggaauccucacccuccuuguguuuggggcacuuugugcauugucuuauucauuuuuauccaugcaacauaugagauguauuccguauuuuacaggugaauaaacugaggcuuggagagcuuaaauccacucuaugaaguuuugcagccugcagguuacagcaggauuuggacucccaagcucaaugaguagugaugcauuuucaugaguuuuugccaaaugaauacacaaauucucagugggaaugugggagucacugucuguuuagagaacuguagcuccugcugcagaugggcagcucuccggagcccugugcugugccacgaggagcagccguaggccgggcugugcagagccuugucuccaucuaaggaguggaugcuuugauugguaagcaguggcgaggcacggauggucacuaaaagcaacguacuagaaugaggagguguuugucuucggaaauagcacugcuggggaagguagguuaaagaauguuggagcugagcucaggaagccacggaagaggcugcagucaggacgcgugguaagagggcagagcgaaggagcuucaggaggggggcacuccaugucugaagugggguugagagguuugagagcguuugggagguaguugaauccagaaagugaggaaagguuggugguggugaugauggcuguggaagaguagcucucguuuauuuaggacugacugggucaggcaugucaccugggugcccucgugucauccuuggaccacccugcagugcuugcaaagugaggaggcugagugggaggucuuucccuucucgguuaagguauccauagggagaggccagcggggccagacaggccccuugcagaugucucagcaggugcugagggacagggaggugcaggcuguugagggagaggcgaggcugggcugugggucgcauguggguugcggugaggacacaaaccccuuugugaggacacugagacuugagcccggggcugcggggccguggacaacagcaccucacaucccagagggagcucugcacuugcagcugacuccacacccagggccugucacagccgcccagcaaacauacugagcaaggacuggauggaaaaugagaugcuauuucuuucuuuaggguucuuugcauacuugcacagucauuuaaaauccuaaagaaguaauuguucgcucuugguaggagcuauacagguguucauuauaauauucuuuuaacuuuacauaugaaauuguucauaauaaaaaaguuggguuaaaaaaguggcauuaaucauaguccuguuuacaaacugcauaggauuuaugccucauuacgauuccccacccuaaaucaucaugcuucacacuaagagagaaaagucuaaaggaaauacuuuguuaucucaaucugcuaaguagaauguuuuuaacuuagcacauuuguuaaauaauuuuucagagagcugcuuacuugggcacacauaauagaggcaaacuugguacuuacccuaauaugaauuaauguaagguuucauuaucuuuuaacuguuggcagugauagaacuaccauuuuucaucucacauuuuugcuauuuaaagcacucauaggccaggggugguggcucacaccuguuaucccagcacuuugggaggccagggcgggcagaucaccugaggucgggaguuccagaccagccuggccaacauggugaaacccuggcucuacuaaaaauacaaaaauuaguugggugugguggcgcacaucuguaaucccagcuacugggguggcugaggcaggagaauugcuugaacccaggaggcagagguugcagugagccaagauagugccacugcacgacuccgucucaaaaaacaaacaaacaaauguaugaagcacaaauguauaaagcacuuguagaacuucaugaugguagucagagacugaauuguugcuaacugcauuauuuaauauagccuaguguuuuauguuaauucuacuuauuuaacaagaguagcaugacaaaacaaaaagguuuaaacugccucucauguaauuuugaugauuuuguuuccacuuagauuuaugaaacuuggagacaucuuuucaagguauacagagcacagccaguuuaaaggugcuucauaaaacuuuguggaagccaaaaucuauagaacugagaagcaucucagguagauaguuagcugcuguuuggaauuuuuaaaacuuuauuauauucacucuucuaagagcauuuaucaaaacaaucucuaaaauaguaauuguaagcucuauuuuccuugucuuugaaaguaagcgcuguguccugauggaaggcucugagccagcugaccucuugaguucugauccuaacugauucacuuugugcucuaauccucacgcacuuagaggguaccauagacaugaaaauaguuuggguuauauuccaguuuggguuauauuccaguaccaugugugccaaagaacauaaaaaugagugaauauuuuuauggauauuuugcaaccauaaaauuggguuuuaugguuuuauugcagucaauugcaauuuugugcaaugaauggcugugucauuguucauacucagauuuauaacgucagcaguauccguggauaacccuucuuggaugugcugugaaauaagugcagaaaccucccugcccccacccuccccggggacaaggugaaagcagcacguugugaaauaagugcacacaccccccggggacaaggugaaagcaccacgcguggcaccacguugugaaauaagugcacacacccccggggacaaggugagagcaccacgcguggcagcacguugugaaauaagugcacacacccccggggacaaggugaaagcaccacacaucgcagcacgcuacauacauauccagaggguauuugagcuucccugugcuacuuugcuucuauaaagccaaauaaauaaaacauaugcacauguaauauguguauuuuuagguuaaaugagaucucuuugucaccuaauacauggcccaacuuuucuggcaguccuccuaagggaggacugugguacuugaggagcaggcauuagggaagcacauucagauagcccaguauuuggaaaacacuaaagaaaagccauccuaucuuucacagaccuccugucugucauuccaagggacacacauacaugcuaaggauuaaacacaucuggaauauccauuucuguucagcuaaaaagacuuaauuuuuugaaauagguuuuuuuaaaaaauuaauggacacccuaauuuggggcuuguugaugucuuucucaggcaguguucuauauuguaauuauaaagguggugacucaguuuucuaguuuuauguccgccucuuucagagcaggcaaaaguugcauucguuccaaauaacagaucugagcugaaaggcaaugacggacuuucuucauauaacuagagcccuucucauuauuaaacguuguuagaggcugcgugugcaguggcucacgucuauaaucagaacacuuuaggaggccaagacagaaggaucgcuugagaccaggcugggcaauguagggagucacugccucuacaaaaaacaaaaaaauuagcuggguguguugucgugcgccuguagucccagcuauucgggaagcugaggcagguggaucacuugagcccaggagguggaggcugcagugagcugugauaaugccacugcacuccagccugggcaacagagugagacccagucuccaaaaaaaaacacacaaaaauguuauaaagguaccuugacaugcuagggagaaaauaucuuguucuuccuauuaaaaugaaaauaguagcaaguaacaaucuuaacgcuacuuuguauuauacaguugggcaucccagcugcuucagcccaugaaugugcagcaugccugcaugguaggaaagcuggguguucccgcaggccuccugcauuaauguguuugcuguuguccccuuuauccuaggaacccucacccagaaugaaaugauauuuaagcggcugcaccugggcaccguguccuauggcgccgacacgauggaugagauccagagccaugucagggacuccuacucacagguaaguggguuccuccugcacggggucugcuuccacacacaucccgcgccaugaguccagcugagccucguguguucccaucuguaaauuagcacgcuucuugguggucuuaacauccugcuacuucagucgucuguucgaauauacgaaucaggaaaucgucuuugaugagcauuuguacaugagugaaaucguagaaggcauagugugcugaagucauuuauucauaucacauuuuacuagugaguuauuuguaaaaaauuauucaguaaacauuguaguugaagaauguucaguaggauacuacaucaauauguuuucuaacaguucuguuuuucucuauaauaaaauguucucauauuuuuaaagguaaauucuuuuuuugccuuuucgguagauaaaaguagacaccaucguguugggaaucucguaucugucauucaccuaccugucaucagugcccagguggugauguuucaucuguagguguucuucauuauuauuauauuaugacaugaagcucaaauaucacauucuuucaucuguaaauauguauuaugugccccuaauugauaaggacucugccuuucguuggggccaaagcucccuaaaguucugagaacaggaauuagagguugaguaucccuuauucaaaaugcuuaggaccagaaauauguuggauucuggauuuuuuuagauuuggaauauuugcauuauccuuacugguugaacaccucuaaucgcuuaucugaacaucccuuugagcaucaauggcguucaaaaagcuucaaguuuuagaacauuuccaauuuuagauuuuuggaucagggauacucaaccuguauuugcuuuuaaaacaggauuuagccuagaggcuguaccacuugccagagauuuugcaggcaguggguuguguauagagucuguccauggacccaagucauccuaacagccucauuccugcuguaggcaccucagagccaccacacugagcacagcccuggcccugaggaguguuuccuugucauucauuugcauuuuuuugugccugucauaauuugaagucauugauucaguuugaucagaccuggagaucugagagaaucaauuuaagagacuagcagacaaggcugcagugugcgucacaaauuuacaccuucugaggcccuuuuucugccuguuuguugauuuauucugaauauagugauccacauaauaaugagcuaaggccuaucagguucaaaauuguacauagcucacccuggggggugugacaguucccagcgcugcacggcacugcuccccggacuugcagaggccacccuucaaaaguguacacagcccacccugggaggugacaguucccagcgcugcauggcacugcugcccagacuugcagaggccaccuggcgacgucagcuguggagucuaggagacuuuuuguauuuacaguaauuuguuucaaacuugauuuucgcagagacuagacuaaaugacacuuucccauugcugcguuucuacucuugacaacuccagaguagcauucaguggucagcauuguauucaguuuuuugaaaaccuucucuuucuuguauacuugcuaccagucuggcauaagcuuuacugucggcaugcugucaaauggaagaagucucauauguguauauauuuagcauauggaauguuuauccacacacauaagcaaacaaacauacguacacagccaaacacuuuauuauuuuggauguaauucauuuagauacggaauauuuguaaccuaggauauuuauuaauagaagaaaaaucuuaaaaggagaaggaauacaguuucucccaggaaucuauuucugcguugaaauaguaccagaugagcucugcuuuuuaaaaaaaaaaaauuaucuaugaauguaauuuuaauagcuucaaauaaguuauuaggaaaaaauuaaaagcagaaaagaugaagcaucauuauauaaacacaguaaauguuuauugugcuuccaccuaagaggacuuuuaaaaucauuuuugcugaaagcuucuguuaguugaacagacaguacuucuuaugugaaauugaucugauucucuaucgguauucuguuuuauuacuaagaugacaggagucuaguagguccacugccgugcaacacagaucuuuuauaaccugauuguauuuccccacuggaggcauuuggugauagagggcauaaucuuucauggaauuugugugaaauuaaauuguacaagcaucacuaaacaucacguaguuuggaaggagggagccagcugaguuugcugucucgcagcagcgugagcaggcgcagaugggcuggguccucacugaaaggcagcaccagcugagcagaaaguuaaacccuucauuagacagcacuguaauuugaugggcaggagauucacaguucauuggaucuguucacccaguccaagcgugagagccuugguuuccaaggaggauugucaugaguuacuccgaaguuaacugaagaaacguuugacauccuguugggguuggggggaguguccucugacacccuccgccacguaggaggugaauaauaaaaaguuauugcuuugguggugccgaugaaaucucugaaacauggcugagcccgaggagagccaggcacacacauaagcccuaaauggggacuugcuuuaagagagcaggauucugagauaugacacggggccauuuuuccucugaaugcaacuuaggauuguauuugguuguuauuauccacaaaacuagacugucuaaacucagagacuacugagagcaggauuaauuuaugguauuaagggaagauucuuaaagauuuuguccugcuuuuagcuuuguacaacauuauuuaaagaaagcugaaagcaguugugaguauaccauuucauuuuguucuuuaauugacucugcuuuuagaagucaugaauaaauaggaguuaaggacauagcaaauuagugccauuguugaagugaauacaguaaaaauaaauugucagauuuuuaaguaguauagugaauauuuugguguauuugacaaccuggauauaucgaagugcuucauaguacuaggcuuaaaaaaauaacucauuaaucagugcuuuauaggagauaaucagaaucaaaucaggcuacuuauuucuagcuacuuugcuuguaaaaaucauauauguuaauaauuccauguuaacuagauaguucucuuugcucuaucuuuaauuaugugacguuucauauucuaaagaugcagucucaagcugguggaaacaauacugguucaacuccacuaagaaaagcccaaucuucagcucccaaaguuaggaaaagugucaguagucgaauccaugaagccgugaaagccaucgugcugugucacaacgugacccccguguaugagucucgggccggcguuacugaggagacugaguucgcagaggcugaccaagacuucagugaugagaaucgcaccuaccaggcuuccagcccggaugaggucagucaaagcacaaaaccgugggagcuuguccguuccauuuggacuccagagucaugaggauucauucuuucugggauggggaauauagaggagcaguuuaucguagcuuuaauguauguuuuagcuguauguggaaaacugcccaaccuauuccagcauguagccucugacguagccugggccuugcacaugcaaaugugcggccgccacaucucggcacaucccagaacacccagggcuggucacagggaacagcaugagaaauaccagcgagguuuacugauuccguaaaguaauuugugucaaagcugcauuuuauaaaacuguugaaguuugggacuguccuuauggcuauggauuccguguccaaauugaaucaucugguuuccauauuaaauuuccacauauuuugccagauuuucaauacagggcauuuauuucaaaagaaaauuggaauguaaauaauuuccaaaaccuacagaaaugguaagaucuuaaacaugguaaauuaguuauuucuaacuuuacaucacucuuugauuuuuagaucgggaaaauucauuauuaaauuuguuuaauuaaugucuuaguauauuuuauauacaguuuuguguacacuuugucccuuuaagguccuugagguaguucuguaaaguaaucaagccaaccacagaagcacuauaaaccaacuagugucuuccgauacuuuguaaaacugugucauauacauaaauaauuggugggggcagggcguaccuucagugaaaacaaaaagaaaaaaaucagaucuaauguuuuaaagagaggagucuggugguucugguugacgaguuuauuacaaaagagcgccaucaucccccuccauaauggaauagaaucucagccaagagacaagacgcaacuucacacccaccaggauaacaggaaucaaaaagacagaccauagcaaggacugagagguugcagaggaacuggaaccugcaugcacugugggugggauuggaacagggugcagccacucuagagaacagucuaagcguuccugaaaaaauugaacauggaauuaccauaugccccgcccgagagacaugagaacaaagacccguauguuaauguucacagcaguguuagagccgggaaguggaggcaguccaaaugucuaucagcuaucaaacaagaaauaaaauguagucuguucgcacacauggagcaucauacagucacaaauggcaggaaggagccacgucuaugauggcaucgaggcaccuuugaaaccuuuugcucaguggaagaaggcaggugcagaaggcaaccugcaugccugugugauuccauugccaugacauuuccagagcagacagacccauggagacagagagcagagcagcagguaccagggucugaggagugauccccaguagguagaaggucaggggugguggagugauccccagcagguagaaggucaggggugguggagugauccccagcagguagaaggucaggggcugaggagugauccccagcagguagaaggucaggggcugaggagugauccccagcagguagaaggucagaggcugaggagugauccccagcagguagaaggucaggggcugaggagugauccccagcagguagaaggucaggggcugaggagugauccccagcagguagaaggucagggguggaggagugauccccagcagguagaaggucaggggcugaggagugauccccagcagguagaaggucagggguggaggagugauccccagcagguagaaggucaggggcugaggagugauccccagcagguagaaggucaggggugguggagugauccccagcagguagaaggucaggggugguggagugauccccagcagguagaaggucaggggcugaggagugauccccagcagguagaaggucaggggcugaggagugauccccagcagguagaaggucagaggcugaggagugauccccagcagguagaaggucaggggcggaggagugauccccagcagguagaaggucaggggcugaggagugauccccagcagguagaaggucaggggcugaggacugauccccagcagguagaaggucaggggcugaggagugauccccagcagguagaaggucaggggcggaggagugauccccagcagguagaaggucagggguggaggagugauccccagcagguagaaggucagggguugaggagugauccccagcagguagaaggucagggguggaggagugaucuccagcagguagaaggucaggggugguggagugauccccagcagguagaaggucaggggcugaggagugauccccagcagguagaaggucaggggcugaggagugauccccagcagguagaaggucaggggcugaggacugauccccagcagguagaaggucaggggcggaggagugauccccagcagguagaagguuucucuuaggggaugaaaauguuuugaaauagauuaucguguugguuacgcaacucugugaauaugcugaaauuaauucaauuguacauuguaaaugggugaauagugucuccauaaagcuauuuaaacaaaagaagaugcaaagugaguguagguuccaugacuauugaaugaguagaaaauuaagauucuucacaaagacaaagcaaauucauagguuaaaaaacuaaaaucuuagaaaguguuaggaauacugauucaauuucugaaaguauggguaugaaagcugcucaauucuaauuccacagacaguggaaauaugagccuaaaaccccacuguugcugaucagcaugugggccagacagacagggaggcauguggagaagaggcaggaagaaggguggagaggcaugagagagccucuuucccuggugauaauacaucuugcagcagagacucaaguccuugcuguggaagggugagaauagggacagaccguagccgccaugaggaggcggagcuggcgugugugcgccucaucaugcacaguacggggcuugcagcacugggaagggcaucaccguuuugcugauuaaaauuaagaagucagaauauacaacuaugcguucagaauguuuggaaaauugccuuaugaguaauaacuagaacagauuuguagcccaaagaagacagaacagaauaaauaaauguguguugauaauugaggaggagcuaugcuggcugcagagcugaccaaggguggcaagcaacuuuuacuuuaaaauugccugaaagcaggagucucuugucuaggcuucuagaagcagaagaauucuaccacuuuauggcucaggaacaaccaguaaugucauucaucuuuuuuuccuugagaguuggcugugaccguguccugacaaggcacaaacuuccaggaucaugggacuagaucucguguccugaaggcacuucucaugucugugugcagaugugggaaccacuuuccuggggaaggaaagauauacacagaagcaagugguuuuuaaacuugucuguacaucaggcagacuuccagggguuuuuuuuuguuuccuuuuuaaaaauacuuaucuuuuuauauaugcacgcuagcacccccauuacagaaaugcugggcuggggccaggcauggugggucaugccugucaucccagcacuuugggaggcuaagcugagcggaucaccugaggucaggaguuugaggccagccuggccaacauggcgaaaccccgucucuaccaaaaauauaaaaaauuagccaggugugguggcaggcuccuguaaucccagcuacuuggaagacugagacaggagaauugcuugaacccaggaggcggagguugcagugagccaggaucacgccacugcacuccagccugggcgacagagcaagacucagucucaaaaaaaagaaaagaaaugcugggcuggggcuggacauuucuccauuuugaaaaucuaaaagguuacaccccacaauugagaaccacuguauuuuauauaucuuuccuuuugacuuacuuuuaggacuugaggcgaaugcugaaguuugauaaacgggugaaugugaggaugugaggcccuccuccaccaauauuuuaaguuuucuguacacuuuucgugguggugacucucagugggcucagcugagguuguccaggggacagauauaaacauccccugauacggugaccucaggaacaagaaagccuaaaugugccagcagauucaugguauucgacaaaguauaagccacggcuagacuucaaggaaaacaagcuugcuuauuuaaaacuuuaguuacauaggcauuuuucuuuuuguuguuuagucaagauacuaacuuacucuaaccaaaauauacuaauuuagcaauuaugacacgucauuagccauguaagaaccuaaaggauggugaaaaaguagccaaaacgaugaaagugguuuuuuuaaacaugggaaguugagaacauggaucacucaucuccccucagacucugcggaucacagguuggcuuuccgucuuucucuacaguccgucgccuuccuaucuccagauaaguaucagggaugccaccgugaugggacagcccugcaucgcagccaguacacguuccucucugucaccaucaccggagcuucuguguuucauugagccuuucgugagaaucucuguccccgguguggcugggcgcacuugcacgcagccaugcagccuucccucguggcaggcuuuugcugucaaacccguaaugccuucuguucccgagaccucucugaguaacuccgugugccugccgccuucccuccagucauucccaugcacagcguugagaccggucugcucacgcgccuucgccgaggugccuucacaaaggugccuucgcggaggugcuggucuuggcuucccugcuuggguucaaccagugccccauccaaaugcucuuccggccacaucaguaauucaugaugguggguacauguggauuggguggugccuucuauggacuggcauaaacggaucauuuacuuuuuccuaaaugcaguuauauuacugugugaaauuucuguagucacuccguuacuuuuauaauuauucagagcauuuuguucagcaaggcugcgccaagcuuguauggagcugcauccuggcacucgcucguuugcuucuucugugcucuucccuagccugacaucccuuggcugcccucaccccagaccagggguccccagcugcccauuggcacgcgggacucccaugugucuucugggugggcaucccucuccguguuuucgcagguucugaguagcaggcuuuaucuuccuuacgccacaucugccuucuuuucaggggcucacaagcgucgccugcugagcgaaccuuggcugugugggaagauggugcggggagcuacuggucaagugggaggaggggaguaaaacacaucuguaggaauauugguccuuaaaacuauauuaguggaaguuuaaguaggagcuaguuuccuauaguuuagcaaggccaugucccaaaguuuagaugguauuugccuuuuugguacaaugugaaauuacgauaaagaacuuaaguuccuucuugugaaucacauugucacuucccucuuuucagaaaguaauuggcaaagucucugaaaauugggaucaguugaaguauuagauuucagaaaagcuccagaauacaaugucgucaucguauagaguuuuucaacuuugaggaaauguggaaacccaagcuccacucuucccacucccugucagcgcgcuguuggcuacaccuuucugucagugggcacgauuguuaagcuuccuuuagccaucagcccuguuacaguucauagauuguguugacugauagauacguaaaaaucucuguagcuaaacucagaaccacguuuggaauugggguguguguaugugucucagauccauuuauuuaguaaaagagaaucugagcgaagaggcguaguuccacaaucauaagcaaauaugggcauuuagacugacaagacgaugaguugagacuuguaagauuuaucaguugcugucuucuuagcauucuagugugggcugugagacaaacacaggucaugagcaaccgcucuguaagaggaagcaagcccccauauuccuaucaagaaggggucgaacacauuguuuuuucuguuauggcauucuggaaauucucaaaaaugucaugugauuauguauugaaaaagaaggauuuuccugccauaaauaugagaaaccuagacuagagauuuuucccaaagaaaacuguauuugaaguuuuaaaaauacuguauuacauauuuaccauauuaccuuauuccacauuuuuuauucaaaguaucugggauuuuuuauuuuuaaguuuuaauauaagucauaacacuuuuugaaucuuaaauugggaauucacaauagagauuucauugacuccaagauuauuaaaaauuuagagaaacuauagacauugcuaaccuuacaguuaaauuuuuuuacuugucuaaaaugucuuucuacuugggaaauuggacaaugauaaaaaauagcagaacauuaaauaaccuuuuaaaaaucccuaaaacguauuuuaaaucugaaaaugaaaacaauagacuucaucauaauuuuuaaagagcucuauugaugcaauguuugcaagucccuaaagccucaggaaaaucaucuaaaugguucauuauuuagcuuauugaacuuugcugcaguuagguugacggaugauaguaguguuucccgaucaccaaaguaccguuuuaaaagcauuuuuuaucgaauaaagugcuuagaauauugcacccuggagcuuuauuuagggaaaugguucaauugauguuuucuauuuaaccucagcucugaccuaucacaacaucuaugguuaauaagcaacauuaucauuugagagacuuaacuaguuucauccacugugcacccauaccauccucuuaaaacccuguuuguggcgcugugucaucucggucuuuaggaaggaugcaguuuaguaaguagagugcccuaguuuuagucgcugauacacaguugcuguucuucaggaaauaagcagucuuugauuuucauuuuuccugaaggagaaacaaucuuucuccuuaccuacacaugugcauagaugaaucuguauuauacaaauaauugaauucugaggaauuaauuuuaaauccuuaaagguccugugaggcauaagcaauuaaacacuugaagugugaugugucuugugugguauguguggugauacgauacuugaagguagaugugauggugauugucaaaguguaaauaacugauuucguauucauaauguggaaccuacuuaugccccggucauuguuucuuaugauaagugaucaauauuucauuuucucuaagagaguagaaaguucugcuugccuaucacuugcucuccgcaggcucagcauagcaggcucuagcugagcaaacguuaaaugcucucuggaaguucccucacagaauuaaaauucagcccuguuuaacuguuagggcauauguccagugcagucgcaggacaccagcaccgaacuaguggcaugagcccucggagaaggacagaagcucggugggcagagccucugagugcagagggugucagcucaagcgcugaaggcgugggguggaaggaacuuugaagaccgccggcuucuuuugguccagaaagagugacugugauucuuaaugacugcuuauuccucuagacuagcuguuuaguagucucauucuuuucccucuguggcuguguuuucucauguugguaaguuccguauuuaaauaguauuucagaauguagcugucaucgccugacuccaguauuuauuugcaagaaucagcuauaauuaaugacagagcacaaguggguuauuaauaguauugcuuuuggguuuacagaaguaggcacuaaugcaugaggcgugcuguauuuuuuaauucauuuuaucgugugugccuauugaagcaagacuaauugugggguuuugucagauauauuugugaggagcaaaucauugucagugacauaaagccuucacacugugaccuucaggaccaauagagaauaaauacuacguagccuaucugugaauauugauuagcagcuuuuucagaugaucaaauugcaucuuauguuaauaauuccauuaaaauauagagaugauuauaauaaccacaaucaaaaaugaugaaaucucagugauuaaauuaugauguacaaagugcaugguaagaaaauguauauuuuuacaguguagcggguagcugccugugugaauugcuaauaugauaaaggaaauuucuuccuagcuuuuaagaacaguagcacagaaauuucugaauaauggaauuauagagaauuauuaaugguaagaauugccccguauuuuguauucucucauaugauauuacuucuggcugugcuacucuugggucuguuucucagagugguuauuuagcauggagaagugcaaguguguaaacaaaucgccuguggcagagauuacuuaacuguguugcuaagcagccugugcaugagauucagcucagguucccacuuacauauauuuuuuugcauucacaucuuaguuauuuuuugccuuugaauugucaagaaucacauuauuagagauuuuugacagcucaguaucagagaacuagucauuugaaguguacuaagccuuuaaauucuggucuuucugcauuucagagaaaaauaucuuagggauuacuuccuaucauaaugucaggcagcaguuaauuccauauuaauauagaagcacacgaggaguacuugauaaacuacucugccaguuuuuuauugaauacggacacaaucgcuuugaaagagaaaaucaagugaugacaucggaaacaggauuauuagagagcuccugacugaguaaagaaaaaucuaaaugacaaauggccggucgugcagguggagauugcguucugugguugccugcgccaucccugagagcauccagagaaaacagggaaaaauguccacugcaaccuuccacccgccgccugaaugugagggcugcagccacgugucaccugcugcuguggagacagaaucugagccgcacaccugagaauuuccauccaccccucagcagccuucuucccaugucuguccuguuggcagcuaacauguuuaguauacaguccaaccaaagacugcaaauaauaaccucaaagaagcuguggcaaagagggcagagaucaaaguggucucugugggaaaguagcucuugcagggauccaccucccaaauguggucagcaguagcagugaccucaggacagcagccccaccgcagcgcagccaacacgucagagagcaccugguacccucaccagaugccaugugcaucaagagaaagaaaugaacauauguuaacuuggcaucaaacuaaaaacucaguaagaagaagaacaaaaccaaaggaaagugggaggaagaaaaaguaaaggaaaacauacaaguaaugauugaguaagcaguaauucaaaagcugauucuuugaaagguuaaaugaaaucggaagauuauuggcaaaacauaguaaauacaaaacagcgaauguaaacuaaguucacacauaugaaacuauccauauguaagaguguauaauaaacaaguaggcuuaaauguuuauaagagaauaugaaauacagcucaaaugcuuauguuuucaaagacaguaaaauaaguguuuucuggagaaauauaaauuucaaaauugacuccauauaaaucugaguagacgagaaaagaaauuuagaaaaaucacccaaaauggcuuuugaccaguuuuauaggucaguuguuuugaggcacaaauaaaucauauacuguaagaacuuuucuugagcaagaaaaaguuuggcaaugaugucuaaggacacaaaaaaagcagaaguucugaaaaaaaugauaaauugaauaucagaguaaaacuuauuuuuuucaaaagacauuuauuaagaaaauaaagacaaauuaggauuucaacauaaauuugaaaaaagaaaauaaagauaagccagagacuuguaggaaauguuugcagaauacuuaccugauaagugacuaguaugcugaauauauaaagaauucucaaaacucaguaaugaggaaacaucaccugaauuuaaacauuggcaaaagauuugaacagcuacaucaccaaaagagauaugaauauugacuguaaaauaccauaaaaguagugauuuguggggucuaauacagaaaaaauauuaagauacaugaugauaauagccaaaagucaagaggcgauugaugucaaugggaguaaauuacucuaagguccuuagaguacagguaaaggugcugauuuacuuagacuuugguaaguucaggauuaugcuggcagcagugggaugacugccaaagagcaguaaaagagcauguaccucuccggggugguggaaacauggccauugcaugguagaaugcacacagggcuccuugcagaaauggcugauucuagaaccaaggcaggaaauacccagacugagccuggagcaucugguacugccaggaaguaaggaauugcucaaagccagcaaacaaacagaaaaagcugccugcauggcaggggaugugucggagggacacagaagccaacuggaaaagcucccuguggugaaugcuggaacagcaugagcagcaaagucaguuguacuggauuauagcccauaguaugaaacaaauaaugcaugaguccaaacugauaugaauaaauaaaugaaugggagagaaagacagaucgcccaugcagaaggauuccugugcaaaaggaucauguauguagcuacugaacccgcagguuggggagcauaauuccucuuccuuuaggugugggcuacacacgaugacuucgucccaaagagcauggugugaaaaggggaaaggaagaguagcuugacgaccucagucaggugaguagggucagcaucagcagugaaaagucguguugcuagaugcagcccccacaggauguggucaacagcaccucaccuucauggucuuccuccccagccccacagccccagucuacucgugagaaaaucaucagacaaauaaaacugagcgauacuuaacaaaauacccgaccaguacuucucaaaacuguggaggucaucaaaaacuaggcagguccaagaaacuguagcagccaagagaagacaugaaaacuaaaugugacaucccggaugggaccugggacaagacaaggacuugagguaggaaugaaggaugucugaaucaaguauggauuuaagcuuuuaaaaauggaaccugcugcuugcucagauuuuauugacaacuugaagaaacacuguguauaugcaccuuucagaaaauuaccaaauaaaaguucagauauguuuuaagugcuuugucuuuuuuugugguuauuuuacaacagugguuuagccaguuucuucuuugugguaucuggccuuuaguauuuaucuuguaauuguauggaagacacagggucacugcaggauagcaugacuucaggucccacuguagaucacccaguaauauuuccucugcagaacgaggugaccacucugggugguguggucuuccuuuaacucguguccuugugaaauuagaaaaauguuaaaaauguuagggaagaaaaguguguuucugggcacagggucaucaugaccagcugugugguauucuggugagugccagcaucucggccacccauuucauucacaccugguugugccuucacuggagggucuuggauguucugggaccugcaguggaaggaagcaagaaagggcuucucggcuucacuuucaggcaaguuggagacccaugucagacacuaaaaauaaaaguugaggaacaaacauuuuagcacuguuaaauauugucucuuguuaaagacacguaagcugccuuccagaagugcuucaauaagaaaauaaaaugcccuuguauauguaguguuugaaaugugagugaauagagagggaacaguucccuaggggucccugccucuccuggcuaaugugagugaauagaggaggggcccccuccucuccuggcuaacgugagugaauagggagggaacacugaacaguuccauaggggcccccgccucuccuggcuaacgugagugaauagagggaacacugaacaguuccuuccguaggggucccugcuucucuggcuugcguuguccuccucauuguuuccuucccuacgucuccacuuaacaugacaaguccuguggcuggaaucacuguccucagugucucucccacguugauagcacaaaaagauuuaaggaaaccggccugaagaauaucuguaccguauauccauuucauuuauugccagaauuuaguuucuaguuccucgggauuaaacugauuguagaggugaugcauguaugugauucuccauguaaauaaaucuaaaauaaaguccugaagcaaauauugccaugacuucugcaucuacagagcuuggcuuacaggaguacucuuugauuuaauuaauuuauuauuaaccuauuuacuucuuucaggugauuugcauuuuauaugcaaauaaaugguugagaggcacacuaguaacuucagggagagagcgacucucuuuaaacucagagcccagauugcucugcagcagcccugugcucaccaggcuguccaggcccuggagaguccugacacggagugccgagaacgugcccauuuaugguuuugccugugucuucagaauuccacucagcuuuccacuuuuaaaucauuuuaaauaggagaucuuuuagcuuucauuuauucaagaaauaagucguugugcuuguuccugagucuacaucggugagcacagugcaccuggaccuguguggggaacugagguucugggagggaaggagcccggaccugggaguguuggucccuagaacgcagcggaggcgcagugcgaguacguccucugccaggggaaggggaggggcacacagcacucugaucagguggucagcagggccuuuuggagaccugggguugagccgaaaguaagacugccugguggagagugauggggagggccuggcugcgcggccggcacuccacacacaccaggggcaugagaggcccagggccaggccagggggacagucagagaaugggucucuaacaaauguauuugucacugagcuagcugccgucagucuccauaacugugucuguuguuggaagauaaaccccagucuugcuuggacagcuugauucugaaguugggaguugaaaugacagguugucuuuacuggaucugcauauggaccaucugguuggcuggccaugcagaacucccaccccccuccagcccucguugcuuguagaacccuaucccacuuccucgggaugcuguggguuuuacacugggagggagcuuacauacuaggaaacuccgggaugcuguggguuuuacguugggagggagcuuacauacuaggaaaccuugggaugcuguggguuuuauacugggagggagcuuacacacuaggaaaccuccggaugcuguggguuuuaugcggggagggagcuuacauacuuuaggaaaguguguauauuuuaaucucucaaacaucuuuaggaagauaauagacucaaacuuaucaauccuuuacaauuuucuuuuaauuucuacaucuacugucccuagauguaaguuauuucuaagagccuucuaaaaagaacaccaugacuauauuucagauauaccaagagaauucgcuaggcugcuuucaccuagucaaauccccacacuuacgugcugcagagcugcagagcaugaauuaagauaugaaagcucaaaaccaaaaccggagaaucugccguguccgugggaaccagccguuccuuugauguaucuucaauaaggaggaccaggucugcgugaaguauugaguacuuagguaugaauucaggagcaaagaugcuaaaaguacugcauguccucacugaaauuauuuuucuuguaguuauuucaucuagcaauuuuuuuuuuuuuuuugaggcagagucucgcucuauugcccaggcuggagugcgguggcacgaucucagcucacugcaaccucugccucccggguucaagcgauucuccugccucagccccccaaauagcugggauuacaggcaugugcccaccacuccuggcuauguuuaauuuuauauuaucgaaauucuguccaacaacaggcaaguuacaugagaacaguaauuaaagcaucuaucaugaaaaauuuggauauucuuuuuuucugguuggcauuauauagaguuaaucuucaagaugauuacaaauuaaaaacaauuggauggaaugcugggcuagguauaagaagcuaaacugauuuuuguuauaagcugcucuuugcucaaauggauugugaaaccaagcauaaacuaaauaauaaacagaugugagucaccaaauauagaaagcucaguccugacugcaguggggcaccagugagaugacaggguguucacggaaagaugcaauuuacaggucaaaauguaaucguaaccuuucacuguguaaauuggaaauuagccucaggagcguuggcauaauuuacagcuuguggagaagaaguuuuauuggaggaagcaaugguagagcuacacccucacuucccacuggagauggugaugcacaggugccaccucccuccccuucgaugggugguaguccuggcugacccccacgugccuuuuuugguaauguggaguguaucgcugaugcccugaauuacaggacugcgucaucccuagcacaauuuuagacucucgguguacuuaguaacaugcaggaaagucggagagggagaguucuaauucaagccccgugggugacacccuacugaacguuuaacacaggcauggaauuccagaguuguagcguccauagaacggcagugccguccaaccucuaacccaacgucagaauugagacagcgaguguugacaucugccaccauugcugcacggcacaccaucccaaauguggggcacagaaccauuccgacauucuccuggccgcacccucggggcacggucaggcagcuuccaucaguaggagaggguucugacccggauuccaccccaggcaggggcaguggggccaaguggcuucagcccuggccacaucagcacuuccucagugaguauguccuuuacugauuucuaacaaagcaugaaaauuacaagcaaagaauuuccagacagcaguuucucacaguauuuggcacacauuaagcauuggauuugcuccuauuuguguaauuuauguucuuacuaagauucuuaagcaaaacagaccaaagucaaaauuugcuaauuucauuuauuuucagcaaaaggaagacacaucaaucauguuugagagugggaagcuucagguuuauaaaggucaaauucuaggugccucccagagcagaauguucucaacaugcagcaaaguuaaauaugguacuucagacagagucagaccguccugaaauaugguagagacucggggccuuugauuuagucuugcuuuauguuuuaugucuuuuuuaaguuuuuaaauuuuaaauuauucuggguacguaauaguacauacuuaugggguacaugugauauuugauacaagcauacaauaugcagugaucaaaucgguaauugggauacccgucaccucaagcauuuaucguugcuucgcguuaguaauccuccguuuaucguugcuucgcguuaguaauccuccguuuaucguugcuucgcguuaguaauccuccguuuaucguugcuucgcguuaguaauccuccguuuaucguugcuucgcguuaguaauccuccguuuaucguugcuucguguuaguaauccucuguuuaucguugcuucgcguuaguaauauugcaguuccauucuuaguuauuguaaaauauacauaaauuauugucagugaaggucacccuaucaugcuacugagcgcuggaucuuauuccuucuauccgacuguauuuuuguacccauucaccagcccccuuuaucaccccuauccccaauauccucaauguccccgauauccuucccggacucugguaaccaucauucuacucucugucuccaggaguucaaccuuuuuuucuuagcucccacauaagaaugagaagacccaguguuugucuuucugugcccggcugauuucacuuagcauaaugugccccuguuccauucacauuguuguagaugaaagggucucauucuuuagugauggcugaauaauacuccauuguguguacaccacguuuucuucauccgugcauccagugggggacacaggcugauuccauaacguggccacugugaacagugccgcaguacacguaggggugccgagaucucuucaguguacugauuuccuuucuuugggggauauucccaggcgugggauuguggauuauaugguggcucuguguuuagauuggggguaaccuccaugcugcucuccagagggcugcacgaauuuacauucccgacaacagugcucccuucucccaccuccucccucgccagcauuugaauugcugucuuuuggauagaagccguuuuaacuggggugaggugauaccucauuguaauuuuuauuugcaugucugaugauuaaaggauauugagcaugcuuuccuauaccuguuggccguuugugugucuucuuuugagaaaugucuguucagaucuuuugcccauauuuuaaucgaauuacucauuuuuuuccgauuaagucguuugagaauauacaaugaucugguagauucugcuuauuaaucucuucucaguggguaguuugcaaauauuuucucucauucuguggguuuucucuucacuuuguugauuguuuucuuugcugugcaguggcuuuuuagcccaaugugauccuguuuguccauuuuugcuuugguugccugugcuuuugaggucuuauucaagaagucuuugcccagaccaaagugcccuggagugugccagccuauuaggcacauuuucaaauuugauuagugguuuuagauaccaagcagauauuacccauauaagggugucuuuuaauuuuucaguccacccacagauacagaugucaagcagaaaaggguugaggucugucugacucacucuugggguguaguucuucagccagcgcugugggcugagaccagacccugccccacaucccacuaccuggaggaccaacaggugcugaccagguacccaacaaauugcacuggcccuuacaugcaggguugauuaauaagaguaaaggcucuuuucccuuaaauauggaaacgaguugucucacuucagaauguugcuuauagaaaaauaguaauucuauaccauuaagucuucuuaauugcuggucuaauauguaacauuuugcugucccugaauuuauaaauaguuaacuauauggucuuauuuguuuaaaugaaauuuguauuucuagaugauaaauucgggcugaggagaaauuccaacauuguacauagucauuccuccuucagaaagcagguuuugaaguguguucagcagcuggggcuguggaguaaaccaguggggcuggagagccauguggggaagaugaaggccguggccgaagacagacccggucccugcuggaaaagggagcccacaaccccugagccccucucccagguucuggggaggagggaccccagaugccggaggacacaggucguuugugugacgcauucuuuccuccccagucuagagcaggacuagcugguacucucccuggaaauagaaaauggugccucagaucacuucugcccucugggaugcagaugaagaacuugaguugagaaaaggugucugacucucccaucucuuaugccuuuucuguagaagugcacgucggauuuuguaacugaaaugacugcaaauguaggauaguaguuacaguuucucucucaauacugcuuuuccagaaucauucuauuccauauaucauaagcucacuuuacuuuguaaacuucuuaaaauaugagaaauuuguaaaagguaaaugcugauagauugaguacgcaccauuugaaacuguauaaauauguguguguguuuauuauccuaaaacaguuggccuguuugucuauuuaauuccuuaacuagagccuaaaaaauguuugggaagucaccugaggucacaugacagggaaggagcgggggcuuuugcacugcaggccucucaaaagcaugccuguggggcgaggucaguggcaguggcaccugggcagcccugaaaaggagggacaggugccugucaccuccacgcagcaccggugacaccaucgcgaucccuggcuuugcucccggcacuccccacuugcacgcagcaucuccagagccagaagagacauggcguuaggcuguuuuccauuaucucugcacacuccauuccuucacaugguguuagggugucaucucuguacccuccguccccucacaugguguuagggugucaucucuguacccucccuccccucacaugguguuagggugucaucucuguacccucccuccccucacaugguguuagggugucaucucuguacccucccucccgucauauaguguuagggugucaccucuguacccucccuccccucacaugguguuagggugucaccucuguacccucccuccccucacaugguguuagggugucaccucuguacccucccuccccucacaugguguuagggugucaucucuguacccucccuccccucacaugguguuagggugucaucucuguacccucccuccccucacaugguguuagggugucaucucuguacccucccuccccucacaugguguuagggugucaucucuguacccucccuccccucacaugguguuagggugucaucucuguacccuuccuccccucacaugguguuagggugucaucucuguacccucccuccccucacaugguguuagggugucaucucuguacccucccuccccucacaugguguuagggugucaucccugcacacuccuuccccucacaugguguuagggugucaucucuauacccucccuccccucacaugguguuagugugucaucucugcacacucucucccugcacaugguguuaagugucaucucuguacccucccucccugagcucacaugguguucgguuucaucucugcacacuccguccccacacagugcccugcugugucaaguucaaagcaugaaaaagaaaggaagcagcucuucacacccagacacuggaaaaucaugcuagagguauucuguggucagacguguggggaauugcuuagaaaaucugauuuuaaagguaguuccuggucugcccacgagugcaugucuggagggcuccugugagaaagcugaggguagagcccuggcauccuccugguggccucccugugcugacuguccacugugcugacuguccacugugugcccucacaccucauuucucgaauccuugcugcagcucugaguggugccucggcacggccauucuguagacaaggacccugggguugcagaggugcagccauuugcccaggguucgguccuaaccugagcagcuggccacagagccagagcucuugagaacuuugcuacagucucucuaagagugugaacucauccucacaggaauguucagaaggcccuaagauugauuuaauauccugugcacuagacaacauuuaaaauguuccugaagugacuugaguucuuagaaccuaagauuuuaaaacuguuuggcugagagugagguggagguuaaaacugaaggcaaggacgugcucaucggaagaggugggugagaaugagguugugguuuaagaagaggacucacccaggcugugaggggcuucagcacuguggguggcggcaggccugcagaacagagaggagacccugagggaagcagcuguguuacugggcugugcugcaguggugugggacguugcagagagcgugcucuccaugguuagugugcuccccaugguuagcguguucuccgugguuagcgugcucuccgugguuagugugcucucuccaugguuagcgugcucuccgugguuagcgugcucuccgugguuagcgugcucuccgugguuagcgugcucuccgugguuaacgugcccuccgugguuagcgugcccucccugguuagugugcccucccugguuagcaugcucuccguguuuagcgugcucuccgugguuagcgugcucuccgugguuagugugcucucuccaugguuagcgugcucgccgugguuagcgugcucuccgugguuagcgugcucucugugguuaacgugcucuccgugguuagcgugcucuccgugguuagcguguucuccgugguuaguguguucuccgugguuagcgugcucuccaugguuagcgugcucuccauggauagugugcucuccgugguuagcgugcucuccguggguagcgugcucucucugguuagcgugcucuccgugguuagcgugcucuccgugguuagcgugcucucucugguuagcgugcucuccgugguuagcgugcucuccgugguuagcgugcucuccgugguuagcgugcucucucugguuagcgugcucuccgugguuagcgugcucucugugguuagcgugcucucugugguuagcgugcucuccguggauagcgugcucucugugguuagcgugcucuccgugguuagugugcucucugugguuaguguguucuccgugguuagcauguuccccaugguuagugugccuuuagcugcauaauaggauuggcauacccuauuuaucugauuaaugucugguagggagguugcuuuuaaagacagacuuuuaucagaaaauaauacuuuuugucauaaaauacuauucacaaauuauuaacuguaaaaauugcucuuccacuugugauuguuaaauuuuaauaagucaauaaauaauuaucaauaagaauacauucuauuucugaguaccugccauaugccagagaaucacucauguuauuuuggccucaaagcaauuuggaaggccauuuuuccacaugacagaagaggagcguggccccagcagagugaagaccuggccacaggaguuccgacuuucacacuugggcuuagaacccaggccugcuuucuccuugucuaucuugucuccuuuaaguuugcaaauauuacauguagacacauuaauagaguuaauuagucaccaauuugucucuuauuuuagaaaaauaauuaccauaaacaugagauucaaacuauuuccccuuucaugguguccauggaacuggggagggagaaaccuugaaaagucguauaacuugcucccuguccccagacugauggggugagcugcguucucaauuuuaaaaccaucuggcucuagggagcaauuaacacaaauuguaaagaaagucuuuaugauccauaauggucuuuauuuuaaagaauaauaccaagugacuuuugugauauugcuuaggauuccucuagaacaauguuauucaaacguauauacuuagccgugaaaacaaaaaguucugaacaccuaaguucuucugcagcugucucauguuggcaagcuuucugagcacugccgugcuggcucgccugcgugcggcuuuccugaggcagcgguggccucaguuguugcuggucucccguaggucgcucuggugcaguggacagagagugugggccucacgcuggucagcagggaccucaccuccaugcagcugaagacccccaguggccagguccucagcuucugcauucugcagcuguuucccuucaccuccgagagcaagcggaugggcgucaucgucagggugaggcugcggggagggugccacgcgauggcuucagacauuuuguuuucacaccuuuuaaacacagauuuucccaaaagaaaguuaaacauuuacucaggugcuuuaugcuguuacaguuuuguuuguuuuuuuuuuuuaaugaaaucuaagcuaauaaucuauaucugggaaccuacugugucucuagugagauaaaauaauucuccuaagucaaccuagccagaaucaauaaugugggauuuauuaauuuuugaaaucaacaacuaaagcuguuuugauuucaacaaaaauaacaugccaaagaguuugacuuuuguacauugauuuaugaccauaaaguugccaaaacguaccuuaauuuuuuuagcaaacaccaaaaucauaucuuggaaguugacuaaacaaugaagcauuaaauccaacuguaaaaguuuaagagaaugaaugcaacucaaaucauauucauuaacacacucagaccuucagccuagcaucucaggaugcacaauuauguucucaguccugauugcacuauugcugaagagugggccuagcccuccgcguagaaacacgugugaggagcuuaacacacaggaacacauucauaggaauugcuuuuuccauuguauguuuuauuagacuagcaguuauuugccccgagcaaugcagccuaaaugugccucuguuuauuuuuguucuuugauaggaugaauccacggcagaaaucacauucuacaugaagggcgcugacguggccaugucuccuaucgugcaguauaaugacuggcuggaagaggagguaugugagugacucuagcgugguucacaguguuucuauggaagaggagguaugugagugacucucagccugguucacaguguuucuaugaacuuuauugauagaugacaggaaaaggauauccuuuccccagcuugcagacacugguaucauuggaugaauugagcugucaaaaugucaaaccagaugcugaugggaaccacauagguugucaaacacaguaucauuuuauacuaaauuauuuuaagugcuugcaguucucaauuucauaaaggagaaaggguaggaguccuaucuauuuauaaauaguuuacccuuuuuuuuuuuuuugagacagacacacugucacccaggcuggagugcaguagcgcaaucuuggcucucugcaaccugcacuucccagguucaagcgauucuccugccucagccucccaaguagcugggacuacaggcacccgccaccaugccugacuaauuuuuuuguauuuuuaguagagacaggguuucaccauguuagccaggauggucucuaucuccugaccucgugauccgcccgugucggccucccaaagugcuggcauuauaugcaugagccaccaugcccagccaauaauuuacuuucuguguaaauaacaaucauuuuuguuuugugugugagugcgugucaaucuauacaaguagguccuuacaaagaauauuuuguuuauaauagaaauagaaggcauuaucaaucauucacuauucugaaauaauacuuuauauguaaucaaaguuauauuuuaauguaucucuuuuguaacauaaauauuugcaagauuuucuuuagaauuuuaaccuaaugcuaauuugugcauaagguucaccuaaaauuagaacauaagauacaaauaauaagcaaucccauauuucauuaaauucuccugaaguaaauaggauuuguagguagccucaugagaugauuuuaucguuaagcuuauguauaaaucaguaguuggauuuccaaguaaaauggagacuguuguaauuguaguaaacauggcccuuuuuccugugugcguguugcuguuggaauucagagucucuccucccacccugggaccucagagauggucuguccgugcagccuccacaccccaguguucgcaacgguaguggcaauaugaaucaauaucuccuucggggugguuugauuuaaucagggacgugaauaaauuaaacucccugaagaccuaguaaaaugccauaaaaauuacuuuuggucauaaugaugugcaauuaauuguaaaauacuucuuuaauuuauuuagcuuuaugaggccaaaucaauaaauguuuugcaacagacagaugaugucagaauguuuuucacaaagauaacuuuauuaaaaauucuauguacauuuauuuuuucaacauuauauuuucuuuccuuggauaaauuguugucccuucaccaaugucuuuguugugguacuacuauauuaugaaagccuuucauuuuauuaaaaacgaaaugaggcagcagauucuucgagcuggaguuaaaaguguauuauucugcuuccaucaggcuccuccagaacugaauucuuggcuugucaaauguuuaaaaaaaaaaaaacuuuucaaugaucacauaacagaaagaaccaguuuaugcaaaccugagauguaagaauauguaagucugugaacagacuuaaaauagugauguuccggauagcuggagguguugaggugauuggcuuccuucccucuaaacacaaaccugaguugggcccuggacauuguauuguaaaggaaacaaguacaggugacccuugaacaacacgagggccaggggcuccaaaccccacacagaugaaaaucagccuaucacuucugacuccccaacacguaacugcugauagccuccuguugaacgaagccauacuaauaacauggauaaaucgauuaacacauuguguauguuacaugaauuauauucugcauuguuacaagaaaguaacuuagagcaaagaaaguguuauuaagaaaaucaugggcuggguacgguggcuuacgccuguaaugccagcacuuugggaggccaaggcgggcagaucacgaggucaggagauugagacccuccuggcuaacacggugaaaccccaucucuacuaaaaauacaaaaaauuagccgggugugguggcgggcgccuguagucccagcuacuugggaggcugaggcaggagaauggcgugaacccgggaggcagagcuugcagugagccaagaucgcgacacugcacuccagccugggcgacagagcgagacuccgucucaaaaaauaaaaauaaaaaaauuauaaggaagagaaaauguuaucuacucaucaguaagugggagugggccaucgugaagaccuucugacuuucuuccucauggucuucauguugaggaggcugaggaggaggagggguuggucuugcucucucaggagggcagaggcagaacagguggaggagguggaagcggaggcaggaggggcaagcucacuccgcauaaacuuuacugaaaauaaucugcguaaaaguggacccacgcuguucaaacccauguuguuuaagggccaucuguaguuaaaauugggaacgacaggagguauaaugaaugacagccuugccuuuguaauucacaguaauugucacuucuuuugucuccuguaacacaugacccuauagaggucacuauuccaauuccuaaacaggagacgggaagagacacagcuguuggaugcauaaagaagggugcuagacccacgccucuccuccagcccuuccugccaucccugcagccuccaguccaacgucaaauacaaucaacuggaugaauuaaaaagaaauugcaaauaauaugaagaguucaauaauguuuauuugccuacagauuaaccuugaucagcagauacaguacacuggcuucauuagaguggggccucccacauggagggcugccugaugcccaggagagaugauggguggugacagggucucugcgcgugccuggggggccgugauguguuuccaaaugugcggcugugcccgggugguuucucagcacuuuuccugggcagugcugagaaaggucagaugcccaaagucccagcugucugggcugcaacugccaucucuggcuuucuguugcugucugaggagcuggccucuccacugcauguccaccccaagggcuggcggagccuuccuuagggacacugucauguucuucucccugccaugcagauucucaguguucagcacaacauugcacaaaccagguuuacuaguauuugaucuucuuuuccguaaacaaguguagcuaauuaacuuguuuaggauauccuugcuuaagugucugcauuaucaauguucacauuuuuaaaguuuuaaauauacauugaaaauaauguuuuugauuaguuguucucuagcuguaacguagagcuuuauucuccuuggagguuaccaaaauagccucuaaaagaccucuccccucacugugugucaugguggcagggcaggucuuggagguuaccaaaauagccucuaaaagaccucuccucucgccgugugucaugguggcagggcagguuagcagcugcaccaccucugcgggcucauugcggccguagcuaaguugggaguguccaccugagcuacagaaaguuccuggggcuucaggaagaugugauuaccacugauuucucuguauugucaaccccagugucagagacaggagcuuuguaaacaugguuaaaauuugaaagaguugcucaaauuugaaauuugagagggagucaacaacaucuggauggagagucuuaagcagcgaaucuuucgggaccuuccagagcacagagaagcccucucuacagggagggucacuguuaaagcaucuuaaaguauguuagcccuaauaaguugaaacugcuaggcugggcgcgguggcucacgccuguaaucccagcacuuugagaggcugaggugggcagaugaugaggucaggagagcaagaccauccuggccaacauggugaaaccccgucucuacuaaaaauacaaaaaaaauagacagggugguggcaggcgccuguaguccuagcugcuggggaggcugaggcaggagaauggcaugaacccgggaggcagagcuugcagugagccgagaucgugccacugcacuccagccugggugacagagcaagacucugucucaaaaagaaaaaaaaaaguuagaaacugcuagauucaaaaauugauaguuauacagcuuaguguucauuacuuugguuuuuuuaauguacuuuuuauagaacacaccacagcuuuaaagcuuaggcacaccucacccagcacuuaguaaucaauuguagggccucucuguaucccuggaagagagcccggcuguccugagccccguccugguccacacagcagaggggggugggguugucuccugacagccccgacacccccuggggcuguccgggagcccagcacccuccaccccugccucuugucugcaucccccagacguuggccccuugggcaggaccgugugugcucacagcuaaguccuacacacgccuggcccccaggagacccaccggcgcccucccucccacaucugcccagacgcccaccccccccuugugccggauaggagacccaccggugcccucccucccacaucugcccagucgcccacaccgccuuguuccagguaggagacccaccggugcccucccucccacaucugcccagucgcccacacugccuuguuccggguaggagagcgggguggguuuguuucuucaccugccuugcaggaacacgugcccucacgcgucuguuccuguggccgcaugaggccugucccucuggguguccuucacgucaccacaaccacgugagggaggaacuguuuucacuuugcacacaaggaaauggcacagaaagcgcagaguuccagaaguggcuucugccgcucugccagauucucuccgcuggcuauguggaaaugcaggauguagcuauuaacuaugagcaggcucguucaagccuuuuaaaaccugacccucguucauguaagcaauauggcagcgucaaccucguguggacaucagggucuacuuuuguaagugcaguuugaacuuccaggacugggaugugugucacugguaugagcaguuuaacuuugagaguguuaccuccacacagguuugcuccugcaccaccccucagccuugucccagagagccuguuucuucacccaucaccagcuaaaacuguugcacuuuuaccucuaaugggaaaguaguguuuuuuauuuugacaccuucccugacugaacacgguuagcaccguuucaugagcucauugcaggcauuuccaugucuugcuuuaacacgcacaucaggccccgugacuccugcagggcucccccaacucuggaaggcgaaugcagggugaggcuugugagcuuugggaucuggccguguccccaccaaccccagcucucaccgcggcccugcacuccugcccuccccuccaucacuaacugcgcuuacugcucaugauuggcugcccugcaaggccaguuacaugcacguuaaaaauagagcaagaagaacuuacgcagauucacggaguuagucccagagcaacacucuuaugagcccauuucuaugaaggaggaaacaaguacagaaaaaugaggucguuugcccaaaaacacaaagucuguggcagaaacagguuuccggcccagccaccugguucuaaauccaugguauuacaacacgccaggggggucccccucucccccaguguacaccaggagcccucccuggcaccaggcgcuccccucgcccguccccagcaccgccgugugcacccuccaugcccucccuggcaccaggugcuccccucgcccguccccagcaccgccgugugcacccaccaugcccucccuggcaccaggcgcuccccucgcccguccccagcaccgccgugugcacccucugugcccucccuggcaccaggcgcuccccucgccuguccccagcaccgccaugugcacccuccguguguucuugcuacaugcaggcugccguccacacucuggaguggugguguuuaaggauucaggguaugauuuuuugaaaagcccgugcugugguaaaaagaagcucugcuaggcaccaggagaguccagguggagugugccccaacuccauccagugucuuugccucucgagugaaggggucaguaggauuugagauaccagacaggucgggagguuaaaaggaugcauuguauguaaaggugucccucugcugaguugucucuggccuuggugaugaaggugggcacaggacaugagggcagggcaccagcaaucagaguguggcacugcccuggccccacacacggccacaggggcucugcagggcccaccugugacucggccucuccuuuuccagugcggaaacauggcucgcgaaggacugcggacccucgugguugcaaagaaggcguugacagaggagcaguaccaggacuuugaggugagccgacucccagccaucccauccuccuacgacguuuccuuccuuacgcugaaauuaguucuuccugucuuuguaugaaauuagagcugggaucgcuauagucuaggagugaaggcagcuucgcucagcaggagcauggggugauccugucugcauuucuguuuccaccauuucuccagcuugcuggggaaggaggguuacagaagcaaagaagugccaguuuccuuagaauugugcuugauaacuccucaaugaucacaguccagccgagcugaguacacauagaguaugugcacauaggcgccucccccucuguccccagagcccaugcuguccagcucuguggaguacacacacggagcacguacacgugugcacacaggcgccucccacucuguccccacagcccaugcaguccagcucuguggaguacacacacagcacguacacgugugcacauagucaccucccccucuguccccacagcccaugcaguccagcucuguggaguccacacacagcacguacacgugugcacacaggcgccucccccucuguccccagagccgauacacucaagccaagcugagcaugcacgacaggucccucaagguggccgcgguagucgagagccuggagagggagauggaacugcugugccucaccggcguggaggaccagcugcaggcagacgugcggcccacgcuggagaugcugcgcaacgccgggaucaagguacugcaggcucaccucugcuggcgcgcgcugcuuuugcugaagcaaacagugcuuuuccuugggcauggugauuugugaaacuccuguggggucauggaugugagagagcucuguaagcagagcugcccaccagcuccccuccuuccuuagggacaucugcagcuggugcacacacaaauccccacgccaccccuacuccagaccuuccucucuacaccucuucccucucuggauaccccagccuuucuaaagaggaguccuggucccagcccuggcgaugucaaacugccacaugccauuucccagggaugguuaugcaccccccacaggacgcauggagccagugcccgucacccuggccaccgccggccagaugucugcagccauuccuggguuggccggcacucgugcccuugcccccagccugucacaacccugcaccuggcaaggcugggccacuguguucucuguguaaccuggccuccuccugcaggggucucugugccuccccugugagcacaggguacguccauugugacggcacguguuccaugaggacgggagugcaugagaacccagaccucaugggcuucggcuucauucucgguuaaauugugccacauuuggaaucaucucaugcuucagggcauguuagaguugagaauauagaauacucagacgugcacuacaucuguucauuuuauugauguuuuugaagaaauaaugcauccacauugucacaaacucagcacaaaaggacacccaguggaagcugcuucucacuugugccuggccccugggcucagcagcaagagccugccccagagacgccuggacguacagggcaggugcaaagcugcuuguccucccucuggcucuuuguucucucccagcaccuucuccguagcuggaggacacccccucuaccuuggcuguguggcuuaugcccccauccccaccaugcucccagcagcaguaucccaucucccagcaggcagugcccaccuucccugaacuccccaaggcagugccccgucucauccagcugugugguccuuggcaguuuaaauaugguguccgugaaauucgaguguuuaucuuggaugggagagguuaggcauccugaccauccuucuugguggcuucccccagaugcuguguggcggggcacacgcucccugcccaccgaccugcucucuggcuuuuucacuuacugauguguccucuuccugcacaggggaaauuggcacuuaugguguaaguuuuauuuuucaggagcuuuccucacauguucucauugaagccgaaaggucaacugcaaauugguuaagauaauuuauuucagcacugccucaaggaccugggacucagaaugggaaaaaguguaacuugguuuucagagaaaagcugcauagcuagacuagagggacagaacugaaggacagugucagaagucaaagcugugccaacuucaguuaaaaaauacaucccacaagccuugaugaagaugcugugccauggacagaaaauaggcaucuguuuuccuugcugucuagaggucugcauggugaagagacuuguaagauuuaauguccuucugagaucgcaguaggaaguaugucauguucgcaguaggaagugugucaugaucgcaguaggaagugugccaugaucgaauuaggaaaugugucaugacugaaguaggaagugugucauggucgcaguaggaaauacgucaugaggcuguaucauauccaucugagaucacaguaggaagugugucaugaucauaguaggaaguaugucaugaucacaguaggaagugugucaugaucguaguaggaaguaugucaugaucacaguaggaagugugucaugaucgcaguaggaagugugucaugagacuaucauaucugucugagaucgcaguaggaagugugcaugauugcaguaggaaguaugucaucgcaguaggaaguaugucaucgcaguaggaaguaugucaugaucacaguaggaagugugucaugaucacaguaggaagugucaugaucguaguaggaagugugucaggaggcuguaucauaucugagaucgcaguaggaagugucaugaucgcaguaggaaguauaucaugauugcaguaggaggugugucaugaucgcaauaggaagugugucaggaggcuguaucauaucugacugagaucguaguaggaagugugucaugaucgcaguaggaaguguaucaugauugcaguaggaagugugucaugaucgcaguaggaagugugucaugaggcuguaucauauccaucugagaucgcaguaggaagugcaugauugcaguagaaaguaugucaugaucgcaguaggaagugcgucaugaggcuguaucugguuucagaguaauuguucauguagaaauucaaaauuacaagagaacaauucugacucagaaaguuuagauuacuaaacuuaauuguauuguacagccaaaaaguugaauaacgaagugugauuaaugagaagcagaugagcuggguguggugcuuugugccugggaucccagcuacucaggaggcugaggcgggaggcucaaucgagccccagaguucauggcaagacccaucuguaaaucgacacaugaaugagcgagcauaugaccccugcauuucacuguaacuuuuuagugaacuucaccucagucuacuuccuacuuuauaugugcuagauuauuaguauauuaaaguagugaauaucccuugcauuaaaauuuggaucuuuacaucaauuauuugcuaaguuauaugacuuucucgaguuuugcucuuuauucuuuacauuauguaaagucugacuucagauguuccucugaaacucgaaggugauuuucagcgggaccucacugcguuuccugaaucccacucagguugccgcagugcuaguucuucuucaacuuugucaugaugaugugucauacucuuaggucccguaaaugaauauaagucuguaaaauaaauaaaaagcacaaaucuuagacacugagaagagccacagguggagcgugcuuaagcagauaaucaguacacuguagaaguuuuuuuucugcuuccuguuuccaaaaaugcauauuucaauaugauacauaagaaaucugagaaauucagcuaaugagaauauuacuggaaguucuuugcuguuauauauaucaaauauccugucauguauuaaauauccugauauuuuacucuaucgucuaggaauauauauacacauaagaugugcauggguaugcaauuuuuaaauguaaaagugcuacuauuugacauguuuuauuugacauaaacaacuuuugguuugacuaugggccauuuacccauugaaccuccguuuccaacuaaaaaacuagcaaacugcagugaaggucuucaugagccucccagccuggcaaacccugacugugugccgccuuggcaguccugugugcuugcuuuguguggaauccuuugugguaggcaccuuugacacucacagcuauccuuauuagacuuagccucugagugccgggcccagguguuacucacaugccuccauaucucagcugcuguaucuacacaucacugugcucucgcuuguuccaccuuagcaaguucacauacuguuuaauugugguuggauguguguagcgugaccucguugaagucuguguugccgacacaccauuuaauugugguuggauguguguagcgugaccuugucgaagucugcauugccgacacaccauuuaguugugguuggauguguguagcgugaccucgucgaagucuguguugccgacacaccauuuaguugugguuggauguguguagcgugaccucgucgaagucuguguugccgacacaccauuuaguugugguuggauguguguagcgugaccucguugaagccuguguugccgacacaccauuuaguugugguuggauguguguagcgugaccucguugaagccuguguugccgacacaccauuuaguugugguuggauguguguagcgugaccucguugaagccuguguugccgacacaccauuuaguugugguuguauguguguagcgugaccucguugaagccuguguugccgacacaccauuuaguugugguuggauguguguagcgugaccuguugaagccugcguugccaacacaccauuuaguugugguuggauguguguagcgugaccuuguugaagccugcguugccgacacaccauuuaguugugguuggauguguguagcgugaccuguugaagccugcguugccgacacaccauuuaguugugguuggauguguguagcgugaccuuguugaaguuugcguugccgauucuugugcagccaucaccaccaccccuuccagaacuguuccauccuccuaaacggaaacuguccaucuccccauuccccuuccccuaaacccuggcacccaccaucuaguucuuucucuguggauuggauggcucuagggaccucauggaaaugggaucauacaguauuuguccuuuugugacuggcuucuuucacucagcguaauguccucaagguugaaccacaaugcagccuguaucagaauuuccauccuuuuuaaggcugaauaauacuccauuguauguauggaacacauuuugcucauucauuuaucuauugacgggcaccuggguugcuuccaccuuuuggcuguugugaauuaugugagacaucagaaaugaacguguccuugucuuguugaaauucaccaguuuaaauuguucccuagauauggaugcuaacaggcgauaaacucgagacagcuaccugcauugccaaaaguucacaucucgugucuagaacacaagauauucauauuuucagacagguaaguauguaucuuaaucacuuugaauuuuuaaacauuugucucacacaaacgaagccuauuguuuuugucagaauauauauuuauuaaucacuaaauaucuuuuuaaaaagaacuacuguaauuuuuuuaauuuauaacagcacaccagcauggcacauguauacguauguaacuaaccugcacaaugugcacauguacccuaaaacuuuaaguauaauaauaaaaaauaaauaaauaauuaauuaauuaaaaagcauguuaaaauagauauuuuuagccacauacauuaaucaugaucaaagcugcuuuuugacggaaugaacaagcucuaaguucagaaguauuuuuugcuuauacuauuaguauuauuugcuauuuuaaaagaggcauacugcaauuauuuucaauuuguaaaaauguauauugauuaaaaaaauuacauuuuucuacaaguuauacguguuacauguuguccagaagcugcuguugugaaacaagcuauaaauacaaaauagaaauguguuuuuaaucacugccauuuucagagcaagugcugccuuaacuaguucaaagaaaauuaauagaaaugaucuaaguuuauguguuuacuguauguauuaguuaugacuaaauuuaauucaaacaaaaaauaagaauuucuuggucuugauuuauggugagugaacagacauucugugucugcgucuguucuaaaugaaucgcuugcaccuacagaaggaguuauuugaauauaauuuauauguaaauguaguuuguuuugaagcaucagaaucacaaauuaggcccugaagacuacuauuugcaauuaaauuauuaaugcuucugauaaaacuucagaucaauuuuuguugacuuuucaguguuauagcaccacaaauuaaauuuuucacaauaaaaccuaccuauuuaaagaugagucugagauuguuaauuugaaccacaugaagcuuuuaauuuauuucaguccuauuaauaggacuauuaauauaucauuucuuuuaugcuccauaaaaucuccacagaaggaauaugaaaaaccacuuacauugguuucugaaauauuuuuguucuaaaacaaaugauauuucaagauuaugacuuacuuuuacucuuuuagguuuuuuuaaaaaucccucagacacuggguaaaaacuaaacuaauggaguaaguugaaacccauggcagagacaacacaagcaauuaaguauuuugcauuauuugaccuauuaugaaaagagauguauuuacauaacaccuugauuugagagcguccugucucuuacccgauguguggcgaugauguguggcgaugaggagcucggccucccugggcucuggugcucuguugggugcaagccucguucugcagagccguguccguaacgcugcgagucagugacucucagcagcgcugcuccccacgccagccuacccuggccuguugcucuguuaaauaaucaccucgugggaauuacaagaaaauucuuaaucauuaucguuguauguuaagggaguguauguauaaaaggcaauuacccucccaaacuauccagaagguaauuauuaacucauaggcacccuuuacacaaauuucaucagaguggugauuccacugcauuccucacuauacguuuccugcuugcaguugccacaaauuugaaaaugauuggcguuaacugaguggauagacacacccagcacugcuggaggaauuggaaaggaccuucuuccggguccaaauacuaaagcuccuuugguuuuagauaauaaccccagaacauuccacugugacucugcaaauaaugcccuguuucucugugccuguaacuuagacaacauuuuaauuugggauucuuuuucucccuuaauggagguaaccagucggggagaggcacauuuggagcugaaugcauuucgaaggaagcaugauugugcacuagucauaucuggggacucucuggagguaaggcuggacccugagugaguacaugucugucugugucucugaggcaaggcuggucccuggcugagugucuguuugucucucaggcaaggcuggacccugagugaguacaugucugucugucugucugucugugucucugaggcaaggcuggacccuggcccagugugugucugucuguccauuccagugcaucaaggccuucuugagucaagugcuuuugcccauucaugcuguuuuuaggcaguuuuccauuucguagcagcgguaucugccgcucuggaaagcagccccagccugaggagaugucagagcuggaucacagcgauuguuacuccuccuugacacauugagagccugaaagcugggcugggucgcagugauuguuacuccucuguuagacauugagagccugcaagugcugcaggagaccuggaggaggagcgacaagagccuguccagcgccuugguucuggcucucuguccucuccauguugcauccgcuggagcaggaauguccaaaguagcuucaugccucguuuucuucgcacgguggcccccggcugagggaacuguggcaccggggcuggugggagccucccccugcacagcuuuugcacaggcuccugggcuuaaucguccuggaccucuguuguugcuaguguccucagagcaagcacuccaagaaaucuggcagaagcugccccagaacgucaccgggucacaugauguuuuucaagaaagucacuaaggcagcuuggauuccaggggagggggaucagaccagaaggucaugucguagcucaaaucauggaggauucucucugguacuucaaguggaagaacuucccuaggcaggagaaggaugguuccauguuacauagaauuucuucccaugauuuuuuauuuuccccuguccgugaguccugugaaaugauucacagaaaacugaaaagauugagaacuguggcgucuguuggcuuugcucccaugguuuugcacuuucuacauuacacaaaucugggacacuguugucgaccauaaggcaaaauaacacaggcuuuguuuuccagguuugucuaaaguacuacgagcaugaauuuguggagcuggccugccagugcccugccgugguuugcugccgcugcucacccacccagaaggcccgcauugugacacugcugcagcagcacacagggagacgcaccugcgccaucggugagagccgcccacccugcucacagggaggucuccagagaaacccguaggcugacauugaugggcaaaguuuguuccaucucuaaaacuagauugauuucaucuccauucauggaaguuucugaaauagcuucugaugguaaaaaugaaaaacgugaugauggauaagguuuuauuucaucucacuuuucuugcuucgcaggugauggaggaaaugaugucagcaugauucaggcagcagacugugggauugggauugagggaaagguagguucgcccuuuuaucaacacauuagcacacagucagcacacaucaacacgacucagcacaugcugggccacuguacacucagcaccuacuuggucagugcacgucagcaugugcuuagcguacgcucggucagcaaacacucagcacaugcuuggucaacacacaucagcacgugcucagcgcacagucagcacacacucgguacacgcucggucggcgcacgucagcacaugcucagcgcacagcacacacucggcacacggucaucacacgucagcuugugcccagcgcacagucagcacacacucagcacacggucagcgcacaucagcacgugcucagcgcacagucagcacacagcacacacucggucagcgcacgucagcaugugcucagcgcacagucagcacacacggcacauacgugcuuagugcacaucagcacaugcucagcacacacuuggcacacucguuuagcacacuacacaugcucagcacacggucagugcacgucagcacaugcucagcacacuugguacacuuguuuagcacuacuaugcuuggcacacacuuggucagcgcacgucagcacgugcucagcgcacagucagcacacauucggcacacauuuagcacacuacaugcuuggcacacacucagcgcaccucagcauguguucagugcacagucagcacacacucggcacacacucggucagcgcacgucagcacgugcucagcgcacagucagcacacauucggcacacauuuagcacacuacaugcuuggcacacacucagcgcaccucagcauguguucagugcacagucagcacacacucggcacacacucggucagcgcacgucagcacgugcucagugcaugccuggucauuuuacacucagcacauacucaccgcaugcuuggucggcacagucagcacaugcucggugaaugcgcacuuggucaacacguguggucagcacacagucagcacagccugaagagccuggugugucccgggcacugaacuguacauuugaauaaaggaggaauuggucggagucccccgcuuugaccucacauuucauaaugucaauccugccacgugcauuacagccuagcccucggcgacuugcuguuggcggacuggcguacagggaggugucacucuuagucaccugcccuagggcucagcucagauguuagcagaucccucggcgagccuuuccauggccucccuccuguuuuccacgcaccauucucugugugguugccugugucuccuggccaacugagcugugguuugagguucaucuuccgugccagcuuuaucuguguuacucucuccuucuccacagucacuuaaauauuaauacagacacacccagaaagaccuggaaaauucaccuagcucaagcaagcguggcuuuuuccuuggcuacuucauuuuguaaugccuuacaacagcguugugaaagaggggauagauuguuucuucaaauaugaaaaaacagaauugucuugaagcagcccaagauuauagggguguccucccacagggcuggcccaugucagaucauaggggugucuuccgacagggcgggcccacacucagaucacaagggaguccuucaacagggcuggcccggacucugcagcucugcugacuccugugacaccuauggucugucagagccgagcucuccugaagcacuugugagagccugggcuggugcugggggcucuuccugccccugugucugagaccauaggaccuguccccaucgacggagcugaagcuuuacaaguucugcagagagaauuucggucuuuguaacauuuaggcugaguucuaaaacucacuuuuggagucugauuuccagcguccgccauguuugaaaaggccccgugugcuuuucucucaggaggguaaacaggccucgcuggcggccgacuucuccaucacgcaguuccggcacauaggcaggcugcucauggugcacgggcggaacagcuacaagaggucggcggcacucggccaguucgucaugcacaggggccuuaucaucuccaccaugcagguacuaagccuucugugcuggcacccauggagggcaggguccaggaagggcaggguccgggaagggcaggguccgggagugggggugcugagugcugccggaaguaccugggcugugcuuaggaguuagcgaggccccugagaggcuuggggccacaggugcucguggaacugacaguugucuucgucugugggcucucucuccaggcuguguuuuccucagucuucuacuucgcauccgucccuuuguaucagggcuuccucauggugggguaaguuacacucagaaccugccagcucauccaggggaggacuucuauuuugaaaaaaaaaaaaaaaaaaaaacaaaaaacguauauagaagauucuugauacagucaucauuuagaaugaauaauacugauguaaaaacaacauuuuacuugggugaacuucaagacagcaccugcacacuuguuccuccugggauuuucuuauuagauuuuguuuucaaguggaagccauaguuugugucaggaacuguguuggaucugagauuuuuaaagggucccguggcagaaggcggaggggcagaguggccacugacaggcccucccggcucucugcaggcugcccuccccuggcuggggcuucauccuguugugcggcguggccagcagcaaagagagaacaggaagugcagggacaugguguggcaugcuucgaagcaaacacuguuggucucuccugggcaggaauggaaucucauuuucaaagauagcagcaccagggcugggcgcgguggcucacgccuguaaucccagcacuuugggaggcugaagugggcguggguggaucaccugaggucaggaguucgagaccagccuggcuaacauggcgaaacccugucucuacuaaaaauacaaaaaaauuagccaggcgugguggugugugccuguaaucccagcuacucaggagacugaggcacgagaaucacuugaacccgggacggggagguuucagugagcuaagaucgugccauugcacuccagcuugggcaacaaagucagacuccaucucaaaaaacaaagauaacagcagcagugucuuagaaaaggacaccaaaagcacagcaggcaugcgacgugcauugaaagcugagcugauuuugcugcuguaucugcaaaacaggagcuuccugugaagagggaauaggugggaauuucucuuuuccuccuccucugugguuaugacuagaaaugaaaucagugugacuguugguguuggcagcaaacuaaaagcagccucucaucugccacugaccucccugaccucugcaaagcucaugcccaccuuaaccagguuccacuccacaaagagucucagaaaauacuugaauaguaacagccacuggcuucgaugcucuuggcguugaacgugcuuucauccucaccuuguccccacuucaugugugagaaaagugagagacccagagagcucaggaacucacccgugggaggcccagcucagaccugaguugucaggggcuggcgccgggugcugcuccucaccgucacgcagccacugagcuuaccccagguccacagagaaacagaguccuuucucccugcauagcuguuucuaguccgcagucuaaacaccguuucacucgacagcucccugaaucccaggaguuccucacaauuuuagcaaaauacagggaaauaucagucugugcguguguuagguuuuuguuaaacaugugagguccucuuaagucaccuuuuuccugaguuagaaucacugagaggcgcccccgucauccugagcuguccaaggagcaugcacagagcuggcacuugggucucugccuuccuuccgucuccagucuucagguccucucuguccucuggccuccacacaugauguccccuuggccuagaccacugccagauguccccauuguccuugcuucccugggaggccccgcacccccccccccaccaugcaccuucacacccccaggcugcgcaguuguauuaccaguuagcguccuauucuccugcgugcucuacaaggacaaggcacaagguauaucggguccucguaccugcugugaguuugucagcgugaacuucagugcaugcgaauuucagaggagggccagacucuggcggauucuaggccccccaccccaagccucaggacagcugagcuguggggcucacagcuaccaagacuccuggggcaccugcuucggacuccacguccuucgccugcacauguuagcaccguuccucccaagauagcagcagccuguccuguggucuuaaaaaucacuuugaauaaaguagguaagagccuagggaaaccuucgcaggugucuucaggcuucucucaccccuagcccuucaucuucgcacaagugccucuguuuuaggccccugccugcuguaaucacucagggaauaacccccaugaucguaagcauugcagacucucuuuuuguggcccacaaggaaagcgccgucaucggcccugggcucuccuggccgcugaggcucccucagccccaguaugagguagcacaggacagcacugugcguccauggugucaacuugaaccuuauuucaugacucuacgugaccaaagaaugucccagcaaccuaccaacucauagcccauacaguugauggaaauggugguaggauuugugcuaauauucucagcuuuccgugaauuccaguaguguuuccuauaguacuucaaacaaaggugaaaaauccuaaagguacaauaagugcuaacgcuuuuuaaauaaguuuucccauugccuacauauuuacaguaauuauuacauuaguugcuuuuuuuuuuuuuuugagacagagucuugcugugucgcccaggcuggagugcaguggugugaucucagcucgcugcaaccucugccuccuagguucaagugauucuccucccucagccucccaaguagcugggauugcaggcaugugcuaccacgcccagcuaauuuuuguauauuuuuaguagagacgggguuuugccauguugaccaggguggucucgaacuccugaccucaaaugauccaccugccucagccucccaaaguguugggauuacaggcaugagccccuucguccagccuaguuacuuuuaaauaguacagaauuugcacaguaauacugauugcaucuugaguuugaacaguguguuucuuccuuggaagucauagaaaagcauaacccuucucaccuucuuucauauuuuaaaaaucauggauuugaaacaugaaaaggaaaaugugggggaccauggagauuauucuuuaaagaacuacugcuuggguuagugaggccugugccugccucacagcccgagugcucugcagcguccccagcuccuguuccuacagcucuucuuuauaaugggcuucauguaaaguaacucugaguguccgucacaaaagaaacgucugugacuuucuuaagcacucauacucugaauuggguuaggugggagcuuuggaggggcgaugccuuuaguuaagcuucuuugaaaauaaauaaugaguuugccuucaccuaggaaauaaauaccaagaauugaacaaaaaucaacaugauguuuuuacaaaauaacaucuaacuagaacaaaaucaugucuaugauaaacuggcucuagaaccuagaggacaguugauagaauuuaauuccacaaauaugguuuucaucugcauucauuucaucagcucuggagggaacuguuggcccaggugacuuuccugaagcaagaggccccaagagcaggaaggacuaggcauacucagugcacagcagggaaacccagggagggaccagggaccaugggggccgcaaagguggugauggggaagccuagggggaugggggauggggcagcaggaggggcugggagagacaggacagccuggggagguuccugugacccccaagcccacucugcccuugccccccaagcaggccuggggaaugccaugcccuccccgagaaagagagcuccuaggccaaguccucauggggaaccucuguagggugcagcauugugcacuuuggcaaguuggaggcucugagagagacuucugaucucaugagcccacaacucauguuccacgaaaaugcuuugggaaaagcuagucugaacuggccagaggugucugucuccccagagauucuggcagcugccggcgaggaccucacacacagcgccacaucauagcagccauuccugggugugggucuucuuuuacccuugcuagugacucagauggauagccugugagugcucucguuaaagucagauugaaccuuaauugagcaccaagaaggugcaugacauuccgagagagagcucugggcaggaggagcacaggcaggucccucggggagccguguccagaccugcaggaacgggaggcucuguggguuuaucagagagggucuugagaacuucugcuuccagccgugauaaacagauuuaucuuccaagccuaauuaaaugcaaaacacaagaaaacacgugaaacaaauguuuucagacauuggauaagaagcuggggacagggaugccucagagaagagaaacaacucucccacaucuagaacgaacagccagacggccucaaaaccucuguuucaacagccacauggccucgaaaccucuguguuucaacagccagagggccucgaaaccucuguguuucaagaguccuuguaccugcugugaaguuugucagaguaaacuucagugugugcaaaucucagaggagggccaggcucugguggguucuagggccccccaaccugugcccagauuggcacagacuuccuaagcaugaacaucgugaugcauggagaauaaacugacaugauggacuucauaaaaauuaaguuuuugcucuucuaaacauaguacuaaucaaguaaaaaggcagacaagaguaaaauacuuucaguacauaucuucaacucaacgaucagacagacaacucaguuuuguuuuuaagaugaaagauuugaacauucaucacaaaagaagacauaagaauggucaguaagcacaagaaaauguauuuaacaucauuaguuaccaggaaagauaaauuuaagccacagagagaguuaaggcucugcuaccacggaggccaggccgaaaggccaaguggcguuuuggcaggcgggcagcaggguggcacugcuggcgagagugcagaugguccagccacuccagaaagcaggcuggcaguuuuuaugaaauuaaaaauuugcugccccaugccccagcaaccucccuccucaguguucacccaggaaaaaggaaaacacucaugcuuccacgcaaaccgacacagggacucucaccgcuucagcugugaucuccacagacugggagcuuccacgcagaccagcagcaggacucucaccgcuucagcugugaucuccacagacugggaaaacaccaacggccauccaccaggggguggaagagcugcauuguguccauagugugagacgcuggccugcagcacagagaaagcagaggacacgcucggcaaggugggcgaguccugacaccgcuggcccgaagagacccacucgcagagagcggagaccacccagagagaauagccagguguuagccugcggggaacagccauuuaugugagacucaacggcagcgagggaggcaggggucucccaccuggcgcaucacaggccucguccuugggggugacggagaugcuccgugucauggucacacggcgguuccaugacacuugucaaaauucaucacaugcugaaaguuauaccucaagaaaguagguuuaugaaaaggaggcagcaaugggguuuuuguuguuaaagguugaagagauagggagggguuguucaaagaaaguuaacaaaaguaauuaaagauuucgagggaaguacaacaguguuguacaaguuuaacguaauaaagaaauuaaagauugaauuucuggauagaguucucuaagcauguagauauuuagugcccagcaguaacucaucaagaaaacagaaugaugugaaauagacuaaaaguaccuuagaagaaaauguuucauauagaaccuacaauaguuuuaaaaauagaacggucugcauuuagugaccguggaaucucagucauauuaaaacagaauauaaccuuuagguauccgcauguuucaaggcuaaaauauaacguggugucauggguguuucugguucucugccacgggguaacuuucccaacuugagauaacuaugagaguguguucucauaggugacaaugucauuuaacaacaacaaaaaaaaccccagccaagugcaguggcucaugccuguaaucccagcacuuugggaggccgaguugggaagauuucuugagacuaggagugugagaccagccugggaaacauggugagacccuaucucuacaggagaacauuagcugggcauggugguacacacccgcgguccuagcuacucaggaggcugaggugagaggaucagcugagcccaggaggucaaggcugcagugagucaugauugcaccauuguacuccagccugggccacagagugagaccgugucucaaaaaaaaaaaaaaaaaaaaaaaaaaaacccagccccacuuccggcccagcuccacuuccaggacggugggaggugagguagauggguuccucccugcuccuucugcuaaguucagcuggaaacagaaggcucugaguggagagcgaggugaacagagggggcaaggggcgaggcggcaggagcuccccggguuuuccagcagcuggagcugaaggagccggcagccuggaaacgcccaugggugcagaaauuuaaaauuugaaagucccagcgaggucccagccucuccaaccguggguccacgaaaggggcaccaggaagacagauggcuuucagaugaucgucacucuacuccagccagacgccagggaagggcugugcccaccucccccuccccaaaaaggcaaguggagagcugaaagugccacuucacgagaugcagcgaugcacccggcaucugcagggugauggaaugggaggaggcaggacugcauccccagugaagggguaaugagccccucagugucggcagaggccgcauggggagccuuaaccccugccccugcacagcagcaaaaacagcgcccuccuuuccccaccagagcagggucagcacccuucagaaaauucagucuuuacccggaaugucagggguuuccaucagagucccuugccauaccaagaaccaggaagauuucaaggugaauggaaaaaagacagucaauagaagccagcccugagauggcagagaugcuagaauucucugacaaagacugggaaacagucauuaccaacauacugggagcaaauggcaaaauagaacagcccagcagacaagauacagagcagaaccaaauggaaaucuuagagaugagaaauaacccagacaaaaaaaaaugccgugacugggcucagcagcaaaauagaagggacagagggaggacgcagugaacuggaagacagaaaaacagaaaguccucaaucugaacaagagagaaaacugacugaaaaaaaauggaucagagccucagggacagcaagaugguaauucuaccguuugugccgugggagccccggccgcuguaccguuugugccgugggaguuccaggggagaagagacagggcagggcuaggaacuuacuugaaggaauaaaggugaaaaccucccagauuuggcaaaagacauaaauguauagauucaagaagguaagcaaacccugaacaggacagucaaauucacaccaagauaaucauaaucaaacugaugaaaaccagagacaaacccauugaaagcagccagugaggagacgggguacguuggggaugacuggaaacccugcaggcagagggacucaagugccggagaaaggccucaugggcacggcacacugcagccagugacggccgcuuccggaaaggaaaggggguguuggcaagacucguguccagcagugcuuaaagauucuccaagcucagccaugaaggggcaguccaguuaggaaaaggacagaaggcgcagagacggccacccugugugugaggggacgcacagaccacaagcaagccggugaaaugaugagcgcaucgucagccacagagaccagguuagaccacaggaugcuccgccucacgccugccagaauugugaggaagagucacagaaacuggauagcucuuacauugcuguaggaguguaaauccuaccaucuggaagauguccuagcacucaugcuccugagcguuuauacccucucacucggcacucguuuccaaaccuagcacucacgcuccugggcguuuauaccaucucacucggcacuccuguccaaaauaaauggaaacuucaccaaaaaaccugugcagugaauauuuacagcaguuuuauuugugaucaaaaacuaggaccaacccagauguaacuucagugguuaagcacacugugguucauuugccugccacaaaauaguagucagcaauagaaagaaauaagcuacugacacagcagcaaccuagaugaaucuccagagaauugcgcuguguaaaagacgccaguccccgaaguuaaccugcuguacaguuccauuugcauagcauuccauuugcauagcauucuugaaaugaccagauuagagauggggaacggauucaugguggccagggauuagggaggaggcagcagagggaagugguugcagcugcagagcagccgcaggagggacccugugugaggggugcucugggucuggaggugucugugugagggaugcucugggucuggagguguccgugugagggacccugugugagggaugcucugggucuggaggugucugugugagggguguccugggucuggagguguccgugugagggacccugugugagggaugcucugggucuggaggugucugugugaggggugcccugggucuggaggugucugugugagggacccugugugaggggugcucugggucuggaggugucugugugagggguguccugggucuggagguguccgugugagggacccugugugagggaugcucugggucuggaggugucugugugagggacccugugugaggggugcucugggucuggaggugucugugugaggggugcccugggucuggagguguccgugugagggacccugugugaggggugcucugggucuggaggugucugugugagggguguccugggucuggagguguccgugugagggacccugugugaggggugcucugggucuggaggugucugugugaggggugcccugggucuggagguguccgugugagggacccugugugagggguguccugggucuggaggugucugugugagggacccugugugagggaugcucugggucuggaggugucugugugaggggugcccugggucuggagguguccgugugagggacccugugugaggggugcccugggucuggaggugucugugugagggguguccugggucuggagguguccgugugagggacccugugugagggaugcucugggucuggaggugucugugugaggggugcccugggucuggaggugucugugugagggacccugugugaggggugcucugggucuggaggugucugugugagggguguccugggucuggagguguccgugugagggacccugugugagggaugcucugggucuggaggugucugugugagggacccugugugaggggugcucugggucuggaggugucugugugaggggugcccugggucuggagguguccgugugagggacccugugugaggggugcucugggucuggaggugucugugugagggguguccugggucuggagguguccgugugagggacccugugugagggaugcucugggucuggagguguccgugugagggacccugugugagggaugcucugggucuggaggugucugugugaggggugcccugggucuggagguguccgugugagggacccugugugaggggugcccugggucuggaggugucugugugaggggugcccugggucuggagguguccgugugagggacccuaugugagggaugcucugggucuggaggugucugugugaggggugcccugggucuggagguguccgugugagggacccugugugaggggugcucugggucuggaggugucugugugaggggugcccugggucuggagguguccgugugagggacccugugugaggggugcccugggucuggaggugucugugugaggggugcccugggucuggagguguccgugugagggacccugugugaggggugcccugggucuggaggugucugugugaggggugcucugggucuggagguguccgugugagggacccugugugaggggugcucugggucuggagaugucugugugagggguguccugggucuggagguguccgugugagggacccugugugagggaugcucugggucuggaggugucugugugagggacccugugugagggaugcucugggucuggaggugucugugugaggggugcccugggucuggagguguccgugugagggacccugugugaggggugcucugggucuggaggugucugugugaggggugcccugggucuggagguguccgugugagggacccugugugagggaugcucugggucuggaggugucugugugagggguguccugggucuggagguguccgugugagggacccugugugaggggugcucugggucuggaggugucugugugaggggugcccugggucuggaggugucugugugagggacucugugugaggggugcugugggucuggaggugucugugugagggacccugugugaggggugcucugggucuggagguguccguguggaugcugguggugagguucacacuacaguuaucuaagauguuaccauugggagaacuggguaaagaucacauaagaucucggugcuauuccugacaacugcaugugagucuacaaugaucucaacauagaaagguaaacauuuuuaaaaaucauucuucuacccguaagcauuugugacuuauagaacaugcuacugugcucugagauaaauacucagucuccgcaaucaucuuacuugguugccaacuuacuuuguugguuuuuguggaguauuuuuugguguuuuugaagcugugaccucuaauccagaggucuguuucuagcugugugguagaaguuucucacgcccauugcacuccgcucuuggucuugcagguaugccaccauauacaccauguucccaguguucuccuuagugcuggaccaggacgugaagccagagauggcgaugcucuacccggagcuguacaaggaccucaccaagguacgggccucaggcaagcugucugccucacgacuagcacccacaucuagcauuuuacacgagugagaaacaggccagucaggaggcauuuccaggcauuuugugaaaaacgauucucuguccuugaagauguuuuuuaugucuccuaauuguuguuggcauuuucucuuugaguuaaacuucaaaaggggaaaaacaucucagggaaaaaaauuucucaaauguuugcaauaaagcucuaauaucauacauacaauuagaauuguaaaagauauucuaaccauuuguggaacuuuugugaagugagcucaccaaaugucagagaagaucucacuguguaauuucuguagaaaggcucccccggacagcgucacugcaccugcugcagaaauagcauuccaaagcuggggaacccaugggcugcauguuuccuguguauuuccaaguuugucaguaguuguggauuucagaauuaucccugaaaagugauaacaugugucugucccuaggguccauagacuauuuuugcagugaugucaccaagaaaaaaauccaccccagaaaacuucagucaccugaaacucugagaaagauggauuuauuuggcuuaaaacugugcucuguuaggauuaaaggaggcuuugaauuuaucauauucuuuacgacagcauauuuuauagcauagaacguguaaggauacgggguagaagagaggcucagcucugcagacacaaaucaugguaacucugguauuuuccacaaagcuagcuguuuugaaucaacauugaaaacaaaauccacuaaccgcaauuaaauuuagauuuacaaucgauaaaugacaggugucugaaauuaucaacucagauuuuuaaagcaguagcuguaugguaaagaaagaauuagauuaggcauuaaaaaagaaagcuaaugacuaccuagcaaacagauucuaguccagcuaaccacuaauuaaccaacuagauucuuaccuagcuaaccacaaacugagaaacuagacuccugucugucuaacuaguaacuaacaaacgauacucuaucuaauacagcuaaccacuaacaagcuagacucuuauccagcuaaccacugacaaacuagacucuaguccagcuauaaccacucauuagccagagaggugcuggguaagucauguuaacuuuuugauuucuugauguuauugaaaugaaauaaagacuuuaaaguuucuugaaaaaaauaaagaauucucauuaguguuauaaucaagacaaauaaagcuaguucaccaguaucacaugaaauauaaauaccaagcguuauuaucaugguggcaucaucgugacuacugggaagcaucgucccaggucacaccuacuauaacuagaagcaagaccgcuuaaguaucuuaaacugaugaaaccauugugauaaaguacagcagaguaaggagcaaagauccaaaaacuucgggaagcuagugugaauaaugaucauuuuaguagcauaugcauuuccucauucccagagacucuaaaaauguuuaccuaaaugcugccuuacaaacauacgggaacaagcuuuucauguacgaagguaaaccucgaugcgcuacccucaacccuaggaaaccggcacgcaagcagggcagaggucaccaggggucuuguagccccagccggugcucccggaucgcugugcugggagaaacuugucauaggacugucaugccacagccaucuugaccggcuauuggaguggggcaguaacacguuuuuacuguuuucaaggauuuagauuguacgcaccagucucuuucuuuguggauaucuaaauggcucuaguaacaagagguucauagggccacaggugucugacggagcagcuaauuauccguaacuguggccauggaauccguaaguucuguguuacuggugccguugaacccuguucacuucugauuguguuggaucucauuaaggguauuaaauuuccguuuucguuaaggugagcaacaauuuagaauguuuuaguauccuaaagucaggucaccaucccuacauuuuuuuuuuuuuuuggucaagaaugcagucacucauuuucucuaagcuucuuuucuucaacaucuuaucugcauuguaacuuuuuuuuaaaucuacuacacuucaaauucuuugaaaagaaaauagcacuaaaguacugagccacuaaaguuaauuuaguuauuuuuucuuauugaagcuaaagaacuauuuugaagcuuucuguuccuucugaacaguucgccaagguagcacagacugcagcacucugcguuguugucugaugaucggggcagcuggagacuggaugugccaacgcaguuuauccacaccggucagugucaguggacaccaaguccccaguccgucggcucaagcuccugcgauguaggacaacauagcccugcucucaacaagucuguauucuagucaggaugagaaagcagugaaucaguggcauagagcaacagcauaaagggccgcggccugcagugugaguaacaacagcauaaagggccgcggacugaaaugugaguggcugaccggcgagugccgguccagucaguucugagucacauaucucaggucaccguaaauuuauaaaauaccuucagaggcgagccagggaggcaaggcaugcauucccugcacacaggagaagacucaauuggaaagaaaaucuccucuuuuuuauguguauuugauaaccagucuuuauaaucuaaaaguacaaauaaggcacgcauuauaaaucucacuuauuguccuaaugaguuagccaaccucaaguauaaacauuuguccccugcugugucucgauggccugagccacacaucgacacaguaucuguuaaguaaguauuugauaaacaaaugaggcagugaaugaaucaguuaaacaaagagucaggauuuccuucgcuuuccuaaaacuguguagcuuuuauucuuuacagaaaaugguauauuugcaacacuauuuuguuauucuuuugaagcucaaauucugcuuugaauuauuaaacuuuacucacgaugaguucaggcacuuaauuuucuggaugccaguaagacgggaaacugaccuacucaucucucuccuaacucugcacaugucuucauucauucugaaugguguguaaccgcuuagggaagcuaguuacuccaagauccaggcaucaggacuaguaaggugacccugguuaagugagccagcucacguggucccaaaauaucucagacuguggcugugaauuuuguuaccaauucauaaucuuacauuaccagcuaacuccagagacauuugauuuguaguugugcuaauuguaaagauaucaaguagguaauauacaguucuucaugaaaucucuggugccauuagguauugaaccauucggaccccuucacuaauuuuuauuuucuguagaauacucucaaaugguuuuaucuuuugaaauguauauuuguauacuuauauucuuuucaaaauaauagugaauaagacaauaaaaggaaauuuaaaacauugagauuaggaaggaggaaauaaaaauaucucuguuuguggaugcuauaauuuucuauguagaaaauuccaaggaauccacacacauacaaccuccuauacuuguaaacuucauaaaguuucaggauacaaggaauaauuuuucaaaaucauuuuugauucuguacacuagcaaugaauaauugggguuugaaaaaauuuguaaacauuuauaauaauacauuuaagcauuuauaauacaagaaagugagacacugaaguguaccucuaacaaaauacacccaagaucugugugcuggaaaccaacaacauugaggaaagaaacuguaaaaggcguaaacagauguuccuggauugagagacguaaacagauguuccuggaaugggaggcauaaacagauguuccuggaucaagaggcauaaacagauguuccuggauugagagacguaaacagauguucauggauugagaggcauaaacagauguucauggauugagaggcguaaacugauguuccuggauugagaggcguaaacccauauuccuggauugagaggcguaagcagauguucaugguuugagagacguaaacugauguuccuggauugagagacauaaacagauguuccuggauucggaggcauaaacagauguucauggauugagaggcauaaacccauauuccuggauugagaggcguaagcagauguucaugguuugagagacguaaacagauauuccuggauugggaggcguaaacagaugauccuggaaugagaggcguaaacagauguuccuggguugggaggcguaaacagauguuccuggauugagccucaauuagauguucauggauugagagccucaguauugcuucacauugacaagcucacucuagaauuuauauggcaaggcaagggaacucgaauugccaaaauaauuuagaaaauaacagaguugggccgggcgcgguggcucacgccuguaaucccagcacuuugggaggccgagacgggcggaucacgaggucaggagaucgagaccauccuggcuaacacggugaaacaccgucucuacuaaaaauacaaaaauuagcugugcaugguggcgcgcaccuguagucccagcuacacgggaggcugaggcaggagaauggcgugaacccgggaggcggagcuugcagugagucgagaucgcgccacugcacuccagccugggcgacagagcgaaacuccgucucaaaaaaaaaaaaaaagaaaagaaaaaaaagaaaauaacagaguuggaaaacacacuaccugauuccaagacuuacuguaaaacaguaaucaguuagacaauguguuauugucaaaaggauagacaaaaagaucgguggaacagaaaagagagcccagaaauacaucacaugugucagaugaucuuuggcaaacaugagaggaaaucagaaggagaagaguugugucugcagcuguugggacaauucgccgcccaugagcaacagacccacaaccuccaccucacacuucaugugaaaauccacccaaaguggacccuugaccuauauguaaagcuauaaaccuuucagaagaaaauacacacaaaauaugcaugaccuuggguuaagcaaagaguuuuuaaucaugagaucaaaaucaugauccuuaaaggaaaaaaauaauaaauuagacuuuaccauaauuuaaaaguuuuggccaggugcaguggcuuaucaugccuguaauaccaucacuuugggaggcugaagcaggaggauaacuugagcccagaagcucaauaccagucugggcaauauagugagaccgugucucuacaaaacauagaaaaaaaugagcugagcauggugguugcugugugccuguagucccagcugcucagggggcuaagguggaaggauugcuugagcugaggaguuggaggcugcagugagcugugauugagccacugcacuccagccugggugacagagcgagaccuugucucaaaaaaaaaaaguuuuucucucugaaugauacuguuaaugaaaaaacaagccacagccuagaaggaaauauuugcaugucacacuuuugauaaaggaguuguuucuauaguauauaagaaacccccaaaauucaacaagagaacaacccaguuuuuaaaguagacagaagauauuaacagacaccaccccagagauaauccacagauggcaaggaagccugugaagaugcucagugccauuuucaucagggaacugcaaguugaagccaccgugagaugccguguacccacccgugcuagaacagccgaaauaccagcaacgugaaaggcuggggaggguccagagcagcagagacuccccuucacugcuagggugaagggagaaugauacagccucuucggaagacaguuugggcauuucuuacaaagguaaacauguauuuaccccaugacccaguaguccuguuccuagguauuucuccaagagaaaugaaaacuuagauucauacuaaauccuauauaugaauguucacagcagcacugucauaacugccagaagcuggaaacaaccuugugcccuucagccagugggcagaaggaugucuccguggacagggacagcccaugcguggauggaaggacaucuccguggacggggacagcucccgcgugauggaaggacaucucuguggacggggacagcccaugcgugauggaaggacaucuccguggacagggacaguccaugcguggauggaggacaacuccguggacggggacagcccgugugugauggaaggacaucuccguggacggggacagcuugugcguggauggaaggacaucuccguggacggggacagccugugugugauggaaggacaucuccguggacagggacagccugugugugauggaaggacauccuaguggacauggccagccugugugucaugccaccaggcagugggauugugcuuagcagugagggguuacugcugacucacaugacaugauggaucauacauugugcauuuugcugugcagcagaagccagacuugaaagcugguauugauucuuuuuaccggacaccugggaggugcagaacuguagggaagagacccguccguggucgcuaaagguuugaguguagagggugaccggagaggcaucccgaggggguguggguguggaagcugcucugucuggcgcggugguggcggacaccugaccgugccucucucagagcccgcuggacggcaccagcauggagcuaagggaggaggaaugcagacagcggcccaugaaccgcagaaccacacugugggcugggaagaaaggagcucuuuucaguggccuugggaaaggcguuugacugugguucacuguaaggcugaagacaaaaagaacugcaaaccgugggcugcguuuggcauuugcuucuuacaggaaucaauaagcccaugcaugguagcuaaugagaagcagauuucucccuguuagcgaugaaguuagaaaugaagggcuggauugaagcccagaucaguuugggcuugugguuucugugagauaaauaaauagaugaagaaauaaacacggacaugugugagcaugacuuaguaaacacacacaguccuaggccauacaccgaguggcuagaaucaggaaccaggcgguagugagcaagcucaguguugcagauuaugcggacgagacccugugccgucccccaccacgcagagcccuagagaagggguuaauuccagggcugaggcaagggaaauacaagaugagccugaaacuucuuguggagcaaaaaaguaaggaacugcugaacaagaaucagugaggcuggugcgggaggcaggucugacggcgucagaggcugagccucccacgggcuagcacugaacacccugcacagcaaccuagacagcagcaugacuagaugauaaccagagagcacacagauaccuucaccuccaccguguguacgcagagaaagugccuccucaaccagagagcacacauaucuucaccuccaccguguguacgcagagaaagugccuccucaaccagagagcacacauaucuucaccuccaccguguguacgcagagaaagcgccuccucaaccagagagcacacagauaccuucaccuccaccguguguaugcagagaaagugccuccucaaccagagagcacacauaucuucaccuccaccguguguacgcagagaaagugccuccucaaccagagagcacacauaucuucaccuccaccguguguacgcagagaaagugccuccucaaccagagagcacacauaucuucaccugcacuguguguacgcagagaaagugccuccucaaccagagagcacacauaucuucaccuccaccguguguacgcagagaaagugccuccucaaccagagagcacacauaucuucaccugcacuguguguacgcagagaaagugccuccucaaccagagagcacacagauaucuucaccuccaccauguguacgcagagaaagcgccuccucaaccagaggauuccaguuauaaauggugaaggaaccagggcaguuggaggccccgcuggggcaccaaggcagcagccacugucacgaggucuuccaagggaaguggaacuccagggucacaguucccaucaccagggaugagagaggccaccacaccuccugcuguggagcccugcaggggacacgugucuccucaacaaauccuccccaguagugucaucaguagaagacaucagacaagucgaaaucaagggcauuccaaaaagacauguccggagcuuugaggagcagccaggucauuaaggacggggagacagaggcgcuggccagaucacagagcccaggagacaucacggccagagcagcgugggguccuguguggggcccugggcaggaaaagcacauuugagaaaaaccaggaccuccacaccauuucucugccacggugcgugucugugucuccauggagugucgcccugggugggcuggagggcgccauggccccgggugagcuggacggcgccguggccccgggugagcuggagggcgccauggggcugucugcgcugcuucugcagcuucccugcaagucuaaagugauuucaaggcaaaaugauuagaaaacggagucagagccaagaaagucuucaauuuuccuaggauagaugaacagaauugggcauggcgccaggugccuguggucccagcugcccgggcuggagaaucacuugagccuggaaggucgaggcugcggugagcugugaucgcaccacugcaccccaucccucggcaacagaucaggacccugucucuacaaaaacaggacuguguuugcaaagcugcagucuuauccuucaaaguguggaguucaaaaccagcccaugucugcgccuggcccuggcccaguugcgagcacucuguggcagcaaguccaccuuuaggugcacacucucugcuugguggcucucauuuaaccuguccuguaauauuugaacuuucuguccaguaauauuugaaguucauuuuauauucuaagagauguauuuaaugaaauugagcuuauccauguaagaaugaaggaaugagacccugaagaaaucagucaccguaauuucagaccauuaauagaagaaauaaaagugacaguggagugaguguggcaagcagaagagcugucgggaacgucaccugcccaccccuuugcuguaggacccuaccaccagcauacuccgucguuggcacccucgucguuggcacgucucuacccucagcagagcaggccaggcacugaacggcaggaagcccacacuuccuccccagcuucccuuccugccaaggccagagacgcgugcagagccccaguuaauuggggcuucucuccccggcgccaccgugagcaccguccuucccucucuguuuggaggguuuguucuugauaugcuuugacugcacuuuuucuccucuugcaucugccuauaggaucuuucuacuccacacucccaaacuucucucaaauaauuacaauuaugggaacaggcgaaauuuguuguuguuguuguucuaguaagaaucagauugggaggccgaggcgggcgggucacgaggucaggagaucgagaccauccuggccaacaccguaaaaccccgucucuacuaaaaauacaaaaaaaaugagccgggcgugguggcucacgccuguaaucccagcacuuugggaggccgaggcgggcgggucacgagucaggagaucgagaccagccuggcucacacggugaaaccccgucucuacuaaaauacaaaaaaauuagcugggugugguggcgggcgccuguagucccagcuacucgggaggcugagguaggagaauggcgugaacccgggaggcgaagccugcagugagccaaggucgcaccacugcacuccagccugggcgacagagcaagaguccgucucaaaaaaaaaaaaaaaaaaaaaaucagagaacguauacugaggagguaggcugggagaauaaauuauaauagagauaaaagugguuacagacucaggacaggaguccuggcauuuuggaguggcuggucccaugccacggugccgauccuugcagagggaccaucuuucacgccacacgcgcaucagcgugcucugugccccacagcacugagugcuuccguacgaauaacuguacacauaugacuuugagguugguuaaucuuuccuuaaaauuugcuugauuuggccgggcgcaguggcucacgcuuguaaucccagcacuuugggaggccgaagcagacagaucaccugaggucaggaguucaagaccauccuggccaacauggcaaaagcccaucucuacuaaaaguacaaaaauuagcagggugugguggugcacacuuguaaucccagcuacucgggaggcugaggcaggagaaucgcuugaaccugggaggcggagguugcagugagcugagaucgugccacugcacucuagccugggcaacagagcaagacuccaucucaaaaaaaugaaaauaaauuuuaaaaauuugcuugauuuuauuuuuuacaauuuuugguaugauagaaauauacuuucugaauccguaauauuuaaugguaaauauaacaguagcauucagugaauauuuacuaugcugcuggcauugugcauauuuuauuucauggcucauuuuauuucaugcacgugagccacaugccacuauuacuucuauuucacagaggagggaacugaggcacagagauuaaguccugagcccaagaacgcagaagaaaggcgugugcuaggcaggacuccacuccaggcauuccacacauacggggacaucagucagagugacagacaucuucaucucuuccuaaaccaaaugaagagguaccuggcccaggaagaguggcuucuuccauaacaugaaacccauagugaaugaauugcuucuaugaguaacgugucuguaccaucaaauauaacaggauuuuguucucagagcuacagucugggagccauuaauaggagguguacggauauuuuucucaaauuaucuauuuuguugauguuuuuuguacccauucuguuguguuugcuuuuauuaaucuauaauaucaucugcuucaauauggaacaccccacaggugcaggucugaggugcucccuguuggcagcuccuaaagagaggcagcacagacaccacuucgucuuccacauagacaccaaucauugaccuacaugaauaaaacugaauacauuucagcaaaucaggccacagaauaagccuuuucuuucuuaugucaaaauaauuaaauuuccuuuuacaguuuuugaauaaaaugagccacauacuuaauuacagaugaauuucgugaccaaagaccaaacaccuaccauuacccagggagagaaauguccuugggaaauacguaccaagagaacuuauuuggaguauauaaaugguuuaacuucaaaguuuucugcuuuuuaaaaaucaguggugcuuggcugggugcgguggcucacaccuguaaucccagcacuuugggaggccgaggugggcggaucaugaggucaagagaucaagaccauccuggccaacauggugaaacccccucucuacugaaaaugcaaaaauuaucugggcaugguggcaggcgccuauagucccagcuacuugggaggcugaggcaggagaauugcuugaaccugggaggcagaaguugcaaugagccaagaucgugccauugcacuccagccuggugaaagagcaagacuccgucuuaaaaaaaaaaaaaaaaaaaaaaaaaaaaaaacaguagugcuucuucgucacagugaauuugaaucuuccuuuucauauucacgugugagggcucaagcuccgucagcaucuucacacacugacucuugcagccuaggaaaacacuuaacauaugucaccacacuugucuuuuauaauuaaacuacaacuagaauuauaauucauaaaucugccacugguggccuccugcaggaauauagccgcauuuccagcguccgugccucuguucugugauggcucaugccugugucuaaaggucuucagcagacucaggcaggugcagguucagacaggcccugagcacagccugucaccauccuccaucuucccugcugucuucuguguccccugagcuuccgugaggguuugucuuuccucuguggcucuuuaaaccacuuccuguccuuaggagaaucucccccguggguggggaagcccuaaaucagggcaggacuuugggcucugaucagcagacuacacuucuuagcaccaccagccuccagcaagaaccugaggaaaucacggaacuucucgagucuccucgucuguaaauggaaacgacgucugcucuguguaacugagaaaauagaugcgaaggugucaaacaaaggccucacauaaagacagggccucucaacacgugucacuuucgacagcucuuuagcaccaacaagucagggcgauuguuaaugacucagccucucuucuuggacucuaaauuaaucuucagggaugcagugggacaagcaaccccgugggccagagcuccccugccuccugcccccucguccccugccuccugcccccucguccccugccuccugcccccucguccccugccuccugcccccucgucaccugccuucaacuucgcagagugaagggccuggcgcaaggacccauuccaugggguuauguaugugacauguucuccagcgaggguuuaagggauaacuuuuuacuucaguugagaugugccauccuuacugaagaacuguuacguucuguaucuuuugaucugaaaaaaccaaacaguaaauauagaaguauuuguugacaagaaauaagggaaaauguuuuuauugccaagagccuuucccccugguucacugaaauguuugcuuguauacaucacuccuggcuuaguagagccaacaagacggcaggucaaacagaagacaacaugaacgucuaaccucaggcaccaguggacacgugugggacccaggcagcuucuucaggauucgggugucaggaaaaggcgcccgaaaugcugguagaccagguggcugggguggcauggauggggcuuauggaccugggucuuucagaagugacccauagcucacuccuggaaggcgugagucaagcaggugguucugcgcacuaacgacgcucuuccacuguuucccuagggaagauccuuguccuucaaaaccuuccucaucuggguuuuaauaaguauuuaccaagguaagacgagauccuuaguuuacuggacuaaagauuuuuuuauuuuggucuuuuuguuagcaauauuguuuuuacuugcagauuaaauuccaacagcuuaaaaugccaucagcaguuaaauacucccuucuguuuaucuuguaaaucaauauuccagcaacauggguccuuuuuuuuuuuuaacugaugcaugccaccuaaaaacugacuuaguuuuuaauuaaauguuaauccagaaagauuuuaacaagcacuuaccacauuguauacccugcacaauggcuuucuuucauagagugauaaaaagacuuugagaaaucugaguuauguaaggagaagccauuagcugcccuuuguuuaguguucagauaaaugggagauuguugcaaguauaacuaacagaucagauauauuaauuacaugcaacacauaauuauuuacacuaauugaaguagagguguggcuucguauccagagauuaaaaaguuugucugccucgauuugccauuucuaacugauguagcuaggaucccaucuuauuuuguccauaauccagaguuuaagugacuuguucaucagcaugaagcaugggcauggccauuauccgccuuuuuuuuuuuuuuuuuagacagagucucgcucugucacccaggcuggagugcagugguguggucucaguucacugcaaccuccgucuccuggguucaaaugauucuucugccucagccuccccaguagcugggauuacaggugcgugccaccacgccuggcuaauuuuuuguaucuuuaguagagaugggguuucagcauguuggccaggcuggucuggaacucacgaccuggugauccacccgccucagccucccaaagugcugggaagacagacaugagcugcugcgccuggccuauccccuauuuuuaagggucuugagugacguugcugguucaaggcuguuuccucuagcuggcuuacacccugcucgugugcauggaaaaagcuccugcuguuuuucaggcggcauccucauguauggggcccuggugcucuucgagucugaguucguccacgugguggccaucuccuucaccgcacugauccugaccgagcugcugaugguggcgcugaccguccgcacguggcacuggcugauggugguggccgaguuccucagcuuaggcugcuacguguccucacucgcuuuucucaaugaauauuuugguaaguugccuuggaauuguuuuuugaaucguucucuauucaugauuuugaaguauuuucuuauuguugcuucugaauacauuguguuaaguuguggaucaugguaaaacccauaucagaaagugccugcucuuacugucccugcaccacggaugaaggcgcugagccccgucggucacuggcuggccgguccccugacaggaggcgcugagccccgucggucacuggcuggccgguccccugacaggaggcgcugagccccgucggucacuggcuggccgguccccugacaggaggcgcuaagccccgucggucacuggcuggccgguccccugacaggaggcgcugagccccgucggucacuggcuggccgguccccugacaggaggcgcugagccccgucggucacuggcuggccgguccccugacaggaggcgcugagccccgucggucacuggcuggcugguccccugacaugagcagcacagccacucgggagcaguugggacucagaccugcgggaggugaacacagccgcgugugcacuuguccucgucucagugccugaguguccaugcaguggugaaccuguacguaggaaaaugugaaauguuccuguucuuacauaaaagaacucucagaaaauacccguggcucauaagaaaugguuauuuucaaguuauaaugugcuaguuauuuuucuuuugaaaauuggcucuuagaauauuuuccuguaagaucaugaauuaacacacucaaggacacgugaacacacucagugccacagugagcucacaaaacgacaaagacaugcaucacgggcgugggcaggacucaccacgacuuugagccucagcuuuugcaucugcaaacuggagacgguaucacuucccauuaggggcgggucugaagaucaguaguaacacgcuuacauacaugugaaugaaugugcagagcuccuuucacaccugcagaacauggccagcccuccagcgcgugcgccuucugugcugagcuccucucagaccuggauaggucucugucuccuaggggaaugccaaggugugugcuucucagacacaggagccuuuagcuauuggguuucagugauguuuaaacaguuguaugguaucaggcagggaaaugagauguuaaaaccacauugaaaacgcagcuugcacugccauuuuauugcuuuuuaauguauuucuuauucuuuugcuaaccccuugaaauauccugguaucuccuuuaaucuguccuuuauuuucuuuauuacuguuuuggaacagguauaggcagagugucuuuuggagcuuucuuagguagguaaaguuaucauuucuuucaaaaguguagaaauuuagccaaacaauauugauaaagauacuuaacuaauaagaaaaacaaaccuuccucuaauucaguguuccucaggaacucucugaugucacguaaacugguggccaugugcuugcucggcuagucaugggcugagugcuguuggcuugccuguucaggggcuugguggcccugagugaggggaaggggccgggcauccugccaucugcugaggauugcaugagccccuaaaacauauuugccuuuucaguuguaggggcugagcugcuggaaaacacuuccagggucuucagaaaaugaguacacacaaacuuaggaauuccccuucauacagagauccagcgcuucccugugucauuuauuuuacaaaggccucuaacucugcuccauagaucuuuuuaucccauccggcaacagucuaaagggauuuccacuauauguagauucgaaguauguaaaucuccaguuucucaucugccucuuuucaugcggaauucaaguagcuagucauuagcaguacagcuugguccuggugaguagaugguucuucuguggagaugcugggagggugacaggcgagaacauucucugggugggccgggcucagagccucuaagagcagaccggucugaguauuuguguugcagauggaacugccagcugcccucuguugcccccagccccucauaaagucagcucuaccuuagaaacacacacacacacacacacacacacacacacacacacacacaaaacaaaacaaaaaaauggcuagccuagaucguccaaacaaaucccacagguuaggugagcuggugucucuucccuaagcaccacaacuaguacuucagugccuucacaaauucugccacagaguguuguccacccauucagugguguuuggugacauuagucaucugcaaccauuuuuuuuuuuuuuuuugagacgaagucucacucuuguuacccaggcugaagugcaguggcacaaucuuggcucacugcaaccucugccuccugaguucaagugauucuccugccucagccuccugaguagcugggauuacaggugccugccaccacaccaggauaauuuuuguauuuuuaguagagacaagguuuccccauguuggccaggcuggucucaaacuccugaccucaggugauccacccaccucagccucgcaaagugcugggauuacaggcgugagccaccauggccggccuacaaccuuuuuuuuuuuuuuuuugagauggagucucacucuguccccaggcuggagugcaguggcgugaucugagcucacugcacccuccaccucccggguucaagcaauucuccugucuccaccuccccgguagcugggauuacagguguccaccaccacgcccggcuaauguuuuguugucuuuuuuguagagaugagguuuuccuauguuggccaggauggucucgaacuccugacuucaagugauccgucugccuuggccucccaaaagugcugggauuauaggcaugagccacugcgcccggccugcaaucuauaaugcuuugguuuuguuuuuuccauuaaaagaagaaugaauuaugcccgguaugcaggucaaacaauucugcagucaagaaaaccugagauuuggagcugggccccuguaaaugcacagugauguuuccguggcaagcuuagaccgucugguggccuggccaggucuguggcuguggccaugagggcccaggacuucuuggucagcucuuaccuuuuucucuguuuccugccaacagauguugccuuuaucaccaccgugaccuuccuguggaaagugucggcgaucaccguggucagcugccucccgcuguauguccucaaguaccugaggcgcaagcucucuccucccagcuacugcaagcuggccuccuaaggggcugugcacccccagcgggcuggccccagcaccuucugcccuucccagcaccuugugcccuugccagugaacgcaggguuugccauugcuaccaagcaagcaccacaagaaagggaggguacgccaggcgagcccagggcacagaugcugagacagccucuccuucucagugcagggacgucaccccugccaggcaagcccagggcacagaugccaggauggcuucucccucucagugcgaggcuucaccccugccaggcaagcccagggcauagaugcugagacagccucucccucucagugcagggacgucaccccugccaggcaagcccagggcacagaggccgggacggccucucccucucagugugaggcuucacccaugcuaggcaagcccagggcacagaugccgggauggccccucccucucagugcgggaacgucaccccugccaggcaagcccagggcacagaugcugcgauggccucuuccucuuaaguguggggccucaccccugcuuuucuuucuuuuuuuguauugucaaaauuguauuuccauauugaagcagcuugaguuucuacugaaaaugagcccgaauuauuucacuauuacuguaaaggguucaucuuacucuggcauucugagaauuagacugaaaguuuaauuucugcaguucccucauauucagauucuuucuuugauguuauaacacaaagucauuccuacucaaauguaauaaaauugaggcuccacggaggcccguguccacaucagcugcagcucccacucagacagacggccugccccacagccugcccuuugcugaagauacccucgcuuuauacuugcauuucgcuuuucaguaaaaacagucaaguuacugaguucucacauaa

SEQ ID NO: 192769 - RNA, 136636 nt, Homo sapiens
cgcgcgaggagccgccgccgccgcgccauggagcccgagugagcgcggcgcgggcccguccggccgccggacaacauggaggcagcgccgcccgggccgccguggccgcugcugcugcugcugcugcugcugcuggcgcugugcggcugcccggcccccgccgcggguaggugggcgcaggccggccgggggccgcggguugcucggacaauggcccgggcggccccgcggccaagugcgcgggcgccgccgccgucucggaagcgacuuggcgaguugggagcgaguuggggcgcgcgcccgggaucccccugccguccccggcguccccgccacgcgcgggcccuuugucuccccacccgggcccuccccggggacgcugcgucccgggcuggcgaggagggcgcccgcuccgccaggugcggcgcgggcggguccucaccugcccgagcccgcgggaagccgggagccgagccgagcccgcgcugggcccguguggcccgggccgggcaccgagcggggacuuggggcgcggaggcgggccuggcccggggagccgguucgcaagccuguuuccagcggccgcgcggccgccccgcgugcuccgaggacgggcugaaguugcagcgagaaaguucugagcccgggcgcggggcggccuggccgguggcgcugcuccugugagccgcguggcuguggguuuccaagcggacugacaccugccaggugcccgggcgacccgaaugccccguguggccgccggguccccagauaguguccauccccgggucggcuacgcggaggugacguggucccagaucgcggggcagugggggaggcaggcuugugccucaguuguacacucccguggggagagguagggcgggggaacuuucucuccaacuuuugguguuucccaggggguggaguugaggucaggaggacucaggaaacuuaagcagucgugaaacgcuacacauguucuuuuaauuuggagauugccaugugguuuuucaagcaagccucuugcuaccuaaaucauucucuucggaugugcguguuuuguuuuucuggaguauggcuggccaaguggcacggccgcaagugccugugcacgccgcggcuccuguucuguuuguggcaguuuagcggggaggaccucgggccccuuugucugggccuccuuaaggcaaacagcugucucccugaauauuuccagugugaauggugcagcgggguggcccuguagucagaucccccaggcugcagccucugcuuggaggugugggggacagcggggaacaggaggagcuuggaguuuguuucacguccuccugccucugacccaagccuagagauucuauggacaguuucaccccaaaucugccucuuucaggagcguguuuacauuguggggccuugucuggagcuagcaaaacaaggugaagacaaaacagcgacaguaucuggggaguacaggccagcgccgcuccuuuuuccggaaaugccugggucaaggaggcaaaagggguuuuggggaaacuguuuguuuuaaaggggggguuucuaggccgaccgcguugccuuucaccucauugcaguuuuggguuuugugcacguuuuggggugauguugcuggagucaaaugccugucguccaugugguucgagccccugaggagaaagaauuauagcuguagaguucaguugugugugaggcaaaaauagaguugauuauuuuaacauuaggcagcaaggccugggagccccagugaauguggugauccaggccuaaaauggaaggaaagggaggaaucuuucugcagaacgguuuugauguuauaucccugguuuuacugugugaaauacaugccucggaccucagcgaagccaguaagugggccgcuaauuauuuuuccugauugcuuccuguugcaauuggaagcugugaacgcacggaaauggcuuuguucuaguggucccagugcugagaacuuccccagcucccaagcccuaguccucucuccucggggcccaagugcuuguuccagggccggccuguccaggcacccccucucccccuggagguuccuccuguagaugcccaaggccaaggccgggcccucugggagagcccagaagggcugagugggguuaaccaagugcuguguggagcacccugagagaguccccuccaaagcagggccccguguguuuagcuccccucuucaguuccaagaaauucgccggugaacccgauccagcauuuguucagcacuuuccuggggagauucaccucgugcuuccugucguuuuuggaacccguuuaauuucagccgugcugugucacugcucaggcauuuaguagaacucacacacacgggugggggauguaggcaggugaggccucugaguugcuuucucccuugcagcgacggguugcagggcugauggggguggagggguuuggggucagacccaccuggguuuacaugcucaguggcuguuugacuucgggcaccauaccuaguuucuguuaucucaccccguuccucucccaggcuauggggagcccuaacugcccugugugagaccuuuagccccaucccuggcagagcugcagugagcgcaguugugugucagcguccucgaucuuucuggccccagccggucuagaggcuguuauuacaauagucuggauuuuuccuguaugaccuuggacauccaguccacugacaaacucacucacucaccgcugcagcccucgggggcaggaguaguuaguuagcacuguggacagagccccugcgcccagggucugauuccagccuggccgcuuccugugcugggaggcuuaggaagcugaugcuaccuuugugugccucaguuuucucaccuguaaaaugggaauagaauccuuccuaccaugaauucagugaguuaacgugcaccuggcccgguauaaugcuguugcuguuuugcuuuggugucugcuaccgagugaagugcuaggguugagugcgauagaauggcagauaaggccccgccccugcgggcagagcuucccauguagaggggaggacagggaaagaagcuuugcagcuaugcagaggugggcccacgggugcuccuucacccucgggguguccugcgagaggcccuuagaggccagaucaugcuguggagucugguugugauccacaaggcagcggaagcuucuggaaggcuuuaggcaggaguuacaggaaaugcaagcuaaagccagaucuuuccuaggugaaaggugucgaguuguuuuuuuuuuaaauugaggugaaacuuauauaauauaaaauauuaaaguauagaaggcaggcauuugguacauucacaguguuuacaacccucucuucuaucaaguuauaagagauuuccaucaccccaaaauaaaacccauacccauuacacggugacuucccguucccucuccccggauccccuggugaacaccagucgacuuucugccucugugguucugccuguucugggcauuuugcaugaagggaaucuuacaaugcgucuucguggcugacuuccuugguuacuguaacguuuucaggagucauccaaguaguaccacguauggguguuucagccuuuuauuuuuuuuuugaaauggagucuugcucuguugcccagguuggagugcgguggugcgaucuuggcucacugcaacuucugccuccuggguuuaagugauucuccugccucaggcucccaaguagcuugcauuacaggugcccgccaccacgcccagcuaauuuuuguauuuuuaguagagacgggauuucaccauguuggccaggcuggucuugaacuccugaccucaagugagcugccggccucggccucccaaagugcugggauuacaggugugagccaucacgcccggccuauuucagcccuuuuuguggcugaauaauauuccauuguguggagggaccacauuauauuugucaguucauccgcugauuggauugaucuugguugguugcaucucccagccggcacgagcaggucucaugccuccugcauccugguggagguggcuggugggaggaucuggccugagacucuccugccgagguucaggaacgagccaggugauggggacaaguuggggagucagugcuggcaucucagaggaggggccugggcccugagaggagugcugggagggcagagugagggccaaguucagguuacagaagccgugagacagccggacaucugugguuugugaggcuuuggaaacacuuaaugcgcucuccaaauggggagucuguuggggaggcccuggcgggagccggggcuacauccagguccucggcuugguggccuuguucacuuauuuguucaggaagcagcagggugugggcucugugccaggccgcccuggagggcuguccuggggccagugagguccaagugugaugggcggaggcagcuguggcuugcuacgagccggccucagggacccaccggcuggcuccggcugcucucugcauucucuucagcucuggagagccgugugccagcccucagccucaguuuccucaucugcaaaaucgggacgaugguguccaccuugcccaugcugguggggucccaagagcuggugucuggggugagggagcugggggccaaaagcuccugcccuggggcauccagcuguccuuugaagaguaccccgagggugugacugagagccaguccccagcacccuuguccagauggggaccaggaggugggugaagauauuuggggucugagcucugugcugguugcccccgagggggccuggagcccugaguuaggagcagaacggggugcugguccuauccguucccuaccuggguagugggggcugccuuccuggguuggggguggggggagcucccugugucccuaagccaugcagaggcaugcgcauacgcgcugcucuuaggcauguggguggcgcucugaggucccugcccauuccccagccccaugugguggucccugugcuccagguccagccucugguuuccaguuuguccuaguuugucaccuuguagggggcaguugacacuuugcuggccugacucguggugugccagagcccguggcugcugggcgacugugccucuuucucucaguggcaagagccuuauuuucuaauagagccugaugggccagagguuccgccacagggacacuguucucugucucucgugcuuggggucucuugcuguggacccccugggagguuguccugggggugcggggauuguguuuucuggguauuuucuuauuugcucuauuggaguguauuuaauuuaauauauauauuuuaaacaucuuuuaguuugccuuaauguaauuuuuuuugagauuuaauuuuuuuuuuuuugagauggagucuugcucugucgcccaggcuggagugcagcggugugaucucagcucacugcaagcuccaccucccagggucacgccuuucuccugccucagccuccugaguagcuggaacuacaggcacccgccaccacgcccggcuaauuuuuugcauuuuuaguagagacgggguuucaccguguuagccaggauggucuccaucuccugauccucccgcucggcuucccaaggugcugggauuacaggcgugagccaccacacccggccugcuuuuuuuuuuuuuuuugagucuugcucuguugcugaggcuggagugcagugauucagucaccgcuuacugcagccucuaccuccugggcugaagcaauccucucaccucagcccgcaaguaguugggaccucaggugugcaccaccacgcccagcugauuuuguuguuuuuuguagagacaggguuucacuauguugcccaggcuggucuugaacuccugggcucaagcgauccacccaccucagccucccaaagugcugggauuacagacaugagccacugcgcugggccuuaauguaguuuuucuugugguuaaacugaggugaagguucacucaaggaggaaagugguuuuuagccuuuugaggggcucaaggaccccuucaaggauaugacaacggcuccucuccugagaaggugccuggugggggcggcacaggcuccacuccaccccauugcaagaauccagggcccugcagggcucagagcccucucccugccucccuguggggcauugagaggcacucaccuucugagggccucaguuuccuuuuuuuguaaaauagaaccagcugauuccaaucucuauggucucuucuagcacggagcuucacguuuuuucucccuucaggauccugaggccucuggaucgcuagagauugggggugcccccagaagaggcgcugcuucugugcccucccucaccccaccgugccuggcuccuuguuuuuuuuuuuuuuuuuuuuuuugagacaggagucucacucacgcccaggauggagugcgguggcacgaucucggcucacuguaacuucugccacccugguucaagcgauucuugugccucaguagcugggacuacaggcaucugccaccaugcccagcuaauuuuuguauuuuuaguagagacaggguuuugccacguuggccaggcuggucucgaacuccugaccucaagugaucugccugccucggccucccaaagugcugggauuacaggcgugagccaccaugcccagccugccuggcugauuuuuuaaaauuugucguugagaugggugucuugcuuugcugcccaggcuggccuugaacuccugggaucaagcgauccucccaccucagccucccaaaguguugggauuacaggcaugagccgcugugcccagccuauuuuauuauuauuauuauuuaauuuuauuuuuucucacuauugcccagcuccuggccuccaacuccugggcucaaaggaucuuccugccucagccuccugaguagcugggacugcaggcaugugccaucacacccuacuuuguacuuuugcuuuucugucuuugcucuuguuaaaagccaagugccauuucauaguacacaggugcacuugacagcauuuaccugauugaggaguuuuuccagccuucauugcuauuacaaagcaugcuugcucgugugucucugcauguguauaaguguuuuuauaggauacauuccuagucaaagaguguguccauuucuguuuuuaaagauauugaggccgggcacaguggcucauccagguaaucccagcacuuugggagguugaggcaggaggaucacuugaguccaggaguucgagaccagccugggcaaaauugggagaccccccaugucuacaaaaaauuuaaaaaauuagcugaguaugauugcacacuccuguagucucagcuacuugaaaggcugaggugggaaaaucuauugagcucaggaggucaaggcugcaguaagccaugaucacagcacugcaacagaucuagccugggcaacagagcgagacccugucucaaauacauacauacaagcauacauacauacauaacuccuaaaaggcuguagcaguucauaccugcaagcaucuacgagaacacacacuuuccuauauccucucugaugcuggcaauuacaagauuuugguuuuugguguuuucuuugguccaguuugguuaaaaauuauaacaccuuuugauuugcacaacccucauuucugguuuauugguauuuacuuuucugcaaauugccuacacuuauccuuggcccauuuuucuguugucuuuuucuuuucuuuuuucuucuucuucuuuuuuuuuuuuuuuugagacagagucucgcuguguccuccaggcuggagugcaguggcgcgauugccaucuugguucacugcaaccucugccucccggguuccagcuguucuccuggcucagccucccaaguagcugggacuacaggcaugcgccaccacgccuggcuaauuuuuguauuuuugguagagacaggguuucaccauguuggccaggcuggucucgaacuccugaccucaagugaccuacccaucuccgccucccaaagugcugggauuacagacauaagccacggugccagccuguuuaucuuuuucuuauagauuugugggaggucuuuauuugguauggacuuuaauucuuuguucuguuuguuucagguuucacugcuggucuguagcuaguccuucauccuuguuucuggugguacauuaucauaaagauauuaagaagcuucauauaaucauaacucuacuuuuucccuauggcuuuuuuccuaucccuuguuacuccaucuccagauuauaaauauauccuccauuauuuucuuccaggacuguuacuguuuuauguuuuacauucagacauuauucugucuggguuuuuuuuuuuuuuuuuuuuuuguauaugguaugagguaggggucuggccagugaauagggaguuguccaacaccuuggugggaugguccauccuauccauucauuguaaaugcugcucuuuuauguguaguguccacagacaccuggguccugauuccagacccuucacugugcuccacugccugugagugucuuuguguaccggaaugcugcugucuccaucucugaagcaucagaacauauuuuaagaucaguuauguaaauucccaccucauuguccuuuucaaaagacguauuggcucugcuugcacguuuaugcuuuuguggugaacuucagagccguccuaucagguuccacccuuugaucucuugaucuggggacgguaaauggugauauccagcaggugucagagggcuggauuuuaaauggccuccgaugagcuggcggucucaggcuguggaagugaauucaucugcugggugcaguggagccggccuugacauuuguggguuuugcugacauuuguggaaggcucuggaggugcccuuugugccgacuugcccgagccacuccugcugcccaacucacuccggugucugcucaggaaagaaauucuaaugcacacuaauuuuagcauuagcccgauggcaaauauaauuacugaguuaauuaucacuccccucccuaguuaaucccagagcaaaaugugggcaccuuucauuucuuccuugggauguaccccuguauuaguucagauggggaggcgguaccugccuggcaaagcucucaggaaauugcucaacggggcauuaauagcuaucugagcguguggccugggcuggaacacaccagccugggugcugggugucuuccaggcucuggccaccuuggguucugccccaggaaggagcagacugucuccucuaggggaccugaagcuuaacguccucacuguacgagauaguuuuggagcaagauauguucuggggcuugcuucugcggguaaaggccauuucuccaaacuuucccccagagcgaacuugcuucccaaaaggagucuggauccgggcguggccgugcugcccuggccgccuccucacuucagcuggagccuccgagcugacguccaugccuauuccuccugagcacuguagacacaggccccagcucuguccccugcccucuccuccacucagacucccugggcucugaggcuuuaccuacaggcccugcggugcauauucagugaaagccuagauucagagccaaugacaucagcuuuuacuuggucuccuugcuuucuggaaccuccccuuugcccauuuaucuuaugcucuggccagauuaauuuuucuccaaguaguuuucaucacauccuucccuuucucagacagucgugcccauucuccagcaucugaaguuggaacuuuuuggccuggcaggccgugccgcccugagcagaccugcccaucuucugccccuggugugggcacuucucuugccagaucugucuggaaccuuccaugguccacccaaccugggagggccuugaggacaggggcugucuucgucugcgccccucugccucuagugugaugucugguagaugaucaguaacuguucugaggccaaggccucaucuguccagggagcagaucuuacccaucuuuuaccuccucuggcucgaauucugcuggagcaugagcucccucuagccuagguuguagaacaccugucuggcuaugugacagcuucugggccaagugugaggacccccaugguccugcaguaagagcccauauuucuggggugugggaaacccaguguaccccaaagggacuugacugugaagucccggguccacgugguacccaccagccuccuagggcccagacuccgugagaugccacggugggggcuugggcauuugcagccuucacuuggcauucuuaccauuuucaggaaacuuuauauaaacauuuuuaaucaugcaaaaaaggaauuauggaauaauaaauguuuauauuaaaaagucuuggugguuuugauugauuuauuuauuuuuugagauggagucucguucugucucccaggcuugagugcaguagcacagucuuggcucacugcaaccucugccuccuggguucaagcaguucuccugccucagcuuccugaguagcugggauuacaggcacccgccaccaugccuggguaauuuuuguauuuuuaguggagauggaguuucaccauguuggcugggcuggucucgaacuucugacucaggugauccacuugccucagccucccagagugcugggauuacaggcgugagccaccaagccuggcuuggugcuuuuuaaauuuauuuugagauagagucugacucuguuacccaggcuggagugcaguggugccaucacagccuacugcagccucuaccuccccuggguucaugugguucucccgccucagccuccugaguagcugggacuacaggcacacaccaccaggcccagguaauuuuuuaaaacacuuuuuuuguagaaauggggucccuccauguugcccagguucauuuggaacuccugggcuuaagugauccucuugccucagcuucccaaaguacugggauuauaggcgugagccaccgcgccuggcuacuuugguacuuuugaguuaaaacuauagaguaggugacugagugauauuuuuaaugcguucucaagaauuugaacacgaagagagugucacccucccagguuaugcccccgggaguucaugcacuugccaccuggucgcugcucagggggcccagggaguuugcugcagugccggaggacuccugggucccggcugugccuccccgcagccgccugcucccuugggacacucauucauuugcuguggccacugccacccacaguccuugccucguagacuccacugcagcucugguuacaaagagcgaguggucagggacuccugaccugccaugcagggccccgugggcuugugguggcuuuggugccguccgcugcgucugccucuuagagcauggaguucuccuucucaggagggcugagcugcuggagcucuaguccugccgcagagcagcccccaagugcggcguugccugucccuguggagcaggugacuaccuggcugcgggcggaacagcaggccauggcucugguaguggucugugacagcauaucacccugugggacagauccccgggaccuaguggggugggauagugagagcugcguccacaggggaggcucagagacuugugugcccaguguggcccugugugcugacccagcugggcucugcccuguguggcccccagggugcccggcgugugcccugauggccuggggcagagcuccagagagccauggcuggccgagggcucacggauucucacccgcccccagugccucaggagacaccugggcagcgaacagcuugaggugugcagaggaugggucacgaugggagggaggcacaaggggugcuuuccaucucuuuggccaccaguuuuaauuaaaaaaaaauuuccaucuguuuugaaagguuuuauccucuuaaggaaaugacguuuauuaagcaacagccccuucugcucaucguccagcugugcccacuggcagagcagaggcuggugggauuccgccugcuccacaccaggaggugccacuuggcuucccagugucgaaggccuucuuggacucagcacaccuucacggccccgugggcugugggucccuggguugggcaugacugacuuggagggugaugagagaucuccaggauccaggcaggucuggcacgccacugggugcuaggcgcugggcucugggcggccuccuugcugugcuuuucucugaggguugagggagcccugcucagagaccaccaggugagcucugggggucccucugggcuccugugcccugcacagcccgguucugaccacagaccuccuccaucaggguggacuauagcccagagcgggauaccaccacgcccaucaccccccaccccuggagccccugaccaaggcccuucuggguacuuaaccagugaucugaucucaccacagucagggauuagggccucucccggagggcugggguccaaugguaugauguguuucaggugagaaacagguucagggauguccccagccucacuggcuguuguuggcagagcaggaugaaaggcagacgggaaugcagaauugggaucuugcccugaccccugugauccgugaggcccuugagcuagagggaugcacucagucgaagugcccgccucuugcuuuguguuagugugaagaggaggggugggcccuguucuauucuuggcugcccacagcaccuaaggccagcuuggucaccaaggcaugcuggaaggucaccacagguggcacagguggcuuggggugugcugggcagcaaccauuaugcagcaguggccuccaagcagaagcugcuguuucggacacccgagguauucccagccuccuuccccuaccccgagguuugcuggagucacugagggggcaguagcgagcugcaggugcagggucgggguccuggggguugcguguaugcgcagccuccagagaagcccaugcaggccccccucacccguuccugccugaccugcuguuguguccugcuccuagcucugcggucugggacaagcacguuaacugcuucagagcucaguuuccccauccgugauagggaaugaucuuuaugcucccacaggcucguccugaggcugcagagaggcagcguugaaaaguaccuagcucagggccuggcucagugacgguuagcuguuaggguuaccaucgcaucgcaauuguuacuccauagugacgaccccccggggacucuggacuuguucagcucagcugagaggcugcuuggccgaaaccaucucagcucugcauaguguggccugguggccuguggguugcgcucaugacaacguggagccuauucagucgguaccgagugugcguccuugccuagcuggccucggcauuuauuuuguagcuggagcccuggugggauggggucaggugggcucuaggagucugggggacaggugcagguaccuucgggugcgccuccccugggggccucugcuuugucagaaguauggcagggggcugagggcugacuaucuauuuguaggugucaccagagcaguccccgccucuccuuuucagaggacauuguugaggggacccugccaucugcgucugggcuggcugcuuccucuguggggggcuccucccggcugaccagcagcccuuucuggcccccugcaucagcgccuccccacucagcuucacugcugaaggcagggccagccugggcaccagguucuucccccucugcccaaggucccugcccacccgucuucccucgcccuggccgugacggucagugccuuugccccgcucugacgaccaggcccugugcgcaguuggcgcuccgugguugcugagagaugugcucuccagucugugggccagauggggccucugaaguggagggggcccacccucucuccugcagccugcuguggcuccccaucgccucugggaugagagcagacccugcgaagccuugagcuccuggcccuccagcugugagcccaggugggaccacccaguuacaagagcguuaggccuggcuguguaggagacgugugucuccacaccagaguccuugcggcauaugggaagccuucaugguccucaugguggggagggguccccggggaggcauggagucucgcuccuagguugcuguguggcuucagcgcucuguaccuccaugccccuguccugcagaugucaacacccaguugaggagaacguggacuuugcccaguguugugcagggaugguggggccaggcuggagcccacguguccugccuucgcccuggccaagguggggguuaucugcccuggccaagcugugccgcccgucccugcccgccccagcaggugggggccugcggugggaucccacccaugagcaguagaggcuuguugacuuacuggccucccaggcucccccuccaaagccaaguccuccaggacgguucuugccccugagaaggggcagugugggugcugggcugcagcgagccccucuucguuccauuuccucacagucucggggacggagggcuuguccuggagcacaggaccgggauugugcugagguccugggaggccacggucaugaggggacccagugaaggccaggaggggacaagcaucccuccagguauggggagggucaccccagcgccucugcggaucugacccacuggcugcggcuccugugcuugacccuuuuggcaaagauaugcaguggucuuucaguugcccccccuuaggcagcaugaaaacaauuuaacucuugcagaaagaaccugggaauugaucuccccugucacugaucccacaagugugacuuugcauugguuucuugguccccuugugcccagucuccccaucuguaaaauggggugacaguaguuccaccuccuaugaggacugagugaagucaggaaccagaagcagcucccacaugagacucagaaagugugacaggcguggaggguagggacccaugaagcuaggcccggcaccuuaggaagaagagggagcuuuccugcagguuucccccggacggaauguguuucguccugugcaccugccugcagagccccucgcacgcugucaguccacaaugaaugcuugguggaagaguucacccagggccugcaacaccauagugcucagcuucuccaaauucuucuuaacuuccagacucgacacguaaacuugauuccaaggaaaucaaagcugaucgucaacacuggacuuugcaggcagcucccaaacccacaugcauauuuacaacuaagaaaugccaguuccucaaagaauguuagccucugagaugcaucaggagaccaggaggcaagggguuaaaggcaaaccguggcauuccccaaaucuguccaguucccuggcaugguacagugucgcggagcccgagguggcaucuuuuguuuggcugcugauggcggccuucgggccuuggcauccacguugcugcaauuuuccaggaacaguagaucauuugaaaguagagcugccacguuuugcucaauaaagggauuuuguagagcgaugauaaauuuggcaugucuuuauuauuauuauuuuuucaacacuuaaagaaaauaaaagcugguacaaagguauguuuguuucugaaauguguuuccuuccccagauguucuuuucugccaguucuaaaaugcguucugagcucgguccuccaguuuccucccugugaggaagaacaaugagaccuuuguaaccacacaggggaaacggccgcuucccucugcagugggcaugggggaggggcugggacgucccaccuccucccaccucgauggaaaccacgagucugugccagcccagccgacugucgggggguuuggcagccuccuuucccauggugguaauuugcagggucauggcucaggggcaccgcagucugcaccuccgucccuggauccgugcguuugcuguguggccucgcaguaaaugcuuccaucugcguggcauuuauggacccuggggcuugguacugucuguguuaucuggagucgaacuugcccuuuuccuuuucugucugccuuucuugcaucaaaugcugguccccacccaaaggguagcccagucugcaggacacggcgcagagguagaguugguggcuucacgaggguccaguggggcacagaccuuccucggcugcucugucgcuuugugacuugagacugcgugggugggguaccugagggauccgugagcccgcccuucccacacgugugcaugcacacacacaugugcacagugcuucagaaguaccaccuuaguuggauuugaaggacagccaagagaccuguauaaagcuuguaguuagagucguuucgauacuggccugaauuaagagcagucuccaugggguugcugucugugggguacguguuuaaugaaaauccuuguuuuuaaauaaauguauccugcuuuagaacacccaagauauaaaaucuagacuucauagacaaaaauagcuaacauuuguuguguaucacagugugccaggugggcucuaagagauguuugauuucuuuaauccuuccagcugcccugugggcugggggccaucccuacccucauuuuacagacgaagaaacugaggcugggagaggucaauuaacuugcucaaauuugguauaggcaaaacuaggaauuggcagacggugguuccagugccugccuuuuaauugguacuugaauuauacgaguguuuucuuccaucaauaaaagaaaucggcgaacagccucccauggguuucaguaagugcaagcccuccuugucaucccagaccucagccugcccauuuaauggaugaagacacugaggccuggagggaacagugacuucggagccacucuccuggacucugccacuccucucgccucccauaugaaccugaguggccacaugacccugggggagagcuacucaacugucccaaggagagggugaugacugcuggccucccaccggccaucagcgccccacugacugacaccccugagucagucuccacccuggaacuguuucucucacuauuugccauggccuugggccgcuuccgggggcuuggcaaggcaggaggcguggaaccaagaugguauguaaucagaaugcuauauuuuguugaaaauaagaauguuaguaaugggcugguuucuggcaggucaaacugggacucugaaauacauauuuuucucugcucugcccuaaaccuucuaauuagugaaaacgcacauuugcagacaucaaucaaaugucauauucccuagcagcuuguccugggaucacugagcuggucacauuccacaguugcuaacucagggcuugcagaguaugugugcacgugugugugcaugcguguguuugugagagagauacaugccuucuggggagcccugguggccuguuuccuucccucccaggccccugagcuucugcuccccaccccgcccccagccccuugucagcacaugcgcggccacugcaaugagauacagacguucgcccaauuaaaacacaguuaguggaggacacauggcuuucagggaaaacugcuuucucucaggaagaucucugcugugcaguauuccauagcuagaccccagcuccacucaacaguggacuccauuaauagccuggguuuuggaagaggcgauuugcuucugguaacuggcuccggugcauggauguucccuccucuugcuggaaucucugcccgacccagacagugcuugugaaccagcccuggugggcuccaugggguucugggucugggaggcaaggacuugccuggggucauucucauucugcacggcacuagccaugcuggcugcaugaagccguaucacagagaccuguggguccuuuacaucugaucauccugucauuuguaucuguaucuggggugguuaguugcaaacaauuccacaguagccaaaucaagaaagucacuggcucucgcaggagcgcgauugguguggggcgagccuggggguguagcccaggcaagcccuucacccugaugcgcauuagccuucuuauccaggaaauggggggaggcggucugggcccagggaggggagcaugccaagcuggggaucuccaccgguccaggauucagggcgccucugaccguucucugcccagugccuccuguucaguuuuacuuuuguguuuuccauuucacuucugccucuaggccaguguuuuucaaaauauguuuccugaguggaaaugaaaaaauguucugugaucaggcgcaguugggaaauccuaggggagagaaagugaacuaggcuuccucaccgcaggacuucucagagccuuuaaaaugguaauuaugcuccaggccuugugccccucuaccuaggcauccuuuacugguugggaagagacggcagguuacgggugaguccggguaaguggaguugugccuaagcugauaaccugacgucaccaacacuguucugucaccuugcuuugguguggcuucuucacaguugucacaucugggccguuuggagugaccuagcaaguccuuugcuugucucccaggacuuuccggaguagccaagcagagccuucggccaguucccuuguggggccaggcccugcccgggagcacaggcaggagaacagcugccuccccgccugccccagggccuuggugucagggccauagcccccagcucugcgguggagcagcagggaccugccuggcccaucucccuguugagggaagacccggaggcgccuguccuguucugugugcuccgaggugucugaaaccagcuaccucauuuucuuuuuaucuuuugcaagugauuucuuauuuccugcuccacccccaaacgugcccccuguauguuuccuguucgccugcuucccugaccuuugaaauguggucccugcucgggaaacuugccuggaccucagucaauuaugguuuuccucugggcuguguguguguguguguguguguguguguguuugagugugcaagugugugcauuaggauuagagagaauucgauggggggccaggggccaacaggaauggggguggcugagcugagaggccaagggcagguuccagguugcauugagagccgaagcuggugagugugaggcgggcagaugugagguguguguggggaguggggugcugucugggugacugggcugggagagggcaggugggggccaagcuggaagaggugguguuauucuguagcaccugauguacacagaccuugggggugcagcuccaggcuuucucucuccccacccgccccugaaggccccacucucccgccuucugcagccagccuuccuuuugucugccccugagcuccuccgcucuuguggucguuaagaaaagcuuuuuauaauccaaguugguuugggaagaggcaaacuguccuuucccaacagucauaugccaacccuggccacaucuauucuggauuugaagcaaaauaugguauuuauucauuauugucaugcaaaugucagcagcucgcucauucuugauggagacagcaccuggaaugggagggauggguccacggccagcauuggaggugcucggccccagcacccgggccuugcucugcaggcagcccugcucugcaccgggcccugcucugcaccagguuccacuggguggcaucagccaugccugcccugaggaggugaagugcgggcucucuccagugaaggugcagaggcagggugagcuggcgggcuuacggaggacgugggcuucaccuggguccaggaggccaggucacauucagccaaguauucaucagcuggguguagagaccagggaggguuuuuaggggugggaauggcuggaggcauggagguggucaggguggagucuacgggagacuuggucuacucuggugcggugggauucauguagagagagcccuugugggcugaggccaggcugugggguagaugggagagaccuccuggcuuagcagguccuuggguggauggauggacggauggagggauguugggggaauuggugggauauagaugguucagccaagguggaaaugggggaguagagcuauuccuggggugcuugaagaugucagcaaguaucccacuccagcuugaguuugcagagcuuucucuaaaaggcagaacaugugcuugguuaaaggaaacccaagauuuuauuauuguuguaaaugucaagucccucauuuugaaucuuuagacaacugcagaauugugucacugacuuggguaaaagcccaaggaaaaacaugaaauuauguugccaaaauugcggucaucguagcugcaugaggguuugaguggccaccgccaccccaguaggagagacgcguagauguugaauacacugugagcugcgugcagguaauugaaacguggauguggggaaggucccuggcuucauggaacugucuacauaaaagcgagccuggguguuuccuguuucuucuaccuuaagaaauuuccacgagaagcuaagguaugguuuugccaagaauguuguuaauggcccagcaaugaauauuuucagccacuuguagacaccugaacuucauucuuggcaaacagguguaugauucuuggacuuggagagacugaacuuugcugugcucagaauggaggagaccagcucacuuguacuuugauuucucccuggucccugucauuuuagccugaucagugcuuuuucaagcauuuccccuugaaggggagauaggacuuucuggcucagggauggggaggcuuccaggcagccuuaaacauugucccugccccacccuaaguaucuuugaaguuucauguuuuaucauaaagucugugagaauguugcagacuccguuauagucaugcuaguuuuauuuuuuuaaaugugguuugaauuuuauauaaaguauauggauuauaucugagaacuaauaugcaaggccuguaugcaaaacauaauacaacuuuacagaaggacauuggagaggacugcaguagauguucacggauaggaagacaggagauggagauggcaguugcccccagauugaucaguggauucagugcaggggccggcagugcgcucuccucccuguucuuuccucccaccccauugcacaaauguuggugccuggcauuuaaagaagcagaccaggcgcgguggcucacaccuguaaucccagcacuuugagaggccaagguggaucacuugaggucaggaguucgagaccagccuggccaacauggugaaaccccaucucuacuaaaaauacaaaaauuagcugggcgugguggugggcaccuguaaucccagcuauuugagaagcugaggcaggagaaucacuugaacccaggaggcggacguugcagugagccuggaucgugccacugcacuccagccugggcaacagaguaagacuccaucucaaacaaauaaauaagaaauaaagaagcagcaugucgaggguggugcuauguagaggugucgggggugauuggcauccagcauccggaagcaaggugggguagggugcagaggugacugacagcagaggcuacuggagcagaugggaagcugguuauggagcuaauaaguaaauugauugagcaaauaaguaaacauauggauaguaacacaagccaggcuuugcacuuuggagaaggugcuuacaaacuuggacgagacaguacccagacacauagcugaaacuguagguacugccacacacacaugcacagaaauagagaaauagucauagaugcauguguguauaaaaguguauguaggcuaggcacggcagcucaugccuguaauuccagcacuuugggaggcugagguggguggaucacuugagguuaggaguuugagaccagcguggccaauguggcgaaacuccgucucuacuaaaaauacagaaauuagccgguugugggggcacaccuguaaucccagcuacuugggaggcugagaaucacuugaaccugggaggcggagguugcagugagucgagaucacgccauuuuacuccagccugggugacagagugagacucugucucaaaaaauaaaauaaaauaaaauaaaagugugaguauacauacacacguacaguugguucuuguuauucuugaaaguuaugcuccauaaagucacugggaacccugaauuauugaauacugaaccauugcuccuaggggaaacaucgggcuagguuccugugagccucaggucacaacguuuuugccaacuguucgauaccugaccuggcuuuuuuuuuuuuuuuuuuuaagacagcgucuugcugugucaccccaggcuggaaugcagugguacaaucaugggucacugcagccuugaccuccugggcucaggccauuuuccugccucagccucuccaguagcugggacuauaggcaugcaccaccacaccugucugauuuaaaaaaauauacagaugaggucuugccauguugcccaggcuagucucaaacuucuggccucaagugaaccucccaccuuggccucccaaaguguugggauuacaggcaugagccaccgcacucagcccauaaccuugucuuauguguguuucuaagacaccuuauuuaggcugagugcaguagcucacgccuguaaucccaacaguuugggaggcugaggugggaggaucacuugagcccaggagguugaggcggcagugagccaaggucacaccacuggacucuaaagccugggugacagagugagacccugucucuaaaaagcaccuuauuuacuguauauuguugauucauuaacauugaauucauggccaacuacgcuauaacucauaccugaauaaagccucucaugcauauucucucuguaaggcguggggcagccucaugcaccuaggagcacuacacagcagcauaugugcaggggacauuuuauacagcaaaauugcccacaaaaagcacagugauguggaaagcauggcacuagcuagaccgagagaaggacacuugcuuacaucucgacagccggagcaagaagauggggcguuguggccucaguugaccucaguuuggaacgugugauggugacucaguuuuuucacacucugcaagucagugagugauugcagaagugcugugagguuuaauuugggggauauaaauaaauguuagcaaguaggcgagcucaaguacggaaucugggaagagggaagacuguacguguauauccuaccuccaucagcagagaggccuagaagcaaugaccccaaguagcagugagcacaccagagcccaggucuggguuucugaauaccauucuccacccaaaggagucagagcuuguccacgaagaagcugguucuagggcuggggcaaggaaagguacaagccgagcauggggcaucuuauuguguaagaaagcaaagaaguucuggaggacugguggggaccucugggacagaagagccagcuuagaggggugcucacuguccaaaucuaggaauauuugaacgucaaaauguuguguacaugccuuagcgaccaacccacauuuaaaacaaauuccugaaugagggcuguaacuguagucccaagucauucuuuuuuguagcucauaauagcccauaauauuacuauaccauauguuugcauuuaccuauuuuuauuuuauuuuauuuuuuugagacagaguuuugcuuuugucacccaggcuggagugcaaugguacaaucucagcucauggcaaccucugccucccgguuucaagcuauuuuccugccucagccuccugagaagcugggauuacaggcaugcaccaccacaucuggcuaauuuuuguauuuuuaauagagacagaguuucaccguguuggcgagacuggucucgaaccccugaccucaggugaucugccugccuuggccucccaaagugcugagauuacagucgugagccaccgugcccggccugcauuuaccuguuuuuaauugugguaaaauacauauaacacuuaucgucguaaccauuuguaagcgugaaguucaguggcauuaagaacauucauguugcugguaaccacugccaccauccaucucccaccacaauuuaauaaaucauugaaaacagacuuucuugaccacaaacaauggugcagcagaagcaucauagaucucugucuguccugcuggcugagcuguggcauccuuccuuuuuuauauuguaaaaacuguaaauaaaaugccauaaaaacgccagcguugaucuuuguggaacuugcggagcugacuguagaauguguuggggguauaacaggaccagggcagcccagguguuucugaaggagacgaaucgggagggacucgcuccgccaggcaucagggcagauugcaaagccuuguuuuugcacaucaugccgaugcgggguggacaguuagaccaagaggagcccggaagcagacccaggcuuuggcaucaggagcuuuggcaucuggcagaacuccugucccugggguuggggugugaggaggugugcaggguaguagcgugaauaacugcuuugaggagcugaagcuagaaggugcccagagcuguguuaggugucagagaaguuguuugugaggcauugugaguagaauuaaguaacuugagugcguaauugccucuggggaucaggccugggcaugcucaacauucaccaagucauguuuguuuuucaaugcuccagcucuuccuccuccaggaagccugcccagucuacccacagccaggucuacccacagucagcccuuccucuucuuagaagccugcccacucuaaccgcagccagaucuuccucugucuaggaagccugccugguucacccacagccgugucuucuuccucuaggaagccugccugguccacccauagucaggucuaccuccuccaagaagccugccugauccacccacagccagaucuuccuccuccaagaagccugccugguccaccaacagccagguguacccauagucagcucuuccuccucucggaaaccugccaacuccacccacagccagaucuuccccaucuagaaagccugccuaccccaccuacagccaggucuucuuccuccaggaagccugccugggccaccugcagucagcuuauccauccccaggcuccaggcauuaccuguccaugcauucaucccaccuuuucuucuugggugguuuugugugugcguguguguguguauguguguauauccugcccaacuaaccugcaggcuccuugacucuggagcccugaugucuucuguuucucugucucuuccaucaugcuggcacuggacgcaggaucauuccugacugauuaaucucuagcuuguguccaggcugcagcuugcuccgaugagcaguuggaggccuaguguaaugcuuggugaauauauauaaggcauggacugaaaauguugcuuauuuugguauaguagcaaaggauuggguuaccuugaauugagucuuguuugguguaaccauguaaauaaacaguguaaaauauaggcuauuggaauggaagcccagacaucuguuaugaauucuauauauaaauauuggauaugcuuacauggguuaaaaugagauuguuggcacuuggguuuucaaacuccugauucugcuccggguaggacugaucacggguccugggacucaaggcaggaggggccacgagcuggccuuucucugacacugacuugccagaagugggcguuccugggaguggcagacaugcacccacuagagauagaucugaaucacccccucacauucuccuaauagugccaagaacccacagcagagugcgggguguacugaguuugugcugagcaggggugccugaaucccggauugaagaaaguguucuacgcccgauuaaaccaacugggaauccaggcaaaagaagacguucccaggggaagccagccugcccagugugcauggugccuuuuaaacaaauuaucugcauucccauugggaugaaguucacuugacaacauuacucauugguuuuuuugcuuuuguuuaguuuuuuuuuuuuuuuuuuuuuuuugagacagaaucucacucugucacccaggcuggaguauaauggugcaaugucggcucacugcaaccuccgcuuccuggguucaagcgauucuccugccucagccucccgaguagcugggauuacaggcaugugccaccacaccuggcuaauuucuguauuuuuaguagagaugggguuucaccguguugcccaggcugcucucaaacuccugaccucagaugaucugccugccuuggcuucccaaaguguuggcauuacagguguaagacaccgcgucgggccuuuuuuguuuuuguuuuuuugagacagagucuccuucugucacacaggcuggagcgcaguggcacaaucucagcucaccgcaaccuccaccucccggguucaagugguucuccugccucaguaucccaaguagagcugggauuacagggacccacccgccaccacaccuggcuaauuuuuucuuuuuuuuccgaaacggaauuuuggucugucgcccaggcuggagugcaguggugcaaucucagcucacugcaaccucuguuucccagguucaagggauucucuugccucagccuccggaguagcugguauuacaggcgcccuccaccaugcccagcuaauuuguguauuuuuaguagagaugggguuucaccguguuggccaggcuggucucgaacuccuuaccucgugauccgcccgccucagccucccaaaguccugggauuacaggcgugagccaccauaccuggccauaauauucguuuuuaugcaucauuccuuuuuauggccccucucaccuccgucagguggugaauagacuacguuucauuuauccguucaucgguuauggacauuugagcuguuuccauguuuuggcuuugugaacacugcuguuaacaugcguguaccuguauguguacauacaugaguagagggguucaguucuuuuggguauauauguaggaguggaauuacuggucauaggaucauucuauguguaacuuuuugaggcacuaccaggcuguuuuccacagcagccagaggugucuuuaaaagcaguugucaacugggcuugguggcucacaccuguaaucccagcacuuugggaugccaaggcgggcggaucaccugaggucaggaguucgagaccagccugaccaacauggcaaaaccccgucucuacuaaaaauacaaaauuagcugggcgugguggcgugugccuguaaucccagcuacucaggagacugaggugggagaaucgcuugaaacugggaggccgagguugcagugagcugagauugcgccaucauacuccagccugggcaacuagagugaaacuccgucucaaaauaaaaauaaaaauaaaaauaaaaggaaugaucacuuccuguuucaugaaugaggaaacugaggcucugggagaugggaaauccugcccggaaucucacagcuggaggccaggccaggcuuugaauccaggcaacugagucugaguggauggugugugcuuuguguuggagcuggcccagggcuggaugaaggcaacauuuaauuaaugaaaaccacuacccccucccggcuguuaccucuugagcgcuuuucuaugaagcauccuguuuaagccucgcacucugugauguggaggugcaguaauuauccccauuucacagacaggauguugaggucagagggguugagugauugucaugggccaggucucagccaggcuugcuaacccuggagucugccgucugcucugaaguggucacucucagcuggagagcugaccuggcccuuuugccuuugugauguacgguccugaaaaaaauauuugcagaaauagcuucauaggaacauauauggaauuuggaauuaaaaaauauauuaaaaacuauauauuuaccaguauuacaauauauuacccagagacuugucucccuaaugaggccaccuuuacuuuuucaaucuuugucuccgcuggugcuuucucauaacugccauucauucuaguagaaaucaugguucacgguuaugcugggugugugguuuuugguguugacaugucgaacguuuuguuguuaccgcagucauuuuguuacuaguuaauuggugcuaccuuuccacggagacaauagucuaguuaccccugccgcuggagauuguucuuuuuuuuuuuuuuuuuuugcuauuacaaauaaggccucagcaaauauugugacucagacguuuuccuucuuucugguguuucuugggacagacuccugcaggggugaucccuggggagagggcguaauuauuuuauguucaugaugcggcagucaccaccguguuucugaaagguuuguucugcacucugggcugccaguugacauucgguuuuucauggugaucugguggguccuggggugugaugguggccgggcccagcugcuucagcccucagccuguccaucccccacccacacccagaacugaggcuccaaggugcagccucaggugucugccacccugugcaucccucaucgccccaggucuguugcccucccuucuccuccuucucaaauuacgcugcccagaggucaggcuagaggucagcagguccaucacuggauggaaugaccuggggcaggccaagguaucugggggcuguguagcugugaccccugagcuucagggggcugugaaacgagagaccuugggcacaugggcacaugacguggugggaaggcgcccagaggaccagcacccgccaugcuacccccacacucugcuccagugugcucccaccccaggaccuuugcccaggccugccggcuccuucuuucccagcaaggccugcucugucucagguagcaugcagccccccgacccacuucucauguagcaugcagccccccgacccacuucacccugcaccauuucccugaucugcagcguuuaugauguaacauuacuaagguguccuuauuggcuauguguauugcuuguuuauuaccacccacgugaauacggagccauucaggccguguccugggugucugggugggccagcuggugcugggcacucgccugcuggaggagugagugcccauggccagccccuccuggugccugggcugcgucuccuccuuagugugcugccucuacaggcuuuucuccugaacuguccucuuugcuuuuuuuuuuuuuuuuaagcuuuaaaagaaguuuuuguagagaugcggucuugcuguguugcccaggcuggucuugaacuccuggccugagaugauccucucuccucggaaagugcugggauuauaggugugagcuacggagccggcccuucccuucuacucugcuacucugcuguucucucucccucccgucggguucugcuccugccacguucuccccucuccccaccaaaggcuggguuuucuuugucagggcuccuuuccccuuuggagaagagggggcuguagggccuuggugcgaggcccuccagugacaggaucccccaucacccagaguuccacaggcccugguagggaggagggggagcagaagaggaggugccaucuuugccugcuggggaagggcaggggccacccacacagagcucucccauuugcuguggacccuggggccacugccaguuccuuccaaaggaaagccagcuccccagguggugggagagugauguggcuuccucuuaaacuuaggaauugagugugugguugcuucuaagugccuuagaagccggagcggcuccuggaaagagccugccugccacagcgggccuuacccuggcugugcccacagaugucccuggggccugccgcuccugcccggcucuccuggccucccccgguguggguugggaaaagcacagcaaauuaaaaaacaccuccaucucuggccuuugaagaaugcaucugaacagccgagaguguaaaccguggugaaauguggucuuuccaguuuggggagaagcagggcagagcuggggcuuuuguacccaggguuuccaagagcuccugccucccucggcugggcuggccagggccccccgcugggaccuccagcuguaauagggaagguuuuacuggguugcuggccacuguggacugccccuaagggcagguaugccugccuuuacccggguuccccuccugccuggaagauacagcccaugggaggccuguugucugugggauccuccagcaucagagacacuggggccagcgucugccuggugaggugcaggccuggcaggcccggucccccaccugcuugagcacccacgguggugggggcucgcugccucccgagacaaucuaugucauuguuguccaaggaagcuaauuuagaguagaaaguuccguguccagucccacucugugcguguguuagcaggggacucucgggccggagcuggguccacccugguagggggacuucauggggccugggcgacagcacuguguauuuguguguguguguguuugugugugugugugucugaggagguggaccaguuucucaaaaggccugugaccccaagaaccaaggaauuucagccuggguggaucacaccuucacuggugagugggacaagcugggggcccucgccacaggagcagccagggcauggggcacaguuggccucauucacaaaaugggaguauaagugaucccugcucuggcggccaggacgaugagugggaacacaccgugugggggcugccuggccugggugugccgcggguguccuuguuggugaugguuccaccugcuugugccaccagugcccucugggucucacacacaacucucuucccagcgaaggccccuccugcccucaggccucagugcugcuuccgucucggaaggccccaggagcuccugcauccugggcgugauuccugugugccugcagacccccucgcggcugccaucucauccuuuggugcaccuguuggccagaccuccugguagcgggugcugcacuccccugaaugugccggggccugggggcagggaccugggcuccucccucacugaguggagggaacucagugucuuggaguuggggugccugcaggcuggguggugcaggugaaaugcagaccucucagcugguguuccagagcagcugccuucccccgcccgagggacuucacccgcagcccagucagggguggcgccugggugcaucgcccgcaggcuggguagggguggagccuggguggcccugccugugagcugcauaguugucgccuuugacccugaguuuucuucguuaucuguuuggaccuguuuggggcaggcaggggaugagaucugaagauaaaugccuuagcugugaccaucuccuuuugugagaggucaauguccaguuccgcugcaguuauaacaucccauuuuuugauuucuuuuuauuuuuuccuuuuucuuuuugagauggagucucgcucugucacccaggcuggagugcaauggggugaccucagcucacugcaaccuccacuucucggguucaagugauucuccugccucagccuccugacuagcagggguuacaggcgugagccaccacgccccagcuaauuuuuguauuuuuaguagaggcaagguuucgucauguuggccaggcuggucucaaacuccuggccuuaagugaucugcccgccucggccucccaaagugcugagaugacaggugugagccaccgugcccggcccagaacucuuuaauucccaccugaaacuugccgccuuaagcagguccccagucucccuccccuagucccuggucccaccauucugcuuucugucucaaugaauuugccuaccguaaguaccucauauaaauugaaucauaaaguauuugucuuuuuauaucuggcuuauuucacuuagcauaacauucuuaaguuucauccauguuguagcaugugucagaaucucucucuuuuuuuuuuuuuuuuuuuuuuuuuuuuuugcagacagagucucgcucugucaucuagacuggaguucaguggcacgaucucgguucacugcaacaucugccuccuggguccaagcaauucuccugccucagccuccuuagcagcuggaacuacaggcgcgugccaccaugccuugcuaauuuuuguauuuuuuguggaggcaggguuucaccaucuuggccaggcuggucuugaauuccugacuucaggugauccacccgccucagccuccccaagugcugggauuacaggcaugagccaccgugccugaccagaaucuuuuuccuuuuugagacugaauaguacuccauuguguggauggagcagauuuugccccgcuauucaucccucaguagagggacgcuuggguugcuuccauguuuguuuguuuuuuuguuuuuguuuugcuguuuuuugagacagagucucgcugugucacccaggcuggaaugcaguggcgcaaucuuggcucacugcaaccuccaccuccaggguucaagugauucuccugccucagacuugugaguagcugggauuacaggugcccgucacuacgcccagcuaauuuuuguauuuuaguagagacgggguuucaccauguuggccaggcuggucucgaacuccugaccucaggugauccacccgccucagccucccaaagugcugggauuacaggcgugagccaccaugccuggcugccuccauguuuuagcuguugggaaggaugcugcugugauccaagguguaugcauaucugauugugucccuguuuucaguucuuuuggguauauaacccaaagcgaaauugcugggucauaugguaauucuguguuuaaguuuuuggggaacugccaugcuguuuuccauaguagcugcaccauuucacauuuuugccaguggugcacaaggguuccaguugcuccagauccucaccaacacuugcuauuuuguuuuuuugauaguagccguccuaauuggugcaagaugguaucuuauuguaguuuugauuugcauuucccugaugauuagggauauauuaagccuguuuugauguguuuauuggccauuuauaugucaucuuuggagaaaugucuguucaaguuguuugcccauuuuugaguuggcuuaguuguuuucucauuguugaguuuuaggaguucucuguauuucauggauauuaaucucuuaguagaucuaugauuuggaaauauuuucucucauucuguggguugccuuuuuacucucucgauagugucuuuugaugcacaaaaucuuuagcuucccaugaagucccguuugucuuuauuuguggccuaugccuuccuguuguuugacuuucacagugucccucguugccacaaagaacuguagaccuaagaugaugacagcacggguggggcggcggaggcgccgcugucauuuuccuggccucagguccucuguguguccucccauccuguggagcaugucuccugggaaugggaggggccaggauuugagccagugcuugucuuggcagggaggccugugcucggaaccaucuaccccacugcgcuggggucuccugggccaugcucuggcccuuuguguucccagcuacccucauagaggcugcaaaucuuuccccugcugaaaugaaaccaacugaacuaacuacaggauucaguucugugauugucauuggcugaguugaguuuguuuuggcuuucucuuucuuggugaaggugggagugugggguuggcugggcucccccaucugcgcaggaggacccaggggucugcaguuuucaugaggaaugucagcuguuucaagccaaggcuucagauguuuuuuggggguguuuguggccagcccagccuagcccugcugacagcagacacggacugauggagcucccuggaggcccuuaaccuccuccuguccacaucuuguguucacuccucauguggcuucuuagucccucugagucuguguuggggguugcuggacccuccugguccgacgucugaggugucugguggggugauggucugaaggccucuccugauuucucauugagcccguugugggaaugagaccguugucugugagaugaggcuucuugcacaggcagaaggggcugagggcugcggugcagagggaggugagggagccagccuggccgcaggcagaucaggaaugcuugggguggggugguggagagaaguguaggugaggccagaggccaaggccuuggaggccaggcuagggggucugaccuuguucugcauggcacuggcacagggagcuguggaaggugucugagccaagggguggcauuccagagugacccuuuaaauguaggaauguccagaagcagggugggagaaacauggaauacagggguggaugggaagcugaugccacggccaaggaaacgggccugagcuuggacaguggucaaagacuuguaagggaaucuugaggcucugucuggccugggcucugaaccccucaaaaaauguggcccuguggcugggucuguagcgagcagcauggccagugcugugccugcauguccccauccccugugucaggccaacaaaggggauguggcuucucugcagaacaggacagggccccuguagccucuggaggacgaugugggagguuuugggcauggcaggaagggucacccauaucugggggaacagacguaacaguugguaaacaaacaggugcugucaccgaaugugggaagaaggcuguuugcugcgcugcaggagccucugaaugaugcgggccggggcugcccaggcaacuuccugacaacgccuuaggggugggaggaaggaacuggaggucuugggcaugggcagggcaguaccaggagugcucugggcauagugcuccaucccagggcuguguaucuugcuggcuuagccaguggcccucacgguuugcuucugccccacagccucgccgcuccugcuauuugccaaccgccgggacguacggcugguggacgccggcggagucaagcuggaguccaccaucguggucagcggccuggaggaugcggccgcaguggacuuccaguuuuccaagggagccguguacuggacagacgugagcgaggaggccaucaagcagaccuaccugaaccagacgggggccgccgugcagaacguggucaucuccggccuggucucucccgacggccucgccugcgacugggugggcaagaagcuguacuggacggacucagagaccaaccgcaucgagguggccaaccucaauggcacaucccggaaggugcucuucuggcaggaccuugaccagccgagggccaucgccuuggaccccgcucacggguaaacccugcugcgacuccaccuggguccagggggcggggagugucaccaucucucucucgaauuugcaugagcccaaguuguuuuucagaaaaagggugugacucugaaaaugaacccguggggggguuggcucaggccuguaaccccagcacucggugugacucugaaaaugaacccguggggguguuggcucaggccuguaaccccagcacucggugucacucuuaaaaugaacccguggggggguuggcucaggccuguaaccccagcacucggugcgacucugaaaaugaacucguggggggguugguucaggccuguaaccccagcacucggugucacucuuaaaaugaacccguggggggguuggcucaggccuguaaccccagcacucggugcgacucugaaaaugaacccguggggguguuggcucaggccuguaaucccagcacucugggaggccaaggcgggcagaucaccugaguccaggaauucaagaccacacugggcaacauggugagaccccauuucuacaaaguauacaaaaaugaaucgggugugaugguaugcaccuguaaucccagcuucuugggaggcugagguaggaggaucauuugagccugggagaucgaggcugcagugagcugugaucccaccacugcacuccagccugggcgacaaagugaggagauccugucucaaaaaaaaaaaagagcucagcuuucaagauuuguuauuguugaaggaauuacuuccccuugagauuccauaguuauguuccuuuuuuuuuuuuuuuuuuuuaauugagauggagucucccuuguugcccaggcuggagugcaguggcacaaucucggcucacugcaaccuucgccucccggguucaagugauucuccugccucagcuucccaaguagcugggauuacaggcgcccaccaccacgcccagcuaauuuuuguaguuuugguacagaugggguuucaccauggugucuaggcuggucucgaacuccugaccucaggugauccacccaccucggccucccaaagugcugggauuacagacgugaaccaccgugccuggcccauaguuauguuccuuuuuaaaacuugcaugucugaggcaaccgaugugguuggccauggguuugaaugguuaaacacaucuuugcuguguguauggugggcggccugggaagugcggacgcucaggcagguggaauuugcaccuucuccuggcuuucuaauugcauuggcugaaaaagugcagcuccuugucuggaagcagaaccugcugggagugguucucggguccguucuggaagcugcccuguguccuccucagcuccuagucuggcugaguucaccugggcccuugaaggcucagggccuggccgugaucccagguggggagagcguggguggcaggaaagcuuuggagucgaaguccgggguggagaguuuaaggggagguggcccagcuccacuggccagcuaggccaggucaccccagacucccgagcagagggaacaguuugcuuggccaccccuugucccuccuuugucccuuuucuugcagccugggagugacucugggggccguacacacacccuuaccugggcugugcuaagcccuggcccuugcugaccugucagguucugugcugggucagugucagaacugguuggcagaggucuugacuagaacacaagagccauuucccaccacccccaggcucaguuggaagcccuuugccuguuaguucauucagugucaccacagucucucagcacucccagccuggaccucaccgguugaggggccggccuagaucuucuuugcgcaauggcacgaucucagcucacugcaaccuccaccucccgaguucaagugauucuccugccucagccuccugaguagcugugauuacaggcgugcacuaccacaccuggcuagguuuuguauuuuuaguagacacaggguuucgccauguuggccaggcuggucucaaacuccuaaccucaagugauccacccuccucggccucccaaaguguugggauugcaggcgugagccacugcacccagccugaccuagaucuucuagguuagaaagucccaggagugggcggccaugcauccaggccugccacaggagcccgccugcccuccucccugaagucagggcucuggaagcccuucccuuggccaugcccugugggacaguguccaagcucuggaguaggacugaagaccccugggcucuaguccuggggccaccaacuugcuguugcccuuugcagugaccucccccugacucccauggugccggcugcaggagccgggcgggaggggcugguugccagauccugcagaugccccuccucugggccugcccaggguagugggaaugaggguguggggugagggucuguccucaccaaggcugguguuugggagcucaggaagcagagugccauguggccaaguucaccucuuugaucuguguggugacuuaggaagccauugacuggcuucugacgagcaugggaagggcuggagccuuucagagcccaacagguuugugugagagccaggcgugugugugucugagcaacugagugugggagugggaggaugugagcgugugugugugugugugcgugugcacgcauaugcgugcauacgugugagccuguguguguccgugugugugcaugcaugcgugugaguggauauuuguguguguaugagugugcgcaugugacugugugugcacguguaugugcccgugugagcgaguaugugcgcgagagugucugcaucugaaccagucuguguguaaguaugggguaccagcaggggugggacacgguggaauuuaucgccaaaguauuuugagucccugaggucaggccagagcagccucgugcccccacuaccugagaagugcccccggccucccaggggugcugugcugggcaaccacucaucccuggagccccucguaugcccucgcugcccuccgagugggcuagccaccccugcagcugccggggagccagcugaccuccggggcagccucuguuccgcuuggugaacuguugcccucucagcccucucccccugcacuguggcuccaggagucgcgggguuacugaccuucuuuuuggaagggucggcugguguagcagugucucuggcuaggagggggcaucugcaguagucggagaggcugaagauagcagcuugcuagaagcccucucccagggccggccugcgguugcucaccagcggcugccauggccaucgugucgccaggaccugcgcuccuccugucauugcguucccucccagcgugggucgcugcagcucccucaccucccaaccaggcauccacugcauuugugagcccuugcgccugguccugcuccccacgcagcggguauagcccagucucuggcccuuucagugagugggaggagaugguaaaugaauaguauuugaaagggacgugugcguagggggauaaagcagugcuugggugcuguggcgaggggcuuccgucggagcucaggugcugggaaggccucuuggugacuuuugagucgagacuggaagcagaugaggcugagaaccguguggcugucugggggcagcgcgguccaggcagagggaucagccagugcaaaggcccugggcugguuuggggcggggccuguuugaggggcuguagcagaauguagggaaacagggcccaaggugugaggagaggacacaugaggucucgagcagaggaggugccagcucugacucgugcuggaaggcauccccugguggcuggagcgagagugagcugugggguggguggcgugggggcaggagcccucuccacgguuauuaccgggauccuggcgacagaaagcagcagcggggacaccucacuuguggggguaaggaguggcgagauuugggaucuguucugaagagaaaagacagcuggauuugcuggcacucugcauguagguucgauaaaaagaugagacaagguuggcacggugccacucugugccucaguauccuugucuguacagaggcgugaccaugcugcaugucaugaggaaaacaccaagaacaguuugugaguucaacaaauguuagcugucguuauaauaaaaaugcccuuuccucgccaccagaaguccagucuccaugccuacgugguuuugucuuuuuacuucuuuauggcuuuugcuauguugguugggaagugcucagugcuagguugggaggugaucagucgggaggugcuaggugauuuguugggaggugcaugaugcucaguugggaggugcuaggugcucgguuggaaggugauugguacuuuguuaggaggugcuuggcgcuugguugggaguuguugguguccaguugagaggugcuaggugcuugguugggagguauuugauugggaggugcuuggcacuugguugggaggugcucugcacuugguugggaggugcucggugcuagguugggaggugaucaguugggaggugcuagaugcucuguugggaggugcaugaugcucaguugggaggugcuaggcgcuugguugggagguaauugguacuugguugggaggugcuuggcacuugguugggagguacuuggugccugguugggaguaguugguguccaguugagaggugcuaggugcuugguugggagguauuugauugggaggugcuuggcauuugguugggagguacuuggugcuugguugggagaugcugggcccuugguugggaguagucuuucccaugcucagaucugagcuggcuuugccugcaucaucucugcgagccaacugucccuguuuggcucuggcuuuucuuaacuauuugaaaugguuccuuuacaugcuugccucugaauucucucccagaagcccuccccaggaucacaccuguggcuguucacucccaccccugccccuggggcaaaguugaccuuaguguugauuccugggccucuccccacaccuucccuuugcuccagucauuugaaugagagagugaaaacagugagaugccggcucccacucaucagauccagugaugcugaugacgccagccaugguccuacccugaggugcugacucugucccuguaggcuccaugucuccggagagggagagggagagggagaggauuccagccugucacagcgcccgcggcagcaaccccugcucgccaaauacugacuugaauagugguccucaggcauaagugugggcgcugaguccuggggcaggacugcuguccugagaguggggacaguggaggguggguuuguccucuguccuggccacaggcacacgguugcgaggagcaucuuggccuuccucccggcccugcuagagcccccgucaucuccugugcccuccugcagugcugucccccaccaggguccuuccucagaggaggggguuccugccccggccaucaucaggaagggggucucuggguccgagcguccaccucagugugcacguggccaaaaggaucaagagcccugcagccaggggggccccuccugagacucgacuucguugcaguuucagcaaugcagguggccccgugcggacauccaggcaggguugagggaaggcacaucccucccaggcccaggguacccauguggguggcagagcgggcucuggggaugacccucuggccccugaggaucuggggccagaaagacacuggcuuagcaugggaggaguccccggccuguaccagccugacaaggggcugcaguggcccccgggucucaaauuaaagccagggugaaacccaacccccucuuuaaaaugcaaaauggcccuucccuaaaauaacacacaaccacaaccgcagcuggcucugcacgaaggccaugcugcagcucuuuucuucggaagucgauuuuccuccguggaauuuggcugggcuugugguagcguuugagacucugcaagagcacguccacgccaaccagucucuggucaccgacuggcucgcaaauuccccauuuaaggaaaccagcaggccucuguuaugaaacucggggaaggaaugugaauuaugcuccaugcggaggcuccugcuccugcacguuuuccagccuuuuccaugggccacgguggagcauuuggggaaggccuguguggauucccccccaaguccagacugaugccccugauaccuucucaggagguggcggagggucugggcucuguccaggcuccuagggguggggacgugcagguaaagcaaggcgucugccgcaggcacgcgggagccuucccugggcuggcugccagcaccuuggagucccaggcugccaggaaaaguucacccacacccgggcuuugcuggcgaagggugagucauaugauggccgggcucgggcccucagcagacaccaaguguguucccagagcagccgcucagcgccuguaaccuggaacaggccagccuuucggggccucaguuuucucaucugccuaaugggaauagcaauucccaccuucccuuuguugguuggguucucacuagaugcacaggagacagcagcuugagagggacuguuuggagagcuguuccaugugacaccccucuuacccuguccccacggggccggaggagcaggggcuuggugauagcagcugggcgcagucagccucugcagggaagagggcauguuugguucgaggcuccuaugcccucauucuuguugaucuugucacagccccucuggaagguggagaugguacucgcucaggaacgauaccacucaaggaagcauggcccccuggaugggguggcccuuggugcaccugaggcuccugaggcugcagagcaccauggugggggaggaggcggcugugugucugucauuugccucuucugcugaauggagacccccagagggcaaagcggggcuuguucucccugugucccgggaucacucucaugccuggcuugggcgagcugccuguuucuaaaucacuugcuaaggcugaggggaaugggguuugccgcccaccccaggaagaagggagcaagggagucagcaccauuuuacaaggaccaagagugggaggaggcuccucagaggacauucugggcacuguccccuuucucugcugugaaggguggacaaaacacaauaggucugccagcccuuguguccuguggcucaucccagcuggcugggaugggaacugaguccuccaagcuggugugguuccccucuggucuccgcugagagucacgcccagccucugggcacacacccuguggucaccuccaaacagggcacacugggcacuggugggggugggaccugccaucccagaccuggugucugcucacuuugucuugguucauuggccagagaucacguaagggcgcccugaggaugugcuuguuucucauggaugggugaugcuugucucuugggaacauggagaagcaaagccacgucgcccacagaccuacccaggaacagcugcagcugcagguucaggguccaucccagccauggguuuuauucuuuuuuuuuugagacggaguguugcugucucccaggcugagagugcaguggugugaucuuggcucacugcaagcuccgccucccggguucacgccauucuccugccucagccucccgaguagcugugacuacagguguccgccaccaugcccggcuaauuuuuuuuuuuguacuuuuaguagagacgggguuucaccguguuagccaggauggucucgaucuccugaccucgugauccgcccaucucggccucccaaagcgcuggaauuacaggcaugagccaccgcacccagccuuuuuuuuuuuuuuuuuaggcagggucucacucugucauccaggcuggagugcagugguacagucacagcucacugcagccucgaccucccagggcugaagggauccucccacgucagccucccaaguagcugggacuacaagagugugccaccaugcccagcuaacuuuuuuuuaauuuuuauuuuuuguagaggugggauuuugccauguugcccaggguggcucaagugacccacccaccucagccucccgaaguacuggaauuacaggugcaagccaucgugccuggccauguuuuguuguuuuuaaauagacuuaauuuuuucaaacaguuguagguucacagcaaaauugaugagcagcagguacugaguuccuauacaucccuguccucacacccacacagccuucccaacugucagcauccugugcagggugguacauuuguuacaacugaugaaagcuggcugacgcaccaucacccaaaauccacguuuacacgaggguucgcccuugauuuguacauucuugguuuagacagaugaguaaggacaugcacccaccauuccaugucauacaggauaguuccacugcccugauuuucugugcuccacucauucaucccucuccucuccaacuccuggcaaccacugaugcuuuacugucucuguguauuugcuuuuuccagaguguuuagaacuggacucauacagauuggcucuuucaccuacuaacaugcauuuaaguuuccuccaugucuuuucauggcuugauagaucauuucuuuucuuuucuuuuuuuuuuuuuugagauggagucucgcucugucgcccaggauggagugcaauggugcgauuucugcucacugcaaccucccccucccggguucaaaugauucuccugccucagccuccuaaguagcugggacuacaggugcucacuaccacgccuggcuaauguuuuguauuuuuaguagggacgggguuucacuguguuagccaggauggucuugaucucccgaccucgugauccacccgccuuggccucccaaagugcugggauuagaggugugagccacugggcccagccgauagcucauuucuuuauaccacuaaauaauauuccauccugaguguuuugaauugccuuuuagagguucauuuacagcauuuucaugguagcaaaaaaaucagaaauaaccugaaguucuuuaaaaaacuuacagcagaguacacuaggcaaucaucaaaagaacaaggaaucuuucuauccacaagaagggaaggugcccagaauuuacuguuaacugagaacaaguuggaaauaguauauuuugauugcccagcuuaaggcaggaauaccugaaaccauaccuguugguuauuuccgaugggugagauuuuagggcaaguucacugucuguuguuucaugucugcaucuaugcagacaaaaacaaaaaacagaucuguguuagcugcuucucuugcccugcccccgucacagguacauguacuggacagacuggggugagacgccccggauugagcgggcagggauggauggcagcacccggaagaucauuguggacucggacauuuacuggcccaauggacugaccaucgaccuggaggagcagaagcucuacugggcugacgccaagcucagcuucauccaccgugccaaccuggacggcucguuccgguagguacccacgcaguccuggggcaccccuuuccccuuuguccccagggcuuuugaaggcguuccuucuuaacucaggccuacagacucuucucugaaacucuggggcccugaggaaugcaggacuucucagaacuuggaacagcgucagggucuguguggcauuugccaccagcccuugaauauuucuauagcaaauguggcacguucauucuaaguagggcagaaaagacuaucuguagcccacacccaugcacaguuuuuuuuuuuuuaacuuuguuuuuuugagacagagucucacucuuucacccaggcuggagugcaaugucauaaucucagcucacugcagcccccaccucccaggcucaagcgauccucccgccucagccucccgaguagcugggacuacaggagugcgccaccacaccuggcuaauuuuuguauuuuugguagagacggggucucacauguugcucaggcuggucucaaacuccuaagcucaagggauccuuccccucggcucccagagugcugggauuacaggcgugagccaccgcacccggcccaugcaccaaaugagguuuugucaccagaugagcaacaaaagcuuuccaucuucagagcguuuuggauuuuggaauuguuggggagggcuuauggcccggcaggguugugaacaguaacccugucacacgcaccacccccacccuggcccuaucccagcucaggcauccugagggcaacagccggaagcugucucaguuauuggugcauuccccagucucaccagggggccuuccacauggucagugcucaauaaaaugggccgagaaugaguaggaaggguuuuccccucguugguuaauugcuuuuagagccuucuggucagcauagcuucccagcucuguacuuaauuaccccuuauagaaacaucccuucuguguacaggugaagggcaguuuauucacuaaccaagugcugccugcugcuagcccugugcuaggugucagggauccuccugggacggcagaccccauuccugcacuaguggagcuccuggcccaggcagggauguggcaggugucugugcagagggcaguagugacugcaugggaggacucaguggcuggauuucugcaaacacaggccaacacccacaugaacagacuugagggcuugggcagcuuugcuccacacuugccaggccucguguguuaguuauccauugcuguguaacaaaacagcccacaacuuaacagccugaaacagcaaacagguuuuuuauggggagggagucagugaugaggaguggauuagcugggugcuucuggcucaggguaugaccugaggguacacucaagcuccuggcugggccucagucaucugaagguuugagugaggccgggacauccacuuccaagcucauucucagggcaagaggccucaguuucuccuguuccucuuaugcugagccacacaucucuuuugggcugguuugaaaauauccuguugucccuggaagugcagaccagcgggucugguuugagauuuggaaaugugguuacccuguagacugugguucuugggagcugagugaucuuacaguuaugaaggguggacaagaggauagaaaggcugcagcugggagugcccuggucaaaggauggugacaggggacagugagggugauggagguugaaacaugcuaauggugguggcgguggcggcagcgaauccuuccauagcacuuacuguuuuccagggacguuuaucaguucauuuaaugcucauaccaccucuaugaaacguuugcuauuauguuuuauuuuuauuuauauuuuuauuguuuugaggcagggucucacuuugucacccaggcuggagugcauuggcacaaucaugguucacugcagccuugaccucuuuuuuuguuuguuuguuuguuuuuuuuuuuuuugggauggagucuugcucugucccccuggcuggagugcagcggcaccaucuuggcuaacuacaaccuccaccucccagguucuagcgauucuccugccucagccucccaaguagcugggauuacaggugcccgccaccacgccuggcaaauuguuguauuuuuuuaguagggacgggguuucaccauguuggccaggcuggucuugaacuccugaucacaagugauccacccaccugagccucucaaagugcugggauuacaggcgugagccaccacacgcggccacagccuugacuucuugggcucaaguguuccucccgccucagccuuccaaguagcugagaccacaggcacguaccaccacgccuggcuaauuuauuugguauuuuuuuuguagagacgagguuucaccauguugcccaggcuggucucaaacuccugagcuuaagccauguguccaccucggccucucaaagcacugggauuauaggugugaaccacugugccuagccuguguuugcuauuuugauccccugugcacagagaagcaugugaauuugcccagagccacacagcuagucccagccaggguuggaacauagggucuguagcuccaggucuggucuguucucagccucucucccaccugcuuccccgcgggauucuucugccucugcagcggccaucgcucuucaugaugcaccuggggcuauucacauggaagcgucguguguugggugacgagcucuggagccacacagaccugugcaggccccuuuaucugugacuguggcuggggcaagggccgaggcugaccuucccucagugcuucuggcugaggcagagcauggcccagggagcaaccgagagugaugggccucuggcuucucucacugaaaaauggccacaugggcugggcgccauggcuuacgcguguaaucccagcacuuugggaggccgaggcgggcggauuacgaggucaggagaucgagaccauccuggcuaacacggugaaaccucgucucuacuaaaaauacaaaacauuagccaggugugguggugggugccuguagucccagcuacucgggaggcugaggcaggagaauggcgugaaccugggaggcggagcuugcagugagcugagaucccgccacugcacuccagccugggcgacagagcaagacucuaucucaaaaaaaaaaaaaaaaaaaaaaaaaaaggcugggcgcgguggcucacgccuguaaucccagcacuuugggaggcugagacgggcggaucacgaggucaggagauugagaucauccuggcuaacacagugaaacccugucucuacuaaaaauacaaaaaauuagccgggcaucguggugggcaccuguagucccagcuacucgggaggcugaggcaggagaauggcgugaaccugggagguggagcuugcagugagcugagaucccgccacugcacuccagccugggcuacagagcgagacucugucucaaaaaaaaaaauaauaaaauaaaauaauaaaauuaaaaaauuaaaaguaaggccgggcgugguggcucacgccuguaaucccagaacuuugggaggccaaggcagguggaucaugaaguuaggagaucgagaccauccuggguaacacggugaaaccccaucucuacuaaaaauacaaaaaaauuagccaggcgugguggccggugacuauagucccagccacucgggaggcugaggcaggagaauggugugaacccgggaggcagagcuugcagugagcugagauggcaccacugcacuccagccugggcgacagagcgagacucugucucaaaaaaacaaaaacaaaaaaaaauaaaauuagaaaauuagcuggccauggugguacauaccuguguucccagcuacucaggaggcugaggcaggaggauggauugagcuuaggagauugaggcugcagugagccaugaucacaccaccgcacuccagccugggugacagagcaagacccugucucagaaaacaaacaaaaaagacaacauuguggaaaacaguuuguugauuccuugagacguaaacauugauuuacguaugacccagcaauuccgcuccuagcuguauacucuuaagaaucgaaaacaggucuucacacaaaaugugaauggacaguaauguccguagcagcacugugcacaacagccgaggguggaaaugacacaaaggucccccagugggugaauggaugcacagauuggguucugucugcacacuggaauaugguucaccccuaaaacgggaugaagcacugacaugcuacagccuggaugaaccucgaaaacauggugccaagucaaagaagacagacaucagaggcuguauauugugauuccguuuauaugagauguugagaauguguguaguuaaguccaucaaaaguguuugccggggcugggggcggggacuggggagugacugcugccgggugugggguuugccuguggggcaauggaagugcuuuggaacuagacagaaguggaggcugcaccgccuugcgaaugcacuagguaacacuauucacuuuaaagugguaaauuuaggcugggugcaguggcuuaugccuguaaucccagcacuuugagaggccaaggcggguggaucgccugagcucagggcuucaagaccagccuugggcaacauggcgaaacccugucucuaccaaaaagauaccccccaaaaauuagcugggugugguggugcacgccuguggucccagcuacucuggaggcggaggugggagaaucgcuugaaccugggaggcagagguugcagugagcugagaucacaccacugcacuccaaccugggugacagagugagaccccaucuccaaaaaaaaaaaaaaaaguaaacguauguccugugaauuuuacuucaauaauuuucuuaaaaaacagcaucaacaaaaaugaacagaagaggugguggaucugcagagcccacagcucccaucuucccugugccacuucaugagugucacccucuccuggcaacugugcugagggcuggggacguggcggggacccucugcccccaggcccacccucagggagccugucacggggcgagggucauuaagcaaauaaaacugcacauuaccgaccacgucacauuaugauccuguuuccaguguccauaaucucauuacacccgaguccucauuugcugggcacuguaagcaucuagaaaagaauagcuguuucucggguugaugccaaguuucauuuacucugaaaguauaaauuaugagcauuguaagaaggagcgagugcacauggccugauuuguauacagagguuaaagcguugggcaggagaggugugcuuuuugccaggcauggcuuccuccuuucuucccugggggagacuuugccacuugaccugggggagcccgugugucaccaucacaggcuguguuugggaggugcccugugcacgccgggagaaauguacgagggcgccagcuccuggggcucuugaccuggccucacuugucugguugaaagcaaaugggaagccuggcaugguggcgcacgccuguaaucccagcgcuuugagaggcugagguggguggaucaccugaggucaggaguucgagaccagccuugccaacaugaugaaacccugucucuacuaaaaauacaaaaaucaucugggcguaguggugggcaucagugaucccagcuacucgggaggcugaggcaggauaauugcuugaacccgggaggcggagguugcagugagcugagauuacaucacugcacuccagccugggcgacagaccgagacuccaucucaaaaaaaaaaaaagaaauuaauugggucagcagcaaugacugacgggggacccuccugauggcuccuccaccccgcuucccugacugcaggcagaaggugguggagggcagccugacgcaccccuucgcccugacgcucuccggggacacucuguacuggacagacuggcagacccgcuccauccaugccugcaacaagcgcacuggggggaagaggaaggagauccugagugcccucuacucacccauggacauccaggugcugagccaggagcggcagccuuucugugagugccggcuggggcgcgggggcgagggugcgggggcuggggggagcgggggcgcggggcaggggagugggaggaugcgggggcgugggggugcgcgggcguggguggggugggggggcaggugaccccucccugcagaagcccaugcucuggggggcccccucucuaaagggguaccugcugcaauggagggagguguguggcuggcugggggacacgggccugcagaggaccccucugcagagcucaugggggcuauuucaggcucagcaguggcaaggggauuuccaaggaagguugccucguuuucaaggcccagaagaaguugucuguguguguguguauauguauuuauauacacauacacguauguguguauauauauauaugguuauuuauauauacauauauauguguguguguguguguguguguguguguguauguauuuuuaauagagaugagagauuuugccacguugcccaggcuugucucaaacuccugggcuccagugauccucacaccuugacuucccaaagugcuggggucacagguaugagccaccaugcuuggcccugcaagucgcguauuuaucaaugaauaaucugcccagaaucagcaguucucagccugggggccacgcuggguugugacagaggucccugauggggaaaugcaccagcuucugugacaguggggcugcggcucuggggacaguggcccacucccacagggaccagggauggagauuucuggccaggccauuauggaagguuuggacuuugaauugaaauguggggccuaggggugccagcuguucccagagcaggacacaggaggguggggcucucuggagcuguuuccuggugagaaagucguggucacaaaacccaucuacacuuggggcagcaugagggagggagagguucauuuugaugaguuuguuguuccaguuauauccguauuuuggggcugcuacacccagcuuuccccugguuugaaugaggugcuggaagcauuuaucgaguuccguucaauugcuguuggucauagaagggcuugggagagugacaagcuuggccaucccagcaagagggacaguguuccuauggaagcugcuggguccacacauagcacaaagacaagacaagccuuuugcccaggagcccauugucucugggguucccgucacuaccacacaggcagguccugaccccggccauuggagcguggggggcagccuuugcagagggguguccuuugggggcuccgaggagcuggggaggguguucuagucauaggagcuuggugggaggaagcagauggggagaugucacuccaugggcaggucacaucugggugugaggguggccaggaaggucacggcugguuuuggggaaauugcaggccgucuggccaggcugagggccccauguggacgggccagcgaugaggcagguggaauggugccagcggggaggucccugaugccacuugaggccgauguuugggcagagggacacacuggaggcugucacgggggacgaggcaggaugugacucauucagaaacaagugacgguccucuucuggaaccuucucucacucuguccugguuuucucaguccacacucgcugugaggaggacaauggcggcugcucccaccugugccugcuguccccaagcgagccuuucuacacaugcgccugccccacgggugugcagcugcaggacaacggcaggacguguaaggcaggugaggcggugggacgggacggggcgggcgggcggggcggggccuggcgggaauggguugcggccgccgggggugccccagaaggaaccucggcaaacccguucgaaaugauccacuuggcggguguggugauucaagucuguggucccagcuacucgggaagcugaguugggaggauugcuugagcccaggaggucaauccuguuuuguuuuguuuuauuuuugccccagauauuuuccacuuuuuuacucuccgccuugguccucaggcacuuggugcuuccugggacuguguugcagugaggcauggcucuucuccucuggggcaccggcugaggaucuuucuuuccaggugucgguucggggcgggcccuucgggaaaucacacacguucaggaugcagcucgccuucggggaugcucccgggccugggauagccagucuggccucuggggcugacccuggggccuggcaagcgaggggguaacgagaggugucaggaaagcgccaucccugggaccaguccuccccguuucuguagcgugauggggcccagcuugcagaagguggugggggacagggccugcuuccugugccggugucccacucgggagggcagggggcuuccaagugggcuggcuuccacacucaggaacaguccuaagggcagagucucgguguggggcccccuagaaggacucuccuggcauccgguggauggagaaguguccuugcucucacugcugucugagcacauggggguccugacuuuaggaacaguuuccuggucccccuguucuugcuggcuagggucuguguuugugugcagcggcugggguguguguguggucguggcgcccguggcgugugggucuuuucucugcucccuggcagggguccugcguuuggugaggauuuuccagguuuguauuugucuuucucuuucugagagcagggcaucuuuaaugaagacauggcuguuacaucaaagggucuguccgcugugccggcugcugcaggggaugguuggagagccuccccgaccaagcaucuuguuucccaagucgggagaaggagaauuugagaaauggggacuugggcggccuaguccucacggcucuggacagcaccccauucauucaucugcuugcucauucauucguucauccauccauuugcucauucagcaggcauuugucgaacacuugccgggugcuggcauugcuccgaggcacuggggaccccgcggugcagacagaaucccgggccucuggcgcucgcacucugggcucuggggcugggugggugggggagacggcacaagugaguccacgagggagucagugcauuagaaagggugagugucuuggacacccgcuccuccaucaccucuggggcccuucgcuguugaccguucaccucggccucaaaggcaauguugagagagaaacuggacccagggaaggaguccagaugagcugccuccugagugaccuggcgacaccagggguuuggaccaagcagguuaagggaggauuauagacccuugaaggggaggagugguuugaccagguuggaugagcccuuuguuuacagaggaggccagggcaagucaccagccugggguugcccacagcagguggcauaguagguucuagcagguggggucuggcucccagagccaugaguuugcugcugccccauaccugggcccugguggagcaaggcccuggucucccucgcagacugccccaggacgcugccugcucccuggaggagggggugccucggcugcacaagccucagcggagaaggaugcuuggcuugcuggcugcccgggaaccuuggccuucucagaguuuguuuucuuuccugccugucuguuggugagaagaggcugaacucagugcuggagcuggacccugcgcucugcaguguugguugaaguccuggcggaaagggaaagagugaggacauacgggcucaugacggcagggaguggccaccacagucagggccgggggacggaggggagagagaaucaccggaauauggcaaagguguaaaacaggcagcucgggccgggcgcaguggcucacgccuguaaucccaacaauuugggaguccaaggcagguggaucauuugaggucaggaguucaagaccagccuggccaacauggugaaacuccaucucuacuaaaaauauaaaaauuagcugggcaguaguggcacgggccuguaaucccagcuacuugggagacugaggcaggagaauugcuugagccuaggaggcggagguugcacugagccaagaucaugccgcuauacuccagccugggcaacagagugagacccugucucaaaaaaaaaaaaaaaaaaaugcagcucguccuggcuagucugaaaaagguggagcauauauguugcccaauauccacaaauauuccagaaaauaucugagaagaaagcaguuaaugagacgggccuguuccccugccccgaggcacacguguggugggggccaugucaggaagcaagccggcacacagauggacauaggacagaccuggaucggguacggaacacagcaggggcugagccggagacuccuguacuggggguguggccgccugagccggcaggucagaggucucucucaggaggccugagaucugaaggacuaaaagagggaaaggcgagaaggaacagcacgugcagcggcuuugaggcaggagcaugcugguguugggaccgacuucacgggcugugugaccuguguagucauaugaggugagcucuguuguugaccugaaauuccuaccuuuugaguaaggggcugucugcacuuccauuuugcagcgguccccgcaaauucuguaacgggcccggcucguguguuugagaagcugaagggaggucuggagguggucucuuacucucuuggugugucugucuccacauuuuaucuucuguuuuuuuguuccccagcccucccugcguuuuuccuguaugugacugugugucugugugggugaucgaaccguaaggcuuccugcuauuuauuucacuuuaugcacugcagaagcauuugcgauugcaggagguaaauauguaucaaagacaugaguuuuagugaaggauaucuuuuuuuuuuuuuuuuuuugagacagagucuugcucuguuguccagguuggaguacaguggcucacagcagcuuccaccucccagguucaagcaauucuccugccucagccucccaagcagcugggauuacaggcgcccgcuacuaugucuggcuaauuuuuguauguuuaguagagaugggguuucaccauguuggcuaggcuggucuugaacuccuaaccucaggugauccaccuaccucagccuccuaaaguucuaggaucacaggcaugagccacugugccuggccuaugccugaacaauaucuuaucaagacaugucuuuuagucauccucccgcuauggggcguuucuguucucuuuguguuuuugccauuucugagucuugcugcuguggguugggagugggcaggugagagcuggcuuggggccuggccacuggaguuagagggagcagggccuggugucuguugccaccaucgauuggugaugucugccuaaacacuguguugcaucugcuggggaugucugccuugggagagcaaugggcauguaggaagcaggugucaccaucucuguucuuggggugucaaagcaaggcuggguguggacauuugucgaaggaguggggaauggacacagcccccaacaagcagaucgugcagucgugccugucaggugccuugcccuaacaguggaaggaucauuugaggucagggguucaagaccagccuggccaacauggugaaacccugucucuacuaaaaauacaaaaauuagccgggcgguagucgugcgccuguaaucccagcuauuugggagacugaggcaagagaacauguugcccugggagcuuuuguuaagggucccuguguggcucccucacguaucagaguuccaggaacgggugugggcccugauaaaaucccagacucauggcucagugaagucgcacagcuggacaagcuuggagacccccaaauaacuugcccaggcuacccuggcuugcaaagggccacugcucauccaggggugacggagccgugcugggugccuggcauccagugggugcccaguguccagcugccauguccacuguccaugcccuuaucaccuucauguugucaccaugaccggcgccuuaggugcuguggcuggugccaggcccgugagagcuggggcagguucacucaggguccagguuugccugcaucgucccagaauccucccauaccugggggagugggcugucagugggagccaguaaaggggcguugauuucuuucccaaccagaagaggcaggggcuauagacuuagguggagccccuggcucuuugcuggcucccaggguucuaacagcugggccuucugagcccuggggacuggcugcucguggcugagcccuucaagggcauugcgcuccuucugcaaauguaauucccagucuccauguccaggcccagagcagcccuggggaguccucagggcucauuuuccugcaagcgggggagagggggggacaggcccuguggugauuagaggaggcugccugcgcucacagggggugguuaggcuacccagaggaggaggccccugcaggcuggcagggggccugguggcucuggccccagcccugggcucuguggcauggagcugacaccacagacaccugugggguuggaccgcuggacuagcagcgagcccugcccuuccaguuggauagcuuuuccauuccagagccgucagggccgcagggcugagcacgcagcuccacgcucccuagagacucagccgucaggggucaccuuucucuagucuugugggaacuguuuuugcccucagccgugagaggcacuuuuacacauaacucaguuggagcaugacuggcacgcaggagaaaaacauuuugugucauuuauaggcccugcuugggcgagacucugggccgggaacguccacaugcagccaguguggggacuguuuuacucugagccugaaucuuucugcuuugguuccagaugccguguguaggguguucugucaaagggaggaaaaagcuccucaaugagacagaaagaugcaacugggagucugguuuugcaugaggacgugagcguuucaguucacuuuuuuuuguaagcaugguuccccagucugaccucagagcugccuggagaugggccccacccgcuucccguuaauuaacaggcuggugcucgguguggaugcuggcuccuccgucucccugcccugggcccuuuugaagcugaaguguuccaggggcagcugguguggaaauagaguuuucuagagguuuuagaguugagaagaaaccuaaacucuucuuagaagcauuucaaggguuugucaccaggauggcucucugcaaauuugaggugguucuagaagaucuucccauauuucuuaauccagagggagauggggaugggcgagaaacggcuuuguccuuaaggaagucauguucugguuggaggacaggcacggccuagcauugaagcuggugagucagagccggaccugugagcggggccagaauggggcgcgggcuucagacuucacaaagcagaccacgcggcagccuggggcuuuaguauccaaauguccugcccuccagguuucauuccuugccguaaaauaucacguuaaaggaaaauguuuuguuaaaagaccacaguccugucaccugagcacagucgcuguucucgguuccucuguggcuuuccaggcugcaggugcccauugguauugcggccgugcgcccggcgggcaugaauuagcugugccgccuggcugcugacgggacgccucgccucgacugaaaacuaccuggagcugcucacccaggggcaacgugaagaaaacgugaaauucugucgcuuguugcagcugacagcacggcugugaggucccagugggcagaggccucgugcagggcaccucaccagccgggaugucagagcuggccagaaggagcggugcccauggagggcugccagugcccagagagccuuccgaggugucacguugggcagugaaauucagagucgggcagaggaggcccuggggucacacagggaucuccuccaggcuauggguuggugagguccaguguccgggggugaaggauagaggcucuguggugagggcucuggagcuggcccugggcuagcggaaacgcagguaacgaaggaggcugugcuggugggacuugugccuguucccgagggaggcauugugagugauguuuaggccaagaggauucaggauggaagacauggcuugguuuguaguugggagccggccaaggagugguguugagaaagugcagugucaggcagacccgggaccguggcggugaggaggugcagugucaggcagacccgggaccguggugaugaggaaaugcagugucaggcagacccgggacuguggugaugaggaaaugcagugucaggcagacccgggacuguggugguggugaggaggugcagugucaggcagacccgggaccguggugguguugaggaggugcagugucaggcagacccgggaccguggcggcgaggaggugcagcgucaggcggacccgggaccguggcggcgaggaggugcagugucaggcagaccggggacuuggagcaccuaguuccacuugcgggcugaccuucuauuuuuugucaucguguugggagcuuaggaaagugacuuaaccucucugugcuucaguuuguccguugguagaaagggggugauuauacuccccgcuccaugggguuuggaggaaggcuguguggguugugcugagcagcgugauggugcaggcugucugggucagugccgagggagcgagucuuccuucggcgguuguaaucagaaguagcuuccaaggcugggugcugccaggaggagcuggggugggugaaggggcaguggggagcacggcucacacggccagcgggugaccuggggaggacggaggggggugugcugggcgcuucaggcguguggcucccuuuccuguggggcgaaggucaggaggggggcagggccuggcugugucagaaucacucagacucuuaagacacauccagaguccccagccccaccccaacccaacgcacccacuccaccagaagaaacggggcaggugggggccaaaucugugaguucccaagggaggacuguguggggcagguuguggggggcggcgcuagcauggcuggaaacaucucgagguuugaagccagagccucaggugagacucaagggucccugggacucccuccugggugucugaccguuuaucuuucauggaguuacaggcgaagacauuucugugaugucuugaauucugcuuuuuccugauuuugagcaaaugaaagccagcuggguguagggagucaggugccuuccccaaggaaggggcugagaggguggucacaccgggaccccaagggacagggagcagcguucccaggggcacacaggcggccuccuagagguagggaugcguugguggcggggggggccccgcacugcugugugccuucaagguggcacuauuuacguggccccugagcugcagggugaccgcuagcccugggcuguguccuggcucccccgccccuccugaagugacccccaugagacagggcagguauaucccacgagccucugccgcccagcguggccggggcucagugggaccauggcggcugcgaugcugcucucugcagcucagagucacucucauccccagcagucgagugcagagccugggccuccggccuccccacccccuccacacagccccaggaccaaggcggcagcuggcuucgguuucugccauguuuuuccaauuauguggaaugagcuaaaaacagcaggagugaggccuuauuugggaguugccaccgccauccucggaagcugcuguuccucacugccaccccuccagccccauccucuguggaacgugccccuguucuuuugacuuuugucuccugcacaucccuccugcuugggggccuuugggcagugggcuuagcggcgugcaccaugccacucgggccacacgugcccuggccgguggcucucagagcuauguccagaggguggccaggcagugcucccggcagcgcccagaugaggcuggggugcggcuuggggauuugugggccgcuggccacagcucacccagacagaguuuuaacagauguucgucugucagggacaggaaacaaaaagaagucggggauggagugggggcagcgggaggaacagagggggccacugucgagucugacgggcagacugacagcuggagccgacggcaaagccccucacgucccuccgucuguccgggcggauuagcucaggaagcagggcccgcucagcucggggccgaauaacgggcguuuguucccagagucuggcugucuugucacuuaucagggaaguaggucaaagggaaaaaagaaaggagguccuguggggccgagucugccgcggccgggcagugauuggcguugacuuugcaaacagaaggcagcugcuguucucagccauggaccgugaauuuuuaauagcaagaaaaucagcucacacgguucaggaaguuguggaagaagccugagugcuaacuuuauuuuuuuaauugagguauaacuugcaggcaauaaaacgcacacauuuuaacguguacauuuggauuaacuuugacagcugcauaugucugcauaacuaccacacgguccagacagagaacauuucuaccacugggaaaguucccggugccccuuugccauccucaacccccgcccccuccaccacucuccugacuucuaucaccuuggauuagcguugccuguuccagaacuacauggaaauggaaccacgcagcugugcucuucugcuuuuuggccugaauacucacugucagggcugaugcaagaggagaggggcgcaucauauuccuggagaacgcugucaccguggagcgggggcacagggggaauggcaucucugggaugggugaaugcugugggcgccuuuccacaggcucagaguuagacuguggucacugguuuuguccccugcagccucuuccaugucccccuugugacugcagcauaagcccagcuccaugcggaccccagaccagcuccgcagcuccaacagcuucccuuuaucuucaguggcgagcuuugcgcuugcagggugcggggccuggugggacgcccacguugcccagacagaacccuugugcggcugcgggcacuccuugcccuuuccgcauuuggugaugacuccuuguuucguuucacugaccgugcccugugccucugcucucccuccccaguuccgugugcccuggggucagugauagaagacacggccccugggccccaagucugcugagcugacaccucgggcugccgcucaccugcagagagacacuagaaggcuccgacucccuuccuggcccccacucuguuuuucuaccuuuuaccgccuauuccaauggaaaugcacgauuuguuucucccugugcacaucugaguguggaccucccugccccugcucgugcugugcccaccaccuggagcacccuuccccugcccccugcccccggccacagcgccccuccauccagaccccacuccugcacacggcuccuccgcccgugcgcagcccucugagaguguggcaggugcaccaggcucugcucuagggagcuucuuccucuuccugugucccacgggaccaacaucgggacccaggaaacaggcugggagaguucgguaacaccuucaagaggguuugagagcugagguucuuuggucuucaguggagcuggcagugacuuucuugacuuugucaagagaagccccccgucucugugccaccucuggggaucugauugaacggaaaucagagcauccgaguuccagccucagcccucugcuguguggcugugaaauguaggcccugugugccuugcugaccugggagggucgaaaggacggugucuggggaaggaugcauaaguuguagagugcccugcacuugugauagguggggccgcgugaacugcugauagccaucuucugucaguuggggcaguggcauugucacaugguuccauucuaauccguuauuuuggcuacugccacugaggcggggugggugacaaaaguaacguuucuugggggccacugcagcggucaugguccugagcccuauacccaggcacgcguccugggagcugugugaggggucguccguggcuggcccugcuucuuuuuuuuuuuuuuuuuuuuuuuuaauugagacagagucucucucugucaccuaggcuggagugcaauggcgcgaucuccgcuaacugcaaccucugccugcugagcucaagcgauuauccugccucagccucccgaguagcuuggacuauaggcacccgccaccacacucggcuuauuuuuuguauuuuuaguagagaugggguuucaccguguuagccaggauggucucgaucuccugaccaucucgugauccacccaccuuggccucccaaagugcugggauuacaggcaugagccaccaugccuggccggcccuacuucuuaaaugggccugaggcacacggugccgagagcucgcugaggucuauggaggaagggcgcagaugggaucugggccuggcguccuggccggcccccaaggccuucuccacagaguuuccauguauaccgggguggccuugcggaggggcgcagccaugcgucaggcuggagccagcugcagaggccacagacagggugucaugagcaguacaaguaaccgcugcuguccauugaacaccuacugugugccuggguucagaaaggcacccugugcuggcuuuuaaagaauuaggccgccugccuaaaggggggaguguggccuucuuuuucauuuaagucaccaacuguuuuauacauccacgccccuaaauucuucaguuuuaggcaaagaugagagggcugcccaggcgucauuugcucaacaaaaccacacuucacuugugaggcuguguucccucaccaggguccccagcaagggggugugaguguuuaguaccacagggagggcuggcgcgguggcucacgccuguaaucccagcacuuuaggaacuccucaccugaggucaggaguucgagaccagccuggccaacauggugaaaucccauccccacugccugccuggggaguggccaugcagccaugggccugagguugugguggggcaugggggcagaggcaggcaguggggggccacaggaggggcuggcuggcaccgagggaugggagaggaagggacccgccugcaggucccuuccugaggccggcacugacuuggucacucucuggcugcccugaccccaggcagagcagcgacuuuccuguuuuagagcugagcagacagagccccugacugcaggccaaggugccugccagcugcuccuggagggccauagccucucugugcuugcuggaaggucccaggcaccgugcaggugacaguggccggccucagguuccagcagagccagcaucgggcccagccacuucccuugugcuuugugacccuauggucacuuggcacaggaucccgggucaaaugcugcgguugcggcauuugccccaccacuuaccccugggggcagcggagaaacuuaaucaauugcuaaacaacaaaaauaaucuggccgccugccagcugggaagccacuguggccaggcuguuuauggccuugggaucugcgcaguggacaguggccugcaccgugaccccguucauccugcgugccccaggcccaggagguggcucaagcccucugccuccuguaagggcaccugagaaggaggcccuggagcugggagcagagcugggggugggcguccgggcagcagaggccgauucucagcuuucccuggaucucagcuuuccccggaucucagcuuuccccggaucucagcuuucugcuacccgugugaaaagaagccaggagaacacagcuauccuggguuggugccggcuguggugggaggccugcggugggagccuccgggggccacuggaccuuuccuggguggccuguggccugggagcugcacuugguucggugcagggagguugugacauccacucugucugcagggauggccggggcccugcggcugggugaugaggugggauggagguguccggggcugcccugccuccuuuugccaaaauaacaaaaauuaucuuguuuguuugugaaaaaaccuguuuucccacauuggggcauggaggguauuaacugugaugaccuucugaguuccugcacacuggugacccauuggcagggucuccuccuggcucuggcagggguggcucaggccgcugggcgacggugugcuggccagauaguuccuggggcugcagguggcuucuuucgccccaucccucccauccccuuucauucuuccugucaacacaucucagacccuggacaccgaaugagccgucgguacccacaccccagggcaauucaguggagggguagguggcucguucccccacguugccccaggaagaggacccuguccccggcauccugacccaccucccaccucccuuagagaccgagagccucuaaggauaaacccauucacccguguuucagaggcuuuuuuuuccucuuauaaaauaacauuuauacguucgcuguagcaaggaaaacauuauaaaaaauagugaagaaaauagaaauuacccauaauuuugccacacagacuuaguuguguccauguaucuugugcaccuuuuuucuguuuacggaucaaaaucgacuuuuagggucaggcgcgguggcucacaccuguaaucccaacacuuugggaggcuggaguugggguugggggguggaucacugaagaucaggaguuugagaccagccuggccaacauggcgaaacuccaucucuacuaaaaauaaaagauuagccaggcgugguggugggugccucuaaucccagcuacuccggaggcugaggcaggagaaucgcuugaacccaggagacagagguugcagugagccaggaucacgccacugcacuccagccuggcaacagagcgagacucugucucaaaaaaaaaaauaaaaauaaaauaaauaaauacauaaauugacuuuuaggagauugguucaaacaauguguguaauguugugucugaguguuuuucauuuaucguucaugcaaauuccgacaucauucacucuucuccagagugugcuguuuuccugccugugucaucacccgucaccuugaaugcccucguuuagguaaaauaaguacauuuuauucaaaaauauuugaggacauuuggguugucuccagguucuuggucuugaguuuugcuguucuuguggagccaugguggugucugguugcaggaaccuccaugcguuccagcugcugcuucugccuguguucuuagagaggaaaugcugggguccgcgguucccgggcugcugaccaggaagccugcggugcuuuacggcccuuccagaagcgggagaugcccccacuuaagugucagacaggccuuuccaccucacuggcagcucugagcggcucccuucuauuugcagaugacugagaaguuaccaauuuccacguuuacugacugcuguuucuccuguuaauuuguauuuauagucuucgcuaauuuauugcuaggguuuugguguugucccuauugacuuguaugccuuuuaauuuuuuaaacaacauuaauagacuucauuuuuuuagagcaguuuuaaguuuacaggaaaauuaagggacaaguacagagaguuccuuccaccugcuguccuccucuccuccuccccaccuucccuccuuccccuauuguaacuuucuuucugauauuauaaaagucacucauggcugggcgugguggcucacgccuguaaucccagcacguugggaggcagaggcaggcagaucaccugaggucaggaguuccagaccagccuggccaacauggugaaaccccgucucuacuaaaaacacaaaaaguuagccaggcgugguggcgggcaccuguaaucccagcuacucaggaggcugaggcaggagaauggcgugaaccugggaggcagagguuacagugagucgagaucgcgccacugcacuccagccugggcaauaagagugaagcuucgucucaaaaacaaagucacacacgcuucuuguacgagggucauuuggccgaggggccagauggcucaccaucuaguugggacaggccaugagcucggaaugcuuuuuacauauuuacaugguugagaagaaaaucaggagaauaauguuuugggacaugggaaaaugacauggaauuugcauuuuaguguccauaaaugaaguuuuguuugcucccagcuguguugacugaggcaggcuggcuuccuacagcugcggcagagcugaggaggcgggaaggagaccgugcaggccgcagcaccgaaaauauuugcucucuggcccuucccagagugcuugccgaccucuguccgacagcuagaaggaaggauaggacccguccgacgauaaccacuguugacauuugagcgcguuuccuucccggcuuuugugugagaguggcagucuguuugcuuuuguggucgggaucugcugcacgcacggcgggcuguuugcaugaggcuuccuggaggauagggcugggcucggagcugcacgcaguggggcguguccugcaugcaguggggccucagaagagagcuguggugggcggggcagugccaaugcuggugggugccaggccuccacgcucagaucagccccggcgacagguuugggccacccucucucuggccucugugcaguggcccaggccgucugcucugccuggcacacuugccucuguccuuccacugaagcgcuccucuuacccucugcucccggcuggguacguugaauugugucccucaaggagauaugcuaaaggucuaaccccaggaaccuguguaugugaucuaauuuggaaacagggucuuggcagauguaaucaagcgaggaugaggucacccuagaguagggggccuauauccacggugcugguguccucaugagagcaggugagcagacacugacacucaggggugaaggcugcauggagucagaacagggcuuagugcgauggcggccacaagccaaggaacuccaaguauuuccugcaacaccagaagcuggaagaugccaggaaggauccugcccuggagccuucggagggagucugucccugcagacgucuugacuuuugauugcagggaugcaugucuuagggugugugggggggugcauuucugauguuagaagccaccugguugguggcgaugugucacgggagcccucugcagguucugcguguccauguggucggggacagaggugggcagggacggacggugucgagcuggacauguccaugacgucggccaucccuugggauggcuuuuuuguuuugaggauaaggcugccugccaggaagcugugcccugccuggcccuugccccaagccccuggccugugcuuggccucgcggaagggaugucgcccuucucuccugcaugcgugcagggaggaaggggagaggucagcagcccgccuggaggaggcucgggcgaggggaagguuucacuuucaggcaauguuguggggcuguuuaaacaaccccaaagaaaaccauuuggccaaacuguuaguuuccaaacauuuuacuuccuugguguuuaaauaaauuccuaccaagacucuguagcuggucccagggaaggaguuggccucucuucuuuauagcccggcacagucaguccccugcaccugccccucccaaccccaggccugcuuccccguggccauggcugcugcccggaccucucuacacacagaaccuccuggaggccagcugugggcaccagccuuggcagggcuguggcggagcccaggcugcugguacucucucugcagcugcucccugcuggccuggcuggacagaguccccaccaccacuggggucaccucugugcuggucacagcucacucagaccuucaggcaaauggguuggauccugccucucucccaggugucucagucucugcaaaacucaaaaaccucagaggccuugcagccugaggggugucagagacaccuccuucgagucaguaaacaccuacagauucaccccagcagugaaaggacugcuucgccacagagguuugauuuacuccuaaguaauuggaagggaugccgagaauagguuccucauggugggacuagaggcccucugcugaccuaguuaccagagggcuagggcugggugugcucagccccugaagguucuaggcccauuugggacaccccgccagaaccugccacaaccugccauguggugacagcuaccuaaaucccagaggcucuugagcuggagagcagaccucucaaucucagcaggccccccacacagaccccauaacccuagucugccuucacaguacaguucguggcuauguguucacggauggugucguucaccuaaggucucugcccugugaccccaagggcguccugagggcagauuccaagucuguuucguccaccccuccuucccuagcagcggguccagggccuggccugaacuagcuucccacagagauacuggugggaugaugaaggcagccaggcggcaagugaaaaacgcacuuccugcaugugcuggcuccugggauugaaguguuugaggaagcaaagugaagugagcuuuccucuugcggcuguguguccuugggccgggagccuacccucucugagcguugggguccuugucaguagaauggggcauccucauagcucaagggguggugugugaaaauugugcuauuguguuacuuuaaugauuuuuuuuuuuuucgagacaaagucucaccccaacgcgcaggcuggagugcaguggcgcgaucucagcucauugcaaccucugccuccuggguucaagugauucuccugccucagccucccaaguagcuggaauuacaggagugcgccaccaggccuggcauauuuuucuauuuuuaguagagaggggguuuuaccauguuggcuaggcuggucuugaacuccugaccucaggugauccaccugccucggccucccaaagugcugggauuacaagcaugagccaccgcgcccggccuacuuuagugauuucuuaggaggacagagggaacgggcuggcaagacaggcuuggaauguguuuugggaucaagugccgguuucugucuggcacuggcguucucuguggggccaugauggacacacugcugaggucaagcgugauucgucuugcgcugugccuggcagucucauuggaaaguucuguagacaucguguggauggggcucuucccggccaagcccuuggggaccuuccaggacugugaucuccccacaguggcuguuaagcagggaccuuucgugaaguggagucucugguccccuccaagucauagcuagacagggacucgggcaucgccaagccuggcugauuauucacuggaugaggagacaggcccagagaggggcaggaaccugcccgaggucacccagcaggccccagagguuucggucucggauucucccugcucaucccuggauguagugcugcuguggaugugguucugugcugggggcuguggagagcagggggcuugugccaggaccccagugaggguggcgcccucgccaugaggccgacuguugguauggggcggccauccacugggguguggggaggaacagcuuuccugaggaggagguggcgggaggaacagcuucccugaggaggagguggcggugcugugugaccugggccuugaaggacagguccauugucaacagaacauuuugggaguggagccuagagggagaaaauuuguugaaauucagauuccccucccccuaccaauacacaccaaaucagaugccccugaccagaucuaaauuuggcucucagagauuuccauuguagcugggcacuuggggaaccuucuaagugcugccucugccucuccccagccugccugccucaguuuccccagcccugggcccgugucgcuguugccaucacgugggcgcccucuaguggaggaaucagauuaugcacuccggggcuuggagcaggagucaggaggggcuccugucuuuccuugaaacguuggaugccgggauccuggaacagucucugcauuccuccuggcgagagccagagccugggcacaggggaccaucuguuguuugaaggcugcagccuggcagggcacucaggagaucuggcaguuggcugcagggccaggucuaggggccagggcaucagggaggcucugggcugguucagccccgggccccuuugcagauugugaccugggccccugugcaggggcauggccacaggaugcugggaggggucucugacccugaccuucuuggcucugugcauccuugagaccagaaaggucuggaacaaaugaguagacgaugcccuaaccuggggagggagccacauccugaucccagcaaccucaggaaggaucugucaggauuauggggcacccugggggccccaagucugcaugggucuccacuugcaauuucuguaggaagcucugauaaauccaaacuggggguccuaggacacagucagaaaugcugauaccguuguguguggagccucgggcccugggggucaggagcauguggagggugggccacggggguucagaagagaauccuguaaccccccaccccccaaacugaagcccacuugagggccauggcugaaagguuggggggucuccgugcguccuguggaguggguggugaggaguccuuggguuugcacgccucugggccugagcggcgggaccccguccacagcggaucccugggcccuguugcucagaugcucucagaguguugcuguggccacggagggagccugaguuaagcuucucuugugccgguuguacgcugucaggucacacuggugaguuaggcagggcacagaugcccagagcagagggaacuuuccuuggggauucaacacgugcaagucuuaggggcuggcaaauccugcccucagcuagagagggggcuuuuauuugagaccagaaucaccugagcauccuccuguccccagcuguguccagccugucugcagggacauccugagaggaccaggcucuccccucauccaccugccuaagugccacucugaacccuguccaccugugccguggaggggcgugaccucaagcugcucagccagcagcaggcuuggcccuggggggcagcagagacccagguggcuguggggugggugcuucguggcgugguucugaaacuucguuggaaguguguggacagugccuugccuguucucugugggacccuauuuagaaacgaggucugaguuacugggggucaucacuguguucugauggcccagcuguguggaggccgcggugcagccccauccaaggagccagggcccugggucuagccgugaccagaaugcaugccccggagguguuucucaucucgcaccuguguugccuggugugucaaguggucgugaaacucuguguuagcucuugguguuccugaaagugcccccgggucucaggccucagaaccaggguuucccuucaucucgguggccugggagcaucugggcaguugagcaaagagggcgauucacuugaagggugugucuggcccugccuaggagccccccggcacggugcuggggccugaagccgcccucgggugguggagaggagggagcgaugaaguggcgucgagcugggcaggaagggugagccccugcaaggugggcaugcuggggacgcugagcagcauggccagcagcugggucugcagccugguacccggcgggacuugugguuggggcugguuuguggccaggagaggggcuggcaggagacaagggggacugugaggcagcucccacccagcagcugaagcccaauggccuggcuguguggcucucagcugcgugcauaaccucucagugcuucaguucucucauuuguaaaaugaggaaacaaacagugccagccucccagaggugucaugaggaugaacgagugaccauguagcaugggcugggugcgugucaccuaacaucaccagccuuugcaaggagagcccugggggccuggcugaguauuucccuugcccggcccaccccaggccuagacuugugccugcugcaggcccuugaccccugaccccauugcaccugucuccacaggagccgaggaggugcugcugcuggcccggcggacggaccuacggaggaucucgcuggacacgccggacuucaccgacaucgugcugcagguggacgacauccggcacgccauugccaucgacuacgacccgcuagagggcuaugucuacuggacagaugacgaggugcgggccauccgcagggcguaccuggacgggucuggggcgcagacgcuggucaacaccgagaucaacgaccccgauggcaucgcggucgacuggguggcccgaaaccucuacuggaccgacacgggcacggaccgcaucgaggugacgcgccucaacggcaccucccgcaagauccuggugucggaggaccuggacgagccccgagccaucgcacugcaccccgugaugggguaagacgggcgggggcuggggccuggagccagggccaggccaagcacaggcgagagggagauugaccuggaccugucauucugggacacugucuugcaucagaacccggaggagggcuuguuaaaacaccggcagcugggccccacccccagagcggugauucaggagcuccagggcggggcugaagacuuggguuucuaacaagcaccccagugguccggugcugcugcuggguccaugcguagaaagcccuggagaccuggagggagcccuuuguuccccuggcuucaguuuccucaucuguagaauggaacgguccaucugggugauuuccaggaugacaguagugacaguaagggcagccucugugacacugaccacaguacaggccaggccucuuuuuuucuuuuuuuuuuuuugagauggagucucacucugucgcccaggcuggagugcaguggugugaucucagcucacuacaaccucugccuccugggcucaagugauucuccugccucagccuccugaguagcugggauuacaggugccugccacugugcuuggcuaauguuuguauuuuugguagagaugggguuucaccgucuuggccaggcuggucgcaaacuccugaccucaggugauccaccugccucagccucccaaagugcugggauuacaggcaugagccaccacgcccggucaggccaggccucuuuugaacacuuugcacaccaugggucuuuucauccagggggguagguacaguuguacaguugaggacacugaagcccagagaggcucagggacuugcccagggucacacagcaggauguggcagguguggggcugggccuggcagcguggcuccagcuuuccagcauagaaaucugugaaagcagauaguuugucggucgguaggggagacuuucugagacccgccccagcggcucagaggguaguagccaggggccuuccugggggcucauaacccagaacacugaaugggaaaacccugauggaggaggcgcaguggagcugugggugccgaugggaagucccagaggagcugggaggucaguagcggugcugcccucuguggagcacuuagugggcaccagguguguuuccagguucauggcccugggaccugaagcucagaaggugaaguaacuugcccagggcacccgucgggcagcggcgggcagaggauuugugggcuguggagccugugcucguggcccagcccuggggguugugagugugcuggccggggagcuuuuccugcaaguggacuggugucuaggagccagcaugucaggcagcaggcagcgggagugcagcaggcagcgggagcacagcaggcagagggcggggcucgagcagccauccguggacccuggggcacggaggcaugugggagagggcugcuccauggcaguggcugaagggcuggguugugccccgaggaggguggaugaggguaagaagugggguccccaggggcuuuagcaagaggaggcccaggaacugguugccagcuacagugaagggaacacggcccugaggucaggagcuuggucaagucacugucuacaugggccucgguguccucaucugugaaaaaggaagggauggggaagcugacuccaaggccccuccuagcccugguuucaugagucugaggaucccagggacaugggcuuggcagucugaccugugaggucgugggguccagggaggggcaccgagcuggaagcgggaggcagaggggcuggccggcugggucagacacagcugaagcagaggcugugacuuggggccucagaaccuucaccccugagcugccaccccaggaucuggguucccuccuuggggggccccagggaacaagucaccuguccuuugcauaggggagcccuucagcuaugugcagaagguucugcucugccccuuccucccucuaggugcucagcuccuccagcccacuagucagaugugaggcugccccagacccugggcagggucauuucuguccacugaccuuugggaugggagaugagcucuuggccccugagaguccaagggcugguguggugaaacccgcacaggguggaagugggcaucccugucccaggggagcccccagggacucuggucacugggcuugccgcuggcaugcucaguccuccagcacuuacugacaccagcaucuacugacaccaacauuuacaaacaccgacauugaccgacaccgacauuuaccgacacugacauuuaccaacacuguuuaccaacacugacaucuacugacacuggcaucuaccaacacugacauuuaccgacacugacauuuaccaacacuauuuaccaacacugacaucuacugacauuggcaucuaccaacaccaacauuuaccgacaccaacauuuaccaacacugaaauuuaccgacaccgacauuuaccgacacugauauuuaccaacacugacaucuacugacgcuggcaucuacugacaccgaugccagcaucuaccaacaccgacauuuaccaacacugacauuuaccaacacugacauuuaccgacauugacauuuacugacacugacaucuacugacacuggcaucuacugacacugauguuuaccgacacuagcaucuacugacacugacauuuaccaacaccagcaucuaccaacaccgacauuuaccaacacugacauuuacugacacugauaucuacugacacuggcaucuacugacaccaacauuuaccaacaccagcaucuaccaacaccgacauuuaccaacaccagcauuuaccaacaccgauguuuaccaacgccgacguuuaccgacgccagcaucuaccaacacugacauuuaccgacaccgacauuuaccgacacugacauuuacugacacugacaucuacugauacuggcaucuaccgacacugauauuuaccaacgccagcaucuacugacacugauguuuaccaacaccgacauuuacgagcaccgacauuuacugacaccaauauuuacugacaucaacauuuagccaugugaugggggccggcuugggggcaggccuugcucuuggcacuggggaugcugcagagaccagacagacucauggggucauggacuucugcuucuucuccagccucauguacuggacagacuggggagagaacccuaaaaucgagugugccaacuuggaugggcaggagcggcgugugcuggucaaugccucccucggguggcccaacggccuggcccuggaccugcaggaggggaagcucuacuggggagacgccaagacagacaagaucgaggugaggcuccuguggacauguuugauccaggaggccaggcccagccacccccugcagccagauguacguauuggcgaggcaccgaugggugccugugcucugcuauuuggccacauggaaugcuugagaaaauaguuacaauacuuucugacaaaaacgccuugagaggguagcgcuauacaacguccugugguuacguaagauguuaucauucggccaggugccuguagacacagcuacuuggagacugaggugggaggaucgcuggaguccaagaguuugaggccagcccgggcaaaggggacacaggaauccucugcacugcuuuugccacuuacugugagauuuaaauuauuucacaauacaaaauuaagacaaaaaguuaaucacauauccacugcccugcuuaagacagaaaacauggguguuguugaagccagaggcagcugcuggccugaguuuggugauugguuccuaagcaguugaaggcaguuuuguuuuuccauagaugucuguucucccuuugcugggugcagccucgcccugcugcuguggucggguuucaguggccucgucccguggacgcagccucgcccugccgcuguggucggguuucaguggccucgucccguggacgcagccucgcccugccgcuguggucggguuucaguggccucguccuguggacgcagccucgcccugccgcuguggucggguuucaguggccucgucccguggacgcagccucgcccugccgcuguggucggguuucaguggccucguccuguggacgcagccucgcccugccgcuguggucggguuucaguggccucgucccaugggcgugcuuuggcagcuuuuugcucaccuguggagccucucuugagcuuuuuuguuuguuguuuguuuuuguuugauuuuguuugauuguuuguuuuuguugucguuguuguugcccaggcuggagugcaguggcgcgaucucagcucacugaaaccucugccuccuuggguucaugccauucuccugccucagccucccacauagcugggauuacaagugcccgccaccacgccuggcuaaauuuuguauuuuuaguagacaggggguuucaccauguuggucaggcuggucuggaacuccuggucucacaugauccaccugccucggccucccaaaguguugggauuacaggcgugagccaccgcgcccagccucuguugagcauauuuugagguucucuuggugccagugauauguuacauguguccccaucgcaccaucgucacccauugaggugacauuggugccucuccucgggguggaugccucccucuguuuccagcaacuucugaaggauuuuccugagcugcaucaguccuuguugacgucaccaucggggucaccuuugcucuccucagggcucccaggggaggcccgaaucaggcagcuugcagggcagggcaggauggagaacacgagugugugucuguguugcaggauuucagacccugcuucugagcgggaggagucucagcaccuucaggguggggaacccagggaugggggaggcugaguggacgcccuucccacgaaaacccuaggagcugcagguguggccauuuccugcuggagcuccuuguaaauguuuuguuuuuggcaaggcccauguuugcgggccgcugaggaugauuugccuucacgcauccccgcuacccgugggagcaggucagggacucgcgugucuguggcacaccaggccugugacaggcguuguuccauguacugucucagcagugguuuucuugagacagggucucgcucgcucacccaggcgagagugcaguggcgcaaucacggcucgcuguagccucaaucucccugggcucaggugauccuccugccucacccucugaguagcugggacuacagacacauaccaccacacccagcuaguuuuuguguauuuuuuguggggggagaugggguuucgcuguggugcccaagcugaucucaaacuccugaggcacaagcgauccaccugccucggccucccaaagugcugggaugacaggcaucagccgucacacgcagcucaaugauuuuauugugguaaaauaaacauagcacaaaauugaugauuuuaaccauuuuaaagugaacaguucaggcugggcgugguggcuuaugcuuguaaucccaguacuuugagaggcugaggugggcagaucaccugaggucaggaguuugagaccagccuggccaacaugaugaaauccagucucuacuaaaaauacaaaaauuagccgggcaugguggcaggugccuguaaucccagcuacucgggaggcugaggcaggagaaucgcuugagcccgggagguggagguugcagugaucugagaucaugccacugcacuccaaucugugugacagagcaagacucugucuugaaaaauaaauaaauaaaaaaaauuuuaaaaagugaacaauucagggcauuuaguaugaggacaauguggugcagguaucucugcuacuaucuacuucuagaacacuuucuucugcccugaaggaaaccccaugcccaccggcacucacgcccauucuccccucucucccagccucugucaaccacuaaucuacuuucugucucuggggguucacuucuucuggacguuuugugugacuggaauccugcaauauguggucccugcguguggcuucuuuccauagcauuguguuuuccagauucacccacacauugucgcacguuaucagaaccucauuccugacugggugcaguggguuaggccuguaauccuaacauucugggaggccaaggcgggacgaucacuugaggcaggaguuugagaccagccuggccagccuagcaagaccccagcuaccaaaaaauuuuaaaaguuaacugaacguggugguggugggcacuugugguucccagcuaccugggaggcugaggugggaggaucgcuuaagcccaggaggucaaggcugcagugagcuaugaucgcaccacugcacuccagccuggacaacagagcaagacccugucugaaaaaaaaaacaaaaaaaaaaguuccuuucuuuuuguggcuggaugacaucccauuguauggccacagcacauuuuguuugucuguuuaucggguggugggcagugguuuccaccuuuugucuccugugaauaaugcugcugugaacauuugaauucaaguuuuuguuugaacaccuguugugaauuauuuggauauauguguagggguaggauugcugaguccuaugguaauguuagguuugacuuacugaggaaccauuaaacuguuuucaacaguggcugcgccguucugcauccccaccggcagugugugaggguucugacuuuaccuccucacaaacgcuucuuuuccauuuaaaaaaauauucagccaggugcucuggcucacgccuguaaucccagcacuuugggaggccguggcgggcggaucaccugaggucaggaguucgagacgagccuggccaacaugguguaaccccaucucuaccaaaaauauaaaaauuagccggguguggcagcgggcgccuguaaucccagcuacuugggaggcugaggcaggagaaucacuugaacccgggaggcagagguugcagugagccaagaucgcgccacuacacuccagccugggugacaagagugaaacuccaucuaaaauaaaacaaaaauaaaaauaaauaaaaauuuauuaaaacauucaucacagccagccuagugggugucccauguggcuuugccucgcauuucccugauaacuaggaugcugagcgucuugucccaggcuugccacaccucagcacuuugagauacgucgcacaguccccauuugcgaacgagaaaugagguuuagggaacagcagcugugucaugucacacagcgagcagggggucucugagccgucugaccccacagccgaccaagcuccaauccuuaccgccuccuaguguuguggauguagcccagggugcucccacauuuuucagaugagaacaccgaagcucaaaacaggagcguuuuguccacauuggauacacgaugucugugguuugguccugaagucacuuuauaucucagugguccagacuggaguaggacaggggguucuggggaauggggaaggugucucaggugaaaggaaggaauuccagauucuccauacuguccuugggaaguuagaagacucagagggucuggcaaagucagacaaagcaagagaaaugcagucaggaggaagcggagcuguccaggaacaggggggucgcaggagcucacccccaggaacuacacuugcuggggccuucgugucacaaugacgugagcacugcguguugauuacccacuuuuuuuuuuuuuuugagguggagucucgcucucuugcccagucuggagugcaguggcacgaucucggcucacugcaagcucugccucccggguucaugccauucuccugccucagccucccgcguagcugggacuacaggcgccugccaccgcgcccggcuaauuuuuguauuuuuaguagagaugggauuucacuacauuagccaggauggucucgaucuccugaccucaugauccgcccgucucggccucccaaagugcugggauuacaggcgugagccaccgcgcccggcccgauuucccacuuuaagaaucugucuguacauccucaaagcccuauacacagugcuggguugcuauagggaauaugaggcuuacaggccauggugcuggacacacagaagggacggaggucaggagguagaagggcggagagagggaacaggcggaggucacauccuuggcuuucaaaaugggccagggagagacacccucugagcaugguaggacaggaaagcaagauuggaacacauugagagcaaccgagguggcugggcgugguggcuuacgccuguaaucccaacacuuuggaaagcugagguggguggauugcuugaggccaggaguucaagaccagccuggccaacauggugagaccccgucucuacuaaauauacaaaaauuagccaggcgugauggugcauaccuguaaucccagcugcuugggaggcugaggcaggagaauugcuuaaaccugggaggcggagguugcagugagccgagaucccgccacugcacuccagccugggccacagagugagacuccaucucaaaaaaaaaaaaaaaaaagauaaaaagaccaaccgaggaauugaagugggggggcgucacaguagcagaagggggaucguggagcaggccacccuguggucaugcacuggaagcucauuaccugacgauuuggagcucaucacugggggccuaaggagaauagauacugaaggaugaggagugauggcgcagggcacgggugucuuugguggccagaacuuggggacugcuggggugccucacugcaggccuucucagcgcccuuuauaugcuuacacaggcuguuucuaagagggggauacauugcauaagcguuuucagacuaccucaucaugggucccuuucuuuacccucuguggcccugguggcgcacucucugggaaggugcagguggaugcccagacccgcccugccauccaccugcacguccagagcugacuuagccucgagauugcugcuggcaccuccugccccgggacaccucggaugugcccguggagaugcuggcucuguguuuucugcuggaguuuggugcgucuuuuccuccugcaaguggccaccgcucuuggguauguccucaggcuucugcgagucauggcugcuucucagguccuugcccagcgccaggagcaaacccuccuggcacuuuguucagggguggaugcgccaguguuccugcuguggacccccaucucacaugagggucuugggccugcaggcucguucaggaaacacccgcugaguacgcagugugugccagcugugucccaggcaauggcggggacaguggcugcugcugggguugugguggcuucuggggacucuggggacagcugaggugcaaggagccacggcuccuugaggaugcaguuggacuccagguggaagggaugguugggggagguauaaauggggucagggaggagacacauuuggaacaaugggaacauuuuuaagaugcuaugucgggaggcaacaagguggccaacccaggugcugaggagcccacaccagcccuggacguguuuugccgcucaccuuugcuggggaguggugggagagaggauuccguuccacgugguggugugcgcagcugggcuguguggagcugggcgcuaggaggaaggugcuuucugcggggcuagccgggcucugccuuugaacacaaucaggcuccagguuuucagcauccagugcaugagaggacuucacgggcagcuguggcugaucccuugaugaauugggagaagaacaaaggucuaugaaaugagguuucauguagauggcauuagagacgcccacaacagauuuacagaguggagcggagacggcggaugggucugggaggccccuccugcuggccuugacugugacagcuguccugggaaucagcuuccaggccgccccagcagccugacugacacacacaggguuuuagccccauccugcgaccagcuguugccaucaucagugacagcugggaguggcggugguuccagcccugggcacccuccccaccugcuggggcccacccagggcaguccugacaccuacagguugcuuggagccgcauccgaguccugccccaccacgugugaagcccgaguggucgugggcugagguccccugauugcauccccacuucccuucugcuucacauagcugccucuucucaccguuuuuccagccuccugggcuaggaauuccaguguugugcuggcuuugccccaggacaccuccuuagcccucuuccugagucuagagccccggggguuggaaguucuggccccugggacaccugcagccacacucagcuucuccugugagccuccagcauguccccucaggaccaagcccucacguucuugccuccccgcccaccugggcucagccaggggaaggccuggcugggagcgucuccccucugcccugcccuucuccccucuacccugcccuucucuccucugccccgccauggcuuuuauauccugugccacaagacauggcugugugugaaaguggcagggucuggcaucucugugggucucugaggcccacgcuccagugccacucuucccacccgcuggccgugcccucaugcuggagggacagcccagcccucucccgaaccccagccccaugugcccagcugcccccggcccucuccccuggaagccggggucacuccagccguaugccaugguggggacauccugcuuccuuggccuuccagggaagguccucuuuccaaauggcgacaccuggucccugccuggaggcuggaagcuguggcccuuguaugccccuccagggucugugcgcucgguuggcccgaguucccaucaccgucgucaucaucaccaucaucauugucauuucgcuugucugugagccggccuggucucccagagcagagacccucugagguccagccugaguuggggucuccgugcugaccccugacggggacucaggacguaccaggucugggucaggagugacccccaaaccucgugcccuuugacaggcaccccugacuuuugcuaaguggguggaggugacaucacuuacagcgggagugaugggacagggucuguuggcugcacugugcucccagggaucuggggagaggcuauaucccugggcuuuggcacugcagagcuguguguguuuguguguguguguguguguguguguguguguguguguuugcgugcgcgcacauguguauaagaucuuuuuuuauuacaugaagcaagauaacuguugcuguuuccuuuuggguuuuguguucaacagagugggguacuucuucccucagacaacagaacucuccccuuuaaacacgugcugucagagggugggucuugggcucaugucuguuugcacagccgagucagaggaaacacaggguucuucauaaaaacacugcacagcaggcgacuguccagagucagccugcaggacggcagcagcccugccccucagagcacagcuagggugggcugcuuugggaucucccgucauucccucccagcuggcagccggcggccggcccauuccuuggugugcuggucaggggggcgugcgccugcucugcucacccugggaaugggacagaagcuggcagcucggagaggacagggcuggacccuuggguggccucuggcuggaccaucucauuguccucagacacagccucucgggucuaguuucauuuccugaaaaacaagugcacagaacuagagcaggagucgagagcuacggcccccgggccagauccagcccugccaccuguuuucacaccaugcucaagcugaguggguuuuacauuuuuuaauuacuugaaaaaaaaaaagccaaaggagguuucaugacccaugaaaauuauauggaauucaaaaaaaaaaaauuauauggaauucaaauuucaguguccauaaauaauuucuugagacagggucucgcucugucacccaggcuggagugcagugcuauggcauggcucgcuguacccuugaccucccaggcucaagcgauccuccugucucagccuccugaguagcggggacuacgggugugugccaccaagcccggcuaauuuuuuuuuaauuuuaguaaagacagggucuuucuauguugcccaggcuuuucuggaacuccaucuuggccucccaaagugcugggauuacaggcucgagccacggagcccagccuguuuuuguuuuuucacugauaaaguuuugccgggugugguagugugugccucuagcgauuugggaggcugaggugggaggaucgcuuaagcccaggaguuugaggcugggcucaagugaucaggaggugaacuaugaucaugucauugcauuccagccugggugacagagcaagaaccuaucucuuaaaaauauauauuuaaaaaguauugggugugguggcucacgccuguggucccagcuacuuaggcaucugaggugggaggauggcuugagcccaggaguuugagguugcagcgagccaagaucgugucacuacacucuagccugggugacagagcccagacccugccucuuuaaaaaaaaaaaccaaaaaacauguauuggaacacagccaugccuguucagucacgugcucuccaugcugcuuucugcuccagagacccuuauggccugaaagcugaaaauauuuucuauccuuuacaaaaaaguuugcugaccucuguccuggaaaauucaucucccaaguucucuuccggcacuggcguuccuggguguccuaaauuuggccccuguuauuucugaacucuguuuuggcucuguucccucccaggagccaggacaggcacguucucugcaucuuguccccugacgcccagaggcuuggcucggcucaggcauucuuggaaauaucuggcuccaggaaaggcagaggccuccugagucggcccagagggaaccugccccaggucugggggaggccugacccagcagaguggcuuuugccgauggguugggccggucaagaugugcugaaaguuguccucagaaggccacuuugggauuccuuccuccaguauuagagcaacugagagcugcucauugcaagccugauguuuucccaguuggccggguccaccgggugcccugggauucugcgaucuggguggaaaguagggggcuugggggaguguccuggguucuggaauccagguggcaaguggugagguucagggaguggcuucugagccaccauaggggucucugugggaggcucugcccauccaggagauuccgcaggcccugccggcccagagccagcgucuugcgcuugccgaggcuacagccagccccagccggguggaacagcccgucgccuccucucacuuuguuuuggggccaccugggaguguggagcaaggguagagagggaggaaguggcugccggccgcugcccagcacccuuguuugccuugggcccucugugggcuccuuuuuauugcucuucaaugaagccagggaaauggacuuccuugccucacuucaguucaacaugucuggaaguuugguauuaaaauuaagaaaguguggaaauagagcaagaagagaaaaaucucuccaagagauaauagugaccucugagcugggcgcgguggcucacgccuguaaaucccaguacuuugggaggcugaggcgggcagaucaccugaggucgggaguuugugaccggccugaccaagauggagaaaccccgucucuacuaaaaauaaauaaauaaauaaauaaauacaaaauuagccaggcaugguggcgccugccuauaaucccagcuaaggcaggagaaucgcuugaaccugggaggcaaagguugcagugagccaagaucacgccauugcacucuagucugggcaacaagagugaaacuccgucucaaaaaaaauaaauaaauaaaaaauaaaaauaaugaccucuggccagguguggcagcucauacccguaaucccagcacuuuggaaggaaggccgagaugggcagauugcuuuagcacaggaguuugagaccagccuggccaacaugguggaaccccaucucuacaaaaauagaauaaaauuuaagagguaauagugaccuuuugguagaucgaaaccuggauugcuuucuuuuucuaaaugcugauucuuuucuuugugguguuuguguucugugccgaugucccucccccagcccuguuauugugaguggaagaaggggaaaggguucgcccgcuacugugagccccuccucucacgcuggguguccuuggagaagccugcacuucuucauuguacgccagggcugggucccucccuggagugguucugugcugcugggauggggccaaccccucagauguuuucugagugucacacacaggugugugcauucauggccuuugcgugucuuccuguuguggaggcaaaaaugugaagaacccuagaugauuuugggaccagggcuccaucaccugcuguucauugcacaccggagcauccaggcauggguggagagcucagacuuccaggcacggucgcaggggcuggucuaaccauguucccgcccgccugcucaucagaaccgccuguugggagcuguuaucaugauaccauaccugggcccugggcuauccgauucugacuuaauugcuccagguuggggccaggccguuguuugcuguuuuguuguuucuucugugacguuagccacugggcuaaucugagccccucaguuacagguggagaaacugagacccaugggggugcaaggacuugccgaggacccagagccccuugggggcagagcugaggcggggccuggcuuugggucccagagcuuccaguccccuucccgcucuccuaacagcuuuuuuuuuugagacaagaucucacccugucacccaggcuggagugcaauggcaugaucucggcucacugcaaucuucgcuagcugcguuccagcgauucuccugccucagccucccgagcagcugggauuacaggugugugccgccaugcccagcucguuuuuuuuuguacuuuuaguagagauaggguuucaccauguuggccaggcugaucucgaacuccugaccucaaaugauccgccugccucggccucccaaagugcuaggauuacaggcugggaucacacugugccuggcccuagcagcuuuguccugugccauccaacaacagaugaccgaagucuuuguuucuuaacaugcauuccaucugccuuacaguuuugccaccugcaaaacagaggacuugucgcuuuucugguaagcuggaaauguaaucugguagcaggaggccuguggaagcuugccuuuaauggccuugugucucuuucauccuguccugagagccggagaacuuggauguugcgccuaacucaaccuuccuguuaacauacaguucugcaggcucauggaucaucagaaccacguccuaucucacgcggcuguaugcuuccguugguucagguguuuuuaccuugacaguauuuucuccucgguggcuuuugcggugguugcuuuuaaucagcauugacucuucaagaaaaauauuuagcugcuacaucucagaggagacaggguggaaagcaucugagaccugcaggcucagacuuagaaccagaagugcccucagaguucauccggcccugacccagcgggaaaugaguucacagagaagcgggagaacuuugccccaggcccugccguugcucauaacugccccagguccuuacauuugcuccagguccugccccaggcccugcaguugcucauaacugccccagguccuuauauuugcuccagguccugccccagguccugcaguugcucuguguggugggugugaucuggagcccuccgcccauugcugcaccuggggcaggcauugcuaauugaucccaggacuccuuccugcggagcacgcccugguucuccaggcagccgcugccugucagccugcagugguucgggagaggacaccugcuugccuggucuguuccaaaucuugcuucucaucccagcacagguagggggugcuaugggaaagggauccucagcuggcccugucacugcucuaucagcuggggacguggcauccuagugaaaacaucauggccgggcgcgguggcucacgccuggaaucccagcacuuugggaggcugaggaggguggaucacuugaggucagaaguucgagaccagccuggucaacauggugaaacccaucucuacuaaaaauacaaaaauucgccaggugugguggcggguaccuguaauccgagcuacucgggaggcugaggcaggagaaucgcuugaaccugggagguggagcuugcagugagccgagaucuugccacugcacuccagccugggcaacagagugagacgcugucucaaaaucucaaacaaacaaacaaacaaaaaacaaacaaacaaagcgucauuuauccagcaccccuggggaaccaugcuaccugguguuuuaugguaccuggcaaggugcagguaaaguugcggcucuugggcauugaacccgucuuguuuggggcagcucaggccccaggcaggguccggguuggcucucguugguguggcccuggcccauccagaccuauauuucugccguccugcaggugaucaauguugaugggacgaagaggcggacccuccuggaggacaagcucccgcacauuuuuggguucacgcugcugggggacuucaucuacuggacugacuggcagcgccgcagcaucgagcgggugcacaaggucaaggccagccgggacgucaucauugaccagcugcccgaccugauggggcucaaagcugugaauguggccaaggucgucggugaguccggggggucccaagccauggcucagccaugcagacuugcaugaggaggaagugacggguccaugccugggcauaaguguugagcucaggugccccgaccuggggaagggcaggacaggaaaggugacaguaucuggccaaggacagaugggaagggaccaagggagcugauuagggagugguuauggacuaggaaugucgguaacaaugguuagaaagugacuaacauuuguugagcaccugcugugugcccggcccuggccgggagccuucgugcccacagugaccccgucugcaaauguaguuccuugcccuacucgcacuggggagcaggacgcagagccgugcaacucacaggugccaagcucaggacucccuccugggucugccugggcugggcugugcuuguugccccuguggcccacgcaugugcaccuuccaccugaaagccaggaucuucaggacgcuccccgaggaggucguugucuggcacaaugauuugucucuuccugaaaaggugacagaguuacacuggagagagcagcauccaggugcggcagggacaggccuggggcucgcgggcagggacucuguguccugccggggucccacacugcaccugcuugucagaggcacucagucaaucuuugcugaugaaggaugagaggacagaggacgugaugcuugcugcugcauugccugcaguccugggugagaugcccggguugacucugcugcccgucggguggaugugaugucagauccccggcuuuaaaauacgagggagcugggaauugagggagcagguuggggcagaaagcacagccccguggaagccuggagcugaggcagugugggcgaccccuggagcagugagugcuuccuucauggccuucaucgcacccugcaguccucauguaggggaugcaauccaugaauuuaguuuucccagccuccuuuaaaaacgcguucaugcuggggccggggcagugcaguggcucacaucugaaaucccaccacuuugggaggccgaggcggguggaucaugaggucaggagaucgagaccauccuggcuaacaaggugaaaccccgucucuacuaaaaauacaaaaaauuagccgggugcgguggcaggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaguccaaaaaaaaaaaaauuagucugggugugguaucacgcgccuauaaucucacuacucgagaggcugaggcggagaauugcuugaacccaggagguagagguuguagugagcccguaucguaccacugcccuccaccugggcaauagagcgagacucugucucaaaaagaaaaaaaaaaaaagaacauuuaugccaggugugguggcucaugccugaaaucccagaacuuuggaagacugaggcaggaggaucacuugagcccagaaauuugagagugucuucccugggcaacauagagagaccucaucucuaccagaaaaaaaaaaauuagcccggcaugguggcauaucccuguggucccagcuacuuagggggcugacguggcaggaucaccugagucuggaggcagagguugaagugagcugagaucaugccacugcacuccagccugggugacagacagagacccugucucaaaaaaaaaaaaaaaaaaaagcauuuacuauccaccauggaaggugagacugaccugugagugauuguucaaagaacaaaaaauaaaccccagagauaagacaaaagggugccuccaugggggugugauuuaaagcugagaaauugggcuucuucccccuccccucucaccccgugguuugcuaaaggagaugggaaaaaggauucuuuuuuuggcugaaauauuuaacacuaaauuaaagccaauuuuaacagcacuuugguugaugagugaaauuaacagacuggccaaaaauaaacgaacggucuguacuaugugaaaaagaggcagcuuuggccaugcugggccaaugugaguuuucaggguugcugggaaugucugugaaucggaggaagggccuagcugggacucucaggagccaaggcccugaggggcaacuugccuggucccugcccugaggcguucacugcuuucuuccugggccagaucgcaggcccggaggcuggaccacugggcuggcacucuugccgagcugcucccugacuuccugaccaugcuccuuucagcagccuugcugcacuuuaguuuccuugaaugaaaaauggggaugagaauagcuccuaccuccaaggugaauggagugaguucggacaggugacucccugggaccagugccuggcgccugacaagguccagucagagcccgcacugcuguuacugauacccuuggcuguaccaggggagaacuugguugccauugccagguguucucccaccacccccacuacugucccuguuugauguguggcgggaauaaagcugugcacauuggagcuuuuggcacauccuggcuuucaggugaaaggugcguguguguuugaggguuuagccuggccaacccagccaugaggucggaccugacccgggggugaguccugagcucggcaccccugagcuguguggcucacggcagcauucauuguguggcuuggccgcaccccuuucccugcugggcuguugauguuuagacuggagccucuguguucgcuuccaggaaccaacccgugugcggacaggaacggggggugcagccaccugugcuucuucacaccccacgcaacccgguguggcugccccaucggccuggagcugcugagugacaugaagaccugcaucgugccugaggccuucuuggucuucaccagcagagccgccauccacaggaucucccucgagaccaauaacaacgacguggccaucccgcucacgggcgucaaggaggccucagcccuggacuuugauguguccaacaaccacaucuacuggacagacgucagccugaagguagcgugggccagaacgugcacacaggcagccuuuaugggaaaaccuugccucuguuccugccucaaaggcuucagacacuuuucuuaaagcacuaucguauuuauuguaacgcaguucaagcuaaucaaauaugagcaagccuauuuaaaaaaaaaaagaugauuauaaugagcaaguccgguagacacacauaagggcuuuugugaaaugcuugugugaaugugaaauauuuguuguccguugagcuugacuucagacaccccacccacucccuugucggugcccguuugcucagcagacucuuucuucauuuauagugcaaauguaaacauccaggacaaauacaggaagacuuuuuuuuuuuuuuuuugagacagagucuuacucuguugcccaggcuggaguaccguagcgugagcucagcucacugcaaccuccgccucccagguucaagcgauucuucugccucagccuccugaguagcugggacuacagacaugcaccaccacacccagcuaauuuuuuuuauauuuuuaguagagacaggguuucaucauguuggccaggcuggucuugaacuccugaccucaggugaucugcccgccucggccucccaaagugcugagauaacaggugugagccaccguucccggccuaggaaaacuuuuugccuucuaaagaagaguuuagcaaacuagucugugggcuggccuucugauucuguaaagaaaguuugauugguggcugggugcgguggcucacaccuguaaucccagcacuuugggaggccgaggugggcagaucaccugaggucgggaguucgagaccagccucacccacguggagaaaccccgucucuacuaaaaauacaaaaaaaaaaauuaaccgggcauggcggcgccugccuguaaucgcagcuacucaggaggcugaagcaggagaauugcuugaaccugggaggcggagguuguggugagcugagauggcaccauugcacuccagccugggcaaccaaagugaaacuccgucucagaaaaaaaaaaguuugauugguguaaccaaagcgcaucuguuuauggauugucuguggcagcuuuuguucugccgagaugaguugugacagaucuguaugggcucuaaagccuaaaacaugugccauccgccccuuuacagaaaaagugugcugaccucuguucuaaaguauuggacaacuacaauguuugcucauuuauuauucuaugauuuguuuucugcuuuuuguuguuguuguuguuguugagauaggguuucccucugucacucaggcuggagugcagugguguaaucucagcucacugcagccucgaccuccugggcucuagugauccucucaucucagccucccuaguagcugggacuacaggcacacaccaccacuccuggcugauuuuuuuuuuuuuuuuuuuuuuuuuggggagacaggguuuccgcauguugcccaggcugguuucaaacuccuaggcucaaacacccaccucagccucccaaagugcugggauuacaggcgugagccaccaugcccagccuauucuacuguuuguauuacauagcuuuaaaagauuuuuuaugacuuuaagucacaaggguucuuuguagaaaaaaaaauauauauaggaaaguauaaaaagaaaguaaaaauuguccauaaccucuccagccagagacgaccguugcugacaccucagcauauugccuuuaagucuuuuuucucuaagauagcauuucucuucaucacagucauaugcuacgcagaauucuguauccugauuuuuucacuugacauuacaacagguauuugauggcgcugugacaaacucuuuggcacaaucuuuuaaauguaugaaauacuccacugcacagauguuugcuuuuaggcuuaacuguucuuuuauuuugcgugugcugguuacagccgggcacaguggcucaugccuguaaucacaacacuuugagagggugaggcaggaggaucacuugagcccagaaguuugagaccggccugggcaacauagugagaccccaucucuacaaaaaacuuuuuuaauaagucgggcguaguggugcauagcuguagucccagccaccaaggaggcugaguugggaggauugcuugagccccaggagguugaugcugcagugaccugagauuacuccacuguacuccaaccugagcgacagagcaagacuuaucuggggaaaaaaaaaaaaaaaaaaaaaaauauauauauauauauauauauacacacacauacacgcacacacacauaauauaaaaauauauauuuauaaauauauaauauauaauauaaaaauauauauuuauaaauaaaauuuauaaauuauauuuauaaguaaauauauaauauauaauauaaaauauauauuauauaauauauaauaaaauauauaauauaaaaauauauauuuauaaauaauauauaauacauacuuauaaguauauauuuaaaauauauguaauguauauuuuuuaauguaugauauauaauauacauuuauaaauacacauuuauauuauuuuauauaaaauauauauaaaaucuccaaguugcuuuuuccaaaaaggugucuugcugcauuucaaacauucauuuaaaaacuugaaugcuggugaucugguccagaauguguucaguagcugcugccaguggccaagcaucucgggagaugucuacaaaacacgcugguucuggccuggcgugguggcucacgccuguaaucucagcacuuugggaggcugaggcagguggaucaacugaggucuggauuucgagaccagccuugccagcuuggugaaaccccaucucuacuaagaauacaaaaaaauuagccaggcgugguggcaugugccuguaauccccaccuacuugggaggcuaaggcuggagaaucgcuugaacccagggggcagagguugcagugagccgagaucgcaccauugcacuccaggcugggcaagaagagcgaaacuccgucucaaaaaaaaaaaaaaagaugcugguuccuaaaauguggcccuuuuccuccucaccugcugccagaccaucagccgcgccuucaugaacgggagcucgguggagcacgugguggaguuuggccuugacuaccccgagggcauggccguugacuggaugggcaagaaccucuacugggccgacacugggaccaacagaaucgaaguggcgcggcuggacgggcaguuccggcaaguccucguguggagggacuuggacaacccgaggucgcuggcccuggaucccaccaagggguaaguguuugccugucccgugcguccuuguguucaccucguaugagacagugcgggggugccaacugggcaagguggcaggcuguccguguggcccucggugauuagagcuguacugacgucauuagccuugaugguggccaggacugguagggcccucagaggucauggaguuccuucguggagcgggugcugaggcuguaucaggcacagugcuggcugcuuucaccugggccgucucaccgaaguguccauggagccugcguaggguggguaucugugucgauuuuacagaugcagaaacaggcucagagaaaccgagugacuucccuaaggucacauacccaguuagagcagagcugggccaggaagugcugucucaggcuccugaccaggucuccuugcuuugcacucuugccaaaaccaugauccagaacugacuuugagguccccggaccucaggcuccuccgaaauggccucuuggaggcugcugagccacagcuuaggacccaccucgagaggcaaaugugcuuugagcugccaggcguccugggggcccugccuugggcacgggguucagacaggccccagauguguggggcgucuuucuggacuugaguuuucuuuucugugugguggacacagugcucaccccuuaaagcaccugugaugugugcagcagcccaaucccugccugucgccuguucugcuagggaaggaaggaagacuucaggauggcaggacaacagaaagagguccagguuuuagagcaagggcaggucaaacuuagaaaauucuggaaugaggaugugcauuuccucuucuggaucugcuaaaagaagagggaaggaggggcugcugggggaggagcccagagccgaguuuacauccggaucccgcaaggccuccccugcccugaggucuuguuuugugaugugcuuguguccauccugguuucugccguguccccaacauccggccaagcuuagguggauguuccagcacacacucacccugucugugcaucuguuuuuguguccguaaguggguauuuacucgccuuacgagugagccacugugggaauucagggagguggcgcagugaccaccccuggagggauauguguguggcaggggucgagggucucgcccuucccugcuuccugcgcguggcuuucuccaggacggggagggcugagcugaagagguggggacaguugcguccccccgccacccacuguccugcggugagagcagacucacugagccugcccuucucccuugugccuuccagcuacaucuacuggaccgaguggggcggcaagccgaggaucgugcgggccuucauggacgggaccaacugcaugacgcugguggacaaggugggccgggccaacgaccucaccauugacuacgcugaccagcgccucuacuggaccgaccuggacaccaacaugaucgagucguccaacaugcugggugagggccgggcuggggccuucuggucauggagggcggggcagccgggcguuggccaccucccagccucgccgcacauacccuguggccugcaaguuccccaaccuggcaggagcuguggccacacccacgacugcccagcagccucacccucugcugugggaguuguccccguccaccccugggugccuuugcugcaguuaugucgggagaggcucuggugacagcuguuuccugugcaccugcugggcacuaggucccagcuaaucccugugccaggacucuaauuucacccuaacacacauggugguuuucauugcuggggaagcugaggccugagcacaugacuugccuuaggucacauagcuggugaguucaggaucccccagagauaccagggccagcacucgauccccacccagcccugaaccccaccaugugcugggauugugcugggaguguccacacgcccgggaccccagggcuggugcucucaucuccuuuuuccagaucaugagaaugaggcucagggaaguuugaaaaaaaccuaucccaagucacacagcaacaggagcaggauuugaacccagaaaaggggaccgcacacucuguucugcuagaguaguuagcuguccugggugauauggcaggugacaggggcaacugugcuuaacaaaggaacccccauccccccugccaaguugggagacuagaaggucaggggcagaagcucugaagggccaggugcaguggcugacaccucuaaucccagcacuuugugaggccaaggcgggcagaugauuugagcccaggaguucaagaucagccuggguaauguagugagacgccaucucuacaaaaaaauuuuuuaaaaauuagcugggcauggugguucaugccuguaguccaagcuacuugggaggcucaggugggaggauugcuugagcccaggagguugagguuguggugagcugugaucaugccacugcacuccagccugggcaauagagugagaccgucuccaaaaaaaaaaaaagaagaagaaaaagaagcucugaggcuccaaguccccaggcaccccuuggcuugagggcagacaagggaggagagggucaccugggcagcccugacuuuuguccccuggcaaagggaccuucagugaccuuggcccuaggagagccucugagcacgucagccaugucgaaccgcucaggaagggcagcaagaauuuggcuucugaccucugccucuccuacucgccaucugcacugggugugguugugcccauuuuacagaugaggaggcuggggcaucgaccagcugaaugccuugucccagguacugcguaggcagagcuggcaguugaaccccguguccugguugucgcugggggugggcugcacccugacuugugaggccaguagcaagguuugcacgugacuucgugaccgucacccagcucugcagcacaucccgugacccagcucauccaggccgcaugcaaaccuguugccaggcgagaaaccagucaccgcacagcugugguugccugaaaugauuaagcucauuaaucaccccggagugaggacagacucagaugaaaaccagcaaaagcccuggaaacucaugugacccugccaaugagggcggccaugugcauugcagccuggccgucacuccucgguacguguuuuggacuuaaacgcuccggauguuuacugagugcuugauuaauaacauggaaggccuggucucauugcugugggagugaaggaugcacagccaggccugacaugaugagaacaagaaccuggagucucgcugccugggugguaauccuggcccugccacuuagcaacugugugacuguagccaggucacuuaauuuugcuagauccugccugcgcuucaguggaucuugcugguuuuccaagguggccaaacacuuuaaggcauucauguggucgcuaggcugcaggguugaacccuggcucaccccgcagggcgccgugugcucuguggccuggcugugccuuugcugacaccgugcccguguguguucaugcaggucaggagcgggucgugauugccgacgaucucccgcacccguucggucugacgcaguacagcgauuauaucuacuggacagacuggaaucugcacagcauugagcgggccgacaagacuagcggccggaaccgcacccucauccagggccaccuggacuucgugauggacauccugguguuccacuccucccgccaggauggccucaaugacuguaugcacaacaacgggcagugugggcagcugugccuugccauccccggcggccaccgcugcggcugcgccucacacuacacccuggaccccagcagccgcaacugcagccguaagugccucauggucccccgcaccucacucccucguuagaucaggcugguucugggagcugacgcugaaaggagcuucucaucugggguuccuggguguacauagaugguuggguagguugugcacugcacaagcugcaugaugcuaccuggggguccagguccaggcuggauggacuuguugcuucaucaggacauagauaaauggccaaaacuccucagcuggaagguccugggcaggaucuuugggugugaaaaccagucacaggggaagggugcuugcucauacugccagcacagugcugagugcuuuccauagcgcucguuuacuccucaagccuggaggguggggaguagcauggucccauuucacguacaaggaacccgaugcacagagagguguggcaacccauccaaggccauacaacugggguggguugagccgggguugacuguggcaggcuggcucaagagucccugcuccugaacccuugccaggcagccuggcaucagcucggggaauuuuugcccugacccuuggaagcaggugggccucuuuguucucaugucagugaugagaagagugacuuuccuauggccccucuggaguacagguguuuccuguuggcgggcucuucccccaugacaucagcagcgagcugguuaugauucccuacgcagaacuugauaguuuauaaagcucuuugucauccaggccccguuggagucucacgcagaccuggucgcaggcggggcuggucuugccugucccagcugcauggauggggaacuugaggcuugcaaagguuaaggggcuguucgaggcccaggcuggcaggagaugggccugggccagagucugggacuucccaugccugggcugucuuugguccuguugcucaccaucccucccuggggccaugaccuuagagagccaaauggaggugcagguaacccacggcaaggagggguugccaugacucagaguccccguccuguggccggcaguaccuggugcaacgacuuggauuucagaccagccacuguagcccgcugacggugcgcucgaagugccacagcuucugaagccaggcaggacucaggccaggagacucuguuagcuguugagagggagaggccaacggauguucugguucugcuagagagcugguucuucggauccugguaccagugcacugagaggaggcccagcuugauucuggggcugccuugugguggcaugugcugcucacugacacccucgaggagugucuucucucgggcuuguugacugugcccgguuuuccgcaguucacuggugcacacauaggcacauagcaaaccgcacacacagucguggguaugaguuucacuacauuccaccaccaguguucacuaccauuaccugccuuccgucuuaaguguucaucauuuaaaaauaaauuuauugggcuggacacgguggcucaugacuguuaucccagcacuuugggaggcugaggcgggcagaucaccugaggucaggaguucaagaccagccuggccaauauggugaaacuccaucucuacuaaaaauacaaaauuagccgggcaugguggggcaugccuauaaucccagcuacuugggaggcugagagaggagaaucgcuugaacuugggagguggaaguuucaagugagcucauuuugugccacugcacuccagccugggcaacaagagcgaaacuccaucucgaaugaaugaaugaaugaaugaaugaauggcagggcguaguggcucacaccuguaaucccagcacuuugggaggccaaggcgggcggaugacaaggucaggagaucgagaccauccuggcuaacacggugaaacccgucucuacuaaaaauacaaaaaaugagccaggcguggugacgggcgccuguagucccagcuacucaggaggcugaggcaggagaauggcgugaacccgagaggcagagcuuacagugagcccagauagcaccacugcaguccagcgugggcaacagugcgagacuccaucucaaaaaaaaaauaaauaaauaaaagaaaaauaaauuuaugaucuauuucaaaaauaacacauguacuuugaaacagcagagacacauaugacacggagaaugaaauuccccauagcgcacccccaagagacagcccugguccccccgucuuucccguggaccuccagcggggcagaugcugagccgccuguugucgaguggcgugcuaucccguccuccagcuccucuguggcuuacagacacccaccugcagcccugucuuugccuccucuagcgcccaccaccuucuugcuguucagccagaaaucugccaucagucggaugaucccggacgaccagcacagcccggaucucauccugccccugcauggacugaggaacgucaaagccaucgacuaugacccacuggacaaguucaucuacuggguggaugggcgccagaacaucaagcgagccaaggacgacgggacccaggcaggugcccugugggaagggugcggggugugcuucccaaggcgcuccucuugcugguuuccaggcugcugccccuguccuuagcagagggaggaaacagaggauggcucugggugaaugaugacuugggcuucgauuauguagucacaggguaugacccugagaugcguggaaccccgagacugugauuauauguagaaacuggguuuccccguuguuuaaguagucaugguggggucagaccccacaggacuuuugucuuuucaagaaagaaaauggucgugugucaugcagggguaguugguacugguuaauccagguuuauccuuuauuuugugggaacuguacagucauuucugcuacaaugcuguauaugcucuucugaaagacaccuaugcaaaaucgcacaguaaaaaugacacaacucauagggaaagcggggccagggcacagcccucaaaaucuccaucaaugacauguaagaaaagagaggaaccugggaaauagcaaagugccuuuugcacauuaaaugguuagcuauaucccacaauacugugcauucguaaacguuaaugcugcaauaaauacggcacuucaccuugggaagaucuggaguuggcuuaugaguguggaaggguguagcgcaugaguuuuugugaaacacuggaaggaggauugugggaaaucaaauggaaaguucucaccccaggcguggagaagagugggucauggccccagcagugagcccagggaggucagagacggaggugugugugugggugugacccugcgcaguucccugccggcuguaguuuuuugcauucacuuaauguuucucguggaggaaauugugcaugagcaaaugugaaaccgugcugugcucaaauuguccuaauacaucauugcauuggaacagauuggcuuuuuuuuuuuuuuuuuuuuuuuuuuuuuugagauggagucucacucugucaccagccuggagugcaguggcaugaucuuggcucacugcaaccuuugccuccuauguucaagugauuuuccugccucagccuccugaguaacugggauuacaggcaugagccaccgcggccggccagauuugcauuuuugaaacaacugcuaggcugggcgcgguggcucacaccuguaaucccagcacugugggaggccgaggcagguggaucaccugaggucagggguucgagaccagccuggccaacauggugaaaccccgucucuacugaauauacaaaaaucagcugggugugguggcgggugccuguaaucccagcuacucaggaggcugaggcaggagaauugcuugaacccaggaggcagagguugcggugagccgagaucacaccauugcacuccagccugggcaacaagagcaaaacuccaucucaaaaaauaaaaaauagaaaaacaagugcuguagcggaagugagcacuuugcggagucaggcuuguguggccuguuccacaaaugaugugcucacggcggccucaggcccaccuggagucugcagcauggggcacaacagguucauuaguguagaauuccaggacaggccuggcuccuaagcagccuucuuuuacaaaaacugcagagcccgcuuguauccuagcacuuugggaggccgaaguggguggaucacgaggucaggaguucaagaccagccuggccaacauggugaaaccccaucucuacuaaauauacgaaaauuagcugggugugguggcacgcgccuguagucccagcuacucgggaggcugaggcagaauugcuugaaccugggagguggagguugcagggaucugagaccaugucauugcacuccagccugggcaacagagcgagacgccaucucaaaaaaaaaaaaccuacagagccacacggccucuuucuccaccgaguguuggugugggagcuuguguuauuguggugaaaucuugguacuuucuugaggcagagagaggcugagcgccuggagagacuuucacaugggucgccauguccgccgucgguuucgcuguugugcuccccaucugaaggcuggugccguccagacaggcuggacgccccuuuccaccagauccuuccucccgcagcaguuucuaguuacguuguacugugaggucuguguccuugguugauggcaaaagucagccgaauugaaauucagagccaugccuggcucccuggagcuucucuccugggcagcugugaucauugccucugcuguggugugggugguggaaauggauuccuuucaucuugcuugcuacaggugacugucacguggaguccuuuggagagagggacguguuaauugauggauguggcucccaugcugagaaagcuccugggcguacauugccuuagaguuucacuggagcugcguucuuuuauggugucugcuaggcagaagugaugaagacuuggaagaaaacccagaagguuuuccacuuaauuuggaaaaugugcuuuuccccuccugugucuuuugcuaagguccagccuccugcagccuccccgcucuguggacucuggcuuugauucuuuauuaggagucccccugcucccccaaaagauggugucuaaauuaucauccaauuggccgagguuuuguuuucuauuaauuguuuuuauuuuuuauugugguaaauauauauaacauaaaauuugccauuuuaauuguuuuguuauuguuguuuuugagacagggucucaccccagugcccaggcuggagugcaguggugcgaucauggcucacugcagccucagccuccagggcuccagugauccucucaccucagccucucuaguagccgggacuacaggcauacacuaccacaucuggcugauuuuuuguauuuuuuuuuuauuguagagacccgcuauguugcccaggcuggucucaacuccuggacucaagccauccucccaccucacccucccaaagugcugggauuacaggcaugagccacaacacccagccauuuuaauuuuuuuuuuuuuuuuugagauggagucucacucuaucgcccaggcuggagugcaguggcgugguaucaacucacugcaaccucugccucccagguucaagcgacucuccugccucagccuccucccgaguagcugggauuacaggugcccaucacuaugccuggcuaauuuuuguauuuuuuagcagagacgggguuucaccauguuggccaggcuggucuugaacuccuaaccuggugauccgcccgccucggccucccaaaaugcugagauuacaggugugagccaccgugcccggccuuuuuuuguuuuugagacagggucuugcccugucacccagacuggagugcaauggugggcucuuggcucacugcagccuccgccucccaggcucaaguugugcaccuccacaccuggcuaacuguauuuuauguagagacagauuucaccauguugcccaggcugggcuugaaauggacucaagcaguccacccaccucagccucccaaagugcugagauuacaggcgcgagccaccgcacccagcccauuuuaccuauucugcaguugacaguucaguggcauucagucaguucacgagguaaccaucacugccauucaucuccagacuacuucaccuucucggcagauguccgaaacuguccgcauugaacacacuccucaucucccucugacagccaccauucuacuuuguaucucucucugccuucucuagguaccucauguaaguggaauuauaccaauauuugcccuugugugacuggcuucuuucaugugacaugguguccucaagguucaucuguguuauagccugugucagaauuuccuuccuuaaagccugaauaauaacccguuguaaaggcugggcgcgguggcucacacccucuaaucccagcauuuugggaguccgaggugggcagaucacuugaggucaggaguuugagaccagccuggccaacauagugaaacccuggcucuacuaaaaguacaaaauuagcugggugugguggcgcgcaccuguaaucccaguuacucaggaggcugaggcaggagaaucgcuuguacccgggaggcagagguugcagugaaccaagauugugccucugcaguccagccuggguaacagagugagacuuccugucucaaaaaaaaaaaaaaucaucggauggauggacggaccacuucuuguuauuuauccauccacgggugcuagguuucuuccaccuuugguugucgugaauaaggccacuaugaacauuuccuuccguggugaagguuuuguacuagugaggaaaaggcguguuugugguguugcauaggauucugguaagaaaguuugcacuaaccauaaguauuuguacuacauuaaaaugaaagcucaggggccgggcgcgguggcucacgccuguaaucccagcacuuugggaggccagggcgggcggaucaugaggucaggagaucaagaccauccuggccaacauggugaaaccccgucucuacuaaaaauaccaaaaaacuagccaggugugguggcgggcaccuguagucccagcuacuugggaggcugaggcaggagaauggcgugaacccgggaggcggagcuugcggugagccgagaucgcuucacugcacucgagccugggcaacagagcaagacuccgucucacgcaaaacucugucucacgcaagacuccgucucaaaaaaaaaaagaguucaggguuuaugaaacuggccagccgcguaaaguuugcuguguuguuuuugugcccgggaggaguguggccagggugucacgucacacaguacacguuucucagauggugguucuccagacugcugucccaaagucuguuuuugcaucugguucccacagacccacccuccacggugagccugauuuuggccaggguagcuggaaucuugcuugucuuucagcccggcagcuguaccaguccaggguccacagcuaguggcuuuuaggaaggaauuuguucaguuggcuuugacacauggcccccuaggguccacagcucuguagugauguggauguuguuaucuacaaagacacaugauccuucguguccagaugaaagugaugaugucuuugcagcugcccagcaaggcuguguguguguguguguguguguguguguguguguguggugugugugugguguguguguguguaugggggagggaggcacccuuuccaucuggggguguguguguguggggugugugugugugugugcgcguguguguggugugugguguguguguguguaugggggaggcacccuuuccaucuggguccaagagacugggccuggggaagacgcuucuuuuuaucuacuuagagacuuuguuuuauuuguauuuuuuugagacagggucucacucugucacccaggcugggguauggugauaugagcauagcucacugcagccucggccucccaggcugaagcgauccucccaccucagccuucugaauagcugggacuguaggcgugcgucaccauacugagcuauuguuuuuuuuguuugguugguuuaauuuuuuuugauacagauggagucuugcuauguugcccagacuagucucaaacuccugaacucaagugauucucccaccucaguuucccgacauucugggaucacaggugugagccacugcugucucccuguuuuauuaacugcugaaagaccuagauaaagaaagucugaaaagacuuacuaucagagcaccauccuaagaugauucccucugacucaauggagagggaggggagcuuuuccuucaggccuggguggcaggagcccaggugcuccaggccccauuugccccaggccaaaucacucgggaacuuggaugcagcugucuuucaggguaacccaaaggaaccagauccccgcaggcaguaggcuucugggcuguccucuccuccuacgucagcucaguaagagcccuucgaagggaugcugugucggaggccccaaaagcccaggcucaucccugagaugcacagggugggcugggcuuaggcagcgcucgagcaucuccuggacggugaccccagagaguguggagacggagaguccuugagagucacugagagacguggcugcccugccuucccaagaggggcucugagucauuccccacacucaccugccccuacccacccucaccuggcccccagccucaccuacccccacaucuguaccgaucccuuuacccgcaccuucccuacccacccucaccuccccuguaccuucaccucccccacucacccgccccugcacccucaccugucccccaccuucaccuaacccccacccucaccugcccuccccucaccuggccuccuuccguuggggaagggguuguaaggggcggcccccaaacugucuguccuggugcccugcagagaaaacaguacgugagggccgcaguccaaaagcuugaguccuggaagguggaggagacagggauguguugggaagggccccauggucuuggaucccuucucgacugucaauggggccuucaugggagcgccagucuagugaugcacagcugggugcccggcggguggcugaggaggccuaaaguccgaggcggcaagagcucuuccagaggcuguuguccuaaucgcucuggcauacucaggcgggcacguaguuaggagcugauuggagaggagagacccccacaccaauacugggauuugacuuucaggcuaaacuugagaaguguggccucugcuguccugccagagcucuccagccagugcccagggcucuccagccagugcccgggggucuccaccagugcccgggggucuccgccagugccaggggucuccgccagugcccaggggucuccgccagugcucaggagucuugguuucuuugucuuacagcccuuuguuuugaccucucugagccaaggccaaaacccagacaggcagccccacgaccucagcaucgacaucuacagccggacacuguucuggacgugcgaggccaccaauaccaucaacguccacaggcugagcggggaagccauggggguggugcugcguggggaccgcgacaagcccagggccaucgucgucaacgcggagcgaggguaggaggccaacgggugggugggggugcugcccguccaggcgugcccgccgugucuucugccgaaugccagccucucacaggcuggggagacuuuccacccuggggauccaauggguggcuuuccagggucccaaaagcaaacacaggcucuuucacagccccuccaggaaagcagaaagccccaagggcuggaagggaagggggagcucugcugagagguuacaaggcagcgcuggccgacgggaguugcaguugauagguuuuguaucauccuuguuaaacuugaacccugugcagaaaucccuuccacggcaugggggcugccuguugacucgcuccuguuccaccacagggagcuccugggcuucuuccucccagaggcccccgacgcucccaccuguuggucgucagagcuucugguuggugggaaggcacccaggaccuugaggucuccagagagaaaagccagggaaagagggagaccgaaacccaugugacaugaaacucaggcuccaaacugagcacgggaacguuuggggacaggagcgcgauggccuuccucagauagcuggggggcuggcaugaagacgggagcuacagccagcacagguccugggccgggagcccagagauugagcccugacucugucacuuacuggccacgugaccuugggcggguggcauagccucuuggagacucaguuuccucauugguaggagugacggccacaguggugcggccucugcagcacacggggggcucggugggcggaagccccgggucuauaaggcggcugugcaggagccagccgagcuggucucccaacagccagggcuccgggguccuuagcagcuguggggggccugcaccuguuucccauggcugcugucagaaauuaccagaagccagguggcugagaguaauggacacuuguucucucacaguuccugagggcugaagcccgagaucgaggugugggcagggcccugcgcccucugaaggcucugagggaaccuuugggcuucugguggcuccaggcaccccuugacuugugguccugucacuccagucucucugucuggcugcacauggcguggccucuucuguaccauugaaggacacuucaguuggauuuagggccuacccucacccauuguggucguaucuugauccuucaugacauuuguaaagacccugcuuccaaauaagcucacauucugagguucuggggugagcgggaauuuggagagcauuguucaacuaguauagaaugugaccugucagccucgggcagcccugagaggcaggggcuuuccacagcccagcugggugcccugggcuccgugcuguccgaggagacgccauccccacacccguccuucacccgccacccucccgcagguaccuguacuucaccaacaugcaggaccgggcagccaagaucgaacgcgcagcccuggacggcaccgagcgcgagguccucuucaccaccggccucauccgcccuguggcccuggugguggacaacacacugggcaagcuguucuggguggacgcggaccugaagcgcauugagagcugugaccugucagguacgcgccccggggccugcccuaaccgcagacacccggccuucauugucaguaauggcagcagcugccacauuguccgagaccugccgugagcccagugccgcgccaggggcuuuguguguagcguguuuuguccucacacugacagcuguaggcugggguucugagugagccccacagggcagaggcagaaaaugagucucagagagggugagcgagcugcuuggggccccacagcaggagauggagcaggacugcagccuagccucugcccccagcaccugcgcaagaagcugcucugcucuggacuguguuaggcugcgagggcuggagagaaaugagaguuggugcuuagagagggggcgcagguccccauggcuuuuccucuuaugaugagguagaugggugaagggaggggccaugcuugcaggggccagugaccgaggcccgccguuggaacugauggccuucaucccgagcccagcccaggugggagcagggcuuuccgagggcuugucuugggucggccugcuuccagggacucugcugcagcucccaccccuguccaaagcauggaaucccccaggcucccuggcaguccugucaaccucuguccucccaagcugaguguggggcaaguucuggaggucagcacugcucaggggggcccacgggcugcuugcaggggccaaccgccugacccuggaggacgccaacaucgugcagccucugggccugaccauccuuggcaagcaucucuacuggaucgaccgccagcagcagaugaucgagcguguggagaagaccaccggggacaagcggacucgcauccagggccgugucgcccaccucacuggcauccaugcaguggaggaagucagccuggaggaguucuguacgugggggcuggcaguggggugggcaggguggccucuaaacccgaccccuggaggaggcuggaggccagugcaagauccuguguggccucagccaggcgguggucucugccagaugccaacuguugcccgcugggguucagcgacauguccgaaugucccgaggccucugagguuguuuucuuuugccgcagaacaaaucaccacgaacagcguuuuaagacaacaccaacucuuuuuuuuuuuuuuuuuuugagucaggaucuugcucuguugcccaggcuggggugcccuggugcaaacacaguucacugcagccucgaccucugggcuuaauuaagugaacaccuugccucagccucccagguagcugggacuacaggugggcaccaccacaccuggcuaauuuuuuuuuguagagacgggguuuccccauguugcccaggcuggucugcaacuccugggcacaagcuaucugccugcuguggccucccaaagugcuaggauuauaggugugagccacuggccugacaacacccacggauugucucucaguucuguaaggcaaaguccaggcacagcguggcucaccuggguucucugcucagggucucacggggccagaaucaaggugucaggaacgcugggcccucagcggaggcucuguggagaaauuagcuuccuugcucacucagcagguagcaguugugggaucgagguucuguuuucucucugguuauuggucggggaccacucucagcuccuagaggccaccacagguccuugccccguggcccucucugccucagcagugggggcucccugcgucagucccucccacaccuugagucucucugauuugcuucuaaagggcccugugauucggcucagccaccuuuagauuagguuagccuccccuuugauagacuccaagucggcugauuaauaaccuuaaucacaucugcagaaucccuucugccacauaaggucaugacgccgugcuggggacuggggugggaaauuacggggucauuuaggauucugccugccacugccuugcugugucccagggcuugggggaggggccuccacagcugggaccacaguccuuccuccccuccaugguaaccaucugaggauuacuugagaccagccugggcaacauggugagaacccaucccuacaaaaaauacaaacaaaaagggaccaggcugggcuugguggcucaugccuauaaucccagcacuuugggagaccaaggugggcugaucacuugagguugggaguucgagaccagccugcccaacauagugaaaucccgucucuacuaaaaauacaaaaauuagcugggugugguggcaggcgccuguauucccagcuacuggggaggcugaggugggagaauuacuugaaccugggaggcggaaguugcagugagccaaaauuacgccacugcacuccagccuaggcaauagagugagacuccgucucaaaaaaaaaaaagggccaggggugguagugacaaagagacccuaucccaaaaaaaccgaacacugaauccuugagacugaguaaggacacugugaaauuuuucuggguggggcagggaacagagcgucuucugucauuucuuccaccuggguguggucagcucucccuccaagcugccuccucuucuucucauuguccggguguuggacacauuugguuaacuggauagaauaacgcgaguucccagggacuugguccauuugcuauuuuauuuuauuuuauuuuauuuuauuuuuuuuauuuauuuauuuauuuauuuauuuauuuauugagauggaguuucguuuuugucgcccaggcuggagugcaguggcgcgaucucgguucacugcaaccucugccucccagguucaagugauucuccuaccucagccuuccaaguaacugggauuacaggcacccaccaccauaccaggcuaauuuuuuuguauuuuuaguagagacggguuuucgccauuuugcccaggcuggucuucaacuccuagccucaggugauccacgcaccucggccucccaaagugcugggauuacaggcaugagccaccacgccuggcaccauuugcuauuuuaauucccauguguauuagugucccacggcugcuguaacaaaugaccacaaacuggauggcuuaaagcaacagaaauggauucccccaaugugcuggagaccagaagccugcgaccaaacuguugggagggcugugcuuccucugggggcuccagggaggaucuauuuguuggcccuuccagugcugugggugccagcguuccacacuuguggaugcgccgccucaaccucugcccaucuucauguguccaucuccuuugugucugcgucuuuaccucuucuucuugucuguguugccucuuauaaggacguuugucauuggguuuagggcccacccaaaucauccgagaugaccucgucuugagauccuuaaccugcaaagacccuuuuuccaaaaaaagguuaugcucacagauucuaggccuuaagacauggguguaucuuucuggggggcacuauccaaccccuuauacaaugaaagacgggaagagggccaggugugguaguucacgccuguaaucucagcacuuuaggaagcugaagcgggaggaucacuugagcccaggaguuuacaaguagcuaggcaacaugaugagaccccauuucuacaaaaagugaaaaaaaaaaaaaaaaaaaaaaauuagccaggcacaguggcaggugccuauugucccagcuacuugggaggcuaaggcaggagaauggcaugaacccgggagguggaguuugcagugagccgagaucaugccacugcgcuccagccugggcgauagagcaagacucugucucaaaaaaaaaagccaggcaugguggugcaugccuguagucccagcuacucaagaggcugaggcaggaggguuguucgacccacggagaucaaggcuacagugagccaugaucgcaccacugcccuccagccugggugacagagugugacccugucucaaaguaaguaaauaggaggagagacaagugggcaguucagacugaugguaugggcacaguagagacuggugcagacaggcuggccugugaugucaagcaacuucuguaauuguuuccggcauccauuugugugucaauuuccgugucaguaggaagacucuguaggcugccaagaggaauaagugggaggauccucccagagaggccgggccugcaggagggccaguucucaugaguucucauuuggccccuacccuccaggcugugguucugaggugggagacagagccugaccucuguuugucuuguuuugucuuugcagcagcccacccaugugcccgugacaaugguggcugcucccacaucuguauugccaagggugaugggacaccacggugcucaugcccaguccaccucgugcuccugcagaaccugcugaccuguggagguaggugugaccuaggugcuccuuuggggugauggacagguaccugauucucugccugcuaggcugcugccuggcauccuuuuaaaaucacagucccuguggcauccaguuuccaaagcugauugugucuuccuuugcccuccuuucuuuucuacuaugugcauucggugcuaugaauuuuccucuaaguacugcguuuccugcaucucacaaauuuuguuacauuuucauuuucagguaguuugaauauuuuuacacuucuccugagaugacaucuuuggcucauguguuauuuagaaguguugcuuaguuucuaaagaguuggggcuuuuccagcugucucucugcaacugauuucuaauuuaauucuacuguagucugagagcuuauuuuauaugauuucuguuauuuuaaauguguugggugugguguuuuuguuguuauuguuuuugugucuuuuuguuuuguuuugcuucguuuguuuuguuuuugagacagugucuugcucugucacucaggcuggagugcaauggcgcgaucucagcucaccgcaaccucugccucccggguucaagugauccucuugccucagccuccugaguagcugggauuacaggugcacgccaccauacccagcuaauuuuuguauuuuuaguagagacgggguuucaccauguuggucaggcuggucucgaacuccugaccucgugauccgcccaccucggccucccaaagugcugggauuauaggcgugagccacugugccuggccauuagguguguuuuaucacccagcaucaugcaguuuaucuuggugaauguucuguguacucuugaaaagaauguggauucugcuguuguuggguggaguguuccagaaacaucaauuagauccaguugguuaauagugcucaucagguugucucuauccuuccuuccugacugccugcuugagcugucaguuauugacagggguguggagucuccaacucuaaugguggauuuguuuauuucuccuaguaguucuaucuuuuucucuccuucuacccuugauccucuucucccccuagggcuuccugguguuaguggugggagagugggguagugaagaaccuggacuuuagggccaaagaggccaggguucaaauccuggcucugucacuucccaguugagugacccuggcuggugccugaaucucugugagccuccacuuccuccucugugaaauugagagcacuuaccuggcaggcugucaugggcaucaaguaacagggcacuccaccuggacccugacacgugaugcacaggaaugccagcugcuaugccauggguguggcaguaguaauaaagugaccaucuguauccucaccacagugaagccuguccagggcuuucucuccuaugcccccaugccuccagguggccuuggauccuguugguucugugcucugcucagcgaccuuucucccgugggaguuccuggggguucagcuucauccuacagacagcagcacacacuggcugugcacccuuuuuuuuuuuuuuuuuuuuuuuuugagauggagucucgcuuuuuucgcgcaggcugaagugcaguggugugaucuuggcucacugcaaccucuaccuccuggguucaagugauuuuccugccucacccucccaaguagcugggauuacaggcucccaccaccacgcccggcuaauuuuuguauuuucaguagagaugguguuucaccauguuggccaggauggucuugaacuccugaccucaggugauccgcccaccucagccucccaaagugcagggauuacaggcgugagccaccacacccggagugccgguuguuuuuagcaguuugucuuguuccuggagagacuggcuccugcccaggagcucggggaguagggccgcggggugcugccucacaccucgaguuuggccguaagcagaggggacauuuugugacugucccccuccugagcuucccagcagcuuuucuccaaguuacagcccaaaagcucagguggauuugcaacccaacggugucugugcaccucccacugaugcccgaacugcccuggccaagaaacggggccgucagaacgcugcacuaacugcagccuugggccuccaugccagaggccaugcccuuccauccaccacccccuggccugggcccuggcccuccuggcucgggaacuccaggccccuuccucacggcucgagagacguguauuuaccgcacaggugcuugucauucucuuguggccucuucuccagggagaucacagaaggacagggccucacugaggucucggacauggacccuuugauaguggcaggagccaggcugggcaagaggcggccacagucaccucagcagugccaucaccaccgccauucagcccuucccugagccgggcgcgccccuggcucuggccccagugucccaguuacagcucacaggagcuuguggugcccagcggcugcuucugauugagagucgaggucggaggcuuugggaggcugagaggcugcucgguuucacaacugcugagggagacuugggcuccaucucaggucugccccaugucgcccucaaccuccagccaccgguccuccgugucccccauggccaggcacggcuugcagacaucugucguuggcuccucucagccgucgugggcugacccuggcacguccuccuguggcugagcccaguggggacagcugcuuccuuuuauuacccuagaacucucgucuuugaucaggcccccuccccuaugccacacagucccugucacucgggugagcccaguagucauggggaaggccugcggguuccaaacauccaaaggcuugcgugcagcaugacagcuugaaaccgauguuuuuuaccuugaucagauuucagcuuggcgggggcuuugcucagcuuucagugaggccugggccgauuucccagcauccccuccugaggccagccucuguuuccugugauuuucugcacaaagugggagggaggaguccuaggaaauggggggccaccucgaagccuaggccuccucuggcuucucugugccagugcccccacgcuuugugucuguguccccagcccaugggacucugcuauucccugagugcugccgcaugcccagcccgcacugaggacguggagccccgaggggcaggauggccuccauggucacacguaggaaguggccuccacccuccgaugauccucucccuccucccuuucagcgcccuccccggggguguccucagcccuccugccugugcuuugucccgucuucugcaggcgccugggacgugcugacagguccucugccggcuccugccuugcuaugcgcacgcuggucaccacagaggccuggcccuucuucuguagcagucccacacccgcaacagguguggcugcugaccaccugcuuucugccccucugguccugaggagggcgcagugggcacucaggcguggcugagcagauguguguugccgggaggaggaaggacugcuccagucagggcugaauuucccacccggagcauuucugcuguauuugguguagcgccugcugcuuaaagcucugauucccaguuggcacccuuucccuucugcauugaaaaacauacggaugcaugucuucuugcagugaauguguauucucccagccucucuucuggguuggggcuggagguggagcggcacacaggagccgcagcgauggaggaugugcgggugcagcaccccguacagcagggaugccaaacccgcgcugagucccucucaacuucugcuuugaagcccagucacgccauugccuggguuuugcugggcggggcugcgugugauguucuccucugucccucccccagagccgcccaccugcuccccggaccaguuugcaugugccacaggggagaucgacuguauccccggggccuggcgcugugacggcuuucccgagugcgaugaccagagcgacgaggagggcugccccgugugcuccgccgcccaguuccccugcgcgcggggucaguguguggaccugcgccugcgcugcgacggcgaggcagacugucaggaccgcucagacgaggcggacugugacggugaggcccuccccgucaaggcucugccaagacccuggcccugcccuccgggauacgagcuuggggcugccuccggccucacaggaguaggggcucugaaaaccuuugcuugcagggagauugccaagucugucuuuuaggcccaacaaggaaaacucugcaguuccacccauccugucccaccagguaguguggcuugaaggcagacugugagggucuaucucaccuuccugcauuaggucaggaguuucacagaaaccugaggcacauucaggggugggcugcagagguccauggcucacacccuggaaaauccgcccccaaaagacagugcugucuccacugaccagucugugggauagugcuuaagccugagugguuucuaucaacauguagaaucaggagguauaaagagauuugcucaggcauccugggcccucucugaccagcaggaucuuccuuuagaucuugacagugaaacacaucucuucugugcccccugugaguuuucuuucauucauucauucauucauucauucauucauucauucauucauucgagacagagucuugcucugucacccaggcuggagugcccugguguaaucucggcucacugcaaccucugccuccaggguucaaucgauucuccugccucagccucccgaguagcugggaugacaggugcgcaccaccaugccuggcuaauuuuuguauuuuuaguagagacaggguuucaccauguuggccaggcuggucucgaacuccugaccucaggugauccgcccgccucagccucccaaagugcugggauuacaggcaugagccaccgcgcccggccugaguuuuccuuuuaugaaggaccugcuugguugguugccugccacauguugucagcaccaugggcccaggacugcugaggagcuguugaugcccucgcucucccagagccaccggcucuguuagauaauucacaugcagucuggccacuguccuacguccucauucacaaagagcagacauuucguagaagaugagggccugggaguaaccucccugcauguuuuucuauaaaggcauagugguuaaguccuuccagcucauugaccauuggagaauuuuauggaggcuguagacuaggggcugguaaacuaagggcccaggggccaaauccagccugccaccuacuuuuguaaauaaaguuuucuuggugcacagccaugcccauucauucauuugcacaaugucuguggcugcuuucaugccaaaagcaagagaacugagugguuaugcuggagaccuacggccuucaaagccccagaccucacgucuggcccuugacagacagagcuuccccagcccugcugcgcauccuggcccagcaugugcugugugugugauuucagcuugcaggagccgugguuaggaauugucccuguguugguccauuuugcauugcuaugaaggagcaccugaggccggguagauuaugaaggaaagaggucugucuggcucaugguucuguaggcagcaccaguauggcacccgcaucugcucagcuucuagugaggucucaggaagcuuugacucauggugaaagucgaagcgggagcaggugcaucacauggugagagagggagcaacggagagagagagagagcgccucucccucuugcccucaccuugagaggagaugccaggcuccuuuaaguaaccagcucccaugugaacucacagugagagcccauuugcuacugcggagagggcaccaggcaucugcucccaugacccaaacacugcccaccaggcccuaccuccaaccuuggggucauauuuuauucuguucuaugcuaugcuaugcuaugccaugccaugccaugccaugcuauuccuauucuauuauuugagacagaaucucgcucuguugcccaggcuggagugcaguggcaugaucuuggcucacugcaaccuccaccucccagguucaagcgauucuccuguaucagccucccgaguagcugggauuacaggcacacaccaccacacccggcuaauuuuuguauuuucaauagagaugggguuucaccauguuggccaggcuggucucaaacuccuggccucaagugauccaccuaccucggccucccaaagugccaugauuacagaugugagucacugcgcccagugagggucacauuuccguugagauuuggaggggcagacguuggagccaucugagcccccucgucccgcucuagcuucuccucccgugugccccgcggugcugguggcaggcccuuacgccgguucuggcugcaugcucuguuccagaagcuuucuucccugcuugguuaccagaaaaucaucccauccauuacaaggacaggguccccuuaucucccauucccagggcaggacaccgggggcagggcagguggggaacugagcaaguucucugggggcaggcguggcuauggcucccucugggugggcgucuggggagggguggaggcagccgucagcgcccuggcuugcucuuccucccuggccagagacuguggccuugugcugcucccgugugggcugccugcaccuccaguggguugugcucccuccccuccccuccccucaagcucugcugagcaccacugccuuccacagcccccacucucgggaggcgaggcuccucguggccauuccuguccuuggcacccacccccccaccaaccugguagagccuugggcggggucuguuacuccuugcauggcguagaccuccccacaguaggcaccugacacauaccuccuggggggcaggcaggaggugcguugaggucucagcccuggcagucccuccccugcguggcauaggccucgccacagggucaucgaggguggguggagacuguacuagaccacuccccgcugguccuagaaagggucccaucugucugcucucuguuuggaguccagaccuugguugcugugcccugcauggugggcuggggggcacccuccagccucucugagugcauggccucuccuugcagccaucugccugcccaaccaguuccggugugcgagcggccaguguguccucaucaaacagcagugcgacuccuuccccgacuguaucgacggcuccgacgagcucauguguggugagccagcuucuggcacggggaaggggcguccgggcuggguucccccaggaacguggaguuuaggggaggagacgugccuuuccagcggggcugggggcugugugggagacucaggcggcugggaggcuccuugcgggaggcagggaagccuuucccagggcagcggccaggaggacagacugugagcugugggcucggcggcuacagagucugccucagugggcggggcugaugguguccaggugccugcagcacgcacccacccacgggaccuugcugagcagcgucugucaggcagcaagauuacccgagggcugcagugguccuguucccuggcagcuuacugucuggcugaggaggagugauguucacauaugcacacaugucaugugcacacacauguacaugacaacaucccacaugcuccucaaauagcaugaccuguacagucacggauauagggccuaggggauaggaggccaagacagucagggaagacuuuccagaggcaguggcuccugaaaggcugucugauucaggcaggaagggagcugaguucagauaggaaguagcaaugagucauugugucuggggacauggccacuccuucgcugcagagggaccugggcugagagcuccucucuuauggcugcagucgggagagaagucuguuggggggagaagggggcuuccucaagggacucccugugcccuuuggcaccuucgugccaggucaggcuugaggccugaaggcaguggugggggccaccaagggucgccuccucugcugggcaaguucccagucugacgggccugugccgugggccccagcugugggggcgcuguugaugcgcagccaggccucgccgccagagcccgcacgcuuccauuccgcugacuucaucgacgcccucaggaucgcugggccggcccugugggagagugaauguggcuuuugccaaaguugagucuggagccuggaaacuucccuaugggcagccuugauaguggaguggcccaaggagcccacccagccgacccugccccucccguggcuggugggcggcaccaggggcugccuggcuuugcucguucaccaacaucaccugggcuggccagggcgcgcucacuucugccaccaccgagggcccugggcgaaggagugaauaccaggcugccuuggcagggauguguugagggcuguggggagucggacagcggcgggggucagaggaggaggagggugcaccgugcaggcugaagggccacguuacccugagguuggccaggcuccccaggccuagccucccagcucccccacuuucuccccacccuccaccaguggcaaagccagccccuucagggcgcacggugucugcccccaaggagggcccauuccguugggguuaauguuggccaccucuuucuguuugucucuggcagaaaucaccaagccgcccucagacgacagcccggcccacagcagugccaucgggcccgucauuggcaucauccucucucucuucgucauggguggugucuauuuugugugccagcgcguggugugccagcgcuaugcgggggccaacgggcccuucccgcacgaguaugucagcgggaccccgcacgugccccucaauuucauagccccgggcgguucccagcauggccccuucacagguaaggagccugagauauggaaugaucuggaggaggcaggagaguagucugggcagcuuuggggaguggagcagggaugugcuaccccaggcccucuugcacauguggcagacauugcuaaucgaucacagcauucagccuuucccacugagccugugcuuggcaucagaauccuucaacacagaggccugcauggcuguagcaacccacccuuuggcacuguagguguggagaaagcuccuuggacuugaccuucauauucuaguaggacaugugcuguguuguccacaaauccucauguacccuagaaaugaaugugggggcggcugggcucucuccagagcugaaggaaucacucuguaccauacagcagcuuugucuugagugcagcugggauuuguggcugagcaguuacaauuccuacguggcccaggcaccaggaacgcaggcuguguuuguagauggcugggcagccgcaccgcagagcugcaccaugcugguuuguaucacaugggugaccaugguaugucuaagaagguggagucccugugaggucugcaggugcccccacagcuccaggccaccuugaggauugccucugccugcccagcccugaguucccucuccccuguccugucccacugucaccccaagccggccucauugggagccuguuggauggcaggguauagauguaaccugauucucucuggggagcgggguuaucuggcuucucaagagcuccuaggagcccacagugguggcaccaucacagucgcagcagcccccagagaacgcggcccugucuguuccuggcgugcucugugcugccccgccuggguucccugccccagucgcaggccccuuggaggagguaccaugugucucccguuucacagaugagccccggggagcucacucuaguaguggccagagaggccugcggcucagggagcggggcacauuuccaacaggacacaccgcccuggucugagucucguggguagugggagcagaggagagcgcccuaugucuguggggcggcuuggcugagccuggaagccaccugaccucccccgucccuucccugccaggcaucgcaugcggaaaguccaugaugagcuccgugagccugauggggggccggggcggggugccccucuacgaccggaaccacgucacaggggccucguccagcagcucguccagcacgaaggccacgcuguacccgccggugaggggcggggccggggaggggcggggcgggauggggcugugggccccucccaccgucagugcuggccaccggaggcuucccggguuccugggggcugugccaccgccucugaggcaugcuugcuuucuucccuuuucaaacccuucugcuuccuucuuuaaugacauuguugauuguggauaaucugaaaacuacacaaaaauauaaagagccaaaaucucacccaaauccaccuccuagaguggcuguugggcuccgucagcauccaggcggccgucuguguuccgcacggcccagcccaucgauagccgccugcaccaggccugucugcccucugugagccuccccacaggguucccuccacaaacacccuguucucccacccagggcuggcugcuuccuggaaaacagcuggaugguuuugugcaugacagacaaacacagggugauuuucguggcuaaaauacucccuggagcuuuuggcagggugaggggcuggcuccagcugagccacgccuugagugaaaugacugugaggagaauaaacugccgcugcccuccaggaucacuggggcuggcuggggagaacccccguuucugggagcacagucccaggaugccaaggcgagcuuggugccgagaugugaacuccugaguguaaacagcgggggcugacuugacaugcuuuguaugcuuuucauuuguuccugcagcuguaugccccuaaggugaguccagcccccuucugcuuccucuggggccucgccagugagccccaccuugcuggggcugguuccuccugcccuucuggguaucccucacaucuggggucuugucuucuuguuuucuuuuucuuuuuuuuuugagacggaguuucacuuuuguugcccaggcuucagugcaauggugugaucucuaggcucaccgcaaccucugccucccagguucaagcaguuccccugccucagccucccuaguagcugggauuacaggcaugugccaccacgcccagcuaauuuuguauuuuuaguagagaugggguuucuccauguuggucaggcugaucuugaacucccuaccucaggugauccgcccaccuuggccucccaaagugcugggauuacaggcgugagccaccgcaccuggccuuuuucuuuucuuuucuuuucuuuuuucugagacagggucucgcucugucacccaggcuggagugcaauggugucaucauggcuaacugcagccucuaccuucuaggcucaagcaauccucccaucucagccccuaaguagcuaggacugcacgcaugcauccccaugcccagcuaauauuuacauuuuuuguagagaugaaguuucacuauauugcccaggcuggucuccaacuccuggacucgagcgauccuccugccucggccuccccaggugcugggauuacaggcgugagccaccgugccuggccugggguauugucuucuuauggcaccugacuguggugggcccugggaaggaaguagcagaagaggguucuucuugguuuccuggacaguaacugaguguucuggaggccccagggccuggcuuuguuuagggacaaagggaacugguaaccagaagccgagaguuuaaacacccacugcccuucuucccugcuccugcugcugcaacccagcuuaaccagccaggagugcuaggaacccaagcagggcccccgagcacacagcaggcagcucacgaauucucuuuuccuguucucccuugggagcugggaggaucuuaaucaggcaauaagagauggcacugagcagccagcuaauuuuuuaaaucacuuuauuguuuaaccauaugacucacccacuuaaaaaaggguacaguucaguggguuuuaguguauucacagaugugugcaacccucaccacaguuaauuuuagaacauuuuccugccccuaaaagaaacucugcaugaagccagcuguuuuuaaauuagcaaaguuauuuugcauccuuuaaauauauguucaugguacaaaauucaaaagauacagaagagucugcaguccaaagagacuccgcccccaugacgccaagcaggacucccugggaggcauggccuccugcaguguguuucuucuauguccccccaggggucaucuguacauaugcaagcauacaagagcguggacuuuguuuuccaagccagaagauaauuguagauuuaugugcaguugugagaaagagcacagacccauuuauccucugccugguuucccccagugcugccugccaucuugcaugacuuccauuccuaucauaagcaagacacugauaacgauucuuucaccuuauucagauugacauaaguguuuuuuguuuguucuugagacaaacuuccucugucacccagugggagugcaguggcacaaucacagcucacugcagccucaaacuccugggcucaagcgauucuccugccucaguccccucaaguagcucagauggcaggugugcaccaucaugccaggcuaauuuuuaaauuuuuuguggaggugaggccucacuaaauuuccugggcuagucuugaacuccugagcuaaagugauccuccugccucagccucccaaagugguaggauuacaggcaugagccacugcgccugggcugacauauguguuuucguaagcccgaaagauagcaucugaagagucaacauugagccuugccuuuugcugcuaacgauguauaaaagcugcuguucugagcauuucggaggcucccagcugccgugugcacccugccuagagcucuaccguaacccaucuccgggaggaggugcuauuguuuuccucauuuugcaacaaggaggcugaagaacugagcaugaaccacuggccugggucguucgguugguaggcaguggggccaggccauccaacucacaaccaccuucuacucugcuucccccgcacccugaaguuuguucuguuuugaggacacagccgucacauucuugguggcugaacagcacuccuugucaggcguggcugggcccccacuggagggcaucaugguccucucuccugcugcgguugaaccuuggcuguuucaaccacuccugccaaguggcccucugaaagggacaguccaucuuuucucagcagagggccacacuggcaaaacggucccuggcacccuuucucuccaccugucuaauauagaguaaaaaugguaucauguuaagaucuucauuuauauuuauuuuaucaugaaugauguaagcaucauuuuguguguuuaagaaccuuugggcccagcgugauggcuugcagcuguaaucucagcacuuuaggaggcugagaugagcggaucacuugaggccgggaguuugagaccagccuggccaacauggagaaaccccgucucuaguaaaaauuuaaaaauuagccggguauggugaucccagcuacuugggagucugaagcaugagaauugcuugaacaugggaggcggagguugcagugagccgagaucgcgccauugcacuccagccugggcgacagagcgagacucugucucaaaaaaaaaaaaaaaaaagaaaagaaaagaaauuaucaaucuccucuuuuauggcauauauauauauauauauauauauauauauauauauauauauuuuuuuuuuuuuugguuauguucagaaaggccuucccugcucugaucauaaaaaacaacuuauuuucacacucucucucuuuuuuuuuugagacagaguuuugcuccuguugcccaggcuggagugcaguggcgcaaucucagcucacuguaaccuccgccucccggguuggagugauucuccugccuuaccuucccgaguagcugggauuauaggcaugcaccaccaugccuggcuaauuuuguacuuuuaguagagacggggguuucuccauguuggucaggcuggucucgaacucgcgaccucaggugauccacccaccucggccucccaaagugcugggauuacagacgugagccaccaugcccagcccacacucucuuucuuaacguccuccuccuuucguuuuacguucacaucuuuaauucuucugggauguaauuagauuugaugagcaaggugggcauccagcuuguuucuuggcugauggcuuauggguggcgugaauuagucggggucuaucaggaggcagaaacucuaugagaauuugaacagagaaaguuccgucuacaggcuuauuaccagggacuggaauagcagaaauugaacagugagauguacagagaacucuaagaaugcaggaauaggccaggcaugguggcucacaccugucaucccagcacuuugggagaccaaggcggguggaucaccugaggucaggaguucgagaccagccuggccaacauagugaaaccccaucucuacuaaaaauacaaaaaaauuagcugggugugguggcgcaugccuguaaucccagcuucucgggagucugaggcuggagaaucacuugaaccugggaggcagagguuguagugagccgagaucaugccauuguacuccagccugggcaacaagagcgagacucagucaaaacaacaacaacgcaggaauagcagaugagccgaguggccuccccagcccccaccccccaccccccacccugggccgagauccaguccucuuugaauagggccuggccgugguucacgggacaucugagacauugccgaggcgcugcacugguggaucuugccagaagucugcccagugcagauuugggcagaaucucaaacugccuugggauguaggagagaaaccaggccuggucaaguucaugggaagagguggaaacagaccccauaggcuggggcuugggcagcuguaggaagcccucucugcugccucccugccugcucucugcuuugaagcaucuuccccagugcccccagucucaugcccucucaacguuggggucaaauccugaggaauacccagacuggcucucugggccaaagaggacccucuccagaaagagcagggcccagugcggcuuccuaaagggcaggggaagggccuggccacuccccagaggcuacucaccagccaucaggauagccccaggaagcaggccuucucgagcccauuuuauuacuuuauuuuauuauuuuauuuaauuuuaaauuuauuuuuugagacagagucucacucuguugcccaggcuggagugcaguggugcgaucucaacccacugcagccucugccuccaggguucaagggauucucccaccucagccucccaaguagcugggauuacaggugcccgccaccacacccggcuaauuuucauauuuuuaguagagaugagguuucaccauguuggccaggcuggucucgaacuccugaccucaagugauccgcccgccucggccucccaaagugcuaggucaagcccauuuuaaaguugaagaaacugaggcugagguaaauucccuccccagggauccugcugcagccagaaggugguaaaacaggacuucacccgggucugucuggcgugaaaggcaguguucuuguaccacccuagggggccugagagaacugagucccucgggcauaacugacaguucuguucccauuauuccgcaggggcucggaucuggcuguaugcuuuccaggauggccuuggagacccacauaagcccuacacccuuugggaagcugcauguuggguuggggugccgucaguggcacuuguggaaggugcagaccugugugggugugugggcccagggccccuggucccuuccucccuuuguagggcugguugugugcugccuggaccuggggggcacguucacguggugaauuugucuauuuacuauccccgcuuuggggcuggugccagcacaggcccuugugaagggggugccuuugucuggagugggacuguggccccucccucagcguggugacuucugugucagggcuucagcagggacgcagagccccugaguguucggaacaagggcgucauugcaggaguuagacugugugugauggagggaggaggggcaggaggaaaggucagaaggagaguuccugggaaggucccugaggagccuggugaggugcuaacugguguggaggacacucagggccuguggggacaucuccuacugcugggggccagccacaaagggaacuggccgaaguccuguccccgccuucacagcccagcaucuggucacaaggcagguacuuggaagggcgcgggcaccugggccaaaagugccuggguucccuuugccuuucacugagaugaccuucggggcagguggcugcugccuccccuccuguccccagguuuugccaacuggccagaggaagggguccugggaagcaggggggccagaagcccucucugcaaggaaagcccgaggggugugggaggaaggaaggaaugcccaggcuggcgaggcucuaagucacccuggcuuggcucuccucagauccugaacccgccgcccuccccggccacggaccccucccuguacaacauggacauguucuacucuucaaacauuccggccacugcgagaccguacagguaggacauccccugcagcccuccauggccauuggguucccgccagcccgugguggaggggccuaauccccaugccacugaugaggggagguauucugggugcuagugggcaggugccgggcccagcccugccucccucugcucugccaaccacacuaggcugccuccccagacaagcucagcgggcacugcauguuggguucagaaaucagcagaacuccacguucugagcugcucuucaaguugcuccuauggggguuacuuuuaagcugggaaauggcuguggcgucgaggggccgggggcuugggcuccagagucugacuguguguuugaguccggcuguggaaaccuagccauugagaugcccccucuugguggcucuguccucuuaggaugggacaagucugugaaggcugcugcagcacccaccguagaccccuaaucgugugacgucaccaggaugguccgggcugcucacuugccacaguggccuguuugagcccgggaagccaacggggcugcucagcuggacaccagccccccgagcugcccauguuggggucacaggccccaccucccugguuggggaggggcaacugagaguguggagaggugggacccaggugugcuggucuccgcaggggcuggaucagagccugggaugggcagggugagccuccugaccuuuaacccaguggugucaggcaacguggcccacccgccagccgcaccaggccccacccccgcaggugaaggggugggauaggcugggccugggccaggacaccucuggaccacgcauuccucauugcuugggucccuggagcagcagggccucccgaguguggugccgccugccaccuaguggccauuuccacgaacucccaggccuggcuggggagccggaacugcagccuccauuuccaccccacuccgggucgggccaccucccugaugccucaguauuauaucaaacugucacagucugucccacagccuuacagaccacugucuccagaauggucacauccacacugggcagcccagucucgcuaguuccucgucccaccuccugccuuugcucaugcccguccugcucugggcccaccgcggacacaucuuccccccgcccgccgucugaccucacagcagcugggccccaagaggaguauccuguccugcugcacuuuucucaacacccgguguuggcugcaccuucccacccauugcaggccccucugugacaggacgggggcuccuaaacacaccacaguuccgagucugaacucacacagugggaugcggcguuucugggccacaguugggugcagguagccucugggaggaugggaggucaggagccaucuugcgagucagguugcuugaacucaggauggaaguguuccgggcccauugguugcuguauuagccuguucucacgcugcuaauaaagacauacccaagacuggguaauuguaaaggaaagagguuuaacggacucacaguuccaccugccugggguggccucacaaucaugguagaagacaaggaggagcaagucacaucuuacauggcuucagggaacagacagcaugagaaccaagcgaaagggguuuccccuuguaaaaccaucaagucuagugagauuuauucacuaccacgagaacaguauggggggaaccacccccaugauucaaucaucucccacugggucccucccacagcacgugggaauuaugggaguacaauucaagaugagauuuggguggggacacagccaaacccuaucgguugccaacauuuacaguaacaguguuaggugaacaguuguccagucuccuguuuugucggacacuguuucuagcaccuuccaggcagaaucucauguauccuucacuuucgaaauggguacuauuucauccccacuuuuaucaaugagaaacuaaagcucgaagaggucaaguaaguuccuggccaaggucagcuagcaggcucuagaggccucguucuccuuagaggcagccuugccagggcccaggcuuggcaggcugcagggcaggugcgggcaugcccaugguagaggugggaccauugaggcucagagaggguaagugaugagcccuggcgacacagcgggguggguccagaguccggccugcaucuucuggagcuggccaguggacaggccuuucccguucacagccccggggcugcugugcccaccagggcggaugugccuaccgaaucccacuccucugugugugucccuuucaggcccuacaucauucgaggaauggcgcccccgacgacgcccugcagcaccgacgugugugacagcgacuacagcgccagccgcuggaaggccagcaaguacuaccuggauuugaacucggacucagaccccuauccacccccacccacgccccacagccaguaccugucggcggaggacagcugcccgcccucgcccgccaccgagaggagcuacuuccaucucuucccgcccccuccgucccccugcacggacucauccugaccucggccgggccacucuggcuucucugugccccuguaaauaguuuuaaauaugaacaaagaaaaaaauauauuuuaugauuuaaaaaauaaauauaauugggauuuuaaaaacaugagaaaugugaacugugauggggugggcagggcugggagaacuuuguacaguggagaaauauuuauaaacuuaauuuuguaaaacagaa

SEQ ID NO: 192770 - RNA, 10667 nt, Homo sapiens
auuuccggcguuugggcggggcccgggcagggcgcgcugcccggagcugccuggguugcgcugccggccacguccccgcgccgggccucaggcuccuuccuacuguccgagggccaccaggccgccgggggccugcugcgcccggguaaggggcucgcacugccguccggguagcugcugucagggcucccugacuggcuugggacugagagacagagguuggggggcaggaggaggguuggaugggggcacgaggggcagugggagagugaguggggcugagagaggcaggaggaacgggacaggaggagcggcggauggggcacgcacagagugcaagacgcugagcaaugcagguacugaagaagucaacugggggccgagcauggcugggggcccaagagacaggaggagggaggagggccgaagggggcccagacuggagaagaggccggcuugucccauugugggagcagaauggggacacucuggaagggggccgaauuuguccuggggucuuucccgggcaagcccaggacgggacuggaccccaagaagugucgcucuuacuugagugacacagaccuaucccccagacccucucucuaccuggguggagguugugcauugccccagauucccuccccugcccaucugucucccugccugcuucccccgugcgagucacuuaguagcccccguguggcugcuuagcauguugacuuaaucguuaggcugauaggaggaaucggccuccacacgcaugguuugccaccagaaauaaucaucgugcuuagaaaucugacuguaauaacuugcagcuaucccucgccccaggaaaaucucuaacauuucgauaaaaucagcuaggaaaaucuuuaaaauacagauguuuccauuuauacaguggaucugccuaauggacaaaggaaugucagagcuacccacguucuuagcaaaaacuaggcccuaguauuuagcuguguuaccaaaacuuccagaaaccuggaagcaagcaagguaguuaauguaauauaauaaauguccaauguucuagguucccgucugccacagagucacauccuuuggacuacaggacaaugucuauauacacaaagccauaagucuguguuccuugggcuucugcuaccaaaguucagccaggugacgugucaggauuagguaccugcaguuugcccuguauuuguguuugcaguuccuacuccuugguaucuguagcuugccuaacuuggugugggggccuggccauguugcggcugagugagucuuaauagccugauagaauguggggguaacagcuguaguccuuuaccaagcuucaggauuggucuuuggaaccucucuaugccagaaaaaaagaauuaaguuauuucuuucccuuuuuuuuuuuuuuuaagagauggggucucacuauguugcccaggcugaacucaaacuucugggcuuguaauccucccaccucagccuccugagugucugggauuacaggcaugcagcaccacgccuggaguccaguuuuguguaacuugcauaaagugcgccacauauaacaagccaagguucggaacacaagaauucagacaagaugccuugggaggcaucucgaggucaugaaccagaaaaggauagggagguugacacccaggggcauaguugggggugccuuugucauggagugucacauggcucaagggaguauccuguugcaccuuccuugcagauccuauggggagcugaccccugaagaagggagcucccagugccagccuaaccuuccgucuuuccaucugcccuggucuccaacuuaauacaaacuuaauucucucucgcucauuccccuccugccccuggggucucuuuuuucccaucuauuauggucugagacccugaucuacccagucucccuguaccacauaauaaugagaauaacugguggggucccgagacccacauccuaauuuuggcuugaagccuuugcaggggaaacuguuauuuuaaauguuguuaaugguuuguccaucaugagucaacuuacauagaugaccacagguucccgcaugggaucuugacauuuagaauauucuguuggaaaguggaggcaggaccauagcagagggaugaagucauaggacaaugaaggccuguucucgacuacacaguggccaauuccuguuucugugggagugaccaccagccccaccggcugggagggaguaaguggugaugguauccagcagaaguuuccugagaaacccguggaguguccugauauagccuuguggaccugcuccgugugugugcccucaccuuugugugugugauuuugcauguguaugugugugccugugugagugcacaugugugguggcaugugugcaugugcagauggacauaugugcagcugugcgcacacaagcgugugugacuaagugcauguauguguggcugugugugcacacgugggcaucuguguugggagcaggcccauggugguccuugauaucaccaccuacugauaaccuucccaugauaagaggugacgagcuguuucuguaaucuccugaguacgcguuaaauauucaucaaugagagaagcauuugugccgguugacaucuuugcauuauggcuuugcuccuggauuccuccgaaguuuugguuggcuccuaggaaaaugucucuccugauauauagaucguguagucucucuaaauuauggaaaucagcaugugaaacuguaucaggugggauaacucugugccuuucugcuuaguggcuugaaguacuugaagaaaauaugcuguuuucuuuccuuggagccuuucagaaauguuuuccaaaagugauacaugcuuguuaaaaaaaaaaaaagaaggaaagauaugaaguagagaaugaaaaucacaggugaauccauuccccagggauauucauuaacauucuagugcaaaucuuuccagacccuugaauaaaugucccuuuuaacaaaaauaggaucaugguccacacguugcuguguaaccugccguguucauuuacugaugcaugcuauauaucuucccaugucaauaaguagagaguuguguauuuuuaacaguugccauaguauuuuauauaugaauggggccauacuugacagaacuauuccaguuuuuuacucuuucuaaauaaugcugugagaaauaucuuuguagaucaucuuuggaccucugucugagugcuuccuuaaaagaaacugcaguagaaguugcugcauuggaagucguuguuguuuuuuguuuuguuuuuuugagacgcaguuuugcucuuauugcccaggcuagagugcaguggcucaaucucggcucacugcaaccuccaccuucugguuucaagcgauucuccugccucagccucccaagucgcugggauuacaggugcccaccaccacgcccagcuaauuuuuuuguauuuuuaguggagaugggguuucaccauguuggucaggcuggucucgaacugcugaccucgugauccacuagccucggccucccaaaguguugggauuacaggcgugagccaccgcacccagccugcauuggaaguuuugacauugaaagcuuugauccauguugucguuuucccaguggaaugaaugaucuauugaauucugcucuuuuugugccucccuccucacuggaauuuuccuucaugccuuucauaaggaauguggacuuuuuuucaaacucuagaugcgucuguuacuagaguggagagucuaccuucgucucacaugugccacaaaggauggcauggcccgggagugccccaccacguggcuuucacccccugcaaagccagacuucgcccagcgacacagugucaagcccacagcucuccaaggaggaagaugguccaggcugggagcauccccuuagcagcagccucugguaaguguccuggcccugcaggcugggccugcuuguugggugaugggacggugagcccagagggagcuuugcaagaucaucagagggucaagggaaaaggaaagacagccaggccuuauaguaaccaaggaaggcccaggcccagucuguggcccuuaacugucagaggcccugccuccauuuuuuuuuguuuguuuguuugagacaaugucugguucugugguccaggcuggagugcagaggugcaaucuuggcuuacugcaaccucugccucccagguucaagccauccucccaccucagccucucaaguagcugggacuacagaugcauaccuguaguccuggccaauuucuguauuuuuuguagagaugggguuccgccauguugcccaggcuggucucuaacucaugagcucaguccauccgccuaccucagccucucaaagugcggggauuacaugcaugagucauugcaucugaucaggaggccuuaucuucugaguggacuggggugguggcccaugaacaggauggggaucacgcaauccccugcaacccucuucggcuucgugacacaaaugcaaguuaccucaagagguucucccugaccuuggugaugccgugggcacucacagaagccuccucugugcugcagggaggcugugucuuacucaugcagggugguggaggggcgccucuuagcagaagaugaugaaaggcuguccccucucaggaaggagaagguccuugucuguuccaaggcaaagaacuggacaagaaggaggagguucauucaguacauugagucugauccucccugcuguagcuggagcacggucccugaagcuggcugaagugcuaaagcaggggcuagcaaacuguggccgaaucccaccugcugccuguuuguauaaauaaaguuuuauugggacacaaccaugcccaccauucacuucuauuccagggcugccucuguaccguagcggcagaauggaguagcuaagacacagaccaaauggcccacagaaucccaaauauuugccauccuguccucuauagagaaagugugcugaccccugcccuagagauuuguagugagggggcagcagaaggccuggggcugggguacauucaggagccgagacccucuucacccauaagaagccccugccacaucaucucaccuuuaacucacccagaggaccucaaaucccgggcucgggccuggggaacauaccaggggugguagcauuuuaaaaacauucgguagauguuacuggcccaagagagagccauuuaaauacucauauuuaucaaaagcccagcugcacugccuugacccguggaggauugugaguucuuugugcccgaaaccuuccaguuucaguucugccuugcaugauauugguuaguuucuucucuccccaucccccccgccacacuuuuuucugucagaacaaagaaugcuuuuugcacucuagaucugugguuuguaaggccaaguaauuuuucuaagccccuaacacauuaggagcccuuacagaccauuuugaagagaaagcaccauuugaagcuagagaaaaguuagugacucuuggaaagagaccggaagucucguggaacacaccagccuuccagaggagugugugcucuaagggcuuucuccagccccggggcagcuugacaacaguccacauggauuacaggaggcaggaagccacccaggggcuucuuguugcgcaguggcugcuuuugcguagcuggaagugcuucucgggugggcugcuggcuaagccaggcgccaugcuggguccuugcccgugugaucccaugucccaugucacucccaugcagcucagcggggcucagagguccuguggcugcacaugucacuugguuagugagcaugggagcuggaguuggaacgcaggcagugcuguuggccucuguguguccugcuggucucccacuccccuugcauggucucuugacccuauuacaguagcuuccucaagggaaugacagugaaugcugaaagagcuaaaaggcugcuucugccacucaugcauucaauggccccuucgucccugagugaccaaugggcagcucacccagcaccccaaagccccagucugccuacagcuaugcagcuggggccacacuuugcugugggcugcuaagugcugguuaccuugugacuguuuucauuauuuuaucuaacaaaacaaauaaaccaaaccaaauaauuuuuuuauaauacauuaagggccgggcacaauagcucaugccuguaaucccaauacuuuggaggccaaggugggaagauugcuucagccgaggagcuggagaccacccugggcaacauagcaagaauccucucuccacacacacaaaaaaaauagccaggugugguggcaugcgccugugaucccagcugaggugggaggaucauuugagccugggaggucaaaacuguagugagguacgaucaugccacugcaguccagccugggcagcagagcgagacccaucucaaaaaaauaaaaauguguuaaggcguccacaucacuucuguggagcauuagaaugaaggagagggcuuugcuuuacagcaacuugggccggcuguggggaccacugcagucucugaagugggucagucacucauucacucaugccuucauucauugagagagccucuguaucaggugccuggaucgcugccccucacuggcugccccugccuccccucuugcuaaaagcaccuuucuguucuugucuaaggccccggagggacucgcaucccccuacugugaaaucuaaacugccacauggcucauggggccuccucacgcucuccagacuaauucccgccucaccacgcucuuccuugccucugacccugcuguugucaucugcugcucccucuccaccugccugcccacccccacccagcuuucagaaugcggcccaggcaucgcuuucccaggaagccuuccuuggcaugccgaccacaccaccacuggcugaacuguguccucugggccccuguggcacccuguccucuggggcccagccacccuuggggcuucugcccagaguaucagccuaccucacucuucaaggccugcccgcauacugucuccuccuugcuucccagcacugagucacacccugcacaaugcuugugccagccugcaaugaccucuuuucugugucucccauggacugcaggucccugaagagcuuguguguuuuucaccuuuuuguccuaaguguacugccuggcacaugagaaagcacuaaguaaauauuggaugaaaggauggcugggugcauggauggguggguggguggauggauggauagaugaacagauggauaggauaugguggguggauggauggaugaguggguggauggauggguggauggauggauggauggauggauggacuuauggauggacaggugaguagauggauagaauaguggguggauggauggauggauggauggauggauggaugaguggguggauggaugaguggguggauggauggguggguggauggauggauggauggauagauggguaaguggguaaguggauggauggaugggugaguggauggauggauggacagaugaguagauggauagaauaguggguggauggaugggugggcgggcagguggauggaugaauggguggauugauggaugaaugguuaaguaguaucucccaugugaaaggcacagucaccugucacagggugcacauggggugcauuaggcuugauuuguacucugcagacuaugggggaagcugaggaggaagacuugaccagucuuggugaugagaaggccuucacccuaugaacacaaccaagucuuagcccucucuccugcuccuuuaaacucugaacucuaggaugggagaaugggaacuuuugcagguugagauucauagugaaaucgggucaagaagugaucagaugcaaagcacagggcaguucauuacuauaccauggcugaggucuuccugggcaccaggcccuggucucagcacuuggcucagucugcaccuuggacccugccagagcccuccacagcaggugcucucaggcaaggcuguguguugcuggccagacgccuucugaccagcgugcuuucuugaccacagaucccuuggccaagcaggagggaaccauuagcagccugaggagcuggcuggcugggagccucggggaccgcccagccuugcucccagcucacccacaagauguggacagcucuugugcucauuuggauuuucuccuuguccuuaucugaaagccaugcggcauccaacgauccacguaagugagaaagcugugugacugcuggaugggcccacgguggccacaaagcaugcugagcccuugaaagcagcaucugcaaacccaggccaacgcgucaggaaccgcagcccucccaggugccgcacagggaaggguugucaggccaaccuuccuucuccagggccauggugggcaaagagccccuagcaggaccaggcagcugagcccugaaagguuugcucgcuuggccugcaagauuugaugucaucucuaaauugaaucuucacuggggaauugauuccuucauacaucagaucuuuaacugcguucccacucugugccauucauuuccaagaauuccugcagugaauccuuucacaaagccaagcguucuuuuaugaugugaauaccugugcaguuuaucugcuuuguaaaccugggugugcguucagugggcuuuuaauggugaaucacaccuguugugugagacuuuuacucugauguuuugggaauuggaucaaauagugaaggucugaagccuucaaugggcaggggguucauagagggcaaaggaguuuuaaaaucaaauugacaagggcuuuuucaaugagcugcaugccaacagugggaagagagauggggaggaagcauguucgcacaucaccucccccgacucuggcugggcugaggagggggccccacaggccuggguggaagccgaucccugagcaaucccccugugcaggauugaacaugauugucucucuuuuucuccuuuuucugacuuuaaggcaacuuugucccuaacaaaauguggaagggauuagucaagaggaaugcaucuguggaaacaguugauaauaaaacgucugaggauguaaccauggcagcagcuucuccugucacauugaccaaagggacuucggcagcccaccucaacucuauggaagucacaacagaggacacaagcaggacagaugugagugaaccagcaacuucaggaggugcagcugauggugugaccuccauugcucccacggcuguggccuccaguacgacugcggccuccauuacgacugcggccuccaguaugacuguggccuccagugcucccacgacugcagccuccaguacaacuguggccuccauugcucccacgacugcagccuccaguaugacugcggccuccagcacucccaugacacuugcacuccccgcgcccacguccacuuccacagggcggaccccguccacuaccgccacugggcauccaucucucagcacagcccucgcacaagugccaaagagcagcgcguugccaagaacagcaacccuggccacauuggccacacgugcucagacuguagcgaccacagcaaacacaagcagccccaugagcacucguccaaguccuuccaagcacaugcccagugacaccgcggcaagcccuguacccccuaugcguccccaagcacaaggucccauuagccaggugucaguggaccagccugugguuaacacaacaaauaaauccacacccaugcccucaaacacaaccccagagcccgcccccacccccacaguggugaccaccaccaaggcacaagccagggagccaacugccagcccagugccaguaccucacaccagcccaaucccugagauggaggccaugucccccacgacacagccaagccccaugccauauacccagagggccgcugggccaggcacaucccaggcaccggagcagguagagacugaagccacaccagguacugauuccacugggccaacacccaggagcucagggggcacuaagaugccagccacggacucgugccagcccagcacccaaggccaguacaugguggucaccacugagccccucacccaggccgugguagacaaaacucuccuucugguggugcuguuacucggggugacccuuuucaucacagucuugguuuuguuugcccugcaggccuaugagagcuacaagaagaaggacuacacccagguggacuacuuaaucaacgggauguaugcggacucagaaaugugaggggggcgggggccuggcgggaggccuggccccuuccucguccuuuccuuuugccuuugagaccaaaccaagugcuuccaaauucuuuuggugcaauugaggagauaugccagaugcuuaaacacauuuaauugcugucagauuaauuccaugaucacuaaagaguugcugcuuuuuucauauuuauuuuuguaaaugauucugugcccaggagcagcuggggguuccaccucaggguggggcgggcaggaccccgucuccccaggugucggagccugaccugaauuaaaguacugacugcucgccacaa
